United States Patent
Wu et al.

(10) Patent No.: US 7,750,207 B2
(45) Date of Patent: Jul. 6, 2010

(54) ZEA MAYS RIBULOSE BISPHOSPHATE CARBOXYLASE ACTIVASE PROMOTER

(75) Inventors: Kunsheng Wu, Ballwin, MO (US); Santanu Dasgupta, St. Louis, MO (US); Targolli L Jayaprakash, Karnataka (IN); Shoba Cherian, Karnataka (IN)

(73) Assignee: Monsanto Technology LLC, St. Louis, MO (US)

( * ) Notice: Subject to any disclaimer, the term of this patent is extended or adjusted under 35 U.S.C. 154(b) by 653 days.

(21) Appl. No.: 11/514,704

(22) Filed: Sep. 1, 2006

(65) Prior Publication Data

US 2007/0209085 A1 Sep. 6, 2007
US 2009/0293143 A9 Nov. 26, 2009

Related U.S. Application Data

(60) Provisional application No. 60/816,086, filed on Jun. 23, 2006.

(51) Int. Cl.
*C12N 15/82* (2006.01)
*A01H 5/00* (2006.01)
*A01H 5/10* (2006.01)

(52) U.S. Cl. ............... 800/287; 800/298; 435/468; 536/24.1

(58) Field of Classification Search ............... None
See application file for complete search history.

(56) References Cited

OTHER PUBLICATIONS

GI:19855033 A cDNA from Maize Encoding Ribulose-1,5-Bisphosphate Carboxylase/Oxygenase Activase (Accesion No. AF084478). Plant Physiol. 118 (4), 1535 (1998).*
GI:167094 Rundle,S.J. and Zielinski,R.E. Organization and expression of two tandemly oriented genes encoding ribulosebisphosphate carboxylase/oxygenase activase in barley; J. Biol. Chem. 266 (8), 4677-4685 (1991).*
Benfey et al., "The CaMV 35S enhancer contains at least two domains which can confer different developmental and tissue-specific expression patterns," *EMBO J.*, 8(8):2195-2202, 1989.
Cho et al., "Regulation of root hair initiation and expansin gene expression in *Arabidopsis*," *The Plant Cell*, 14:3237-3253, 2002.
GenBank Accession No. DQ430613, dated Sep. 6, 2006.
GenBank Accession No. M55449, dated Jan. 31, 2003.
Kim et al., "A 20 nucleotide upstream element is essential for the nopaline synthase (nos) promoter activity," *Plant Molecular Biology*, 24:105-117, 1994.
Odell et al., "Identification of DNA sequences required for activity of the cauliflower mosaic virus 35S promoter," *Nature*, 313:810-812, 1985.
Piechulla et al., "Identification of tomato Lhc promoter regions necessary for circadian expression," *Plant Molecular Biology*, 38:655-662, 1998.
Welsch et al., "Structural and functional characterization of the phytoene synthase promoter from *Arabidopsis thaliana*," *Planta*, 216:523-534, 2003.

* cited by examiner

*Primary Examiner*—Russell Kallis
(74) *Attorney, Agent, or Firm*—Erin C. Robert, Esq.; Sonnenschein Nath & Rosenthal LLP

(57) ABSTRACT

The present invention provides gene regulatory element polynucleotide molecules, including a promoter and a leader, identified from the ribulose bisphosphate carboxylase activase (RUA) *Zea mays* gene, useful for expressing transgenes in plants. The invention further discloses compositions, polynucleotide constructs, transformed host cells, transgenic plants and seeds comprising the *Zea mays* gene regulatory molecules, and methods for preparing and using the same.

23 Claims, 4 Drawing Sheets

| STAGES | ORGAN | INDUCER | RANGE | MEAN ± SE |
|---|---|---|---|---|
| Imbibed seed | Embryo | - | nd-nd | nd ± nd |
| Imbibed seed | Endosperm | - | nd-nd | nd ± nd |
| 3 DAG | Root | - | 29.73-108.20 | 68.97 ± 39.24 |
| V3 | Root | - | 61.61-367.00 | 149.86 ± 72.64 |
| V3 | Root | Cold | 1.14-122.15 | 49.74 ± 19.37 |
| V3 | Root | Desiccation | 27.00-151.70 | 82.69 ± 25.75 |
| V7 | Root | - | 18.97-544.89 | 202.01 ± 122.63 |
| VT | Root | - | 4.39-164.90 | 75.68 ± 37.42 |
| 3 DAG | Coleoptile | - | 26.12-50.20 | 34.69 ± 5.51 |
| V3 | Leaf | - | 202.48-4029.36 | 1463.12 ± 735.73 |
| V3 | Leaf | Cold | 81.23-4324.20 | 1160.66 ± 724.93 |
| V3 | Leaf | Desiccation | 161.25-2828.00 | 731.10 ± 524.74 |
| V7 | Leaf | - | 180.98-15483.51 | 4190.32 ± 2588.13 |
| VT | Leaf - Mature | - | 210.40-4640.97 | 1593.18 ± 1040.90 |
| VT | Leaf - Young | - | 63.64-1136.32 | 491.44 ± 185.04 |
| VT | Leaf - Senescence | - | 46.25-2274.91 | 818.04 ± 518.60 |
| VT | Cob | - | 107.99-627.18 | 386.84 ± 88.59 |
| VT | Anther | - | nd-nd | nd ± nd |
| 14 DAP | Embryo | - | 429.35-429.35 | 429.35 ± #DIV/0! |
| 21 DAP | Embryo | - | 10.23-976.66 | 140.89 ± 66.81 |
| 35 DAP | Embryo | - | 16.64-190.78 | 67.38 ± 14.21 |
| 7 DAP | Kernel | - | 279.85-4313.36 | 1874.76 ± 585.75 |
| 14 DAP | Endosperm | - | 82.86-2241.39 | 1512.06 ± 714.65 |
| 21 DAP | Endosperm | - | 49.72-192.11 | 96.79 ± 7.75 |
| 35 DAP | Endosperm | - | 14.75-68.72 | 27.59 ± 10.35 |
| DAG - Days After Germination; DAP - Days After Pollination; Em - Embryo; En - Endosperm; VT - Tasseling stage; IS - Imbibed seed; C - coleoptile; R - Root; L - Leaf; V3 - three leaf stage; V7 - Seven leaf stage; nd - not determined ||||||

| | ■ GUS expression detected | □ No GUS Expression Detected | ■ Not determined |
|---|---|---|---|
| Stage | Inducers | Tissue | Cell Types |
| Imbibed seed | - | Seed | □ pericarp  □ endosperm  □ scutellum  □ embryo    □ nd |
| 3 DAG | - | Root | □ epidermis  □ cortex   □ endoderm  □ stele    □ nd<br>□ root hair  □ root tip |
| V3 | - | Root | □ epidermis  □ cortex   □ endoderm  ■ stele    □ nd<br>□ root hair  □ root tip |
| V3 | Cold | Root | □ epidermis  □ cortex   □ endoderm  □ stele  □ root hair  □ nd |
| V3 | Desiccation | Root | □ epidermis  □ cortex   □ endoderm  □ stele  □ root hair  □ nd |
| V7 | - | Root | □ epidermis  □ cortex   □ endoderm  □ stele  □ root hair  □ nd |
| VT | - | Root | □ epidermis  □ cortex   □ endoderm  □ stele  □ root hair  □ nd |
| 3 DAG | - | Leaf | ■ meristem  □ coleoptiles    □ nd |
| V3 | - | Leaf | □ epidermis  □ guard cells  ■ mesophyll    ■ bundle sheath  □ nd<br>■ vascular bundle |
| V3 | Cold | Leaf | □ epidermis  ■ mesophyll  ■ bundle sheath  □ vascular bundle  □ nd |
| V3 | Desiccation | Leaf | ■ epidermis  ■ mesophyll  ■ bundle sheath  ■ vascular bundle  □ nd |
| V7 | - | Leaf-source | □ epidermis  □ mesophyll  □ bundle sheath  □ vascular bundle  □ nd |
| V7 | - | Leaf-sink | □ epidermis  □ mesophyll  □ bundle sheath  □ vascular bundle  □ nd |
| VT | - | Leaf (source) | □ epidermis  □ mesophyll  □ bundle sheath  □ vascular bundle  □ nd |
| VT | - | Leaf (senescent) | □ epidermis  □ mesophyll  □ bundle sheath  □ vascular bundle  □ nd |
| V7 | - | Node | ■ vascular bundle    □ parenchyma    □ nd |
| VT | - | Node | ■ vascular bundle    ■ parenchyma    □ nd |
| V7 | - | Internode - elongating | □ vascular bundle    □ parenchyma    □ nd |
| VT | - | Internode - elongated | ■ vascular bundle    ■ parenchyma    □ nd |
| V7 | - | Tassel primordia | ■ rachis primordia    ■ floret primordia    □ nd |
| VT | - | Tassel | ■ rachis  ■ glume  ■ lemma and palea    □ nd<br>■ filament  ■ anther  ■ pollen grains |
| V7 | - | Cob primordia | ■ cob primordia    □ nd |
| VT | - | Cob | ■ cob vasculature    ■ pedicel    ■ silk    □ nd<br>■ glume/palea    ■ carpel |
| 7 DAP | - | Kernel | □ pericarp  ■ pedicel  ■ endosperm  □ embryo    □ nd |
| 10 DAP | - | Kernel | □ pericarp  □ pedicel  □ endosperm    ■ nd<br>□ embryo  □ scutellum  □ aleurone |
| 14 DAP | - | Kernel | ■ pericarp  ■ pedicel  ■ endosperm    □ nd<br>■ embryo  □ scutellum  □ aleurone |
| 21 DAP | - | Kernel | ■ pericarp  ■ pedicel  ■ endosperm    □ nd<br>■ embryo  □ scutellum  □ aleurone |
| 28 DAP | - | Kernel | □ pericarp  □ pedicel  □ endosperm    ■ nd<br>□ embryo  □ scutellum  □ aleurone |
| 35 DAP | - | Kernel | □ pericarp  ■ pedicel  □ endosperm    □ nd<br>■ embryo  □ scutellum  □ aleurone |

US 7,750,207 B2

ZEA MAYS RIBULOSE BISPHOSPHATE CARBOXYLASE ACTIVASE PROMOTER

This application is a Continuation-In-Part of U. S. patent application Ser. No. 11/218,305, filed 1 Sep. 2005, which claims priority to U.S. Provisional Patent Application No. 60/606,880, filed 1 Sep. 2004, both of which are incorporated by reference in their entirety herein; this application also claims benefit under 35 U.S.C. §119(e) of U.S. Provisional Application Ser. No. 60/816,086, filed 23 Jun. 2006.

INCORPORATION OF SEQUENCE LISTING

Two copies of the sequence listing (Seq. Listing Copy 1 and Seq. Listing Copy 2) and a computer-readable form of the sequence listing, all on CD-ROMs, each containing the file named Corn2004SNP.ST25.txt which is 65,830 bytes (measured in MS-DOS) and was created on Sep. 1, 2006, all of which are incorporated herein by reference.

FIELD OF THE INVENTION

The present invention relates to the field of plant molecular biology and plant genetic engineering and polynucleotide molecules useful for gene expression in plants. Specifically, the present invention discloses nucleic acid molecules identified from *Zea mays* (corn) comprising gene expression regulatory elements, such as promoters and leaders. The invention further discloses methods of producing and using said regulatory elements.

BACKGROUND

One of the goals of plant genetic engineering is to produce plants with agronomically desirable characteristics or traits. The proper expression of a desirable transgene in a transgenic plant is one way to achieve this goal. Elements having gene regulatory activity, i.e. regulatory elements such as promoters, leaders, enhancers, introns and transcription termination regions, are polynucleotide molecules which play an integral part in the overall expression of genes in living cells. Isolated regulatory elements that function in plants are therefore useful for modifying plant phenotypes through the methods of genetic engineering.

Many regulatory elements are available and are useful for providing good overall gene expression. For example, constitutive promoters such as P-FMV, the promoter from the 35S transcript of the Figwort mosaic virus (U.S. Pat. No. 6,051,753, herein incorporated by reference); P-CaMV 35S, the promoter from the 35S RNA transcript of the Cauliflower mosaic virus (U.S. Pat. No. 5,530,196, herein incorporated by reference); P-Rice Actin 1, the promoter from the actin 1 gene of *Oryza sativa* (U.S. Pat. No. 5,641,876, herein incorporated by reference); and P-NOS, the promoter from the nopaline synthase gene of *Agrobacterium tumefaciens* are known to provide some level of gene expression in most or all of the tissues of a plant during most or all of the plant's lifespan. While previous work has provided a number of regulatory elements useful to affect gene expression in transgenic plants, there is still a great need for novel regulatory elements with beneficial expression characteristics. Many previously identified regulatory elements fail to provide the patterns or levels of expression required to fully realize the benefits of expression of selected genes in transgenic crop plants. One example of this is the need for regulatory elements capable of driving gene expression in different types of tissues. Another example is the need for elements other than promoters to provide alternate mechanisms for the regulation of gene expression.

The genetic enhancement of plants and seeds provides significant benefits to society. For example, plants and seeds may be enhanced to have desirable agricultural, biosynthetic, commercial, chemical, insecticidal, industrial, nutritional, or pharmaceutical properties. Despite the availability of many molecular tools, however, the genetic modification of plants and seeds is often constrained by an insufficient or poorly localized expression of the engineered transgene.

Many intracellular processes may impact overall transgene expression, including transcription, translation, protein assembly and folding, methylation, phosphorylation, transport, and proteolysis. Intervention in one or more of these processes can increase the amount of transgene expression in genetically engineered plants and seeds. For example, raising the steady-state level of mRNA in the cytosol often yields an increased accumulation of transgene expression. Many factors may contribute to increasing the steady-state level of an mRNA in the cytosol, including the rate of transcription, promoter strength and other regulatory features of the promoter, efficiency of mRNA processing, and the overall stability of the mRNA.

It is of immense social, ecological and economic interests to develop plants that have enhanced nutrition, improved resistance to pests, and tolerance to harsh conditions such as drought. Thus, the identification of new genes, regulatory elements (e.g., promoters), etc. that function in various types of plants is useful in developing enhanced varieties of crops. Clearly, there exists a need in the art for new regulatory elements, such as promoters, that are capable of expressing heterologous nucleic acid sequences in important crop species. We found that isolated regulatory elements from corn, particularly the promoter regulatory elements, provide these enhanced expression patterns for an operably linked transgene in a transgenic plant. Promoters that exhibit tissues-specific patterns are of great interest in the development of plants that exhibit agronomically desirable traits.

Regulatory Elements Identified from *Zea mays* Polymorphic Markers

Polymorphisms are useful as genetic markers for genotyping applications in the agriculture field, e.g. in plant genetic studies and commercial breeding. See for instance U.S. Pat. Nos. 5,385,835; 5,437,697; 5,385,835; 5,492,547; 5,746,023; 5,962,764; 5,981,832 and 6,100,030, and U.S. application Ser. No. 09/861,478 (filed May 18, 2001), 09/969,373 (filed Oct. 2, 2001), and 10/389,566 (filed Mar. 14, 2003), the disclosures of all of which are incorporated herein by reference. The highly conserved nature of DNA combined with the rare occurrences of stable polymorphisms provides genetic markers, which are both predictable and discerning of different genotypes. Among the classes of existing genetic markers are a variety of polymorphisms indicating genetic variation including restriction-fragment-length polymorphisms (RFLPs), amplified fragment-length polymorphisms (AFLPs), simple sequence repeats (SSRs), single nucleotide polymorphisms (SNPs) and insertion/deletion polymorphisms (Indels). Because the number of genetic markers for a plant species is limited, the discovery of additional genetic markers will facilitate genotyping applications including marker-trait association studies, gene mapping, gene discovery, marker-assisted selection and marker-assisted breeding. Evolving technologies make certain genetic markers more amenable for rapid, large scale use. For instance, technologies for SNP detection indicate that SNPs may be preferred genetic markers.

Gene expression regulatory molecules may also be identified from such polymorphic marker sequences. Experimental testing of such sequences may reveal tissue specific gene regulatory activity.

SUMMARY

The present invention provides promoter and leader polynucleotide molecules identified from genetic markers from corn genomic DNA. In particular, the molecules of the present invention provide gene regulatory activity for leaf tissues, more specifically leaf bundle sheath cells.

The present invention includes and provides a polynucleotide molecule, or a polynucleotide construct useful for modulating gene expression in plant cells, or a transgenic plant cell, or a transgenic plant, or a fertile transgenic plant, or a seed of a fertile transgenic plant, comprising a nucleic acid sequence wherein said sequence exhibits an 80%, an 85%, a 90% or even greater identity to a sequence elected from the group consisting of SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof.

The present invention includes and provides a method of transforming a host cell comprising: a) providing a nucleic acid molecule that comprises in the 5' to 3' direction: a nucleic acid sequence that exhibits an 80%, an 85%, a 90% or even greater identity to a sequences elected from the group consisting SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof; operably linked to a transcribable polynucleotide molecule sequence; and b) transforming said plant with the nucleic acid molecule.

In one embodiment, the invention provides regulatory elements isolated from corn and useful for modulating gene expression in transgenic plants In another embodiment, the invention provides DNA constructs containing polynucleotide molecules useful for modulating gene expression in plants. In another embodiment, the invention provides transgenic plants and seeds containing the DNA constructs, comprising a promoter and regulatory elements operably linked to a heterologous DNA molecule, useful for modulating gene expression in plants. The transgenic plant expresses an agronomically desirable phenotype.

BRIEF DESCRIPTION OF THE DRAWINGS

FIG. 2B: A table that shows the activity of *Zea mays* RUA promoter and leader regulatory elements using quantative GUS analysis in the indicated stage and tissue type.

FIG. 3: A chart that shows the activity of *Zea mays* RUA promoter and leader regulatory elements using quantative GUS analysis in the indicated stage and tissue type.

DETAILED DESCRIPTION OF THE INVENTION

Figure 1:
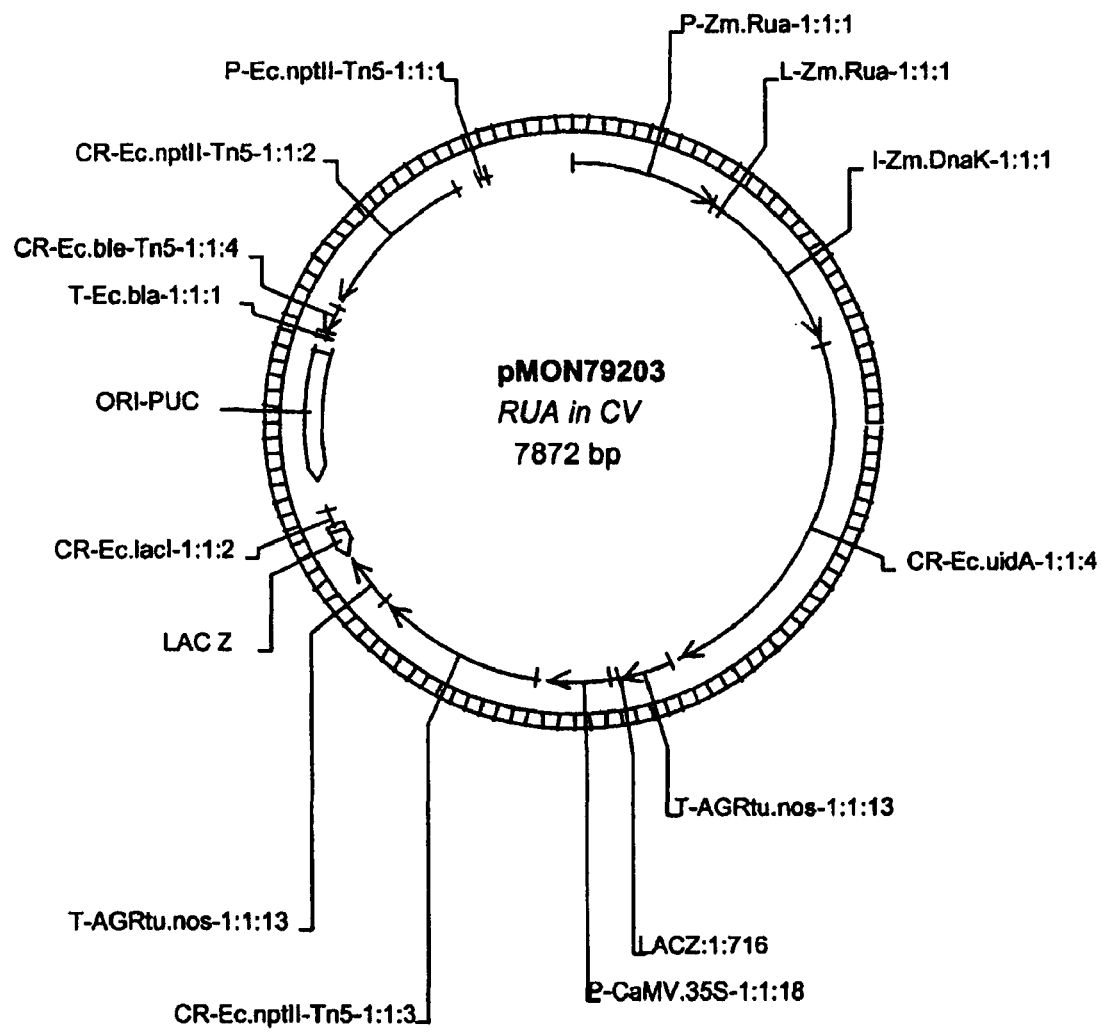
FIG. 1: pMON79203

The invention disclosed herein provides a polynucleotide molecule having gene regulatory activity from *Zea mays* (corn). The design, construction, and use of these polynucleotide molecules are one object of this invention. The polynucleotide sequences of these polynucleotide molecules are provided as SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof. This polynucleotide molecule is capable of affecting the expression of an operably linked transcribable polynucleotide molecule in plant tissues and therefore can selectively regulate gene expression in transgenic plants. The present invention also provides methods of modifying, producing, and using the same. The invention also includes compositions, transformed host cells, transgenic plants, and seeds containing the promoters, and methods for preparing and using the same.

Polynucleotide Sequences

Many types of regulatory sequences control gene expression. Not all genes are turned on at all times during the life cycle of a plant. Different genes are required for the completion of different steps in the developmental and sexual maturation of the plant. Two general types of control can be described: temporal regulation, in which a gene is only expressed at a specific time in development (for example, during flowering), and spatial regulation, in which a gene is only expressed in a specific location in the plant (for example, seed storage proteins). Many genes, however, may fall into both classes. For example, seed storage proteins are only expressed in the seed, but they also are only expressed during a short period of time during the development of the seed. Furthermore, because the binding of RNA Polymerase II to the promoter is the key step in gene expression, it follows that sequences may exist in the promoter that control temporal and spatial gene expression.

The following definitions and methods are provided to better define the present invention and to guide those of ordinary skill in the art in the practice of the present invention. Unless otherwise noted, terms are to be understood according to conventional usage by those of ordinary skill in the relevant art.

The phrases "coding sequence," "structural sequence," and "transcribable polynucleotide sequence" refer to a physical structure comprising an orderly arrangement of nucleic acids. The nucleic acids are arranged in a series of nucleic acid triplets that each form a codon. Each codon encodes for a specific amino acid. Thus the coding sequence, structural sequence, and transcribable polynucleotide sequence encode a series of amino acids forming a protein, polypeptide, or peptide sequence. The coding sequence, structural sequence, and transcribable polynucleotide sequence may be contained, without limitation, within a larger nucleic acid molecule, vector, etc. In addition, the orderly arrangement of nucleic acids in these sequences may be depicted, without limitation, in the form of a sequence listing, figure, table, electronic medium, etc.

As used herein, the term "polynucleotide molecule" refers to the single- or double-stranded DNA or RNA molecule of genomic or synthetic origin, i.e., a polymer of deoxyribonucleotide or ribonucleotide bases, respectively, read from the 5' (upstream) end to the 3' (downstream) end.

As used herein, the term "polynucleotide sequence" refers to the sequence of a polynucleotide molecule. The nomenclature for nucleotide bases as set forth at 37 CFR §1.822 is used herein.

As used herein, the term "regulatory element" refers to a polynucleotide molecule having gene regulatory activity, i.e. one that has the ability to affect the transcription or translation of an operably linked transcribable polynucleotide molecule.

Regulatory elements such as promoters, leaders, introns, and transcription termination regions are polynucleotide molecules having gene regulatory activity which play an integral part in the overall expression of genes in living cells. Isolated regulatory elements that function in plants are therefore useful for modifying plant phenotypes through the methods of genetic engineering. By "regulatory element" it is intended a series of nucleotides that determines if, when, and at what level a particular gene is expressed. The regulatory DNA sequences specifically interact with regulatory proteins or other proteins.

As used herein, the term "operably linked" refers to a first polynucleotide molecule, such as a promoter, connected with a second transcribable polynucleotide molecule, such as a gene of interest, where the polynucleotide molecules are so arranged that the first polynucleotide molecule affects the function of the second polynucleotide molecule. The two polynucleotide molecules may be part of a single contiguous polynucleotide molecule and may be adjacent. For example, a promoter is operably linked to a gene of interest if the promoter modulates transcription of the gene of interest in a cell.

As used herein, the term "gene regulatory activity" refers to a polynucleotide molecule capable of affecting transcription or translation of an operably linked polynucleotide molecule. An isolated polynucleotide molecule having gene regulatory activity may provide temporal or spatial expression or modulate levels and rates of expression of the operably linked polynucleotide molecule. An isolated polynucleotide molecule having gene regulatory activity may comprise a promoter, intron, leader, or 3' transcriptional termination region.

As used herein, the term "gene expression" or "expression" refers to the transcription of a DNA molecule into a transcribed RNA molecule. Gene expression may be described as related to temporal, spatial, developmental, or morphological qualities as well as quantitative or qualitative indications. The transcribed RNA molecule may be translated to produce a protein molecule or may provide an antisense or other regulatory RNA molecule.

As used herein, an "expression pattern" is any pattern of differential gene expression. In a preferred embodiment, an expression pattern is selected from the group consisting of tissue, temporal, spatial, developmental, stress, environmental, physiological, pathological, cell cycle, and chemically responsive expression patterns.

As used herein, an "enhanced expression pattern" is any expression pattern for which an operably linked nucleic acid sequence is expressed at a level greater than 0.01%; preferably in a range of about 0.5% to about 20% (w/w) of the total cellular RNA or protein.

As used herein, the term "operably linked" refers to a first polynucleotide molecule, such as a promoter, connected with a second transcribable polynucleotide molecule, such as a gene of interest, where the polynucleotide molecules are so arranged that the first polynucleotide molecule affects the function of the second polynucleotide molecule. The two polynucleotide molecules may or may not be part of a single contiguous polynucleotide molecule and may or may not be adjacent. For example, a promoter is operably linked to a gene of interest if the promoter regulates or mediates transcription of the gene of interest in a cell.

As used herein, the term "transcribable polynucleotide molecule" refers to any polynucleotide molecule capable of being transcribed into a RNA molecule, including but not limited to protein coding sequences (e.g. transgenes) and sequences (e.g. a molecule useful for gene suppression).

The present invention includes a polynucleotide molecule having a nucleic acid sequence that hybridizes to SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof. The present invention also provides a nucleic acid molecule comprising a nucleic acid sequence selected from the group consisting of SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof.

The polynucleotide molecules of the present invention were all isolated or identified from *Zea mays* (corn), or derived from combinations of such molecules, and are described in Table 1 below.

TABLE 1

Sequence Annotations for Polynucleotide Molecules Identified from *Zea mays*

| SEQ ID | Element | nucleotides from-to | length (nt) | Description | Construct pMON ID |
|---|---|---|---|---|---|
| 17666 | Reg Elements of Zm.RUA-1:1:1 | 1-4755 | 4755 | | |
| 17666 | P-Zm.RUA-1:1:1 | 1553-2280 | 728 | Promoter | 79203 |
| 17666 | L-Zm.RUA-1:1:1 | 2281-2325 | 45 | Leader | 79203 |

Determination of Sequence Similarity Using Hybridization Techniques

Nucleic acid hybridization is a technique well known to those of skill in the art of DNA manipulation. The hybridization properties of a given pair of nucleic acids are an indication of their similarity or identity.

The term "hybridization" refers generally to the ability of nucleic acid molecules to join via complementary base strand pairing. Such hybridization may occur when nucleic acid molecules are contacted under appropriate conditions. "Specifically hybridizes" refers to the ability of two nucleic acid molecules to form an anti-parallel, double-stranded nucleic acid structure. A nucleic acid molecule is said to be the "complement" of another nucleic acid molecule if they exhibit "complete complementarity," i.e., each nucleotide in one sequence is complementary to its base pairing partner nucleotide in another sequence. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Nucleic acid molecules that hybridize to other nucleic acid molecules, e.g., at least under low stringency conditions are said to be "hybridizable cognates" of the other nucleic acid molecules. Conventional low stringency and high stringency conditions are described herein and by Sambrook et al., Molecular Cloning, A Laboratory Manual, 2nd Ed., Cold Spring Harbor Press, Cold Spring Harbor, N.Y. (1989) and by Haymes et al., Nucleic Acid Hybridization, A Practical Approach, IRL Press, Washington, D.C. (1985). Departures from complete complementarity are permissible, as long as such departures do not completely preclude the capacity of the molecules to form a double-stranded structure.

Low stringency conditions may be used to select nucleic acid sequences with lower sequence identities to a target nucleic acid sequence. One may wish to employ conditions such as about 0.15 M to about 0.9 M sodium chloride, at temperatures ranging from about 20° C. to about 55° C. High stringency conditions may be used to select for nucleic acid sequences with higher degrees of identity to the disclosed nucleic acid sequences (Sambrook et al., 1989). High stringency conditions typically involve nucleic acid hybridization in about 2× to about 10×SSC (diluted from a 20×SSC stock solution containing 3 M sodium chloride and 0.3 M sodium citrate, pH 7.0 in distilled water), about 2.5× to about 5× Denhardt's solution (diluted from a 50× stock solution containing 1% (w/v) bovine serum albumin, 1% (w/v) ficoll, and 1% (w/v) polyvinylpyrrolidone in distilled water), about 10 mg/mL to about 100 mg/mL fish sperm DNA, and about 0.02% (w/v) to about 0.1% (w/v) SDS, with an incubation at about 50° C. to about 70° C. for several hours to overnight. High stringency conditions are preferably provided by 6×SSC, 5× Denhardt's solution, 100 mg/mL fish sperm DNA, and 0.1% (w/v) SDS, with an incubation at 55° C. for several hours. Hybridization is generally followed by several wash steps. The wash compositions generally comprise 0.5× to about 10×SSC, and 0.01% (w/v) to about 0.5% (w/v) SDS with a 15 minute incubation at about 20° C. to about 70° C. Preferably, the nucleic acid segments remain hybridized after washing at least one time in 0.1×SSC at 65° C.

A nucleic acid molecule preferably comprises a nucleic acid sequence that hybridizes, under low or high stringency conditions, with SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof. A nucleic acid molecule most preferably comprises a nucleic acid sequence that hybridizes under high stringency conditions with SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof.

Analysis of Sequence Similarity Using Identity Scoring

As used herein "sequence identity" refers to the extent to which two optimally aligned polynucleotide or peptide sequences are invariant throughout a window of alignment of components, e.g., nucleotides or amino acids. An "identity fraction" for aligned segments of a test sequence and a reference sequence is the number of identical components which are shared by the two aligned sequences divided by the total number of components in reference sequence segment, i.e., the entire reference sequence or a smaller defined part of the reference sequence.

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned (with appropriate nucleotide insertions, deletions, or gaps totaling less than 20 percent of the reference sequence over the window of comparison). Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and preferably by computerized implementations of these algorithms such as GAP, BESTFIT, FASTA, and TFASTA available as part of the GCG® Wisconsin Package® (Accelrys Inc., Burlington, Mass.). An "identity fraction" for aligned segments of a test sequence and a reference sequence is the number of identical components which are shared by the two aligned sequences divided by the total number of components in the reference sequence segment, i.e., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

The percent of sequence identity is preferably determined using the "Best Fit" or "Gap" program of the Sequence Analysis Software Package™ (Version 10; Genetics Computer Group, Inc., Madison, Wis.). "Gap" utilizes the algorithm of Needleman and Wunsch (Needleman and Wunsch, *Journal of Molecular Biology* 48:443-453, 1970) to find the alignment of two sequences that maximizes the number of matches and minimizes the number of gaps. "BestFit" performs an optimal alignment of the best segment of similarity between two sequences and inserts gaps to maximize the number of matches using the local homology algorithm of Smith and Waterman (Smith and Waterman, *Advances in Applied Mathematics*, 2:482-489, 1981, Smith et al., *Nucleic Acids Research* 11:2205-2220, 1983). The percent identity is most preferably determined using the "Best Fit" program.

Useful methods for determining sequence identity are also disclosed in Guide to Huge Computers, Martin J. Bishop, ed., Academic Press, San Diego, 1994, and Carillo, H., and Lipton, D., *Applied Math* (1988) 48:1073. More particularly, preferred computer programs for determining sequence identity include the Basic Local Alignment Search Tool (BLAST) programs which are publicly available from National Center Biotechnology Information (NCBI) at the National Library of Medicine, National Institute of Health, Bethesda, Md. 20894; see BLAST Manual, Altschul et al., NCBI, NLM, NIH; Altschul et al., *J. Mol. Biol.* 215:403-410 (1990); version 2.0 or higher of BLAST programs allows the introduction of gaps (deletions and insertions) into alignments; for peptide sequence BLASTX can be used to determine sequence identity; and, for polynucleotide sequence BLASTN can be used to determine sequence identity.

As used herein, the term "substantial percent sequence identity" refers to a percent sequence identity of at least about 70% sequence identity, at least about 80% sequence identity, at least about 85% identity, at least about 90% sequence identity, or even greater sequence identity, such as about 98% or about 99% sequence identity. Thus, one embodiment of the invention is a polynucleotide molecule that has at least about 70% sequence identity, at least about 80% sequence identity, at least about 85% identity, at least about 90% sequence identity, or even greater sequence identity, such as about 98% or about 99% sequence identity with a polynucleotide sequence described herein. Polynucleotide molecules that are capable of regulating transcription of operably linked transcribable polynucleotide molecules and have a substantial percent sequence identity to the polynucleotide sequences of the polynucleotide molecules provided herein are encompassed within the scope of this invention.

"Homology" refers to the level of similarity between two or more nucleic acid or amino acid sequences in terms of percent of positional identity (i.e., sequence similarity or identity). Homology also refers to the concept of similar functional properties among different nucleic acids or proteins.

In an alternative embodiment, the nucleic acid molecule comprises a nucleic acid sequence that exhibits 70% or greater identity, and more preferably at least 80 or greater, 85 or greater, 87 or greater, 88 or greater, 89 or greater, 90 or greater, 91 or greater, 92 or greater, 93 or greater, 94 or greater, 95 or greater, 96 or greater, 97 or greater, 98 or greater, or 99% or greater identity to a nucleic acid molecule selected from the group consisting of SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof. The nucleic acid molecule preferably comprises a nucleic acid sequence that exhibits a 75% or greater sequence identity with a polynucleotide selected from the group consisting of SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof. The nucleic acid molecule more preferably comprises a nucleic acid sequence that exhibits an 80% or greater sequence identity with a polynucleotide selected from the group consisting of SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof. The nucleic acid molecule most preferably comprises a nucleic acid sequence that exhibits an 85% or greater sequence identity with a polynucleotide selected from the group consisting of SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof.

For purposes of this invention "percent identity" may also be determined using BLASTX version 2.0 for translated nucleotide sequences and BLASTN version 2.0 for polynucleotide sequences. In a preferred embodiment of the present invention, the presently disclosed corn genomic promoter sequences comprise nucleic acid molecules or fragments having a BLAST score of more than 200, preferably a BLAST score of more than 300, and even more preferably a BLAST score of more than 400 with their respective homologues.

Polynucleotide Molecules, Motifs, Fragments, Chimeric Molecules

Nucleic acid molecules of the present invention include nucleic acid sequences that are between about 0.01 Kb and about 50 Kb, more preferably between about 0.1 Kb and about 25 Kb, even more preferably between about 1 Kb and about 10 Kb, and most preferably between about 3 Kb and about 10 Kb, about 3 Kb and about 7 Kb, about 4 Kb and about 6 Kb, about 2 Kb and about 4 Kb, about 2 Kb and about 5 Kb, about 1 Kb and about 5 Kb, about 1 Kb and about 3 Kb, or about 1 Kb and about 2 Kb.

As used herein, the term "fragment" or "fragment thereof" refers to a finite polynucleotide sequence length that comprises at least 25, at least 50, at least 75, at least 85, or at least 95 contiguous nucleotide bases wherein its complete sequence in entirety is identical to a contiguous component of the referenced polynucleotide molecule. Specifically, as used with respect to the present invention, the term "fragment" particularly refers to nucleotides 1553-2280 of SEQ ID NO: 17666 or to nucleotides 2281 through 2325 of SEQ ID NO: 17666. More specifically, the term "fragment" refers to a finite polynucleotide sequence length that comprises at least 25, at least 45, at least 50, at least 75, at least 85, or at least 95 contiguous nucleotide bases wherein its complete sequence in entirety is identical to a contiguous component of SEQ ID NO: 17666. Even more specifically the term "fragment" refers to any subset of nucleotides 1553-2280 of SEQ ID NO: 17666 which provides promoter activity or to any subset of nucleotides 2281 through 2325 of SEQ ID NO: 17666 which provides leader activity.

As used herein, the term "chimeric" refers to the product of the fusion of portions of two or more different polynucleotide molecules. As used herein, the term "chimeric" refers to a gene expression element produced through the manipulation of known elements or other polynucleotide molecules. Novel chimeric regulatory elements can be designed or engineered by a number of methods. In one embodiment of the present invention, a chimeric promoter may be produced by fusing an enhancer domain from a first promoter to a second promoter. The resultant chimeric promoter may have novel expression properties relative to the first or second promoters. Novel chimeric promoters can be constructed such that the enhancer domain from a first promoter is fused at the 5' end, at the 3' end, or at any position internal to the second promoter. The location of the enhancer domain fusion relative to the second promoter may cause the resultant chimeric promoter to have novel expression properties relative to a fusion made at a different location.

In another embodiment of the present invention, chimeric molecules may combine enhancer domains that can confer or modulate gene expression from one or more promoters, by fusing a heterologous enhancer domain from a first promoter to a second promoter with its own partial or complete regulatory elements. Examples of suitable enhancer domains to be used in the practice of the present invention include, but are not limited to the enhancer domains from promoters such as P-FMV, the promoter from the 35S transcript of the Figwort mosaic virus (described in U.S. Pat. No. 6,051,753, which is incorporated herein by reference) and P-CaMV 35S, the promoter from the 35S RNA transcript of the Cauliflower mosaic virus (described in U.S. Pat. Nos. 5,530,196, 5,424,200, and 5,164,316, all of which are incorporated herein by reference). Construction of chimeric promoters using enhancer domains is described in, for example, U.S. Pat. No. 6,660,911, which is incorporated herein by reference. Thus, the design, construction, and use of chimeric expression elements according to the methods disclosed herein for modulating the expression of operably linked transcribable polynucleotide molecules are encompassed by the present invention.

The invention disclosed herein provides polynucleotide molecules comprising regulatory element fragments that may be used in constructing novel chimeric regulatory elements. Novel combinations comprising fragments of these polynucleotide molecules and at least one other regulatory element or fragment can be constructed and tested in plants and are considered to be within the scope of this invention. Thus, the design, construction, and use of chimeric regulatory elements is one object of this invention.

Regulatory Elements

Gene expression is finely regulated at both the transcriptional and post-transcriptional levels. A spectrum of control regions regulate transcription by RNA polymerase II. Enhancers that can stimulate transcription from a promoter tens of thousands of base pairs away (e.g., the SV40 enhancer) are an example of long-range effectors, whereas more proximal elements include promoters and introns. Transcription initiates at the cap site encoding the first nucleotide of the first exon of an mRNA. For many genes, especially those encoding abundantly expressed proteins, a TATA box located 25-30 base pairs upstream form the cap site directs RNA polymerase II to the start site. Promoter-proximal elements roughly within the first 200 base pairs upsteam of the cap site stimulate transcription.

Features of the untranslated regions of mRNAs that control translation, degradation and localization include stem-loop structures, upstream initiation codons and open reading frames, internal ribosome entry sites and various cis-acting elements that are bound by RNA-binding proteins.

The present invention provides the composition and utility of molecules comprising regulatory element sequences identified from *Zea mays*. These regulatory element sequences may comprise promoters, cis-elements, enhancers, terminators, or introns. Regulatory elements may be isolated or identified from UnTranslated Regions (UTRs) from a particular polynucleotide sequence. Any of the regulatory elements described herein may be present in a chimeric or hybrid regulatory expression element. Any of the regulatory elements described herein may be present in a recombinant construct of the present invention.

One skilled in the art would know various promoters, introns, enhancers, transit peptides, targeting signal sequences, 5' and 3' untranslated regions (UTRs), as well as other molecules involved in the regulation of gene expression that are useful in the design of effective plant expression vectors, such as those disclosed, for example, in U.S. Patent Application Publication 2003/01403641 (herein incorporated by reference).

UTRs

UTRs are known to play crucial roles in the post-transcriptional regulation of gene expression, including modulation of the transport of mRNAs out of the nucleus and of translation efficiency, subcellular localization and stability. Regulation by UTRs is mediated in several ways. Nucleotide patterns or motifs located in 5' UTRs and 3' UTRs can interact with specific RNA-binding proteins. Unlike DNA-mediated regulatory signals, however, whose activity is essentially mediated by their primary structure, the biological activity of regulatory motifs at the RNA level relies on a combination of primary and secondary structure. Interactions between sequence elements located in the UTRs and specific complementary RNAs have also been shown to play key regulatory roles. Finally, there are examples of repetitive elements that are important for regulation at the RNA level, affecting translation efficiency.

For example, non-translated 5' leader polynucleotide molecules derived from heat shock protein genes have been demonstrated to enhance gene expression in plants (see for example, U.S. Pat. No. 5,659,122 and U.S. Pat. No. 5,362,865, all of which are incorporated herein by reference).

Cis-Acting Elements

Many regulatory elements act in cis ("cis elements") and are believed to affect DNA topology, producing local conformations that selectively allow or restrict access of RNA polymerase to the DNA template or that facilitate selective opening of the double helix at the site of transcriptional initiation. Cis elements occur within the 5' UTR associated with a particular coding sequence, and are often found within promoters and promoter modulating sequences (inducible elements). Cis elements can be identified using known cis elements as a target sequence or target motif in the BLAST programs of the present invention. Examples of cis-acting elements in the 5'UTR associated with a polynucleotide coding sequence include, but are not limited to, promoters and enhancers.

Promoters

Among the gene expression regulatory elements, the promoter plays a central role. Along the promoter, the transcription machinery is assembled and transcription is initiated. This early step is often rate-limiting relative to subsequent stages of protein production. Transcription initiation at the promoter may be regulated in several ways. For example, a promoter may be induced by the presence of a particular compound or external stimuli, express a gene only in a specific tissue, express a gene during a specific stage of development, or constitutively express a gene. Thus, transcription of a transgene may be regulated by operably linking the coding sequence to promoters with different regulatory characteristics. Accordingly, regulatory elements such as promoters, play a pivotal role in enhancing the agronomic, pharmaceutical or nutritional value of crops.

As used herein, the term "promoter" refers to a polynucleotide molecule that is involved in recognition and binding of RNA polymerase II and other proteins such as transcription factors (trans-acting protein factors that regulate transcription) to initiate transcription of an operably linked gene. A promoter may be isolated from the 5' untranslated region (5' UTR) of a genomic copy of a gene. Alternately, promoters may be synthetically produced or manipulated DNA elements. Promoters may be defined by their temporal, spatial, or developmental expression pattern. A promoter can be used as a regulatory element for modulating expression of an operably linked transcribable polynucleotide molecule. Promoters may themselves contain sub-elements such as cis-elements or enhancer domains that effect the transcription of operably linked genes. A "plant promoter" is a native or non-native promoter that is functional in plant cells. A plant promoter can be used as a 5' regulatory element for modulating expression of an operably linked gene or genes. Plant promoters may be defined by their temporal, spatial, or developmental expression pattern.

Any of the nucleic acid molecules described herein may comprise nucleic acid sequences comprising promoters. Promoters of the present invention can include between about 300 bp upstream and about 10 kb upstream of the trinucleotide ATG sequence at the start site of a protein coding region. Promoters of the present invention can preferably include between about 300 bp upstream and about 5 kb upstream of the trinucleotide ATG sequence at the start site of a protein coding region. Promoters of the present invention can more preferably include between about 300 bp upstream and about 2 kb upstream of the trinucleotide ATG sequence at the start site of a protein coding region. Promoters of the present invention can include between about 300 bp upstream and about 1 kb upstream of the trinucleotide ATG sequence at the start site of a protein coding region. While in many circumstances a 300 bp promoter may be sufficient for expression, additional sequences may act to further regulate expression, for example, in response to biochemical, developmental or environmental signals.

The promoter of the present invention preferably transcribes a heterologous transcribable polynucleotide sequence at a high level in a plant. More preferably, the promoter hybridizes to a nucleic acid sequence selected from the group consisting of SEQ ID NO: 17666, or nucleotides 1553 through 2280 of SEQ ID NO: 17666; or any complement thereof, or any fragment thereof, or any cis element thereof. Suitable hybridization conditions include those described above. A nucleic acid sequence of the promoter preferably hybridizes, under low or high stringency conditions, with SEQ ID NO: 17666, or nucleotides 1553 through 2280 of SEQ ID NO: 17666; or any complement thereof, or any fragment thereof, or any cis element thereof. The promoter most preferably hybridizes under high stringency conditions to a nucleic acid sequence selected from the group consisting SEQ ID NO: 17666, or nucleotides 1553 through 2280 of SEQ ID NO: 17666; or any complement thereof, or any fragment thereof, or any cis element thereof.

In an alternative embodiment, the promoter comprises a nucleic acid sequence that exhibits 85% or greater identity, and more preferably at least 86 or greater, 87 or greater, 88 or greater, 89 or greater, 90 or greater, 91 or greater, 92 or greater, 93 or greater, 94 or greater, 95 or greater, 96 or greater, 97 or greater, 98 or greater, or 99% or greater identity to a nucleic acid sequence selected from the group consisting of SEQ ID NO: 17666, or nucleotides 1553 through 2280 of SEQ ID NO: 17666; or any complement thereof, or any fragment thereof, or any cis element thereof. The promoter most preferably comprises a nucleic acid sequence selected from the group consisting of SEQ ID NO: 17666, or nucleotides 1553 through 2280 of SEQ ID NO: 17666; or any complement thereof, or any fragment thereof, or any cis element thereof.

A promoter comprises promoter fragments that have promoter activity. Promoter fragments may comprise other regulatory elements such as enhancer domains, and may further be useful for constructing chimeric molecules. Fragments of SEQ ID NO: 17666 comprise at least about 25, 50, 95, 150, 250, 400, 600, 700, or 728 contiguous nucleotides of the polynucleotide sequence of SEQ ID NO: 1, up to the full sequence length of SEQ ID NO: 17666. With respect to the molecules of the present invention, the term "fragment" particularly refers to nucleotides 1553-2280 of SEQ ID NO: 17666. More specifically, the term "fragment" refers to a finite polynucleotide sequence length that comprises at least 25, at least 50, at least 75, at least 85, or at least 95 contiguous nucleotide bases wherein its complete sequence in entirety is identical to a contiguous component of the SEQ ID NO: 17666. Even more specifically the terms "promoter" refers to any subset of nucleotides 1553-2280 of SEQ ID NO: 17666 which provides promoter activity.

At least two types of information are useful in predicting promoter regions within a genomic DNA sequence. First, promoters may be identified on the basis of their sequence "content," such as transcription factor binding sites and various known promoter motifs. (Stormo, Genome Research 10: 394-397 (2000)). Such signals may be identified by computer programs that identify sites associated with promoters, such as TATA boxes and transcription factor (TF) binding sites. Second, promoters may be identified on the basis of their "location," i.e. their proximity to a known or suspected coding sequence. (Stormo, Genome Research 10: 394-397 (2000)). Promoters are typically found within a region of DNA extending approximately 150-1500 basepairs in the 5' direction from the start codon of a coding sequence. Thus, promoter regions may be identified by locating the start codon of a coding sequence, and moving beyond the start codon in the 5' direction to locate the promoter region.

Promoter sequence may be analyzed for the presence of common promoter sequence characteristics, such as a TATA-box and other known transcription factor binding site motifs. These motifs are not always found in every known promoter, nor are they necessary for promoter function, but when present, do indicate that a segment of DNA is a promoter sequence.

For identification of the TATA-box, the putative promoter sequences immediately upstream of the coding start site of the predicted genes within a given sequence size range, as described above, are used. The transcription start site and TATA-box (if present) may be predicted with program TSSP. TSSP is designed for predicting PolII promoter regions in plants, and is based on the discriminate analysis combing characteristics of functional elements of regulatory sequence with the regulatory motifs from Softberry Inc.'s plant RegSite database (Solovyev V. V. (2001) *Statistical approaches in Eukaryotic gene prediction*. In: Handbook of Statistical genetics (eds. Balding D. et al.), John Wiley & Sons, Ltd., p. 83-127). In the cases that multiple TATA-boxes are predicted, only the rightmost (closest to the 5' end) TATA-box is kept. The transcription start sites (TSS) are refined and extended upstream, based on the matches to the database sequences. Promoter sequences with unique TATA-box, as well the TATA-box locations, may be identified within the promoter sequences.

For identification of other known transcription factor binding motifs (such as a GC-box, CAAT-box, etc.), the promoter sequences immediately upstream of the coding start site of the predicted genes within a given sequence size range, as described above, are used. The known transcription factor binding motifs (except TATA-box) on the promoter sequences are predicted with a proprietary program PromoterScan. The identification of such motifs provide important information about the candidate promoter. For example, some motifs are associated with informative annotations such as (but not limited to) "light inducible binding site" or "stress inducible binding motif" and can be used to select with confidence a promoter that is able to confer light inducibility or stress inducibility to an operably-linked transgene, respectively.

Putative promoter sequences are also searched with matcorns for the GC box (factor name: V_GC_01) and CCAAT box (factor name: F_HAP234_01). The matcorns for the GC box and the CCAAT box are from Transfac. The algorithm that is used to annotate promoters searches for matches to both sequence motifs and matrix motifs. First, individual matches are found. For sequence motifs, a maximum number of mismatches are allowed. If the code M,R,W,S,Y, or K are listed in the sequence motif (each of which is a degenerate code for 2 nucleotides) ½ mismatch is allowed. If the code B, D, H, or V is listed in the sequence motif (each of which is a degenerate code for 3 nucleotides) ⅓ mismatch is allowed. Appropriate p values may be determined by simulation by generation of a 5 Mb length of random DNA with the same dinucleotide frequency as the test set, and from this test set the probability of a given matrix score was determined (number of hits/5e7). Once the individual hits are found, the putative promoter sequence is searched for clusters of hits in a 250 bp window. The score for a cluster is found by summing the negative natural log of the p value for each individual hit. Using simulations with 100 Mb lengths, the probability of a window having a cluster score greater than or equal to the given value is determined. Clusters with a p value more significant than p<1e-6 are reported. Effects of repetitive elements are screened. For matrix motifs, a p value cutoff is used on a matrix score. The matrix score is determined by adding the path of a given DNA sequence through a matrix. Appropriate p values are determined by simulation: 5 Mb lengths of random DNA with the same dinucleotide frequency as a test set are generated to test individual matrix hits, and 100 Mb lengths are used to test clusters. The probability of a given matrix score and the probability scores for clusters are determined, as are the sequence motifs. The usual cutoff for matcorns is 2.5e-4. No clustering was done for the GC box or CAAT box.

Examples of promoters include: those described in U.S. Pat. No. 6,437,217 (maize RS81 promoter), U.S. Pat. No.

5,641,876 (rice actin promoter), U.S. Pat. No. 6,426,446 (maize RS324 promoter), U.S. Pat. No. 6,429,362 (maize PR-1 promoter), U.S. Pat. No. 6,232,526 (maize A3 promoter), U.S. Pat. No. 6,177,611 (constitutive maize promoters), U.S. Pat. Nos. 5,322,938, 5,352,605, 5,359,142 and 5,530,196 (35S promoter), U.S. Pat. No. 6,433,252 (maize L3 oleosin promoter, P-Zm.L3), U.S. Pat. No. 6,429,357 (rice actin 2 promoter as well as a rice actin 2 intron), U.S. Pat. No. 5,837,848 (root specific promoter), U.S. Pat. No. 6,294,714 (light inducible promoters), U.S. Pat. No. 6,140,078 (salt inducible promoters), U.S. Pat. No. 6,252,138 (pathogen inducible promoters), U.S. Pat. No. 6,175,060 (phosphorus deficiency inducible promoters), U.S. Pat. No. 6,635,806 (gama-coixin promoter, P-Cl.Gcx), and U.S. patent application Ser. No. 09/757,089 (maize chloroplast aldolase promoter), all of which are incorporated herein by reference in their entirety.

Promoters of the present invention include homologues of cis elements known to effect gene regulation that show homology with the promoter sequences of the present invention. These cis elements include, but are not limited to, oxygen responsive cis elements (Cowen et al., J Biol. Chem. 268(36):26904-26910 (1993)), light regulatory elements (Bruce and Quaill, Plant Cell 2 (11):1081-1089 (1990); Bruce et al., EMBO J. 10:3015-3024 (1991); Rocholl et al., Plant Sci. 97:189-198 (1994); Block et al., Proc. Natl. Acad. Sci. USA 87:5387-5391 (1990); Giuliano et al., Proc. Natl. Acad. Sci. USA 85:7089-7093 (1988); Staiger et al., Proc. Natl. Acad. Sci. USA 86:6930-6934 (1989); Izawa et al., Plant Cell 6:1277-1287 (1994); Menkens et al., Trends in Biochemistry 20:506-510 (1995); Foster et al., FASEB J. 8:192-200 (1994); Plesse et al., Mol Gen Gene 254:258-266 (1997); Green et al., EMBO J. 6:2543-2549 (1987); Kuhlemeier et al., Ann. Rev Plant Physiol. 38:221-257 (1987); Villain et al., J. Biol. Chem. 271:32593-32598 (1996); Lam et al., Plant Cell 2:857-866 (1990); Gilmartin et al., Plant Cell 2:369-378 (1990); Datta et al., Plant Cell 1:1069-1077 (1989); Gilmartin et al., Plant Cell 2:369-378 (1990); Castresana et al., EMBO J. 7:1929-1936 (1988); Ueda et al., Plant Cell 1:217-227 (1989); Terzaghi et al., Annu. Rev. Plant Physiol. Plant Mol. Biol. 46:445-474 (1995); Green et al., EMBO J. 6:2543-2549 (1987); Villain et al., J. Biol. Chem. 271:32593-32598 (1996); Tjaden et al., Plant Cell 6:107-118 (1994); Tjaden et al., Plant Physiol. 108:1109-1117 (1995); Ngai et al., Plant J. 12:1021-1234 (1997); Bruce et al., EMBO J. 10:3015-3024 (1991); Ngai et al., Plant J. 12:1021-1034 (1997)), elements responsive to gibberellin, (Muller et al., J. Plant Physiol. 145:606-613 (1995); Croissant et al., Plant Science 116:27-35 (1996); Lohmer et al., EMBO J. 10:617-624 (1991); Rogers et al., Plant Cell 4:1443-1451 (1992); Lanahan et al., Plant Cell 4:203-211 (1992); Skriver et al., Proc. Natl. Acad. Sci. USA 88:7266-7270 (1991); Gilmartin et al., Plant Cell 2:369-378 (1990); Huang et al., Plant Mol. Biol. 14:655-668 (1990), Gubler et al., Plant Cell 7:1879-1891 (1995)), elements responsive to abscisic acid, (Busk et al., Plant Cell 9:2261-2270 (1997); Guiltinan et al., Science 250:267-270 (1990); Shen et al., Plant Cell 7:295-307 (1995); Shen et al., Plant Cell 8:1107-1119 (1996); Seo et al., Plant Mol. Biol. 27:1119-1131 (1995); Marcotte et al., Plant Cell 1:969-976 (1989); Shen et al., Plant Cell 7:295-307 (1995); Iwasaki et al., Mol Gen Genet 247:391-398 (1995); Hattori et al., Genes Dev. 6:609-618 (1992); Thomas et al., Plant Cell 5:1401-1410 (1993)), elements similar to abscisic acid responsive elements, (Ellerstrom et al., Plant Mol. Biol. 32:1019-1027 (1996)), auxin responsive elements (Liu et al., Plant Cell 6:645-657 (1994); Liu et al., Plant Physiol. 115:397-407 (1997); Kosugi et al., Plant J. 7:877-886 (1995); Kosugi et al., Plant Cell 9:1607-1619 (1997); Ballas et al., J. Mol. Biol. 233:580-596 (1993)), a cis element responsive to methyl jasmonate treatment (Beaudoin and Rothstein, Plant Mol. Biol. 33:835-846 (1997)), a cis element responsive to abscisic acid and stress response (Straub et al., Plant Mol. Biol. 26:617-630 (1994)), ethylene responsive cis elements (Itzhaki et al., Proc. Natl. Acad. Sci. USA 91:8925-8929 (1994); Montgomery et al., Proc. Natl. Acad. Sci. USA 90:5939-5943 (1993); Sessa et al., Plant Mol. Biol. 28:145-153 (1995); Shinshi et al., Plant Mol. Biol. 27:923-932 (1995)), salicylic acid cis responsive elements, (Strange et al., Plant J. 11:1315-1324 (1997); Qin et al., Plant Cell 6:863-874 (1994)), a cis element that responds to water stress and abscisic acid (Lam et al., J. Biol. Chem. 266:17131-17135 (1991); Thomas et al., Plant Cell 5:1401-1410 (1993); Pla et al., Plant Mol Biol 21:259-266 (1993)), a cis element essential for M phase-specific expression (Ito et al., Plant Cell 10:331-341 (1998)), sucrose responsive elements (Huang et al., Plant Mol. Biol. 14:655-668 (1990); Hwang et al., Plant Mol Biol 36:331-341 (1998); Grierson et al., Plant J. 5:815-826 (1994)), heat shock response elements (Pelham et al., Trends Genet. 1:31-35 (1985)), elements responsive to auxin and/or salicylic acid and also reported for light regulation (Lam et al., Proc. Natl. Acad. Sci. USA 86:7890-7897 (1989); Benfey et al., Science 250:959-966 (1990)), elements responsive to ethylene and salicylic acid (Ohme-Takagi et al., Plant Mol. Biol. 15:941-946 (1990)), elements responsive to wounding and abiotic stress (Loake et al., Proc. Natl. Acad. Sci. USA 89:9230-9234 (1992); Mhiri et. al., Plant Mol. Biol. 33:257-266 (1997)), antoxidant response elements (Rushmore et al., J. Biol. Chem. 266:11632-11639; Dalton et al., Nucleic Acids Res. 22:5016-5023 (1994)), Sph elements (Suzuki et al., Plant Cell 9:799-807 1997)), elicitor responsive elements, (Fukuda et al., Plant Mol. Biol. 34:81-87 (1997); Rushton et al., EMBO J. 15:5690-5700 (1996)), metal responsive elements (Stuart et al., Nature 317:828-831 (1985); Westin et al., EMBO J. 7:3763-3770 (1988); Thiele et al., Nucleic Acids Res. 20:1183-1191 (1992); Faisst et al., Nucleic Acids Res. 20:3-26 (1992)), low temperature responsive elements, (Baker et al., Plant Mol. Biol. 24:701-713 (1994); Jiang et al., Plant Mol. Biol. 30:679-684 (1996); Nordin et al., Plant Mol. Biol. 21:641-653 (1993); Zhou et al., J. Biol. Chem. 267: 23515-23519 (1992)), drought responsive elements, (Yamaguchi et al., Plant Cell 6:251-264 (1994); Wang et al., Plant Mol. Biol. 28:605-617 (1995); Bray EA, Trends in Plant Science 2:48-54 (1997)) enhancer elements for glutenin, (Colot et al., EMBO J. 6:3559-3564 (1987); Thomas et al., Plant Cell 2:1171-1180 (1990); Kreis et al., Philos. Trans. R. Soc. Lond., B314:355-365 (1986)), light-independent regulatory elements, (Lagrange et al., Plant Cell 9:1469-1479 (1997); Villain et al., J. Biol. Chem. 271:32593-32598 (1996)), OCS enhancer elements, (Bouchez et al., EMBO J. 8:4197-4204 (1989); Foley et al., Plant J. 3:669-679 (1993)), ACGT elements, (Foster et al., FASEB J. 8:192-200 (1994); Izawa et al., Plant Cell 6:1277-1287 (1994); Izawa et al., J. Mol. Biol. 230:1131-1144 (1993)), negative cis elements in plastid related genes, (Zhou et al., J. Biol. Chem. 267:23515-23519 (1992); Lagrange et al., Mol. Cell Biol. 13:2614-2622 (1993); Lagrange et al., Plant Cell 9:1469-1479 (1997); Zhou et al., J. Biol. Chem. 267:23515-23519 (1992)), prolamin box elements, (Forde et al., Nucleic Acids Res. 13:7327-7339 (1985); Colot et al., EMBO J. 6:3559-3564 (1987); Thomas et al., Plant Cell 2:1171-1180 (1990); Thompson et al., Plant Mol. Biol. 15:755-764 (1990); Vicente et al., Proc. Natl. Acad. Sci. USA 94:7685-7690 (1997)), elements in enhancers from the IgM heavy chain gene (Gillies et al., Cell 33:717-728 (1983); Whittier et al., Nucleic Acids Res. 15:2515-2535 (1987)).

The activity or strength of a promoter may be measured in terms of the amount of mRNA or protein accumulation it specifically produces, relative to the total amount of mRNA or protein. The promoter preferably expresses an operably linked nucleic acid sequence at a level greater than 0.01%; preferably in a range of about 0.5% to about 20% (w/w) of the total cellular RNA or protein.

Alternatively, the activity or strength of a promoter may be expressed relative to a well-characterized promoter (for which transcriptional activity was previously assessed). For example, a less-characterized promoter may be operably linked to a reporter sequence (e.g., GUS) and introduced into a specific cell type. A well-characterized promoter (e.g. the 35S promoter) is similarly prepared and introduced into the same cellular context. Transcriptional activity of the unknown promoter is determined by comparing the amount of reporter expression, relative to the well characterized promoter. In one embodiment, the activity of the present promoter is as strong as the 35S promoter when compared in the same cellular context. The cellular context is preferably maize, sorghum, corn, barley, wheat, canola, soybean, or maize; and more preferably is maize, sorghum, corn, barley, or wheat; and most preferably is maize.

Enhancers

Enhancers, which strongly activate transcription, frequently in a specific differentiated cell type, are usually 100-200 base pairs long. Although enhancers often lie within a few kilobases of the cap site, in some cases they lie much further upstream or downstream from the cap site or within an intron. Some genes are controlled by more than one enhancer region, as in the case of the *Drosophila* even-skipped gene.

As used herein, the term "enhancer domain" refers to a cis-acting transcriptional regulatory element (cis-element), which confers an aspect of the overall modulation of gene expression. An enhancer domain may function to bind transcription factors, trans-acting protein factors that regulate transcription. Some enhancer domains bind more than one transcription factor, and transcription factors may interact with different affinities with more than one enhancer domain. Enhancer domains can be identified by a number of techniques, including deletion analysis, i.e., deleting one or more nucleotides from the 5' end or internal to a promoter; DNA binding protein analysis using DNase I footprinting, methylation interference, electrophoresis mobility-shift assays, in vivo genomic footprinting by ligation-mediated PCR, and other conventional assays; or by DNA sequence similarity analysis with known cis-element motifs by conventional DNA sequence comparison methods. The fine structure of an enhancer domain can be further studied by mutagenesis (or substitution) of one or more nucleotides or by other conventional methods. Enhancer domains can be obtained by chemical synthesis or by isolation from regulatory elements that include such elements, and they can be synthesized with additional flanking nucleotides that contain useful restriction enzyme sites to facilitate subsequence manipulation.

Translational enhancers may also be incorporated as part of a recombinant vector. Thus the recombinant vector may preferably contain one or more 5' non-translated leader sequences which serve to enhance expression of the nucleic acid sequence. Such enhancer sequences may be desirable to increase or alter the translational efficiency of the resultant mRNA. Examples of other regulatory element 5' nucleic acid leader sequences include dSSU 5', PetHSP70 5', and GmHSP17.9 5'. A translational enhancer sequence derived from the untranslated leader sequence from the mRNA of the coat protein gene of alfalfa mosaic virus coat protein gene, placed between the promoter and the gene, to increase translational efficiency, is described in U.S. Pat. No. 6,037,527, herein incorporated by reference. Thus, the design, construction, and use of enhancer domains according to the methods disclosed herein for modulating the expression of operably linked transcribable polynucleotide molecules are encompassed by the present invention.

An enhancer comprises enhancer fragments that have enhancer activity. Enhancer fragments may comprise other regulatory elements, and may further be useful for constructing chimeric molecules.

Leaders

As used herein, the term "leader" refers to a polynucleotide molecule isolated from the untranslated 5' region (5' UTR) of a genomic copy of a gene and defined generally as a segment between the transcription start site (TSS) and the coding sequence start site. Alternately, leaders may be synthetically produced or manipulated DNA elements. A "plant leader" is a native or non-native leader that is functional in plant cells. A plant leader can be used as a 5' regulatory element for modulating expression of an operably linked transcribable polynucleotide molecule.

For example, non-translated 5' leader polynucleotide molecules derived from heat shock protein genes have been demonstrated to enhance gene expression in plants (see for example, U.S. Pat. No. 5,659,122 and U.S. Pat. No. 5,362,865, all of which are incorporated herein by reference).

A leader comprises promoter fragments that have leader activity. Leader fragments may comprise other regulatory elements, and may further be useful for constructing chimeric molecules. With respect to the molecules of the present invention, the term "leader" refers specifically to nucleotides 2281 through 2325 of SEQ ID NO: 17666, or any fragment thereof which demonstrates leader activity.

Introns

As used herein, the term "intron" refers to a polynucleotide molecule that may be isolated or identified from the intervening sequence of a genomic copy of a gene and may be defined generally as a region spliced out during mRNA processing prior to translation. Alternately, introns may be synthetically produced or manipulated DNA elements. Introns may themselves contain sub-elements such as cis-elements or enhancer domains that effect the transcription of operably linked genes. A "plant intron" is a native or non-native intron that is functional in plant cells. A plant intron may be used as a regulatory element for modulating expression of an operably linked gene or genes. A polynucleotide molecule sequence in a recombinant construct may comprise introns. The introns may be heterologous with respect to the transcribable polynucleotide molecule sequence.

The transcribable polynucleotide molecule sequence in the recombinant vector may comprise introns. The introns may be heterologous with respect to the transcribable polynucleotide molecule sequence. Examples of regulatory element introns include the corn actin intron and the corn HSP70 intron (U.S. Pat. No. 5,859,347, herein incorporated by reference in its entirety).

Terminators

The 3' untranslated regions (3' UTRs) of mRNAs are generated by specific cleavage and polyadenylation. A 3' polyadenylation region means a DNA molecule linked to and located downstream of a structural polynucleotide molecule and includes polynucleotides that provide a polyadenylation signal and other regulatory signals capable of affecting transcription, mRNA processing or gene expression. PolyA tails are thought to function in mRNA stability and in initiation of translation.

As used herein, the term "terminator" refers to a polynucleotide sequence that may be isolated or identified from the 3' untranslated region (3'UTR) of a transcribable gene, which functions to signal to RNA polymerase the termination of transcription. The polynucleotide sequences of the present invention may comprise terminator sequences.

Polyadenylation is the non-templated addition of a 50 to 200 nt chain of polyadenylic acid (polyA). Cleavage must precede polyadenylation. The polyadenylation signal functions in plants to cause the addition of polyadenylate nucleotides to the 3' end of the mRNA precursor. The polyadenylation sequence can be derived from the natural gene, from a variety of plant genes, or from *Agrobacterium* T-DNA genes. Transcription termination often occurs at sites considerably downstream of the sites that, after polyadenylation, are the 3' ends of most eukaryotic mRNAs.

Examples of 3' UTR regions are the nopaline synthase 3' region (nos 3'; Fraley, et al., *Proc. Natl. Acad. Sci. USA* 80: 4803-4807, 1983), wheat hsp17 (T-Ta.Hsp17), and T-Ps.R-bcS2:E9 (pea rubisco small subunit), those disclosed in WO0011200A2 (herein incorporated by reference) and other 3' UTRs known in the art can be tested and used in combination with a DHDPS or AK coding region, herein referred to as T-3'UTR. Another example of terminator regions is given in U.S. Pat. No. 6,635,806, herein incorporated by reference.

Regulatory Element Isolation and Modification

Any number of methods well known to those skilled in the art can be used to isolate a polynucleotide molecule, or fragment thereof, disclosed in the present invention. For example, PCR (polymerase chain reaction) technology can be used to amplify flanking regions from a genomic library of a plant using publicly available sequence information. A number of methods are known to those of skill in the art to amplify unknown polynucleotide molecules adjacent to a core region of known polynucleotide sequence. Methods include but are not limited to inverse PCR (IPCR), vectorette PCR, Y-shaped PCR, and genome walking approaches. Polynucleotide fragments can also be obtained by other techniques such as by directly synthesizing the fragment by chemical means, as is commonly practiced by using an automated oligonucleotide synthesizer. For the present invention, the polynucleotide molecules were isolated from genomic DNA by designing oligonucleotide primers based on available sequence information and using PCR techniques.

As used herein, the term "isolated polynucleotide molecule" refers to a polynucleotide molecule at least partially separated from other molecules normally associated with it in its native state. In one embodiment, the term "isolated" is also used herein in reference to a polynucleotide molecule that is at least partially separated from nucleic acids which normally flank the polynucleotide in its native state. Thus, polynucleotides fused to regulatory or coding sequences with which they are not normally associated, for example as the result of recombinant techniques, are considered isolated herein. Such molecules are considered isolated even when present, for example in the chromosome of a host cell, or in a nucleic acid solution. The term "isolated" as used herein is intended to encompass molecules not present in their native state.

Those of skill in the art are familiar with the standard resource materials that describe specific conditions and procedures for the construction, manipulation, and isolation of macromolecules (e.g., polynucleotide molecules, plasmids, etc.), as well as the generation of recombinant organisms and the screening and isolation of polynucleotide molecules.

Short nucleic acid sequences having the ability to specifically hybridize to complementary nucleic acid sequences may be produced and utilized in the present invention. These short nucleic acid molecules may be used as probes to identify the presence of a complementary nucleic acid sequence in a given sample. Thus, by constructing a nucleic acid probe which is complementary to a small portion of a particular nucleic acid sequence, the presence of that nucleic acid sequence may be detected and assessed. Use of these probes may greatly facilitate the identification of transgenic plants which contain the presently disclosed nucleic acid molecules. The probes may also be used to screen cDNA or genomic libraries for additional nucleic acid sequences related or sharing homology to the presently disclosed promoters and transcribable polynucleotide sequences. The short nucleic acid sequences may be used as probes and specifically as PCR probes. A PCR probe is a nucleic acid molecule capable of initiating a polymerase activity while in a double-stranded structure with another nucleic acid. Various methods for determining the structure of PCR probes and PCR techniques exist in the art. Computer generated searches using programs such as Primer3 (www.genome.wi.mit.edu/cgi-bin/primer/primer3.cgi), STSPipeline (www-genome.wi.mit.edu/cgi-bin/www.STS_Pipeline), or GeneUp (Pesole, et al., *BioTechniques* 25:112-123, 1998), for example, can be used to identify potential PCR primers.

Alternatively, the short nucleic acid sequences may be used as oligonucleotide primers to amplify or mutate a complementary nucleic acid sequence using PCR technology. These primers may also facilitate the amplification of related complementary nucleic acid sequences (e.g. related nucleic acid sequences from other species).

The primer or probe is generally complementary to a portion of a nucleic acid sequence that is to be identified, amplified, or mutated. The primer or probe should be of sufficient length to form a stable and sequence-specific duplex molecule with its complement. The primer or probe preferably is about 10 to about 200 nucleotides long, more preferably is about 10 to about 100 nucleotides long, even more preferably is about 10 to about 50 nucleotides long, and most preferably is about 14 to about 30 nucleotides long. The primer or probe may be prepared by direct chemical synthesis, by PCR (See, for example, U.S. Pat. Nos. 4,683,195, and 4,683,202, each of which is herein incorporated by reference), or by excising the nucleic acid specific fragment from a larger nucleic acid molecule.

Transcribable Polynucleotide Molecules

A regulatory element of the present invention may be operably linked to a transcribable polynucleotide sequence that is heterologous with respect to the regulatory element. The term "heterologous" refers to the relationship between two or more nucleic acid or protein sequences that are derived from different sources. For example, a promoter is heterologous with respect to a transcribable polynucleotide sequence if such a combination is not normally found in nature. In addition, a particular sequence may be "heterologous" with respect to a cell or organism into which it is inserted (i.e. does not naturally occur in that particular cell or organism).

The transcribable polynucleotide molecule may generally be any nucleic acid sequence for which an increased level of transcription is desired. Alternatively, the regulatory element and transcribable polynucleotide sequence may be designed to down-regulate a specific nucleic acid sequence. This is typically accomplished by linking the promoter to a transcribable polynucleotide sequence that is oriented in the antisense direction. One of ordinary skill in the art is familiar with such antisense technology. Briefly, as the antisense nucleic acid sequence is transcribed, it hybridizes to and sequesters a complimentary nucleic acid sequence inside the cell. This duplex RNA molecule cannot be translated into a protein by the cell's translational machinery. Any nucleic acid sequence may be negatively regulated in this manner.

A regulatory element of the present invention may also be operably linked to a modified transcribable polynucleotide molecule that is heterologous with respect to the promoter. The transcribable polynucleotide molecule may be modified to provide various desirable features. For example, a transcribable polynucleotide molecule may be modified to increase the content of essential amino acids, enhance translation of the amino acid sequence, alter post-translational modifications (e.g., phosphorylation sites), transport a translated product to a compartment inside or outside of the cell, improve protein stability, insert or delete cell signaling motifs, etc.

Due to the degeneracy of the genetic code, different nucleotide codons may be used to code for a particular amino acid. A host cell often displays a preferred pattern of codon usage. Transcribable polynucleotide molecules are preferably constructed to utilize the codon usage pattern of the particular host cell. This generally enhances the expression of the transcribable polynucleotide sequence in a transformed host cell. Any of the above described nucleic acid and amino acid sequences may be modified to reflect the preferred codon usage of a host cell or organism in which they are contained. Modification of a transcribable polynucleotide sequence for optimal codon usage in plants is described in U.S. Pat. No. 5,689,052, herein incorporated by reference.

Additional variations in the transcribable polynucleotide molecules may encode proteins having equivalent or superior characteristics when compared to the proteins from which they are engineered. Mutations may include, but are not limited to, deletions, insertions, truncations, substitutions, fusions, shuffling of motif sequences, and the like. Mutations to a transcribable polynucleotide molecule may be introduced in either a specific or random manner, both of which are well known to those of skill in the art of molecular biology.

Thus, one embodiment of the invention is a regulatory element such as provided in SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof, operably linked to a transcribable polynucleotide molecule so as to modulate transcription of said transcribable polynucleotide molecule at a desired level or in a desired tissue or developmental pattern upon introduction of said construct into a plant cell. In one embodiment, the transcribable polynucleotide molecule comprises a protein-coding region of a gene, and the regulatory element affects the transcription of a functional mRNA molecule that is translated and expressed as a protein product. In another embodiment, the transcribable polynucleotide molecule comprises an antisense region of a gene, and the regulatory element affects the transcription of an antisense RNA molecule or other similar inhibitory RNA in order to inhibit expression of a specific RNA molecule of interest in a target host cell.

Genes of Agronomic Interest

The transcribable polynucleotide molecule preferably encodes a polypeptide that is suitable for incorporation into the diet of a human or an animal. Specifically, such transcribable polynucleotide molecules comprise genes of agronomic interest. As used herein, the term "gene of agronomic interest" refers to a transcribable polynucleotide molecule that includes but is not limited to a gene that provides a desirable characteristic associated with plant morphology, physiology, growth and development, yield, nutritional enhancement, disease or pest resistance, or environmental or chemical tolerance. Suitable transcribable polynucleotide molecules include but are not limited to those encoding a yield protein, a stress resistance protein, a developmental control protein, a tissue differentiation protein, a meristem protein, an environmentally responsive protein, a senescence protein, a hormone responsive protein, an abscission protein, a source protein, a sink protein, a flower control protein, a seed protein, an herbicide resistance protein, a disease resistance protein, a fatty acid biosynthetic enzyme, a tocopherol biosynthetic enzyme, an amino acid biosynthetic enzyme, or an insecticidal protein.

In one embodiment of the invention, a polynucleotide molecule as shown in SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof comprising regulatory elements is incorporated into a construct such that a polynucleotide molecule of the present invention is operably linked to a transcribable polynucleotide molecule that is a gene of agronomic interest.

The expression of a gene of agronomic interest is desirable in order to confer an agronomically important trait. A gene of agronomic interest that provides a beneficial agronomic trait to crop plants may be, for example, including, but not limited to genetic elements comprising herbicide resistance (U.S. Pat. Nos. 6,803,501; 6,448,476; 6,248,876; 6,225,114; 6,107,549; 5,866,775; 5,804,425; 5,633,435; 5,463,175), increased yield (U.S. Pat. Nos. USRE38,446; 6,716,474; 6,663,906; 6,476,295; 6,441,277; 6,423,828; 6,399,330; 6,372,211; 6,235,971; 6,222,098; 5,716,837), insect control (U.S. Pat. Nos. 6,809,078; 6,713,063; 6,686,452; 6,657,046; 6,645,497; 6,642,030; 6,639,054; 6,620,988; 6,593,293; 6,555,655; 6,538,109; 6,537,756; 6,521,442; 6,501,009; 6,468,523; 6,326,351; 6,313,378; 6,284,949; 6,281,016; 6,248,536; 6,242,241; 6,221,649; 6,177,615; 6,156,573; 6,153,814; 6,110,464; 6,093,695; 6,063,756; 6,063,597; 6,023,013; 5,959,091; 5,942,664; 5,942,658, 5,880,275; 5,763,245; 5,763,241), fungal disease resistance (U.S. Pat. Nos. 6,653,280; 6,573,361; 6,506,962; 6,316,407; 6,215,048; 5,516,671; 5,773,696; 6,121,436; 6,316,407; 6,506,962), virus resistance (U.S. Pat. Nos. 6,617,496; 6,608,241; 6,015,940; 6,013,864; 5,850,023; 5,304,730), nematode resistance (U.S. Pat. No. 6,228,992), bacterial disease resistance (U.S. Pat. No. 5,516,671), plant growth and development (U.S. Pat. Nos. 6,723,897; 6,518,488), starch production (U.S. Pat. Nos. 6,538,181; 6,538,179; 6,538,178; 5,750,876; 6,476,295), modified oils production (U.S. Pat. Nos. 6,444,876; 6,426,447; 6,380,462), high oil production (U.S. Pat. Nos. 6,495,739; 5,608,149; 6,483,008; 6,476,295), modified fatty acid content (U.S. Pat. Nos. 6,828,475; 6,822,141; 6,770,465; 6,706,950; 6,660,849; 6,596,538; 6,589,767; 6,537,750; 6,489,461; 6,459,018), high protein production (U.S. Pat. No. 6,380,466), fruit ripening (U.S. Pat. No. 5,512,466), enhanced animal and human nutrition (U.S. Pat. Nos. 6,723,837; 6,653,530; 6,5412,59; 5,985,605; 6,171,640), biopolymers (U.S. Pat. Nos. USRE37,543; 6,228,623; 5,958,745 and U.S. Patent Publication No. US20030028917), environmental stress resistance (U.S. Pat. No. 6,072,103), pharmaceutical peptides and secretable peptides (U.S. Pat. Nos. 6,812,379; 6,774,283; 6,140,075; 6,080,560), improved processing traits (U.S. Pat. No. 6,476,295), improved digestibility (U.S. Pat.

No. 6,531,648) low raffinose (U.S. Pat. No. 6,166,292), industrial enzyme production (U.S. Pat. No. 5,543,576), improved flavor (U.S. Pat. No. 6,011,199), nitrogen fixation (U.S. Pat. No. 5,229,114), hybrid seed production (U.S. Pat. No. 5,689,041), fiber production (U.S. Pat. Nos. 6,576,818; 6,271,443; 5,981,834; 5,869,720) and biofuel production (U.S. Pat. No. 5,998,700). The genetic elements, methods, and transgenes described in the patents listed above are incorporated herein by reference.

Alternatively, a transcribable polynucleotide molecule can effect the above mentioned plant characteristic or phenotype by encoding a RNA molecule that causes the targeted inhibition of expression of an endogenous gene, for example via antisense, inhibitory RNA (RNAi), or cosuppression-mediated mechanisms. The RNA could also be a catalytic RNA molecule (i.e., a ribozyme) engineered to cleave a desired endogenous mRNA product. Thus, any transcribable polynucleotide molecule that encodes a transcribed RNA molecule that affects a phenotype or morphology change of interest may be useful for the practice of the present invention.

Selectable Markers

As used herein the term "marker" refers to any transcribable polynucleotide molecule whose expression, or lack thereof, can be screened for or scored in some way. Marker genes for use in the practice of the present invention include, but are not limited to transcribable polynucleotide molecules encoding β-glucuronidase (GUS described in U.S. Pat. No. 5,599,670, which is incorporated herein by reference), green fluorescent protein (GFP described in U.S. Pat. No. 5,491,084 and U.S. Pat. No. 6,146,826, all of which are incorporated herein by reference), proteins that confer antibiotic resistance, or proteins that confer herbicide tolerance. Marker genes in genetically modified plants are generally of two types: genes conferring antibiotic resistance or genes conferring herbicide tolerance.

Useful antibiotic resistance markers, including those encoding proteins conferring resistance to kanamycin (nptII), hygromycin B (aph IV), streptomycin or spectinomycin (aad, spec/strep) and gentamycin (aac3 and aacC4) are known in the art.

Herbicides for which transgenic plant tolerance has been demonstrated and the method of the present invention can be applied, include but are not limited to: glyphosate, glufosinate, sulfonylureas, imidazolinones, bromoxynil, dalapon, dicamba, cyclohezanedione, protoporphyrionogen oxidase inhibitors, and isoxasflutole herbicides. Polynucleotide molecules encoding proteins involved in herbicide tolerance are known in the art, and include, but are not limited to a polynucleotide molecule encoding 5-enolpyruvylshikimate-3-phosphate synthase (EPSPS described in U.S. Pat. No. 5,627,061, U.S. Pat. No. 5,633,435, U.S. Pat. No. 6,040,497 and in U.S. Pat. No. 5,094,945 for glyphosate tolerance, all of which are incorporated herein by reference); polynucleotides encoding a glyphosate oxidoreductase and a glyphosate-N-acetyl transferase (GOX described in U.S. Pat. No. 5,463,175 and GAT described in U.S. Patent publication 20030083480, dicamba monooxygenase U.S. Patent publication 20030135879, all of which are incorporated herein by reference); a polynucleotide molecule encoding bromoxynil nitrilase (Bxn described in U.S. Pat. No. 4,810,648 for Bromoxynil tolerance, which is incorporated herein by reference); a polynucleotide molecule encoding phytoene desaturase (crtI) described in Misawa et al., (1993) *Plant J.* 4:833-840 and Misawa et al., (1994) *Plant J.* 6:481-489 for norflurazon tolerance; a polynucleotide molecule encoding acetohydroxyacid synthase (AHAS, aka ALS) described in Sathasiivan et al. (1990) *Nucl. Acids Res.* 18:2188-2193 for tolerance to sulfonylurea herbicides; and the bar gene described in DeBlock, et al. (1987) *EMBO J.* 6:2513-2519 for glufosinate and bialaphos tolerance. The regulatory elements of the present invention can express transcribable polynucleotide molecules that encode for phosphinothricin acetyltransferase, glyphosate resistant EPSPS, aminoglycoside phosphotransferase, hydroxyphenyl pyruvate dehydrogenase, hygromycin phosphotransferase, neomycin phosphotransferase, dalapon dehalogenase, bromoxynil resistant nitrilase, anthranilate synthase, glyphosate oxidoreductase and glyphosate-N-acetyl transferase.

Included within the term "selectable markers" are also genes which encode a secretable marker whose secretion can be detected as a means of identifying or selecting for transformed cells. Examples include markers that encode a secretable antigen that can be identified by antibody interaction, or even secretable enzymes which can be detected catalytically. Selectable secreted marker proteins fall into a number of classes, including small, diffusible proteins which are detectable, (e.g., by ELISA), small active enzymes which are detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable marker genes will be apparent to those of skill in the art.

The selectable marker is preferably GUS, green fluorescent protein (GFP), neomycin phosphotransferase II (nptII), luciferase (LUX), an antibiotic resistance coding sequence, or an herbicide (e.g., glyphosate) resistance coding sequence. The selectable marker is most preferably a kanamycin, hygromycin, or herbicide resistance marker.

Constructs and Vectors

The constructs of the present invention are generally double Ti plasmid border DNA constructs that have the right border (RB or AGRtu.RB) and left border (LB or AGRtu.LB) regions of the Ti plasmid isolated from *Agrobacterium tumefaciens* comprising a T-DNA, that along with transfer molecules provided by the *Agrobacterium* cells, permit the integration of the T-DNA into the genome of a plant cell (see for example U.S. Pat. No. 6,603,061, herein incorporated by reference in its entirety). The constructs may also contain the plasmid backbone DNA segments that provide replication function and antibiotic selection in bacterial cells, for example, an *Escherichia coli* origin of replication such as ori322, a broad host range origin of replication such as oriV or oriRi, and a coding region for a selectable marker such as Spec/Strp that encodes for Tn7 aminoglycoside adenyltransferase (aadA) conferring resistance to spectinomycin or streptomycin, or a gentamicin (Gm, Gent) selectable marker gene. For plant transformation, the host bacterial strain is often *Agrobacterium tumefaciens* ABI, C58, or LBA4404, however, other strains known to those skilled in the art of plant transformation can function in the present invention.

As used herein, the term "construct" means any recombinant polynucleotide molecule such as a plasmid, cosmid, virus, autonomously replicating polynucleotide molecule, phage, or linear or circular single-stranded or double-stranded DNA or RNA polynucleotide molecule, derived from any source, capable of genomic integration or autonomous replication, comprising a polynucleotide molecule where one or more polynucleotide molecule has been linked in a functionally operative manner, i.e. operably linked. As used herein, the term "vector" means any recombinant polynucleotide construct that may be used for the purpose of transformation, i.e. the introduction of heterologous DNA into a host cell.

Methods are known in the art for assembling and introducing constructs into a cell in such a manner that the transcribable polynucleotide molecule is transcribed into a functional mRNA molecule that is translated and expressed as a protein product. For the practice of the present invention, conventional compositions and methods for preparing and using constructs and host cells are well known to one skilled in the art, see for example, Molecular Cloning: A Laboratory Manual, 3rd edition Volumes 1, 2, and 3 (2000) J. F. Sambrook, D. W. Russell, and N. Irwin, Cold Spring Harbor Laboratory Press. Methods for making recombinant vectors particularly suited to plant transformation include, without limitation, those described in U.S. Pat. Nos. 4,971,908, 4,940,835, 4,769,061 and 4,757,011, all of which are herein incorporated by reference in their entirety. These type of vectors have also been reviewed (Rodriguez, et al. Vectors: A Survey of Molecular Cloning Vectors and Their Uses, Butterworths, Boston, 1988; Glick et al., Methods in Plant Molecular Biology and Biotechnology, CRC Press, Boca Raton, Fla., 1993). Typical vectors useful for expression of nucleic acids in higher plants are well known in the art and include vectors derived from the tumor-inducing (Ti) plasmid of *Agrobacterium tumefaciens* (Rogers, et al., Meth. In Enzymol, 153: 253-277, 1987). Other recombinant vectors useful for plant transformation, including the pCaMVCN transfer control vector, have also been described (Fromm et al., Proc. Natl. Acad. Sci. USA, 82(17): 5824-5828, 1985).

Regulatory Elements in the Construct

Various untranslated regulatory sequences may be included in the recombinant vector. Any such regulatory sequences may be provided in a recombinant vector with other regulatory sequences. Such combinations can be designed or modified to produce desirable regulatory features. Constructs of the present invention would typically comprise one or more gene expression regulatory elements operably linked to a transcribable polynucleotide molecule operably linked to a 3' transcription termination polynucleotide molecule.

Constructs of the present invention may also include additional 5' untranslated regions (5' UTR) of an mRNA polynucleotide molecule or gene which can play an important role in translation initiation. For example, non-translated 5' leader polynucleotide molecules derived from heat shock protein genes have been demonstrated to enhance gene expression in plants (see for example, U.S. Pat. No. 5,659,122 and U.S. Pat. No. 5,362,865, all of which are incorporated herein by reference). These additional upstream regulatory polynucleotide molecules may be derived from a source that is native or heterologous with respect to the other elements present on the construct.

One or more additional promoters may also be provided in the recombinant vector. These promoters may be operably linked to any of the transcribable polynucleotide sequences described above. Alternatively, the promoters may be operably linked to other nucleic acid sequences, such as those encoding transit peptides, selectable marker proteins, or anti-sense sequences. These additional promoters may be selected on the basis of the cell type into which the vector will be inserted. Promoters which function in bacteria, yeast, and plants are all well taught in the art. The additional promoters may also be selected on the basis of their regulatory features. Examples of such features include enhancement of transcriptional activity, inducibility, tissue-specificity, and developmental stage-specificity. In plants, promoters that are inducible, of viral or synthetic origin, constitutively active, temporally regulated, and spatially regulated have been described (Poszkowski, et al., *EMBO J.*, 3: 2719, 1989; Odell, et al., *Nature,* 313:810, 1985; Chau et al., *Science,* 244:174-181. 1989).

Often-used constitutive promoters include the CaMV 35S promoter (Odell, et al., *Nature,* 313: 810, 1985), the enhanced CaMV 35S promoter, the Figwort Mosaic Virus (FMV) promoter (Richins, et al., *Nucleic Acids Res.* 20: 8451, 1987), the mannopine synthase (mas) promoter, the nopaline synthase (nos) promoter, and the octopine synthase (ocs) promoter.

Useful inducible promoters include promoters induced by salicylic acid or polyacrylic acids (PR-1; Williams, et al., *Biotechnology* 10:540-543, 1992), induced by application of safeners (substituted benzenesulfonamide herbicides; Hershey and Stoner, *Plant Mol. Biol.* 17: 679-690, 1991), heat-shock promoters (Ou-Lee et al., *Proc. Natl. Acad. Sci. U.S.A.* 83: 6815, 1986; Ainley et al., *Plant Mol. Biol.* 14: 949, 1990), a nitrate-inducible promoter derived from the spinach nitrite reductase transcribable polynucleotide sequence (Back et al., *Plant Mol. Biol.* 17: 9, 1991), hormone-inducible promoters (Yamaguchi-Shinozaki et al., *Plant Mol. Biol.* 15: 905, 1990), and light-inducible promoters associated with the small subunit of RuBP carboxylase and LHCP families (Kuhlemeier et al., *Plant Cell* 1: 471, 1989; Feinbaum et al., *Mol. Gen. Genet.* 226: 449-456, 1991; Weisshaar, et al., *EMBO J.* 10: 1777-1786, 1991; Lam and Chua, *J. Biol. Chem.* 266: 17131-17135, 1990; Castresana et al., *EMBO J.* 7: 1929-1936, 1988; Schulze-Lefert, et al., *EMBO J.* 8: 651, 1989).

Examples of useful tissue-specific, developmentally-regulated promoters include the β-conglycinin 7Sα promoter (Doyle et al., *J. Biol. Chem.* 261: 9228-9238, 1986; Slighton and Beachy, Planta 172: 356, 1987), and seed-specific promoters.(Knutzon, et al., *Proc. Natl. Acad. Sci. U.S.A.* 89: 2624-2628, 1992; Bustos, et al., *EMBO J.* 10: 1469-1479, 1991; Lam and Chua, *Science* 248: 471, 1991). Plant functional promoters useful for preferential expression in seed plastid include those from plant storage proteins and from proteins involved in fatty acid biosynthesis in oilseeds. Examples of such promoters include the 5' regulatory regions from such transcribable polynucleotide sequences as napin (Kridl et al., *Seed Sci. Res.* 1: 209, 1991), phaseolin, zein, soybean trypsin inhibitor, ACP, stearoyl-ACP desaturase, and oleosin. Seed-specific regulation is discussed in EP 0 255 378.

Another exemplary tissue-specific promoter is the lectin promoter, which is specific for seed tissue. The Lectin protein in soybean seeds is encoded by a single transcribable polynucleotide sequence (Le1) that is only expressed during seed maturation and accounts for about 2 to about 5% of total seed mRNA. The lectin transcribable polynucleotide sequence and seed-specific promoter have been fully characterized and used to direct seed specific expression in transgenic tobacco plants (Vodkin, et al., *Cell,* 34: 1023, 1983; Lindstrom, et al., *Developmental Genetics,* 11: 160, 1990).

Particularly preferred additional promoters in the recombinant vector include the nopaline synthase (nos), mannopine synthase (mas), and octopine synthase (ocs) promoters, which are carried on tumor-inducing plasmids of *Agrobacterium tumefaciens*; the cauliflower mosaic virus (CaMV) 19S and 35S promoters; the enhanced CaMV 35S promoter; the Figwort Mosaic Virus (FMV) 35S promoter; the light-inducible promoter from the small subunit of ribulose-1,5-bisphosphate carboxylase (ssRUBISCO); the EIF-4A promoter from tobacco (Mandel, et al., *Plant Mol. Biol,* 29: 995-1004, 1995); corn sucrose synthetase 1 (Yang, et al., *Proc. Natl.*

*Acad. Sci. USA,* 87: 4144-48, 1990); corn alcohol dehydrogenase 1 (Vogel, et al., *J. Cell Biochem.,* (Suppl) 13D: 312, 1989); corn light harvesting complex (Simpson, Science, 233: 34, 1986); corn heat shock protein (Odell, et al., *Nature,* 313: 810, 1985); the chitinase promoter from *Arabidopsis* (Samac, et al., *Plant Cell,* 3:1063-1072, 1991); the LTP (Lipid Transfer Protein) promoters from broccoli (Pyee, et al., *Plant J.,* 7: 49-59, 1995); petunia chalcone isomerase (Van Tunen, et al., *EMBO J.* 7: 1257, 1988); bean glycine rich protein 1 (Keller, et al., *EMBO L.,* 8: 1309-1314, 1989); Potato patatin (Wenzler, et al., *Plant Mol. Biol.,* 12: 41-50, 1989); the ubiquitin promoter from maize (Christensen et al., *Plant Mol. Biol.,* 18: 675,689, 1992); and the actin promoter from corn (McElroy, et al., *Plant Cell,* 2:163-171, 1990).

The additional promoter is preferably seed selective, tissue specific, constitutive, or inducible. The promoter is most preferably the nopaline synthase (NO:S), octopine synthase (OCS), mannopine synthase (MAS), cauliflower mosaic virus 19S and 35S (CaMV19S, CaMV35S), enhanced CaMV (eCaMV), ribulose 1,5-bisphosphate carboxylase (ss-RUBISCO), figwort mosaic virus (FMV), CaMV derived AS4, tobacco RB7, wheat POX1, tobacco EIF-4, lectin protein (Le1), or corn RC2 promoter.

Translational enhancers may also be incorporated as part of the recombinant vector. Thus the recombinant vector may preferably contain one or more 5' non-translated leader sequences which serve to enhance expression of the nucleic acid sequence. Such enhancer sequences may be desirable to increase or alter the translational efficiency of the resultant mRNA. Preferred 5' nucleic acid sequences include dSSU 5', PetHSP70 5', and GmHSP17.9 5'.

The recombinant vector may further comprise a nucleic acid sequence encoding a transit peptide. This peptide may be useful for directing a protein to the extracellular space, a chloroplast, or to some other compartment inside or outside of the cell (see, e.g., European Patent Application Publication Number 0218571, herein incorporated by reference).

The transcribable polynucleotide sequence in the recombinant vector may comprise introns. The introns may be heterologous with respect to the transcribable polynucleotide sequence. Preferred introns include the corn actin intron and the corn HSP70 intron.

In addition, constructs may include additional regulatory polynucleotide molecules from the 3'-untranslated region (3' UTR) of plant genes (e.g., a 3' UTR to increase mRNA stability of the mRNA, such as the PI-II termination region of potato or the octopine or nopaline synthase 3' termination regions). A 3' non-translated region typically provides a transcriptional termination signal, and a polyadenylation signal which functions in plants to cause the addition of adenylate nucleotides to the 3' end of the mRNA. These may be obtained from the 3' regions to the nopaline synthase (nos) coding sequence, the soybean 7Sα storage protein coding sequence, the albumin coding sequence, and the pea ssRUBISCO E9 coding sequence. Particularly preferred 3' nucleic acid sequences include nos 3', E9 3', ADR12 3', 7Sα 3', 11S 3', and albumin 3'. Typically, nucleic acid sequences located a few hundred base pairs downstream of the polyadenylation site serve to terminate transcription. These regions are required for efficient polyadenylation of transcribed mRNA. These additional downstream regulatory polynucleotide molecules may be derived from a source that is native or heterologous with respect to the other elements present on the construct.

Transcribable Polynucleotides in the Construct

The promoter in the recombinant vector is preferably operably linked to a transcribable polynucleotide sequence. Exemplary transcribable polynucleotide sequences, and modified forms thereof, are described in detail above. The promoter of the present invention may be operably linked to a transcribable polynucleotide sequence that is heterologous with respect to the promoter. In one aspect, the transcribable polynucleotide sequence may generally be any nucleic acid sequence for which an increased level of transcription is desired. The transcribable polynucleotide sequence preferably encodes a polypeptide that is suitable for incorporation into the diet of a human or an animal. Suitable transcribable polynucleotide sequences include those encoding a yield protein, a stress resistance protein, a developmental control protein, a tissue differentiation protein, a meristem protein, an environmentally responsive protein, a senescence protein, a hormone responsive protein, an abscission protein, a source protein, a sink protein, a flower control protein, a seed protein, an herbicide resistance protein, a disease resistance protein, a fatty acid biosynthetic enzyme, a tocopherol biosynthetic enzyme, an amino acid biosynthetic enzyme, and an insecticidal protein.

Alternatively, the promoter and transcribable polynucleotide sequence may be designed to down-regulate a specific nucleic acid sequence. This is typically accomplished by linking the promoter to a transcribable polynucleotide sequence that is oriented in the antisense direction. One of ordinary skill in the art is familiar with such antisense technology. Using such an approach, a cellular nucleic acid sequence is effectively down regulated as the subsequent steps of translation are disrupted. Nucleic acid sequences may be negatively regulated in this manner.

Methods are known in the art for constructing and introducing constructs into a cell in such a manner that the transcribable polynucleotide molecule is transcribed into a molecule that is capable of causing gene suppression. For example, posttranscriptional gene suppression using a construct with an anti-sense oriented transcribable polynucleotide molecule to regulate gene expression in plant cells is disclosed in U.S. Pat. No. 5,107,065 and U.S. Pat. No. 5,759,829; posttranscriptional gene suppression using a construct with a sense-oriented transcribable polynucleotide molecule to regulate gene expression in plants is disclosed in U.S. Pat. No. 5,283,184 and U.S. Pat. No. 5,231,020, all of which are hereby incorporated by reference.

Thus, one embodiment of the invention is a construct comprising a regulatory element such as provided in SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof, operably linked to a transcribable polynucleotide molecule so as to modulate transcription of said transcribable polynucleotide molecule at a desired level or in a desired tissue or developmental pattern upon introduction of said construct into a plant cell. In one embodiment, the transcribable polynucleotide molecule comprises a protein-coding region of a gene, and the regulatory element affects the transcription of a functional mRNA molecule that is translated and expressed as a protein product. In another embodiment, the transcribable polynucleotide molecule comprises an antisense region of a gene, and the regulatory element affects the transcription of an antisense RNA molecule or other similar inhibitory RNA in order to inhibit expression of a specific RNA molecule of interest in a target host cell.

Exemplary transcribable polynucleotide molecules for incorporation into constructs of the present invention include, for example, polynucleotide molecules or genes from a species other than the target species or genes that originate with or are present in the same species, but are incorporated into recipient cells by genetic engineering methods rather than classical reproduction or breeding techniques. The type of polynucleotide molecule can include but is not limited to a polynucleotide molecule that is already present in the plant cell, a polynucleotide molecule from another plant, a polynucleotide molecule from a different organism, or a polynucleotide molecule generated externally, such as a polynucleotide molecule containing an antisense message of a gene, or a polynucleotide molecule encoding an artificial, synthetic, or otherwise modified version of a transgene.

The constructs of this invention comprising a regulatory element identified or isolated from Zea mays may further comprise one or more transcribable polynucleotide molecules. In one embodiment of the invention, a polynucleotide molecule as shown in SEQ ID NO: 17666, or nucleotides 2281 through 2325 of SEQ ID NO: 17666, or nucleotides 1553 through 2280 of SEQ ID NO: 17666; or any complement thereof, or any fragment thereof, or any cis element thereof, comprising regulatory elements such as promoters, leaders or enhancers, is incorporated into a construct such that a polynucleotide molecule of the present invention is operably linked to a transcribable polynucleotide molecule that is a selectable marker or a gene of agronomic interest.

The gene regulatory elements of the present invention can be incorporated into a construct using selectable markers and tested in transient or stable plant analyses to provide an indication of the regulatory element's gene expression pattern in stable transgenic plants. Current methods of generating transgenic plants employ a selectable marker gene which is transferred along with any other genes of interest usually on the same DNA molecule. The presence of a suitable marker is necessary to facilitate the detection of genetically modified plant tissue during development.

Thus, in one embodiment of the invention, a polynucleotide molecule of the present invention as shown in SEQ ID NO: 17666, or nucleotides 1553 through 2280 of SEQ ID NO: 17666, or nucleotides 2281 through 2325 of SEQ ID NO: 17666; or any complement thereof, or any fragment thereof, or any cis element thereof is incorporated into a polynucleotide construct such that a polynucleotide molecule of the present invention is operably linked to a transcribable polynucleotide molecule that provides for a selectable, screenable, or scorable marker. The constructs containing the regulatory elements operably linked to a marker gene may be delivered to the tissues and the tissues analyzed by the appropriate mechanism, depending on the marker. The quantitative or qualitative analyses are used as a tool to evaluate the potential expression profile of a regulatory element when operatively linked to a gene of agronomic interest in stable plants. Any marker gene, described above, may be used in a transient assay.

Methods of testing for marker gene expression in transient assays are known to those of skill in the art. Transient expression of marker genes has been reported using a variety of plants, tissues, and DNA delivery systems. For example, types of transient analyses can include but are not limited to direct gene delivery via electroporation or particle bombardment of tissues in any transient plant assay using any plant species of interest. Such transient systems would include but are not limited to electroporation of protoplasts from a variety of tissue sources or particle bombardment of specific tissues of interest. The present invention encompasses the use of any transient expression system to evaluate regulatory elements operably linked to any transcribable polynucleotide molecule, including but not limited to marker genes or genes of agronomic interest. Examples of plant tissues envisioned to test in transients via an appropriate delivery system would include but are not limited to leaf base tissues, callus, cotyledons, roots, endosperm, embryos, floral tissue, pollen, and epidermal tissue.

Transformation

The invention is also directed to a method of producing transformed cells and plants which comprise, in a 5' to 3' orientation, a gene expression regulatory element operably linked to a heterologous transcribable polynucleotide sequence. Other sequences may also be introduced into the cell, including 3' transcriptional terminators, 3' polyadenylation signals, other translated or untranslated sequences, transit or targeting sequences, selectable markers, enhancers, and operators.

The term "transformation" refers to the introduction of nucleic acid into a recipient host. The term "host" refers to bacteria cells, fungi, animals and animal cells, plants and plant cells, or any plant parts or tissues including protoplasts, calli, roots, tubers, seeds, stems, leaves, seedlings, embryos, and pollen. As used herein, the term "transformed" refers to a cell, tissue, organ, or organism into which has been introduced a foreign polynucleotide molecule, such as a construct. The introduced polynucleotide molecule may be integrated into the genomic DNA of the recipient cell, tissue, organ, or organism such that the introduced polynucleotide molecule is inherited by subsequent progeny. A "transgenic" or "transformed" cell or organism also includes progeny of the cell or organism and progeny produced from a breeding program employing such a transgenic plant as a parent in a cross and exhibiting an altered phenotype resulting from the presence of a foreign polynucleotide molecule. The term "transgenic" refers to an animal, plant, or other organism containing one or more heterologous nucleic acid sequences.

There are many methods for introducing nucleic acids into plant cells. The method generally comprises the steps of selecting a suitable host cell, transforming the host cell with a recombinant vector, and obtaining the transformed host cell. Suitable methods include bacterial infection (e.g. *Agrobacterium*), binary bacterial artificial chromosome vectors, direct delivery of DNA (e.g. via PEG-mediated transformation, desiccation/inhibition-mediated DNA uptake, electroporation, agitation with silicon carbide fibers, and acceleration of DNA coated particles, etc. (reviewed in Potrykus, et al., *Ann. Rev. Plant Physiol. Plant Mol. Biol.*, 42: 205, 1991).

Technology for introduction of DNA into cells is well known to those of skill in the art. Methods and materials for transforming plant cells by introducing a plant polynucleotide construct into a plant genome in the practice of this invention can include any of the well-known and demonstrated methods including:

(1) chemical methods (Graham and Van der Eb, *Virology*, 54(2): 536-539, 1973; Zatloukal, et al., *Ann. N.Y. Acad. Sci.*, 660: 136-153, 1992);

(2) physical methods such as microinjection (Capecchi, *Cell*, 22(2): 479-488, 1980), electroporation (Wong and Neumann, *Biochim. Biophys. Res. Commun.*, 107(2): 584-587, 1982; Fromm et al., *Proc. Natl. Acad. Sci. USA*, 82(17): 5824-5828, 1985; U.S. Pat. No. 5,384,253, herein incorporated by reference) particle acceleration (Johnston and Tang, *Methods Cell Biol.*, 43(A): 353-365, 1994; Fynan et al., *Proc. Natl. Acad. Sci. USA*, 90(24): 11478-11482, 1993) and microprojectile bombardment (as illustrated in U.S. Pat. Nos. 5,015,580; U.S. Pat. No. 5,550,318; U.S. Pat. No. 5,538,880; U.S. Pat. No. 6,160,208; U.S. Pat. No. 6,399,861; and U.S. Pat. No. 6,403,865, all of which are herein incorporated by reference);

(3) viral vectors (Clapp, *Clin. Perinatol.*, 20(1): 155-168, 1993; Lu, et al., *J. Exp. Med.*, 178(6): 2089-2096, 1993; Eglitis and Anderson, *Biotechniques*, 6(7): 608-614, 1988);

(4) receptor-mediated mechanisms (Curiel et al., *Hum. Gen. Ther.*, 3(2):147-154, 1992; Wagner, et al., *Proc. Natl. Acad. Sci. USA*, 89(13): 6099-6103, 1992), and (5) bacterial mediated mechanisms such as *Agrobacterium*-mediated transformation (as illustrated in U.S. Pat. No. 5,824,877; U.S. Pat. No. 5,591,616; U.S. Pat. No. 5,981,840; and U.S. Pat. No. 6,384,301, all of which are herein incorporated by reference);

(6) Nucleic acids can be directly introduced into pollen by directly injecting a plant's reproductive organs (Zhou, et al., *Methods in Enzymology*, 101: 433, 1983; Hess, *Intern Rev. Cytol.*, 107: 367, 1987; Luo, et al., *Plant Mol. Biol. Reporter*, 6: 165, 1988; Pena, et al., *Nature*, 325: 274, 1987).

(7) Protoplast transformation, as illustrated in U.S. Pat. No. 5,508,184 (herein incorporated by reference).

(8) The nucleic acids may also be injected into immature embryos (Neuhaus, et al., *Theor. Appl. Genet.*, 75: 30, 1987).

Any of the above described methods may be utilized to transform a host cell with one or more gene regulatory elements of the present invention and one or more transcribable polynucleotide molecules. Host cells may be any cell or organism such as a plant cell, algae cell, algae, fungal cell, fungi, bacterial cell, or insect cell. Preferred hosts and transformants include cells from: plants, *Aspergillus*, yeasts, insects, bacteria and algae.

The prokaryotic transformed cell or organism is preferably a bacterial cell, even more preferably an *Agrobacterium*, *Bacillus*, *Escherichia*, *Pseudomonas* cell, and most preferably is an *Escherichia coli* cell. Alternatively, the transformed organism is preferably a yeast or fungal cell. The yeast cell is preferably a *Saccharomyces cerevisiae*, *Schizosaccharomyces pombe*, or *Pichia pastoris*. Methods to transform such cells or organisms are known in the art (EP 0238023; Yelton et al., *Proc. Natl. Acad. Sci.* (U.S.A.), 81:1470-1474 (1984); Malardier et al., *Gene*, 78:147-156 (1989); Becker and Guarente, In: Abelson and Simon (eds.,), *Guide to Yeast Genetics and Molecular Biology, Methods Enzymol.*, Vol. 194, pp. 182-187, Academic Press, Inc., New York; Ito et al., *J. Bacteriology*, 153:163 (1983); Hinnen et al., *Proc. Natl. Acad. Sci.* (*U.S.A.*), 75:1920 (1978); Bennett and LaSure (eds.), *More Gene Manipulations in Fungi*, Academic Press, CA (1991)). Methods to produce proteins of the present invention from such organisms are also known (Kudla et al., *EMBO*, 9:1355-1364 (1990); Jarai and Buxton, *Current Genetics*, 26:2238-2244 (1994); Verdier, *Yeast*, 6:271-297 (1990); MacKenzie et al., *Journal of Gen. Microbiol.*, 139: 2295-2307 (1993); Hartl et al., *TIBS*, 19:20-25 (1994); Bergeron et al., *TIBS*, 19:124-128 (1994); Demolder et al., *J. Biotechnology*, 32:179-189 (1994); Craig, *Science*, 260: 1902-1903 (1993); Gething and Sambrook, *Nature*, 355:33-45 (1992); Puig and Gilbert, *J. Biol. Chem.*, 269:7764-7771 (1994); Wang and Tsou, *FASEB Journal*, 7:1515-1517 (9193); Robinson et al., *Bio/Technology*, 1:381-384 (1994); Enderlin and Ogrydziak, *Yeast*, 10:67-79 (1994); Fuller et al., *Proc. Natl. Acad. Sci.* (U.S.A.), 86:1434-1438 (1989); Julius et al., *Cell*, 37:1075-1089 (1984); Julius et al., *Cell*, 32:839-852 (1983)).

Another preferred embodiment of the present invention is the transformation of a plant cell. A plant transformation construct comprising a regulatory element of the present invention may be introduced into plants by any plant transformation method.

Methods for transforming dicotyledons, primarily by use of *Agrobacterium tumefaciens* and obtaining transgenic plants have been published for cotton (U.S. Pat. No. 5,004,863; U.S. Pat. No. 5,159,135; U.S. Pat. No. 5,518,908, all of which are herein incorporated by reference); soybean (U.S. Pat. No. 5,569,834; U.S. Pat. No. 5,416,011, all of which are herein incorporated by reference; McCabe, et al., *Biotechnolgy*, 6: 923, 1988; Christou et al., *Plant Physiol.* 87:671-674 (1988)); *Brassica* (U.S. Pat. No. 5,463,174, herein incorporated by reference); peanut (Cheng et al., *Plant Cell Rep.* 15:653-657 (1996), McKently et al., *Plant Cell Rep.* 14:699-703 (1995)); papaya; and pea (Grant et al., *Plant Cell Rep.* 15:254-258 (1995)).

Transformation of monocotyledons using electroporation, particle bombardment and *Agrobacterium* have also been reported. Transformation and plant regeneration have been achieved in asparagus (Bytebier et al., *Proc. Natl. Acad. Sci.* (USA) 84:5354 (1987)); barley (Wan and Lemaux, Plant Physiol 104:37 (1994)); maize (Rhodes et al., *Science* 240: 204 (1988); Gordon-Kamm et al., *Plant Cell* 2:603-618 (1990); Fromm et al., *Bio/Technology* 8:833 (1990); Koziel et al., *Bio/Technology* 11:194 (1993); Armstrong et al., *Crop Science* 35:550-557 (1995)); oat (Somers et al., *Bio/Technology* 10:1589 (1992)); orchard grass (Horn et al., *Plant Cell Rep.* 7:469 (1988)); corn (Toriyama et al., *Theor Appl. Genet.* 205:34 (1986); Part et al., *Plant Mol. Biol.* 32:1135-1148 (1996); Abedinia et al., *Aust. J. Plant Physiol.* 24:133-141 (1997); Zhang and Wu, *Theor. Appl. Genet.* 76:835 (1988); Zhang et al., *Plant Cell Rep.* 7:379 (1988); Battraw and Hall, *Plant Sci.* 86:191-202 (1992); Christou et al., *Bio/Technology* 9:957 (1991)); rye (De la Pena et al., *Nature* 325:274 (1987)); sugarcane (Bower and Birch, *Plant J.* 2:409 (1992)); tall fescue (Wang et al., *Bio/Technology* 10:691 (1992)) and wheat (Vasil et al., *Bio/Technology* 10:667 (1992); U.S. Pat. No. 5,631,152, herein incorporated by reference).

The regeneration, development, and cultivation of plants from transformed plant protoplast or explants is well taught in the art (Weissbach and Weissbach, *Methods for Plant Molecular Biology*, (Eds.), Academic Press, Inc., San Diego, Calif., 1988; Horsch et al., *Science*, 227: 1229-1231, 1985). In this method, transformants are generally cultured in the presence of a selective media which selects for the successfully transformed cells and induces the regeneration of plant shoots (Fraley et al., *Proc. Natl. Acad. Sci. U.S.A.*, 80: 4803, 1983). These shoots are typically obtained within two to four months.

The shoots are then transferred to an appropriate root-inducing medium containing the selective agent and an antibiotic to prevent bacterial growth. Many of the shoots will develop roots. These are then transplanted to soil or other media to allow the continued development of roots. The method, as outlined, will generally vary depending on the particular plant strain employed.

The regenerated transgenic plants are self-pollinated to provide homozygous transgenic plants. Alternatively, pollen obtained from the regenerated transgenic plants may be crossed with non-transgenic plants, preferably inbred lines of agronomically important species. Conversely, pollen from non-transgenic plants may be used to pollinate the regenerated transgenic plants.

The transformed plants are analyzed for the presence of the genes of interest and the expression level and/or profile conferred by the regulatory elements of the present invention. Those of skill in the art are aware of the numerous methods available for the analysis of transformed plants. For example, methods for plant analysis include, but are not limited to Southern blots or northern blots, PCR-based approaches, biochemical analyses, phenotypic screening methods, field evaluations, and immunodiagnostic assays.

The seeds of the plants of this invention can be harvested from fertile transgenic plants and be used to grow progeny generations of transformed plants of this invention including hybrid plant lines comprising the construct of this invention and expressing a gene of agronomic interest. The present invention also provides for parts of the plants of the present invention. Plant parts, without limitation, include seed, endosperm, ovule and pollen. In a particularly preferred embodiment of the present invention, the plant part is a seed. The invention also includes and provides transformed plant cells which comprise a nucleic acid molecule of the present invention.

The transgenic plant may pass along the transformed nucleic acid sequence to its progeny. The transgenic plant is preferably homozygous for the transformed nucleic acid sequence and transmits that sequence to all of its offspring upon as a result of sexual reproduction. Progeny may be grown from seeds produced by the transgenic plant. These additional plants may then be self-pollinated to generate a true breeding line of plants. The progeny from these plants are evaluated, among other things, for gene expression. The gene expression may be detected by several common methods such as western blotting, northern blotting, immunoprecipitation, and ELISA.

Having now generally described the invention, the same will be more readily understood through reference to the following examples which are provided by way of illustration, and are not intended to be limiting of the present invention, unless specified.

Each periodical, patent, and other document or reference cited herein is herein incorporated by reference in its entirety.

The following examples are included to demonstrate preferred embodiments of the invention. It should be appreciated by those of skill in the art that the techniques disclosed in the examples that follow represent techniques discovered by the inventors to function well in the practice of the invention. However, those of skill in the art should, in light of the present disclosure, appreciate that many changes can be made in the specific embodiments that are disclosed and still obtain a like or similar result without departing from the spirit and scope of the invention, therefore all matter set forth or shown in the accompanying drawings is to be interpreted as illustrative and not in a limiting sense.

EXAMPLES

Example 1

Identification and Cloning of Regulatory Elements

Regulatory elements were isolated from *Zea mays* genomic DNA. All regulatory elements were sub-cloned into a plant transformation vector operably linking the regulatory elements to the *Zea mays* HSP70 intron (described in U.S. Pat. No. 5,424,412, which is incorporated herein by reference), the coding region for β-glucuronidase (GUS described in U.S. Pat. No. 5,599,670, which is incorporated herein by reference), and the *Agrobacterium tumefaciens* NOS gene terminator.

Variants of different promoters, leaders and enhancers, isolated from *Zea mays* genes expressing in leaf tissues, were assembled in novel combinations and cloned using techniques well known to those skilled in the art. Specifically, regulator elements were identified from the following genes: fructose 1-6 bisphosphate aldolase (FDA), pyruvate orthophosphate dikinase (PPDK), and ribulose bisphosphate carboxylase activase (RUA).

A 728 nt variant of the RUA gene promoter regulatory element (P-Zm.RUA-1:1:1) and a 45 nt variant of the RUA gene leader (L-Zm.RUA-1:1:1) were isolated from *Zea mays* genomic DNA using sequence specific primers and PCR amplification methods. The elements may be inserted into a vector using any cloning method known to those in the art (e.g., endonuclease mediated cloning, LIC) to make pMON79203 (FIG. 1) comprising nucleotides 1553 through 2280 of SEQ ID NO: 17666 (promoter molecule sequence) and nucleotides 2281 through 2325 of SEQ ID NO: 17666 (leader molecule sequence).

The present invention thus provides polynucleotide molecules having gene regulatory activity (regulatory elements) and polynucleotide constructs comprising the regulatory elements operably linked to a transcribable polynucleotide molecule.

Example 2

Plant Transformation and GUS Analysis

Corn plants were transformed with plant expression constructs for histochemical GUS analysis in plants. Plants were transformed using methods known to those skilled in the art. Particle bombardment of corn H99 immature zygotic embryos may be used to produce transgenic maize plants. Ears of maize H99 plants are collected 10-13 days after pollination from greenhouse grown plants and sterilized. Immature zygotic embryos of 1.2-1.5 mm are excised from the ear and incubated at 28° C. in the dark for 3-5 days before use as target tissue for bombardment. DNA comprising an isolated expression cassette containing the selectable marker for kanamycin resistance (NPTII gene) and the screenable marker for β-D-Glucuronidase (GUS gene) is gel purified and used to coat 0.6 micron gold particles (Catalog #165-2262 Bio-Rad, Hercules, Calif.) for bombardment. Macro-carriers are loaded with the DNA-coated gold particles (Catalog #165-2335 Bio-Rad, Hercules Calif.). The embryos are transferred onto osmotic medium scutellum side up. A PDS1000/He biolistic gun is used for transformation (Catalog #165-2257 Bio-Rad, Hercules Calif.). Bombarded immature embryos are cultured and transgenic calli are selected and transferred to shoot formation medium. Transgenic corn plants are regenerated from the transgenic calli and transferred to the greenhouse.

GUS activity is qualitatively and quantitatively measured using methods known to those skilled in the art. Plant tissue samples are collected from the same tissue for both the qualitative and quantitative assays. For qualitative analysis, whole tissue sections are incubated with the GUS staining solution X-Gluc (5-bromo-4-chloro-3-indolyl-β-glucuronide) (1 milligram/milliliter) for an appropriate length of time, rinsed, and visually inspected for blue coloration. For quantitative analysis, total protein is first extracted from each tissue sample. One microgram of total protein is used in a with the fluorogenic substrate 4-methyleumbelliferyl-β-D-glucuronide (MUG) in a total reaction volume of 50 µl (microliters). The reaction product 4-methlyumbelliferone (4-MU) is maximally fluorescent at high pH, where the hydroxyl group is ionized. Addition of a basic solution of sodium carbonate simultaneously stops the assay and adjusts the pH for quantifying the fluorescent product. Fluorescence is measured with excitation at 365 nm, emission at 445 nm using a Fluoromax-3 with Micromax Reader, with slit width set at excitation 2 nm and emission 3 nm. The GUS activity is expressed as pmole of 4-MU/micrograms of protein/hour (pMole of 4-MU/μg protein/hour).

Example 3

RUA Regulatory Element Analysis in Stable Transgenic Corn Plants

Figure 2A:
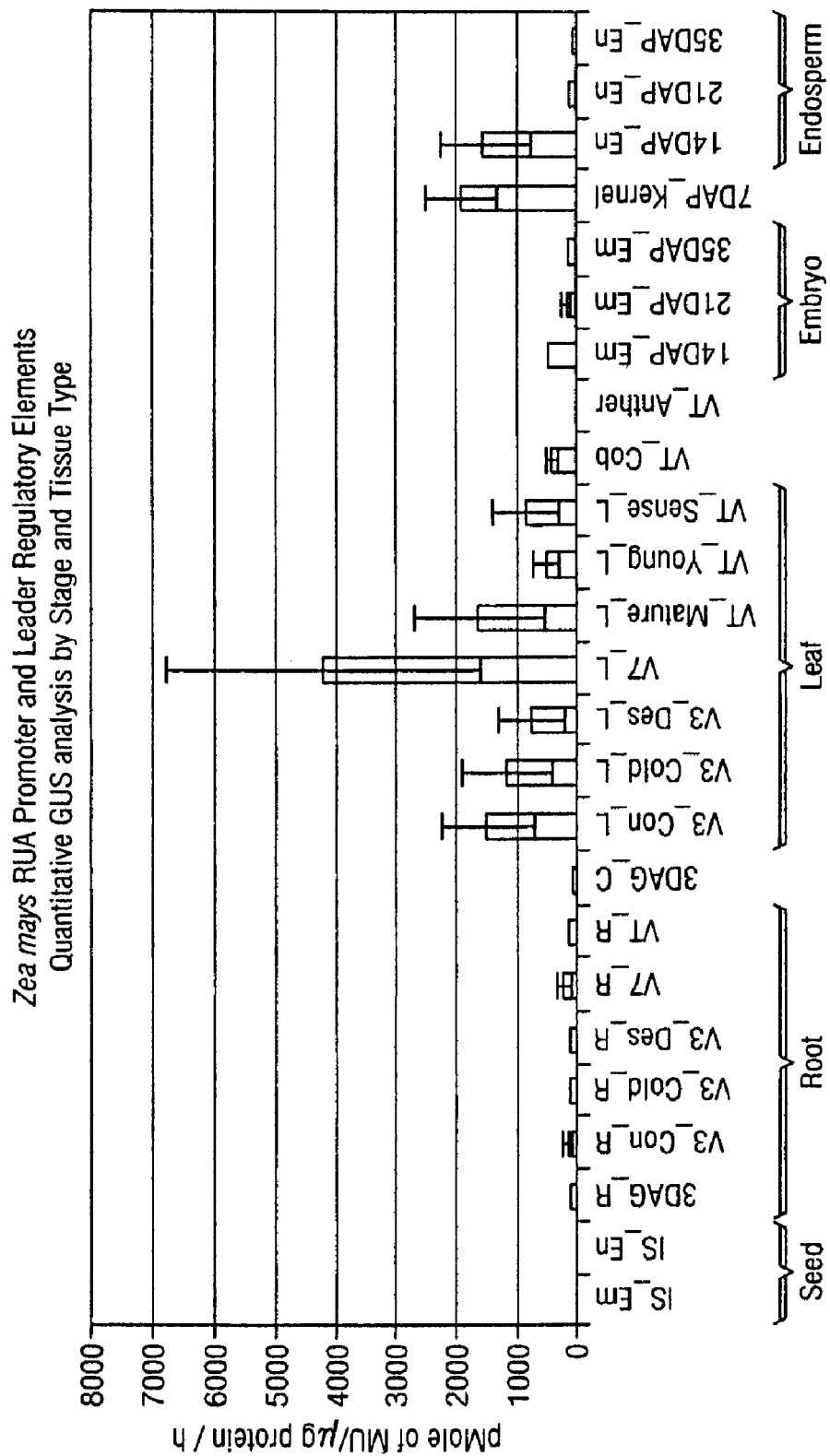
FIG. 2A: A graph that shows the activity of *Zea mays* RUA promoter and leader regulatory elements using quantative GUS analysis in the indicated stage and tissue type.

Corn plants representing ten F1 events transformed with pMON79203 comprising nucleotides 1553 through 2280 of SEQ ID NO: 17666 (promoter molecule sequence) and nucleotides 2281 through 2325 of SEQ ID NO: 17666 (leader molecule sequence) operably linked to the GUS coding region were analyzed for GUS activity as described above. Mean levels of GUS activity (pMole of MU/ug protein/hour) for each stage of plant development and organ tested are provided as mean GUS activity +/− standard error (SE) measurements, in FIG. 2A, 2B. Specific cell types for which GUS expression was noted are provided in FIG. 3.

High level of GUS activity was observed in leaf. The level of activity was highest at the V3 stage and declined at the V7 and VT stages. Expression was observed in primordial organs like cob and tassel primordia at VT and V7 stage. Lower GUS activity was observed in anther, silk, root, seed and embryo at different developmental stages tested. Histochemical localization of GUS activity in leaf at different developmental stages revealed expression of GUS in cell types such as mesophyll, bundle sheath, epidermis and vascular bundle, but most prominent GUS staining was observed in bundle sheath cells. This promoter would thus be useful for expressing coding regions in these identified tissues at these identified specific developmental stages. In particular, the RUA promoter, as disclosed in SEQ ID NO: 17666, and more specifically nucleotides 1553-2280 of SEQ ID NO: 17666, or nucleotides 2281 through 2325 of SEQ ID NO: 17666, would be useful for regulating the expression of genes in bundle sheath cells in leaf tissue.

The present invention thus provides polynucleotide constructs comprising regulatory elements that can modulate expression of an operably linked transcribable polynucleotide molecule and a transgenic plant stably transformed with the polynucleotide construct. In particular, the present invention provides chimeric gene expression regulatory elements with novel expression patterns in a wider range of cell types than seen with any of the individual components.

From the examples given, the present invention thus provides chimeric regulatory elements from Zea mays, that are useful for modulating the expression of an operably linked transcribable polynucleotide molecule. The present invention also provides a method for assembling polynucleotide constructs comprising the isolated regulatory elements and isolated promoter fragments, and for creating a transgenic plant stably transformed with the polynucleotide construct.

Having illustrated and described the principles of the present invention, it should be apparent to persons skilled in the art that the invention can be modified in arrangement and detail without departing from such principles. We claim all modifications that are within the spirit and scope of the appended claims. All patent documents cited in this specification are incorporated herein by reference to the same extent as if each individual was specifically and individually indicated to be incorporated by reference.

SEQUENCE LISTING (25043 sequences)

SEQ ID NO: 1 - DNA, 2383 bp, Zea mays
  misc_feature (2040)..(2040): n is a, c, g, or t
  misc_feature (2135)..(2135): n is a, c, g, or t
gggttattattgtccttttggtttaacctaggcatgcatgttcattttctcatggaggagcagccatacgtacgtggatataattttttttcagatgaatacccatacggcggcatacgtcccgtgctgccgctgctgcagtgagatttgacgcgagaaaagaggtcgccaccagccagccatccacattccgattccacacagggccggcagtagtgcacagtgcagccgctgctgctctgccctctacggctacgagtgcgaggagccgaggacacctttccctttcccttccacctcccctcccctcccctcccccccgcccggggttcccattaatatctagccgcctctccccccgtctcttctcctcctccaaaactgtgagcgagaggcagggagtgcgctcgacggccgccgccattagtgatttagtgttgagagagggagagaatctaaagtgaccggacgctgtccttccttgctgatcggcgacacggtccatccctccctcgctcgctagggttccttttcgtccatggatcagagcttcgggaatctcggggccggagctgggagcagcagcgggggctccaactccaaggcggcggcagccgccgtgtcctcctcgtctttcctgcagctgccgctgtcgacggcgtcccccgcgtactacggcgcgccgctcgcgctcctgcaccacgccgccgcggccccgtcgtcgtcgcagcagcaccagcagcagcagcaccaccaccactacgccaggcacggcgccgagatgtcggcagcggaggccgaggccatcaaggccaagatcgtggcgcacccgcagtactcggcgctcctcgccgcctacctcgactgccagaaagtgggcgcgccgccggacgtgctggagaggctgacggccatggcggcaaagctggacgcgcgcccgccgggccgccacgagccgcgcgacccggagctggaccagttcatggaggcgtactgtaacatgctcgtcaagtaccgggaggagctcacccggccgatcgacgaggccatggagttcctcaagcgggtggaggcgcagctcgactgcatctccggcggcggcggctcctcctcagcgcgcctctcgctcgccgatggtaaatcagaaggtgttggctcttctgaagatgacatggacccgaatggtcgcgagaacgatccgccggagattgacccacgagcggaggacaaggagctcaagtaccagctgctgaagaagtacagtggctacctgagcagcctcaggcaggagttttccaagaagaagaagaaagggaagctcccaaaggaggccaggcagaaactcctccactggtgggagctgcactacaagtggccgtacccttcagagacggagaagattgcgctcgcagaatcaacgggcctagaccagaagcagatcaacaactggttcatcaaccagaggaaacggcactggaagccgtcggaggacatgcctttcgtgatgatggaaggcttccacccgcagaacgccgctgctctgtacatggacgggccgttcatggccgacggcatgtatcgcctcggttcatgaactacacttccatggacgactgtgtggggcctatatatccaatcgtcggaccgtgggagtatatttcagtgtaccaggaccaggatgcgttgcagtgcaaggacattgttgtggaatttttgttgctgattgccaaggggtgggtcggtcgatgtagcgtctatgcatggcttgtagttctcctgtaatgttgttgttaatttccgcttggcggcttgtaatcttaggtgtatctggaacttgaatcctgggtgattaatccggcaagcagctgcctgtttgtatgattgtatggttcgggttggtggaacatgatgcatgctaaggcgtggcctgtctggatcaaaaaaagatgtcttttgtccagcaaaaaaaaaaaaaaagcagactgctgaacatttccgatctacattcacttgtttgtttgaagctctgaagatccaganagtcgacagcgtttatgcatgttgtagtgctgccgtttcattcgtggatctggtgtagtggtaccatctatgttcgtcagctttcttgtgaacanagttgttggctgctgaatgctgatagcatgtggatagatggcaagggggcatggggcaaatggattttcaaaggcagtagggtcctgacgagagagcatcagagagggaacattgcatatatttcatggtggcagtagcgcagtacctctgcaacgagctaggtggatggaacagtgtcccgatcatggcgaccatgtacaagatccctctccgctccggcaatcactggcgctgctgcaggcatgca

SEQ ID NO: 2 - DNA, 1437 bp, Zea mays
gttcccattaatatctagccgcctctccccccgtctcttctcctccaaaactgtgagcgagaagcagggagtgcgctcgacggccgccgccattagtgatttagtgttgaagagggagagaatctaaagtgaccggacgctgtccttccttgctgatcggcgacacggtccatccctccctcgctcgctagggttccttttcgtccatggatcagagcttcgggaatctcggggccggagctgggagcagcagcgggggctccaactccaaggcggcggcagccgccgtgtcctcctcgtctttcctgcagctgccgctgtcgacggcgtcccccgcgtactacggcgcgccgctcgcgcttctgcaccacgccgccgcggccccgtcgtcgtcgcagcagcagcagcagcaccaccaccaccagtacgccaggcacggcgccgagatgtcggcggcggaggccgaggccatcaaggccaagatcgtggcgcacccgcagtactcggcgctcctcgccgcctacctcgactgccagaaagtacttcgcttgagctaccccgaccccggctggcgtcaccggccgtcggaaaaaccgcatctttatttttatatcttgattcgtgaagcgagatttgcttaatttgatgcgtaaatctatccacgcctgtcgcgtcctcacgctcaccctcacagtcacaggacagcacggtggctatgaaatgatgcgcgcgctgtgtctgtgtgattgcaggtgggcgcgccgccggacgtgctggagaggctgacggccatggcggcaaagctggacgcgcgcccgccgggccgccacgagccgcgcgacccggagctggaccagttcatggtcggttcccatgatcccgtccccgttcatcaatccacacagcctgctcgagtctaacctattttcatctctctcttccaatcccacgcatgattgctcgcgtgcaggaggcgtactgtaacatgctcgtcaagtaccgggaggagctcacccggccgatcgacgaggccatggagttcctcaagcgggtggaggcgcagctcgactgcatctccggcggcggcggctcctcctcagcgcgcctctcgctcgccggtaagatagatggaccgaccgaccgatcggggtcgtcttgctgctcgatccctcctccttccgctctcgccggcaccgctcgtacatggcatggcggcggtacgtacggcggccgcgtgtttttatatcgccacaaccacacatactaggatgaggattgccgcattgggaatggctgctttctagatagtgggggtggatgtggatcattgccattgtgagctagtagctaacctgcacctgcccgcccttctgacccttccctcgccattactttaatcacatcctcctaattaaaaaaatccaattaaccaccaat

SEQ ID NO: 3 - DNA, 1387 bp, Zea mays
cattgggtacctcgaggccggccgtcggcagggtcacagtccctacaacggcgtcgatttcccgggctccatccccaccggaaggttcagcaacggctacaacatcgccgactacgtcgcaaagagcatgggattcgcgtgcagccctcctccctacctgtcgctggcacaggcaccggcaccggcacagagctccggccctggcctggcccagacggctctcaccattggcatcaactatgcttctggaggagcaggcatccttgactccactaacgccgggaacacgatcccgttgtcggaggaggtgaagtacttcggcgccaccaaggccaagatggtcgccgcagcgggccccagcgcggtgaacccactgatctccaggtccatcttcctcatcggcatgggcaacaacgacctgtacgtcttcggggcttcggagcgggcgcggaacaggtcagacgcagagcagcggagggacgccgccgccgcgctctacgccagcctcgtctccaactactccgccgccgtgacggagctgtactcgttgggcgccaggaagttcgccgtcatcaacgtgtggccgctaggatgcgtgccgggggagcgcgtgctcagcccgacgggcgcgtgctccggcgtcctcaacgacgtcgccggcggcttcaacgacgccctgcgctccctgctcgtcggcctcgccgagaggctgccgggcctcgtctacgccctcgccgactccttcggcttcacgctggacgtcctggcggacccgcgcgcgtcagggtacaccgacgtcgcaagcacgtgctgcggcggcgggcggcggctgggcgcggaggcctggtgcacgcgcagctccacgctctgcgtcgaccgtgaccgccatgtcttctgggaccgtgtccatccgtcccagcggactgcgtttctcttggcgcaagcgttctacgacggaccgcccaagtacaccactcctatcaacttcatgcagctcgcccactcaagctagtgatgatatggttcatgcatatctgatactacttaacaatacatcggtcactttgtagagaaagggcgcgccgcctgctactagcagagaaaggcaattattagccgttaatataagggcctatgtgttcacgaccgacataatcttgggtgtcatccagcatagccactttccaccgaatcggccagaccggatttgcaaatgttatcaaatcttataatttgagttcaacattgtgttccctttatcattatgttggtccctcttgcccctaccactgctcctacagtgcacatagactgcagtaggatatgacctcagtctatagtcatatcaacttttctatttcagaattaacttatttcagaattaact

SEQ ID NO: 4 - DNA, 1710 bp, Zea mays
ttttccttttcccttccacctccccttgggtccctcgaggccggccggggttcccattaatatctagccgcctctccccccgtctcttctcctcaaaaactgtgagcgagaagcagggagtgcgctcgacggccgccgccattagtgatttagtgttgaagagggagagaatctaaagtgaccggacgctgtccttccttgctgatcggcgacacggtccatccctccctcgctcgctagggttccttttcgtccatggatcagagcttcgggaatctcggggccggagctgggagcagcagcgggggctccaactccaaggcggcggcagccgccgtgtcctcctcgtctttcctgcagctgccgctgtcgacggcgtcccccgcgtactacggcgcgccgctcgcgcttctgcaccacgccgccgcggccccgtcgtcgtcgcagcagcagcagcagcaccaccaccaccagtacgccaggcacggcgccgagatgtcggcggcggaggccgaggccatcaaggccaagatcgtggcgcacccgcagtactcggcgctcctcgccgcctacctcgactgccagaaagtgggcgcgccgccggacgtgctggagaggctgacggccatggcggcaaagctggacgcgcgcccgccgggccgccacgagccgcgcgacccggagctggaccagttcatggaggcgtactgtaacatgctcgtcaagtaccgggaggagctcacccggccgatcgacgaggccatggagttcctcaagcgggtggaggcgcagctcgactgcatctccggcggcggcggctcctcctcagcgcgcctctcgctcgccgatggtaaatcagaaggtgttggctcttctgaagatgacatggacccgaatggtcgcgagaacgatccgccggagattgacccacgagcggaggacaaggagctcaagtaccagctgctgaagaagtacagtggctacctgagcagcctcaggcaggagttttccaagaagaagaagaaagggaagctcccaaaggaggccaggcagaaactcctccactggtgggagctgcactacaagtggccgtacccttcagagacggagaagattgcgctcgcagaatcaacgggcctagaccagaagcagatcaacaactggttcatcaaccagaggaaacggcactggaagccatcggaggacatgcctttcgtgatgatggaaggcttccacccgcagaacgccgctgctctgtacatggacgggccgttcatggccgacggcatgtatcgcctcggttcatgaactacacacttccatggacgactgtgggggcctatccaatcgtcggaccgtgggagtatatttcagtgttgcggtgcaaggacattgttgtggaatttttgttgctgattgccaaggggtgggtcggtcgatgtagcgtctatgcatggcttgtagttctcctgtaatgttgttgttaatttccgcttggcggcttgtaatctaggtgtatctctggaacttgaatcctgggtgattaatccggcaagcagctgcctgtttgtatgattgtatggttcgggttggtggaacatgatgcatgctaaggcgtggcctgtctggatcaaaaaaaaagaagatgtcttttgtaccagtggaatgattggaacttcagattgctgaacatttccgatctacattcat

SEQ ID NO: 5 - DNA, 1289 bp, Zea mays
  misc_feature (1288)..(1288): n is a, c, g, or t
ttgttttcttttcttggcttcagaggcgttagattttcggtgcatgataaccctctatttatccatgcattatgctatataatatgtcgatagttccttttaataggccatatatcttttatttatcactatttaggagtattggctgttgttgttgtgaaacttacttttctgatgtgccgatgtgcatatgtttggagcaacatgttttttagttaaaagcaaaactatactggacagtaaagccatcaatacaaagcaacaaatattacgaggggctgtcctatgctcatataattctactttttttaaaaaaaaaaggaactaacactcttttcaaacgagtaaaaaataaattcaaagtatgcagttagttactctgtctcggtagcaaagtgttgaacagtcaaattcctgcttgaattgctctcttgcttggtctgaaaggcatacattttgttgatgaagatggtaacgatttttgtttggtttcagtggacgacgagtacatcatcattgggtccgccaacatcaaccagaggtccatggacggtgccagggactccgagatcgccatgggcgcgtaccagccgtaccacttggcgactaggcagcctgcccggggccagatccatggcttccggatgtctctttggtacgagcacctgggaatgctggaagacgtcttccagcggcccgagagcgtagagtgtgtgcagaaggtgaacgaggtcgccgagaagtactgggacctgtactcgagcgacgacctggagcaggacctcccgggccacctcctcagctacccgatcggtgtcactgccgacggcagcgttaccgagctgcccgggatggagaacttccccgacacccgcgcccgcgtcctcgggaacaagtcggattacctcccgcccatcctcaccacatagagtgcacactgcaggcagcgccatggctgctctcctctctggcctcaccttggtgtccctgtgtttgtgtttgggacactggaggttcagattgcagtgttgatattatatcccccctccgtccagagggattcgacgttattgagtcataataaaatgcattgtgcacggtgggagactgggaggataggaattatagttgtttattacagtacgactgcttactgcatccagattgtgttgtcccttgtctggtgtagcttctgttgcttgctgcgttgcagtgccggaagtgactccagatttcagaacttaaacatgattgcttgttcaaaaaaaaaaaaaaaaaaaggggcggnc

SEQ ID NO: 6 - DNA, 3147 bp, Zea mays
aaggaaacagtacaaatggacacccggggtcccattccatcccaagctcggatctcgctccccgttgctgcgcgccgcgtgcgtgacggtgcggcaccagcacaccactccgtccgcggcgttcctcccagccggccggctggctccctcgggccggccggcttgacttcccacgatttggcttccttttctaccccgcgggccgcggcgcgtagtcttctactctctagctcgccatcaccgtcgtcatcaatcacggtgaccttgccctcgctgcccgactggaaccggacgctgctgctgctggtaggctgacagcgaggaggacgagacgagggggccatggctcagatcttgctccacggcacgctccacgccaccatcttcgaggccgagtcgctctccaacccgcaccgcgccactggcggcgcccccaagttcatccgcaagcttgtggaagggatcgaggacaccgtgggtgtcggcaagggcgccaccaagatatatgccaccgtcgatctcgagaaggcccgtgtcgggcggacccggatgatctccaacgagcccgtgaaccctcgttggtacgagtccttccacatctactgcgcgcacatggccgccgacgtcatcttcaccgtcaagatcgacaaccccatcggggcctcgctcatcgggagggcctacttgcctgtccaggacctcctgggaggggaggagatcgacaagtggcttgaaatctgcgatgaaaagcgtgagcctgttggggacagcaagatccatgtgaagctccagtactttgacgtctgcaaggaccgtaactgggcgaggggtgtccggagcaccaagtaccctggtgtcccttacaccttcttctcgcagaggcaggggtgtaaggttactctgtaccaggacgctcatgtgccggacaactttgttcccaggatccagctcgctgatggcaagaactatgagccgcacaggtgctgggaggatatctttgatgctataagcaaggctcagcatttgatttacatcactggctggtccgtgtacacagagatcaccttggtcagggacaccaacaggccaaaacctggtggtgatgttactcttggggagttgctcaagaggaaggccagtgaaggtgtccgggtgcttatgctggtgtgggatgacaggacttctgtcggcctgcttaagaaggatggcttgatggctacccatgatgaggagactgcaaattacttccatggcacggatgtcaactgtgttctgtgccctcgcaaccctgatgattctggcagctttgtccaggatctgcagatatcaactatgttcacgcaccaccagaagatagtagtagtcgaccatgagatgccgaaccagggatcccagcaaaggaggatagtcagcttcattggtggcattgacctttgtgatggaagatatgatacccagtaccactccttgttcaggacgcttgacactgtccatcacgatgacttccaccagccgaactttgagggtggatcaatcaagaaaggtggcccaagggagccatggcatgatatccactcacggttggaagggccaatcgcttgggatgttctttacaactttgagcagagatggagaaagcagggtggtaaggacctccttgtgcgtctcagggatctttctgacattatcatccccccttctcctgtgatgttcccggaggacagagagacatggaatgttcagctcttcagatccatcgatggtggtgctgcttttggcttccccgagactcccgaggaagctgcaagagctgggcttgtgagtggaaaggatcaaatcatcgaccggagtatccaggatgcatacgtaaacgccatacggagggcgaagaacttcatctacattgagaatcagtacttccttggaagttcatacggctggaagcccgaaggcatcaagccggaagaaatcggtgctcttcacttgattccgaaggagctctcgctgaagattgtcagcaagattgaagctggggagcggtttactgtttatgttgtggtgccaatgtggcctgagggtgttccagaaagcgcttctgttcaggcaatccttgactggcaaaggagaacgatggagatgatgtacactgacatcgcacaagctctcgaagccaacgggattgaagcaaaccccaaggactatctcactttcttctgcttaggtaaccgtgaggtaaagcaggagggagaatatgaaccagaggagcacccagaacctgacactgattacatccgggctcaagaggctaggaggtttatgatctatgttcataccaaaatgatgatagtggacgacgagtacatcatcattgggtccgccaacatcaaccagaggtccatggacggtgccagggactccgagatcgccatgggcgcgtaccagccgtaccacttggcgactaggcagcctgcccggggccagatccatggcttccggatgtctctttggtacgagcacctgggaatgctggaagacgtcttccagcggcccgagagcgtagagtgtgtgcagaaggtgaacgaggtcgccgagaagtactgggacctgtactcgagcgacgacctggagcaggacctcccgggccacctcctcagctacccgatcggtgtcactgccgacggcagcgttaccgagctgcccgggatggagaacttccccgacacccgcgcccgcgtcctcgggaacaagtcggattacctcccgcccatcctcaccacatagagtgcacactgcaggcagcgccatggctgctctcctctctggcctcaccttggtgtccctgtgtttgtgtttgagacactggaggttcagaatgcagtgttgatattttaccccctccggccacatgatttagtcgttttggacggagggagtagacgttattgagtcataataaaatgcaatgtgcacggtgggagactgggaggataggaattatagttgtttattacgactgcttactgcatccagattgtgttgtcccttgtctggtgttgcttctgttgcttgctgcgttgcagtgccggaggtgactccagatttcagaacttaaacatgattgcttgttcaagtgtgtgctgctaaaaa

SEQ ID NO: 7 - DNA, 649 bp, Zea mays
ggaccgtccgtccccgcagctggcggcgacgcgaggaggcagagctcgggcggccagtcgggctcctcgggggtcggggatgccttgccggccccgtcgggcgcggcggcctccatggccctgatactcctgaggaagctgcaagagttgggcgaaagaactgcatctacattgagaatcagtacttccttggaagttcatacggctggaagcacgaaggcatcaaggcgctcgaattcgttgctgtcgaattgattccgaaggagctctccctgaagattatcagcaagattgaagctggggagcggtttactgtttatgttgtggtgccaatgtggcctgagggtgttccagaaagtgcttctgttcaggtaaccgcgaggtgaagcaggatggagaatatgaaccagaggagcacccagaacctgacactgattacatctgggctcaagaggctaggaggtttatgatctatgttcataccaaaatgatgataggtttatgatccgcagttccccccgacctgctctaatttacgtttactaattctttaaacgcagttaaatttactgatacagaatatattttatgttatatgttcacatctgaagataattcattcactttccggaaaaaaaaaaatgacagc

SEQ ID NO: 8 - DNA, 3074 bp, Zea mays
ccacgcgtccgcccgctgccgcctgccggcgtgcgtgacccgggtcccattccatatccggtgccattttttaatactactagtctcgttcgatcggaatcggcctcccgtcttggctgcatttttctatccccgcgtggccgcgtgtagtcctagtctctcgccagcaccatcatcatcaatcacggcggcgaccccgccccgcctcgatcgcccacgctgcccgactggaaccggacgctgctgctgctgctgctaggctgacagcgacgacgagggggccatggctcagatcttgctccacggcacgctccacgccaccatcttcgaggccgagtcgctctccaacccgcaccgcgccaccggcggcgcccccaagttcatccgcaagcttgtggaagggattgaggataccgtgggtatcggcaagggcaccaccaagatatacgccaccgttgatctggagaaggcccgcgtggggcgcacccggatggtctccaacgagcccgtgaaccctcgctggtacgagtccttccacatctactgcgcgcacatggccgccgacgtagtattcaccgtcaagatcgacaaccccatcggggcctcgctcatcgggagggcttacctgcctgtcgaggacatcctgggcggagacgagatcgacaagtggcttgagatatgcgatgagaagcgcgagcctattggggacagcaagatccacgtgaagcttcagtacttcgacgtcggcaaggaccgcaactgggccaggggtgtccggagcaccaagtaccctggtgttccttacaccttcttctcgcagaggcaggggtgcaaggttactctgtaccaggacgctcatgtcccggacaacttcgttcccaggatcccgctcgccgatggcaagaactacgagccacacaggtgctgggaggatatctttgatgccataagcaaggcccagcatctgatttacatcactggctggtccgtgtacaccgagatcaccttggttcgggacaccagcaggccgaaacctggaggcgatgttactcttggggagttgctcaagaggaaggccagcgaaggtgtccgtgtccttatgctagtgtgggatgataggacttcggtcggcttgcttaagaaggatggcttgatggctacccatgatgaggagactgcaaattacttccatggcacggacgtcaactgtgtcctgtgccctcgcaaccctgatgattctggcagctttgtccaggacctgcagatatcaactatgttcacgcaccatcagaagatagtagtggtagaccatgagttgccaaacgagggctcccagcagaggaggatcgtcagcttcgttggcggaattgacctttgtgatggaaggtatgatacccagtatcactccttgtttaggacacttgacactgtccatcatgatgacttccaccagccaaactttgagggtgggtcaatcaagaaaggtggtccgagagagccatggcatgatatccactcacggctggaagggccaattgcttgggatgttctttacaactttgagcagaggtggaggaagcagggtggtaaggacctccttgtacgtctcagggatctttctgacattattattcccccttctcctgtgatgttcccggaggacagagatacctggaatgttcagctctttagatccattgacggcggtgctgcttttggcttccccgagactcctgatgaagctgcaagagctgggcttgtgagtggaaaggatcaaatcatcgaccggagtatccaggatgcatacataaatgccatacggagggcgaagaacttcatctacattgagaatcagtacttccttggaagctcatatgactggaagccggaaggcatcaagccagaagatatcgattgtcttcacttgattccgaaggagctctcattgaagattgtcagcaagattgaggctggggagcggttcactgtttatgttgtggtgccaatgtggcctgagggtgttccagaaagtgcttccgttcaggcaatccttgactggcaaaggagaacaatggatatgatgtacactgacatcacacaagctctcgaagccaatggaatccaagcaaaccccaaggactatctcactttcttctgcttaggtaaccgtgaggtgaagcaggagggagaatatcaacctgaggaacacccagaacctggcactgattacatccgggctcaagaggctaggaggtttatgatctatgttcatgccaaaatgatgatagtggacgatgaatacatcatcattgggtccgccaacatcaaccagaggtccatggacggtgccagggactccgagatagccatgggcgcgtaccagccgtaccacctggcgactaggcagcctgcccgtggccagatccatggcttccggatgtctctttggtacgaacacctggggatgctggacgacgtcttccagcgccccgagagcgtagagtgcgtgcagaaggtgaacaagatcgccgagaagtactgggacctgtactcgagtgatgacctggagcaggacctcccgggccacctcctcagctacccgatcggtgtcactgccgacggcaccgttactgagctgcccgggatggagaacttccctgacacccgtgcccgcgtcctcggcaacaagtcggattacctcccgcccatcctcaccacataggctgcaggctgcaggcagcgccatggcttctctgtttgtgtttgagatactgaaagttcagatagcagtgtttttatagttattgagtgataataagtgcattgtgcatggtgggacgataggagttagagttgttcataaatcataactactatgtactgcaccagatgacgagattgtgttgccccttgtctggtgtagcttgtgtagctttctgcgttgcagtgctgtttgtaaaggcgacttcagagttcagaattaaaacatggttgttttttcaaaaaaaaaaaaaaaggcctccacggattcgttgatgtggtgctagtacaacaatatggataatctctcgtgc

SEQ ID NO: 9 - DNA, 3159 bp, Zea mays
cattgggtacctcgaggccggccgggtcttggttgcatttttctatccccgcgtggccgcgtgtagtcctagtctctcgccagcaccatcatcatcaatcacggcggcgaccccgccccgcctcgatcgcccacgctgcccgactggaaccggacgctgctgctgctgctgctaggctgacagcgacgacgagggggccatggctcagatcttgctccacggcacgctccacgccaccatcttcgaggccgagtcgctctccaacccgcaccgcgccaccggcggcgcccccaagttcatccgcaagccggactactgttctagcatgctcaagagaacgctcctgcactgcactagttccctttgatcactctaccctaggctcgtctccaacttgtggaagggattgaggataccgtgggtatcggcaagggcaccaccaagatatacgccaccgttgatctggagaaggcccgcgtggggcgcacccggatggtctccaacgagcccgtgaaccctcgctggtacgagtccttccacatctactgcgcgcacatggccgccgacgtagtattcaccgtcaagatcgacaaccccatcggggcctcgctcatcgggagggcttacctgcctgtcgaggacatcctgggcggagacgagatcgacaagtggcttgagatatgcgatgagaagcgcgagcctattggggacagcaagatccacgtgaagcttcagtacttcgacgtcggcaaggaccgcaactgggccaggggtgtccggagcaccaagtaccctggtgttccttacaccttcttctcgcagaggcaggggtgtaaggttactctgtaccaggacgcccatgtcccggacaacttcgttcccaggatcccgctcgctgatggcaagaactacgagccacacaggtgctgggaggatatctttgatgccataagcaaggcccagcatctgatttacatcactggctggtccgtgtacaccgagatcaccttggttcgggacaccagcaggccgaaacctggaggcgatgttactcttggggagttgctcaagaggaaggccagcgaaggtgtccgtgtccttatgctagtgtgggatgataggacttcggtcggcttgcttaagaaggatggcttgatggctacccatgatgaggagactgcaaattacttccatggcacggacgtcaactgtgtcctgtgccctcgcaaccctgatgattctggcagctttgtccaggacctgcagatatcgactatgttcacgcaccatcagaagatagtagtggtagaccatgagttgccaaacgagggctcccagcagaggaggatagtcagcttcgttggcggaattgacctttgtgatggaaggtatgatacccagtatcactccttgtttaggacacttgacaatgtccatcatgatgacttccaccagccaaactttgagggtgggtcaatcaagaaaggtggtccgagagagccatggcatgatatccactcacggctggaagggccaattgcttgggatgttctttacaactttgagcagaggtggaggaagcagggtggtaaggacctccttgtacgtctcagggatctttctgacattattattcccccttctcctgtgatgttcccggaggacagagatacctggaatgttcagctctttagatccattgacggcggtgctgcttttggcttccccgagactcctgatgaagctgcaagagctgggcttgtgagtggaaaggatcaaatcatcgaccggagtatccaggatgcatacataaatgccatacggagggcgaagaacttcatctacattgagaatcagtacttccttggaagctcatatgactggaagccggaaggcatcaagccagaagatatcgattgtcttcacttgattccgaaggagctctcattgaagattgtcagcaagattgaggctggggagcggttcactgtttatgttgtggtgccaatgtggcctgagggtgttccagaaagtgcttccgttcaggcaatccttgactggcaaaggagaacaatggatatgatgtacactgacatcacacaagctctcgaagccaatggaatccaaacaaaccccaaggactatctcactttcttctgcttaggtaaccgtgaggtgaagcaggagggagaatatcaacctgaggaacacccagaacctggcactgattacatccgggctcaagaggctaggaggtttatgatctatgttcatgccaaaatgatgatagtggacgatgaatacatcatcattgggtccgccaacatcaaccagaggtccatggacggtgccagggactctgagatcgccatgggcgcgtaccagccgtaccacctggcgactaggcagcctgcccgtggccagatccatggcttccggatgtctctttggtacgaacacctggggatgctggacgacgtcttccagcgccccgagagcgtagagtgcgtgcagaaggtgaacaagatcgccgagaagtactgggacctgtactcgagtgatgacctggagcaggacctcccgggccacctcctcagctacccgatcggtgtcactgccgacggcaccgttactgagctgcccgggatggagaacttccctgacacccgtgcccgcgtcctcggcaacaagtcggactacctcccgcccatcctcaccacataggctgcaggctgcaggcagcgccatggcttctctcctgtctggcctcagcttggtgcccctctgtttgtgtttgagatactgaaagttcagatagcagtgtttttattatagttattgagtgataataagtgcattgtgcatggtgggacgataggagttagagttgttcataactacaccagatgacgagattgtgttgccccttgtctggtgtagcttgtgtagctttctgcgttgcagtgctgtttgtaaaggcgacttcagagttcagaattaaaacatggttgctttttcaagtgtgctgctaaaggcctgtatggattcgttgatgtggtgctagtacaacaatatggataatctctcatctgcctgtaaagagatctaagggctagtttggtaattccattttcctaagagattttttttttctaagag

SEQ ID NO: 10 - DNA, 4162 bp, Zea mays
  misc_feature (3969)..(3969): n is a, c, g, or t
tccacgcgtccgccaattcggcacggcttccttttctaccccgcaggccgcggcgcgtagtcttctgctctctagctcaccatcaccgtcgtcatcaatcacggtgaccttgccctcgctgctcgactggaaccgtgcctcgctcagatctgccccgttccactccccgctgttggctgttgctctgctctcatcgtcttcggccgggaaaggacgctgctgctgctggtaggctgacagcgaggaggacgagacgagggggccatggctcagatcttgctccacggcacgctccacgccaccatcttcgaggccgagtcgctctccaacccgcaccgcgccactggcggcgcccccaagttcatccgcaagcttgtggaagggatcgaggacaccgtgggtgtcggcaagggcgccaccaagatatatgccaccgtcgatctcgagaaggcccgtgtcgggcggacccggatgatctccaacgagcccgtgaaccctcgttggtacgagtccttccacatctactgcgcgcacatggccgccgacgtcatcttcaccgtcaagatcgacaactccatcggggcctcgctcatcgggagggcctacttgcctgtccaggacctcctgggaggggaggagatcgacaagtggcttgaaatctgcgatgaaaatcgtgagcctgttggggacagcaagatccatgtgaagctccagtactttgacgtcggcaaggaccgtaactgggcgaggggtgtccggagcaccaagtaccctggtgtcccttacaccttcttctcgcagaggcaggggtgtaaggttactctgtaccaggacgctcatgtgccggacaactttgttcccaggatccagctcgctgatggcaagaactatgagccgcacaggtgctgggaggatatctttgatgctataagcaaggctcagcatttgatttacatcactggctggtccgtgtacacagagatcaccttggtcagggacaccaacaggccaaaacctggtggtgatgttactcttggggagttgctcaagaggaaggccagtgaaggtgtccgggtgcttatgctggtgtgggatgacaggacttctgtcggcctgcttaagaaggatggcttgatggctacccatgatgaggagactgcaaattacttccatggcacggatgtcaactgtgttctgtgccctcgcaaccctgatgattctggcagctttgtccaggatctgcagatatcaactatgttcacgcaccaccagaagatagtagtagtcgaccatgagatgccgaaccagggatcccagcaaaggaggatagtcagcttcattggtggcattgacctttgtgatggaagatatgatacccagtaccactccttgttcaggacgcttgacactgtccatcacgatgacttccaccagccgaactttgagggtggatcaatcaagaaaggtggcccaagggagccatggcatgatatccactcacggttggaagggccaatcgcttgggatgttctttacaactttgagcagagatggagaaagcagggtggtaaggacctccttgtgcgtctcagggatcttcctgacattatcatccccccttctcctgtgatgttcccggaggacagagagacatggaatgttcagctcttcagatccatcgatggtggtgctgcttttggcttccccgagactcccgaggaagctgcaagagctgggcttgtgagtggaaaggatcaaatcatcgaccggagtatccaggatgcatacgtaaacgccatacggagggcgaagaacttcatctacattgagaatcagtacttccttggaagttcatacggctggaagcccgaaggcatcaagccggaagaaatcggtgctcttcacttgattccgaaggagctctcgctgaagattgtcagcaagattgaagctggggagcggtttactgtttatgttgtggtgccaatgtggcctgagggtgttccagaaagcgcttctgttcaggcaatccttgactggcaaaggagaacgatggagatgatgtacactgacatcgcacaagctctcgaagccaacgggattgaagcaaaccccaaggactatctcactttcttctgcttaggtaaccgtgaggtaaagcaggagggagaatatgaaccagaggagcacccagaacctgacactgattacatccgggctcaagaggctaggaggtttatgatctatgttcataccaaaatgatgatagtggacgacgagtacatcatcattgggtccgccaacatcaaccagaggtccatggacggtgccagggactccgagatcgccatgggcgcgtaccagccgtaccacttggcgactaggcagcctgcccggggccagatccatggcttccggatgtctctttggtacgagcacctgggaatgctggaagacgtcttccagcggcccgagagcgtagagtgtgtgcagaaggtgaacgaggtcgccgagaagtactgggacctgtactcgagcgacgacctggagcaggacctcccgggccacctcctcagctacccgatcggtgtcactgccgacggcagcgttaccgagctgcccgggatggagaacttccccgacacccgcgcccgcgtcctcgggaacaagtcggattacctcccgcccatcctcaccacatagagtgcacactgcaggcagcgccatggctgctctcctctctggcctcaccttggtgtccctgtgtttgtgtttgggacactggaggttcagattgcagtgttgatattatatcccccctccgtccagagggattcgacgttattgagtcataataaaatgcattgtgcacggtgggagactgggaggataggaattatagttgtttattacagtacgactgcttactgcatccagattgtgttgtcccttgtctggtgtagcttctgttgcttgctgcgttgcagtgccggaagtgactccagatttcagaacttaaacatgattgcttgttcaagtgtgtgctgctaaatgtcaaactgtcgatgtcatgctacaacaacaatattgataatctctcatctttctataaagacctttaaacctggtaaaaaaaatcctgctgctcaatagatccaacgccctataaagacctttattaaacgtggtctcctgagagccctataaagacctttagggtgtgtttagttagggagccaactagaatggaacaacttcattccaatttctgagaacggaatcgctctattctatgtttggtaagtagaatggagccactacgttttttgtttggttggagagcgtattagagcagagccgctccgttctgcgtttggttgagaagtgcattgacgttttctctatccttgtcttcaacctccatgtgcatttgcaaacatttatcttcaatctcatgatgtataaaatatgagcatctagaagatataatccaaatacgaactgaggccaaaggccctgcatcgccctcatacctaactgaacacacaccaagcctcgaatacagactgaacacgagctgacatagaacaagcttgaatgtaaactgaacactcaacatattcattgactagcaagctacaactccaattaaatggtttgtcagactacaactctgattaagcaggattaatctattatcttcctacttatttttggctaaaaataattagactaacagatagtatagcctgtcaattcgaaatgcaacaaccatacagggaccaaaaatacagctctacgaagaaatttcataattgacaagctatgaagaaattttagttatataaagaaataactctatgcgctcctctcttcttctttctgtgcaggctacagatctgcgcaagatagtggcttccttggaagagaagatcaatgcagagataactctctctatgcagcacaaangccacgcaatgggaaaggggcaacctcacatggtgtccttggctcatgtcaggcgatggagttcgcgagtgcaaaggccacgagaggcgggcgatgggtccttaccacgaaggggaagaactgaggaggagagggaggcgctccactcttcccctctagataaccaagcacctagaaaataggaataaaacga

SEQ ID NO: 11 - DNA, 1079 bp, Zea mays
gcttcaatatgccacatatcttttatttatcaagatttaggagcatggttgatgttgttgtaaaacttacttttctgatgcgcatatgtttggagcaacatgttttttagtcaaaaacaaaagtacactggacaggaaaggcatcaaatattacgggaaaggatctgtcctgtgctcatataattctactttttaaaaggatttaactcttttcaaatgaaaaaatagttactcttggtagcatagtgttgagcagccgaattcctacttgaatttctctcttgcttggcttggaaggcatccatttactgacgaagatggtaacaatttctgtttgatttcagtggacgatgaatacatcatcattgggtccgccaacatcaaccagaggtccatggacggtgccagggactccgagatagccatgggcgcgtaccagccgtaccacctggcgactaggcagcctgcccgtggccagatccatggcttccggatgtctctttggtacgaacacctgggaatgctggacgacgtcttccagcaccccgagagcgtagagtgcgtgcagaaggtgaacaagatcgccgagaagtactgggacctgtactcgagtgatgacctggagcaggacctcccgggccacctcctcagctacccgatcggtgtcactgccgacggcaccgttactgagctgcccgggatggagaacttccctgacacccgtgcccgcgtcctcggcaacaagtcggactacctcccgcccatcctcaccacataggctgcaggcagcgccatggcttctctcctgtctggcctcagcttggtgcccctctgtttgtgtttgagatactgaaagttcagatagcagtgtttttattatagttattgagtgataataagtgcattgtgcatggtgggacgataggagttagagttgttcataactacaccagatgacgagattgtgttgccccttgtctggtgtagcttgtgtagctttctgcgttgcagtgctgtttgtaaaggcgacttcagagttcagaattaaaacatggttgctttttcccacaaaaaacaaa

SEQ ID NO: 12 - DNA, 1610 bp, Zea mays
ggcacgagagagagcagccgagccggttcaaccccatgaataccgctgctgcagagatcacggcctgcttctgcgtctgcagctccagcagtagcaacagcaggggctgcagtgcaaacgactgctagttcccctttccccgcatgatctctgccccttcccctaccttctcttgttcttgcttgcacgacccttttccttgtgcgctagctgccgcttcttcttcgtcttcctggagctccccgcatccacacatgccccaagaaccagacaataaaacaacacggaaccatcggagtctttttctactactatttccagcgatttgattatatggatgtgtgcacaggtgcacgtagataggtagaatagaagggagattatagctagctagaggcagcgagcagctcggttgctgggacacgcgatcgagctacagcaaagaagactgcagggtggcgcggcgggcatggaggatctgtacagcatccacccggggatctcgcgccacggggcggcggcgactagcgaggcgtccggggtcgccggtggaccgggctcacccccgcccccgcccccgccggcggcggatctgacggagctggtcaaggcgcagatcgccgggcacccacgctacccgtccctcctctccgcctacatcgactgccgcaaggtgggcgcgccgtcggaggtggccacgctgctggaggagatcggccgggagaggtgcgccgccgcctccgccggcggggaggtcgtcggcatggaccccgagctcgacgagttcatggagacgtactgccggttgctggagcggtacaaggaggagctgtcgcggccgttcgacgaggcggcgtccttcctcagcagcgtcaggacgcagctcagctccctctgcggcggcgccgcctcgctctccgatgaaatggtggagtcctctgaggacgagccatgctcaggcgacacagacgcgacgacagacccagggcaggagcacagctcgcgcctggccgaccgcgagctcaaggagatgctgctgaagaagtacagcggctgcctgagccggctgcggtccgagttcctgaagaagaggaagaaagggaagctgcccaaggacgctcggtcggcgctgatggactggtggaacacgcactaccgctggccgtaccctacggaggaggataaggtgaggctggcggccatgactgggctggacccgaagcagatcaacaactggttcatcaaccagcggaagcggcattggaagccgtcggaggacatgcggttcgcgctcatggagggcggcgtctccggatcctcctccgggacgacgctctacttcgacacgggcaccatcgggccgtgatcgatgcgatagatacctctgacgaattgggggcaaattgttggttgatactgagattagttacatgaagcaatatccgctgtcattttgtcggattcattgtgtatatgcatgggcgacaacgtgtattgtcgggtacacagtatgtagtggcatgtaaagacaccgtaacaatataacatgaattgttcaattgcctgttgcattttgatcaaaaaaaaaaaaaaaaaaaaaaaaaaaaaag

SEQ ID NO: 13 - DNA, 1797 bp, Zea mays
gggtacctcgaggccggccgggaacaacatcccactgattgaggcagttcgtgaacaagccgtcacacccactcgctgctgaaccaggagttccatccatcgccgctcactcccacgatcagcgtcgtcgcttatccgcaaatatctctcttcctctttgcagtcggcaccatgggttccgacttcaaatcgatccccttgatcgatatcggcccgcttgtcgaaaagattgatgatccaagcatggccaacgataaggatttactgcaggttgtccggttactggatgatgcttgcaaggaggccggattcttctatgtgaaaggccatggtattgatgagtcactgatgagggaagtcaggaatgtaacccgtgaattctttcagcttccttatgaggaaaaattaaaaattaagatgacacctcaaagtggatatagagggtatcaaaggataggggaaaatattaccaagggtaagcctgatatgcatgaagcaatcgattgttatactcctattagacctggcaaatatggagatctcgctaaaccaatggaaggatctaacttatggccaaaatacccatcaaattttgaagtactgctggaaaattatatcaaattatgtagagacatttcaagaaagataatgcgaggtatagccttggctttgggaggggcaattgatgcttttgaaggggatacagctggagatcctttctgggtgttaaggttgattggttatcccgtagatattccagaagagcagcgcactgatactggctgtggagctcatacagattatggacttctaacactggttaaccaggatgatgacatatgtgcccttgaggtgcaaaaccgttctggatgtcggacttctaacactggttaaccaggatgatgacatatgtgcccttgaggtgcaaaatcgttctggtgagtggatatatgcaacgccgattcccggaacctttgtttgtaacatcggtgacatgctgaaggtttggacaaatggaatatatcagcccacccttcacagagttgtcaacaattcccagcattaccgtgtatctgttgcattcttctacgagtccaacttcgatgctgcagtagagcctgttgagttctgccgggagaaaaccggcggtgctgctaagtacgaaaaggttgtgtacggggagcatttggttcagaaagtattgacgaacttcgtcatgtaaatttgctaagtacgacaaataaatctgcattgcagcatcagaactccagacctatttggtgtgtagtgctgtaccagaaaggtagtaacggactaaagcatgcgcccgtctctgaaatttgaccttaacaagagtcgcagacttgcagtgcaggtgatatcacaaggaaatcggggggagatttgttctctctgctgcacggagttgtcgacaaccctgtcgctgaaatctgaatttagcatcagacaactggagatgctacgagtccgtctctgaaatctgaatttagcatcaggcgcgaaattgcctccatttcttcgccaaaccatctaatgatggaagctttgtagctggcaaggccatctcgtgtgacgccgcagccagacgatgccagcgtagcaagttacctaccattagcactggttaactagctagccatactagtgaattactctattccgatcaaatgttggagaattcttttctcatagatactttgatgaaaagaattggtaccaggaaggctatgttcggttctaccacaattcatatgtatcgagcgagtttcaatccct

SEQ ID NO: 14 - DNA, 1310 bp, Zea mays
ccgggggcccccgccccgctcccccccgatcagcgtcgtcgcttatccgcaaatatctctcttcctctttgcagtcggcaccatgggttccgacttcaaatcgatccccttgatcgatatcggcccgcttgtcgaaaagattgatgatccaagcatggccaacgataaggatttactgcaggttgtccggttactggatgatgcttgcaaggaggccggattcttctatgtgaatggccatggtattgatgagtcactgatgagggaagtcaggaatgtaacccgtgaattctttcagcttccttatgaggaaaaattaaaaattaagatgacacctcaaagtggatatagagggtatcaaaggataggggaaaatattaccaagggtaagcctgatatgcatgaagcaatcgattgttatactcctattagacctggcaaatatggagatctcgctaaaccaatggaaggatctattatgtagagacatttcaagaaagataatgcgaggtatagccttggctttgggaggggcaattgatgcttttgaaggggatacagctggagatcctttctgggtgttaaggttgattggttatcccgtagatattccagaagagcagcgcactgatactggctgtggagctcatacagattatggacttctaacactggttaaccaggatgatgacatatgtgcccttgaggtgcaaaatcgttctggtgagtggatatatgcaacgccgattcccggaacctttgtttgtaacatcggtgacatgctgaaggtttggacaaatggaatatatcagcccacccttcacagagttgtcaacaattcccagcattaccgtgtatctgttgcattcttctacgagtccaacttcgatgctgcagtagagcctgttgagttctgccgggagaaaaccggcggtgctgctaagtacgaaaaggttgtgtacggggagcatttggttcagaaagtattgacgaacttcgtcatgtaaatttgctaagtacgacaaataaatctgcattgcagcatcagaactccagacctatttggtgtgtagtgctgtaccagaaaggtagtaacggactaaagcatgcgcccgtctctgaaatttgaccttaacaagagtcgcagacttgcagtgcaggtgatatcacaaggaaatcggggggagatttgttctctctgctgcacggagttgtcgacaaccctgtcgctgaaatctgaatttagcatcagacaactggagatgctacgagtccgtctctaaaaaaaaaaaaaaaaggcccctagggcc

SEQ ID NO: 15 - DNA, 801 bp, Zea mays
  misc_feature (1)..(1): n is a, c, g, or t
nttaagaccccaggataccgccgaggggcgccaaatgatcccttcatttaaagggacacaaaagccggaagctccccccgcggtgcgggccgctctagaaactaggggatcccccggggttccaggaattggcacggagggccatgacttagaacatcctaatggaaaaaaaacaaccgaaccgaggaatgggtttcacaagcaagctaaagcgctcgaggcatggtgtgtccatgaagctccgagtccgtgatccgaggccaacgcagacagtccaagatggactcagtttcgtggcgagcttgaagcgcgtgttcgcctgcgagcctgacaagtacgacgagatcatcgccaccatgcgccagttcaagtccgggagcattcgtagtgcggttgtggttgagcgtgtgaaggtgcttctggaaggtcaccctggtctcctccgccacttcaaccagttcctgccatggggttacataagggctcatggaccagtcgggaggatcagcgtctgatgcagccagggcagggaagcgcgtgtggctacctaaacaagcctaaacctactagctggtgctttccatcgcatgaatggcagaatgggacaagagtatctggttggcccgtcatgactgctattctgcattggcagtaccattaagaacatgtaatgctaaacatcagaccggccgtatctttcttgcattatgtcatgtctgttccataatggtgaagccacctgactggcatcttctatatatcatgtatatatgcatgttcttgtcaaaaaaaaaaaaaaaa

SEQ ID NO: 16 - DNA, 1552 bp, Zea mays
ggattcggcacgacctcagaagctgcccagagctaccacccctcttatccccacccctcctcctcctaccttttctccttcagacctcaaaatctgtgtgataggaacaagagcatgcacatccgagaagaggaggctacaccatccacagtaacaggcatcatgtcgaccctgacttcggcggggcagcagaagctgaaggagcccatgtcccctggtggcggctccgcgtcggtcgctgggtccgctgcggagaggaacaacggcggcaggggcaagggcaagactgagatcaagcgcatcgagaacacgaccaacaggcaggtcaccttctgcaagcgccgcaacggcctcctcaagaaggcgtacgagctctccgtgctctgcgacgccgaggtcgcgctcatcgtcttctccagccgcggccgcctctacgagtacgccaacaacagcgtgaagggcaccattgagaggtacaagaaggcaaccagtgacaactccagcgcagctggtacgattgcagaggtcaccattcagcattacaagcaggaatctgctaggctgaggcagcagatcgttaacttgcagaactccaacagggccctgataggtgattctatcacaaccatgagccacaaggaacttaagcacttggagactaggttagacaaagctctcggaaagattagagcaaaaaagaacgatgtgctgtgttctgaagtcgagtacatgcagagaagggaaatggagttgcagaatgacaacttgtacttaaggagccgggttgatgagaatgaaagggcacaacagacagcgaacatgatgggggcaccatcgacaagtgagtatcagcagcacggttttactccttatgatccaataaggagcttcctgcagttcaacatcgtgcagcagcctcagttctattctcagcaggaggaccggaaagacttcaacgaccaaggtggaagataaatattggacctctcaagcttcagtacttatccgtgatgatgcatgactgccagtgagaaactgagctacattactgtggaattatatgtaaagactagtactactgcttcatatatgtgcatgtgcgcacacgcgcacgtagtatgcacaatttcatcccactattatggcttggcaccaactatgtctccttaattatcataggagaaaaataagtcacgcacaaaaaaattctaaagatgaggcgcagtgttggatgactgaaactgaaagataggattctcgtggatggcggtggtcatatacggcctgttttggttgatgtacccgagcgcacccgcggaatcttaaagcaagttgtgtttaattgactgcactttatatacgggttgaacagatgtaattcgagggctgcaaccaggctaagggcatacgcggctggcagccgtatgcccgcgtgcaggcgctgccaatgcagcagcacacaaaacgatgtatagtttatgtgtgtttttctattatatctttcaataaaaagatttaaccactaaaaaaaaaaagaaaaaaaaaaaaaaaa

SEQ ID NO: 17 - DNA, 2070 bp, Zea mays
ccggccgggaccagtcccacacaccaccacacctggcgtaccgtcgatctggccaggcctcgccacgcctatccgcaccctcccctcccctcccctactctctcggaagcggcgccgctgccgccgcagcggcgaggagccagccatggcggcgcacgcgacgctccccttctcctgctcctccacgctgcagaccctgacccgcaccctctcctcgcgcggggcccaccagctccgcgggggcttcctccgcctcccctccctcgcggcgctcccgaggctggcccacccctaccgccgccacgtctcggcgtccgctgcggcggcgcccaatggcgcctccgttgagggggagtacgactacgacctcttcaccatcggcgccgggagcggcggcgtccgcgcgtcgcgcttcgcctccgcgctctacggctcgcgcgtcgccatctgcgagatgcccttcgccacgatcgcttcggacgagctcggtggcctcggcggcacatgcgtgcttcgtggatgtgttccaaagaaattgctagtgtacgcatccaagtactctcacgagtttgaagagtctcgtggatttggatggacatatgagactgatccgaagcatgactggagcactctcatagccaataaaaatacagagctgcagcgcctggttggcatttacaggaatattttaaacaatgcaggagtcactctgatcgaaggtcgtggaaagatagtcgatcctcatactgtcagtgtgaatggtaagctctacactgctaagcacatactagttagtgttggtggccgaccatcgatgccagatatccctggtatagagcatgttatagattcggatgctgcgctggatttgccttcaaaacctgagaaaattgcaatagtgggaggtgggtatattgctttggagtttgctggcattttcaatggcttaaagagtgaagtccatgtgtttattcgtcagaagaaagttttaagaggatttgatgaagaggttagagattttgtcgctgaacaaatgtctttaaggggcatcacgtttcatacagaacagagccctcaagctataactaaatcaaatgatggtctgttatctttgaagaccaataaagaaaattttggtgggttctcacatgtaatgtttgcaacaggtcgcagaccaaattcaaagaaccttggactggaagcggtgggggttgaaatggataagaacggtgcaatagtggttgatgagtattcacgtacctcagttgattccatttgggctgttggagatgttaccaatagggtcaacctgacaccagttgcactgatggagggtggggcatttgcgaaaactgtctttggcaatgaacctaccaaaccagattacagagctataccttctgctgtgttctcccaaccaccaataggacaagttggtcttactgaggagcaggcaattgaagagtatggagatgttgatgtcttcgttgccaacttcaggcccctcaaggccactctgtctggactacctgatcgtgtattgatgaagattcttgtgtgcgctacgtcaaacaaagttgtaggagtgcacatgtgtggtgatgatgcacctgagataattcagggaattgcaattgctgttaaagctggattgacgaagcaagattttgatgccaccattggcattcaccccacatccgctgaggaattcgtcacaatgaggagcccgactagaaaaattcgaaaaagttctacagatcaggtagaatctaaagatgaggttgtaagtaagcagtagataccattttttcctaggaggtgttctcgggggagggagtattcctgctgcaggacgacagctggacggaattttggaatacaccggcagagtagctgaaataactgctaggaatttctgagaaatttcatgttagggaaccaacgatgctgtttaatagaattggctgtacatacctgtccgccgagctattttcctgtgtcttgtacgttgaaataaaatactgcaaatgtttgccttacggtcaagaaattttgcaataaccaataaaa

SEQ ID NO: 18 - DNA, 1681 bp, Zea mays
gcttagcccggcggccggccagaactgcaagagagaagaccaagaaacagagagagacaagcgcaggggacagcagcgggtagctagctagctagcgatcgacgacagacgatgcagatgatgatgctctctgatctctcgtctgacgaccacgaggccactggatccagctcctatggcggggacatggccagctacgccctcagccctctcttcctcgcaccggcggcctcggccaccgcgccgctgccgccacctccgcagccgccggccgaggagctcaccaacaagcaggccgcgggcggcggcaagaggaagagaagccagccggggaacccagaccccggcgcggaggtgatcgcgctgtcgccgcgcacgctggtggcgacgaaccggttcgtgtgcgagatctgcaacaaggggttccagcgggaccagaacctgcagctgcaccgccggggccacaacctcccctggaagctccgccagcgcagcagcctcgtcgtcccgtcgtcgtcggcggcggcaggctccggcggcaggcagcagcagcagcagggcgaggccgcgccgacgccgccgcgtaagcgcgtctacgtctgccccgagcccacgtgcgtgcaccacgacccggcgagagctctgggggacttgactgggatcaagaagcacttctcgcggaagcacggggagaagcggtggtgctgcgagcgctgcgggaagcgctacgccgtgcagtcggactggaaggcgcacgtcaaggggtgtggcacgcgcgagtaccgctgcgactgcggcatcctcttctccaggaaggacagcctgctcacgcacagggccttctgcgatgccctagcagaggagagcgcgaggcttcttgcagcagcagcaaacaacggcagcactatcaccaccacgaccagcagcagcaacaacaatgatcttctcaacgccagcaataatatcacgccattattcctcccgttcgccagctctcctcctcctgtcgtcgtagcggcggcacaaaaccctaataacaccctcttcttcctgcaccaagagctgtcccccttcctgcaaccgagggtgacgatgcaacaacaaccctcgccctatcttgacctccatatgcacgtcgacgccagcatcgtcaccaccaccggtggtctcgcggacggcacgccggtcagctttggcctcgctctggacggctcggtggccaccgtcggccaccggcgcctcactagggacttcctcggtgtcgatggtggcggtcgtcaggtcgaggagctgcagcttccactgtgcgccacagcagccgcagcaggtgccagccgcaccgccagctgcgccaccgacctgacaaggcagtgcctcggcggccggctgccgccggtcaacgagacctggagccacaacttctaggcccgctatatacttcaagctgcattgagactttgagagacgaatgaacggaacacccaaactgcatgcactcctagcttgaagagcaaccaaaactggagttagcaagttatggtgcactactgttgttaatttaccttaatttattgatctctgttagttctattttcatttagggcaatgcgggctagctaattaattccatgtgcacaacttttgatgaatggaccagaaagtttatcttgttgcttttttt

SEQ ID NO: 19 - DNA, 7271 bp, Zea mays
  misc_feature (4066)..(4066): n is a, c, g, or t
  misc_feature (6734)..(6734): n is a, c, g, or t
gactcatggacaggtgatccgccagtaactgactgaagtttactagataccaggcggttaccaatacgaaaagcaaatcactgcattgtcgaaaccatatcataatatgctcatatgcattagttaatcgacacaggctgaacaggtggcaaacatatcagtatacttcaaatagtgttttgtgtaaactactggacacggtctaaaacaacaacgggtccgaacaggtggtaaatatattcaaacttcactcgtcgaacattgcagtctacagtacagcagtataaaaaatagtgttttgtgtaaactgttggacacggtcttaaatacaccgatatttgaatccctgggactgggcgcacaagatccaaccagccaacagcaggagtgcccacaacgcccaaaggggggcgagggggaggaattaagggaacgaaaggggggtcccccgcccaaaaaaaattctcatcagtggggctggtttagcacaccatatatctttggaccaaaagcgtggatggaataagaaaaaggagagacaaaaaagaaggaaaagattaaagcagcaagcaaggaattataaacccagtagtacgtaccatcgcggcgtccctcaaagcacaattttttttctctttcttgcatgggctggcaggcttaaaaagcaagcagcatgatgcatcgggagatagattcagagaaaaaaaaagatggagcgagggaaagaaacctgcttgtttaggactgatcaagcctgcagaaaaaaaggagagaggacttagagaggaaacgaactagagtcaaacaaggctaggctaaagagcggactttggagccctagacagccttttctaacacacacacacacacacacacacacacacacaaaccgtacctgcgcatcaagatgcacggcacgtagtacctgcaactgcaagtaaggataaacagaaagctgcctttgaacgtcagtcactagctagctaggcgtgtatgcagatcgatcgatgagcagcccaggtgacggggggcacagatgaaaacctgatgggaagagggtcagtgaatgagtgagtggttgtgcaacttttgctttcactgtacggtgagagtttgatcccctggtacggtgtgtgcgatgcatgctcggccggtgttccctccaccatttgcccactctttttttttgtgtgtgccctttctccaattccattggtcatctctgactgcagggcaggcaggcaggcggaaccagagctccgatccagacgagattattagaagcagggatcgaaaagtataaagcagtagtgataaaggctaataatgtttctttttttattggtttgctgatggcttaaattaattcttctgctaattaacctagctacatgtgtgcgtgactggctgactgactgactgacacccacgtactgcatgcagaaacatacaaccaatctgagcattagcttgtggtgaaaggctagcagctggctcactgcaaacagaaagtgaactagtccctgctgtctagctagctagcttagaggtgtgtaaaacataggcaacttccttttcagttgcacctcagttttgcacagtcgcaggccagccacacacacacacacaagaatgagctcaactactttgcgcacacaaagatagtaggaatactccctatgtcgagctcatcagttactaagaaaaactaaaggttggttggtgctagcttgcttttgccaatgcctcaatggtctgtgtgcatgtatatatatgttaggccttttttttctttactaatacgtacattttcatcgcctggtggtaataaggcaagtaagaccaactccagcagcactggctatcccactccgtatccctattatacacgctctgagtcactatttcgctctccagcagccttcgcatccgtctccgcaaaacacacgcagtgtacctgcactctccttttccacggtttctctctcctctccgcacaagactgcatgcgccccctcctgctcgcgggccccagttgtcatagactgcatgcggagtgcaaatacggagtctgctggaaacggagacggatacggagaggagagagaaactgttggccgtgctaaatacggatacggagagggagtctgctggagttggtctaaatactccaatgacacagctgctcaggttgtaccactccacaccacatgtcgtcattgcatgcatgctagctgccattgataaaaagatagatgcagaaactaaaggggggaaaaaagagagggaggggcatagcaatagcacgtctggctggatggatgggcgtggctttttggacctgcagagggagtgcactcgattgcagcatctctctctacacgtatgttgcccgccttgccctggctagctgcagcaactgcgcctgcagagggcaacgccaaaccgcctgcagactgcagtgcactgctgcctccccctgacgccttttttccccgatcctctcctgcaataatacaataataataatctgattgccctcctctcctctctcaaataatcacgcttggacagcactagaagcactgagctagctgagaccacagaaccacatgggtctactatatatagaagctaggaagtagagaggggatcagtagctagctaaagcttagcccggcggccggccagaactgcaagagagaagaccaagaaacagagagagacaagcgcaggggacagcagcgggtagctagctagctagcgatcgacgacagacgatgcagatgatgatgctctctgatctctcgtctgacgaccacgaggccactggatccagctcctatggcggggacatggccagctacgccctcagccctctcttcctcgcaccggcggcctcggccaccgcgccgctgccgccacctccgcagccgccggccgaggagctcaccaacaagcaggccgcgggcggcggcaagaggaagagaagccagccggggaacccaggtacgtagtagttaattggctgaccaatcacgccgaccgatgcacctaattaatgaatcaatgtgctacaaataaattaaaaccaaaagaccccggcgcggaggtgatcgcgctgtcgccgcgcacgctggtggcgacgaaccggttcgtgtgcgagatctgcaacaaggggttccagcgggaccagaacctgcagctgcaccgccggggccacaacctcccctggaagctccgccagcgcagcagcctcgtcgtcccgtcgtcgtcggcggcggcaggctccggcggcaggcagcagcagcagcagggcgaggccgcgccgacgccgccgcgtaagcgcgtctacgtctgccccgagcccacgtgcgtgcaccacgacccggcgaggtacgtatgcacggtcctgctcctgcatatatgcgagggaatgctagcgacatagcataacatctcatcgatccatccatccatccatccatccatccatccatccatccatccatcagagctctgggggacttgactgggatcaagaagcacttctcgcggaagcacggggagaagcggtggtgctgcgagcgctgcgggaagcgctacgccgtgcagtcggactggaaggcgcacgtcaaggggtgtggcacgcgcgagtaccgctgcgactgcggcatcctcttctccaggtacatctcatctcatgatcaccgtgcatatatgcatggacgacgtgctttgctgtaattgtaaacgctgatcatttttactaacaagcatgctggatataatagcctaaatctctcaccggacggatcgagagaaaacctagctagacgggatcgatcggtccagcaggtttgccgccgacgactgttccatcgatcgagcctgttaatttagtcacaaaaaggatcgagcatatgcatgtatatgaactatcttccttcactgaccaacatcatatcatgcatggacctagttaatcagtacatatactcctatatatacatagtttttcaagaacattgggtgattctgaagcaacctaaatatatatagatancaaaaatatatgaagtcatcagcacgatctgcgagtgagtacggttcttgaactcttctgatggttgcaataatactaccaacaaaaatatactatatatttgtcgcccactaatttatttttaaactaaatcgcgactgataaaaaagaaccgatggagtactatatatacaagcgcatgtggccttcatttacaattttagggtttccatgcatcctgtcataaaactatttgcatgatcacatccctatatatatatatatatatatatatatatatatatatgcccatagtactactgttgtgaaaaaaccatgagtccctggtcaaaccagtatatgtacatgcaatatgtttattgcatgcatatttgggaatgaacatcctctgcctgcaccaactttatggcagtcgtccatgtggtcatcatgacacattcccttcaaaaatggaacatatataggtacagcatatgaagcaattgaagagtactttaattgtgaaatagtactactgcaagtatatatgtagtagcacaacagtgcaataatgcagtgcattagatatagtagtgaagttaagagttagtttccaaatcttttactagagagatcataaaaaatctataaaaaattctaattcaacttctaatgtatcttatgttaagaaagagatatatataaaaagagtaaattctgtcattagatacatcgttagcagtagtaccactgaatttaattacgtcctacacacacgcgcacacacatgcatgcatgcatctgcatgcttcttttcagtagtgatcacaaaggaaactgacaaaagaacctagctaatcataggacgcagcttttcgtcatcaaagttaaacgaaactttacatgcatggattgcattgagtactcacgcatgtgcacgtcaacacgcgcacacatatacgtatattaacatagtactttatataccaactaattaataaagtcattgactcctctgatcatttgtttagctaattaacccgtttcgtttgatgcatgcatggtctctctggcgtggtcgtgcaggaaggacagcctgctcacgcacagggccttctgcgatgccctagcagaggagagcgcgaggcttcttgcagcagcagcaaacaacggcagcactatcaccacgaccagcagcagcaacaacaatgatcttctcaacgccagcaataatatcacgccattattcctcccgttcgccagctctcctcctcctgtcgtcgtagcggcggcacaaaaccctaataacaccctcttcttcctgcaccaagagctgtcccccttcctgcaaccgagggtgacgatgcaacaacaaccctcgccctatcttggcccccccctccacgtcgacgccagcatcgtcaccaccaccggtggtctcgcggacggcacgccggtcagctttggcctcgctctggacggctcggtggccaccgtcggccaccggcgcctcactagggacttcctcggtgtcgatggtggcggtcgtcaggtcgaggagctgcagcttccactgtgcgccacagcagccgcagcaggtgccagccgcaccgccagctgcgccaccgacctgacaaggcagtgcctcggcggccggctgccgccggtcaacgagacctggagccacaacttctaggcccgctatatacttcaagctgcattgagactttgagagacgaatgaacggaacacccaaactgcatgcactctagcttgaagagcaaccaaaactggagtagcaagtatggtgcactactgttgttaatttaccttaatttattgatctctgttagttctattttcatttagggcaatgcgggctagctaattaattcgatgtgcacaacttttgatgaatggaccagaaagtttatcttgttgctttttttgtttgattatgtttcgctgagaggcatgtgttctcataatggtatgtcgaaagaaatagatgatatactaatataaccatatcttatatactagtcagtctaaacaacatgaataaagattcaatcaagctagagtagtgacatggttactgatgatgatgctacggagtcatcgataagtggtagtggaggaaaagcttggtgcaactggcgacgaacacgaccgcttaacttggatgaacacgacaactcgtcgtggaagttgagagcagtcatgcaaataacacttgccaaaaaccttattaaatccatcctctatctgtgcaaggttagaaagatgagtgttatggatcgagatctactctccctattggtgatgtgcacgtaaatgctcaggatgaagagggctatgacggcagcgcagcattgagaatggaaaatactattaattgactatctcaagatttttcaaataaagtaggagctctctgatagtagttttagtgtgtcttttttcaaaaagatcggtatatatagggagaactcctgccttcgtagtatcaactagcaatacaatattgattgatgttgcatcatccacctctctactcatagactttaacataaaagaccattagaaaaaaggtattgggtcgttgagatttattagaatttctgtgcatgaacgtaggagaactagatcataaaaactttaacaggatcttcgcctaaaagttctnattgagataattgatgaagatgatacatgaattgaagcatcttgtgttttcttttgtattggatatctatccatgtgattggtagcctggctggctatgtgcagactcagcgggtgcattgactatggtcgtgcacgtgattggtcccttgcgtagaacgagacgagcctgctcacgcgcatgcaacacagttaattttttcagctcccgcttgcacgcgtggggatgcggggagggcttctctgctggtccaggccggcacgagcctagcgctcgtgggcacaggaaccaatcacgcggtatatgtgtattacctacgttctaaaagaatgaaattactttaatttatcttaagacaaagtattgaagttttatctaaatttacacaaaagacggacacctttgatgacacaaatatatatatacatatatatatatatatatatatatatatatatatatatatatatatatatatatttaaagcaacaagtttcaacctgtcgtgctacgtcatatttttacaaataaccccac

SEQ ID NO: 20 - DNA, 712 bp, Zea mays
ttggttattaccggttgtttattctgaacttcatggacaactcagccgctgttgtatactcaagcaatcagctggagctggctgatgatgctgatgctcatctatcggttgggtgtgatgcgtgtaggctgtgaagtgtacaacttggggactggaaaggggacgtccgtgttggaaatggtggctgcattcgagaaggcttctgggaagaaaatccctctggtgttcgctgggcgaagacccggagacgcagagatcgtctacgccgcaactgccaaggcagagaaggagctcaaatggaaggccaagtacgggatcgaggagatgtgcagagatctgtggaactgggcgagcaagaacccgtacgggtacgctgggtcacgcgacaacagcaaatgaaccacccatccatgcatcccatcctgcagtaggagcaagcagcagccttatagcctatgctaccataattagtaactcatcaatcatgcatacacataattagtaactcatcaatcatgcatacataatcagccagtcatctgattaggggtactgcgatgggcctcgcttcttcagtgtatagagggaggaggagggggggtcatcttgatattcttttttttttatcattcccgaatgattattattagtagccagttcgatattactccatggttggttgctagagaaggaataagccccattcgcggcc

SEQ ID NO: 21 - DNA, 872 bp, Zea mays
ttctctcttcacgggagcaaatcttttatttaaaagggtagggttcaaacagtgtcaaataatatcatctacgacatgatccagaagacggtccgaataaactgatgcggtagacttggtggtaccgagacttgcctacttggattcagctccagcctccaaaagagagagaaggctatatataagaagagcacccatccagccggccagcccaacctaagtagccgctggtagtagtggtagagctgagagctccagctaacaaccttgtgtccgctggcttggctgcttctctctcctccctcctccattgcttccactgcatgtgcgtcgtccttcatcataccccgatcaagaaaaaaaggctagctaatagctaaccaagtccagccgtccaggtgatatatcgatctccagcgagctagctatagcaaggctgtgcatgccgtcgtcgtcgtccatgggcatgggcatgggcatgggccaggcggcggtggtgagcaagagctggcaggagtcgaagctgctgtggcacatcgcgttcccggccatcctgaccgccgtcttccagttctccatcggcttcgtcaccgtgggcttcgtgggccacatcggctccgtggagctcgccgccgtcaccgtcgtcgagaacgtcatcgagggcttcgcctacggggtcctggtacgcgccgcgcatatatgcaacgactacactcccccatcatcggttttattagtgcgaaaagaaaagacatttctttaggttcgtctattcacgtacaaaacgcaaattacgacttatttggccggattaggacaaaggacaaagaaatcattatctactctagaagatcatatcgatactgttgctt

SEQ ID NO: 22 - DNA, 473 bp, Zea mays
atcattgcagcgaccgaggcagctctgcagggcccgcggaagctcacgggcatcaggaggtacgccttgccctcgggcacgaggaacacggaccgcccgtcggaggagttgcaggcctcgctccacgccgcgaggaacgcctcggcggcgtcgacgccggcatccgcggctccgtagtcgtcgacgttgacgaccctcggtggcggtccggccctgggcagccacagctcgtcgtcgtctggaccctctgccggcgccggcccgtcagcctccgaggaagaaacttcgtcccaactggcgccgtgtactagtagcatgtagtagtgaagaacgacgatcagcatgacgacgacagtggtggtggtggtggagccacccatccggagatggggaggaggctcaggcgaatggaggggaggggaggactggaggagaggagaggccggagaggagaggaagggacgagcattact

SEQ ID NO: 23 - DNA, 878 bp, Zea mays
agcatcagcatcagtacgaactgggaccagggcaggaacccctgcaatgccaaagcatccccccgccaaggtccctggcaccttagtgaaggctagattgatgaggtaggccaagaactggccaccagtgatgagaagcccatttgtgctcactagagcacctctgatcctagcaggggaagcttcagagatgtacagaggagctgtcatggaagcccatcccaacaccaaagaccaccaaaataccctcccaacaatgataactctaggtgttggggaaaacgccatgattacggcacctccaaagaacagggcatcggcaagtatgatggaaggcctccttccaaacttgtcattcatccagccaccaaatgcagctccaaatatagctccagcaacagccatactgactattgtctcccttaatacagtgctcttttccaccgcagcaaagtcatctctaatgtacaggagggctcccgatatgacacctgtatcatatccgaaaagaagaccgccaatgccagcagacaggacaagctgaaggatgtaaggctgtgtccaggacagccgcaggcactccttgaattctgccttgtccgctacagtcacaccgccctccattgatatccaagtttaagttggtgtaggtactcggtccgtcgtccacttcacgacagagagacgaaggaagcgatcaaaacccctcttccgccagcgccgcacagcagagagccgagactatctcctccccccgagagaacgaagacccggccggcccccggggtccacgttcgctttatggcggacgcctcttcgcacacgcggtgtcagtgcggcccggggcgggcgcacttgcttcccggccggcctcgagg

SEQ ID NO: 24 - DNA, 1620 bp, Zea mays
cattgggtacctcgaggccggccggggcgaaacagaagcacggcaatctcgatctcgttcgttcccctgagcggcagtcagtgcgagcgagcgcgcacacagacaactcatcctctcccctctctctctcacacacacacatccatcatcccatccctgtgacgggcgatccgagggcctaccgacgatggtgtccgccgtgctccggaccatcctcgtgacgggcggcgccgggtacatcggcagccacacggtgctgcagctgctgcagcagggcttccgcgtcgtcgtcgtcgacaacctcgacaacgcctccgaggccgccctcgcccgcgtcgccgagctcgccgggcacgacggcgccaacctcgtcttccacaaggttgaccttcgcgacaggcacgcgttggtggacatcttctcgtcgcacaggttcgaggctgtcattcactttgctgggctcaaggctgttggggagagcgtgcacaagcccctgctttactacgacaacaacctggtcggcaccatcaccctcctggaggtgatggctgcgaacggctgcaagaagctggtgttctcgtcatctgcaactgtctatgggtggcccaaggaagtaccatgcaccgaagaattcccgctctgcgccaccaatccctatgggcggacaaagcttgtgattgaagacatctgccgcgacgtccaccgctccgacccggactggaagatcatactgctcaggtacttcaaccccgttggcgctcatccaagcgggtacatcggcgaagacccctgcggtgtcccgaacaacctgatgccctacgtgcagcaagtcgctgttgggaggttacctcacctcacggtctacgggacggactacagcaccaaggatgggactggggtgcgtgattacatccacgttgtcgacctggctgacggccacatagcagccctgaggaagctccacgaagactccgacaaaataggctgtgaagtgtacaacttggggactggaaaggggacgtcggtgttggaaatggtggctgcattcgagaaggcttctgggaagaaaatccctctggtgttcgctgggcgaagacccggagacgcagagatcgtctacgccgcaactgccaaggcagagaaggagctcaaatggaaggccaagtacgggatcgaggagatgtgcagagatctgtggaactgggcgagcaagaacccgtacgggtacgctgggtcacgcgacaacagcaaatgaaccacccatccatgcatcccatcctgcagtaggagcaagcagcagccttatagcctatgctaccataattagtaactcatcaatcatgcatacataatcagccagtcatctgattaggggtactgcgatgggcctcgcttcttcagtgtatagagggaggaggaggggggtcatcttgatattcttttttttatcattcccgaatgattattattagtagccagttcgatattactccatggttggttgctagagaaggaataagctccattcatatacctaactaaagatatatatatacatgcattcactgtcaaaaaaaaaaaaaaaaaaccgcccaactcgagaagggggggccttgtacc

SEQ ID NO: 25 - DNA, 2445 bp, Zea mays
cctctgatgtacttctactcagcaccatgttctaacttacacattgcttagtcacctcttccagattgtacctttactcttttaaactaatatgtttattactaaattttttacaaagtacagtcatgcaacatgggctgtcaatgaatctaaataccatatcattttttctacgatgtcttctttttctactcatatgatcctgttgtaccaatagggtacacctatccatgctaagatccaagtagataaagaatatgaactcatcttaagtatgtactatgtcgtatactataatgtttatcgggttgacaaccagcatcgtcactttaaatacaatcgtactacagttctaccgataaactgatttactgttcgccacgcgcgcatgatacactagttttataaatactgagaaagagaacacacgcactgaggcagcacgattcgtcgtcgtccaaagtccaaccggccgtatggcccatcatcagcgctcctttccccccagccctcccacctcacgcgtgctatcctggggcctgactcgtctcatgtgatgctgtgattcccaggcctacgctacgagtttggtactcgtagtctgatccctagttcatcagggaaagcatggatagccctgccactacgccatggtcgatgcctcacagctcaaaacgtggcttgtgccactgtacacttgtaccctctcaccttgccctcgtccatcacagcaatgacatagccttttcgtctggtcttcctttttctttaaattcttaggcatccacactaattattcgtgtgtttatttcactactcatcactctcgtgggctcggttcattcttatctcctcgcttctcttcacctccctacctgtagttttctccactcgtcctcgtcctttgtccctgtccttcggggacaaaaacaaccaaggcgcaagcggtaatcttccgtggtgggggcgttctctgctgcaagcagtggtgacgccgcttggagggagggcgggcgggaaaggatggaggcggtggtggacctcaagtacctgccggttttcccgaacggcggcgtggccgcggccaagaagaagacgaggctcgggaccactgcggttgccggcggccagacgggggtgtactaccgggaatgcctcaagaaccacgcggcgagcctgggtggccacgcgctggacgggtgcggcgagttcatgccgtcgccggaggccgacccggcggacccgagttcgctcaggtgcgccgcgtgcggatgccaccgcaacttccaccgccggctaccggagctgtccccgccgccgcctctcctcgctttgccgccgcctccaccgccactggcgccggcgccggcgccggctgtcgcgccgcatgccatgcgtgacagccgcacgatgcgcggcgaggaggcgccagacgaccgcctgccggccgccttcgacgacgacaccgaggagtcggacgagggctcagatttcgaagaggaccgtcccctaacgccgctgccggcgccgggcatggtgccgctgccgcccggctaccgccaggtcgcgccacacatgctcctcgcgctgagcaccagcgcgccgggcgcccaaactcccgcggcggggcccaggccgcccgcctccctggtcccgatgccggcgcccggtgctgctgctgctgcggcggcggcggcggcggcgaggaagcggttccgcaccaagttcagcccggaacagaagcagaggatgcaggctctgtcggagcggttgggttggcggctgcagaagcgcgacgaggccgtggtcgacgagtgctgccaggagatcggcgtcaccaagggcgtcttcaaggtttggatgcacaacaacaagcacaacttcgtcggcggccacagccgcgcgccgcagcgcctcagcgtctgctgccacggccatccaccatccgttcatcgacgctgcccccgtctgcccttcctcccacgccgccccagcaccagccgccgctgtgcacctttccgccccagcgccagccgcctccccggccacgcctgtcctcgctgactccaacatcaacggcaacgctgccgactacttccgtgtccaaccttccacggcgagtggcggctcgccgcagtcgtcctagtcaagttagtgctaatcagccatggttatttgtagagcttcgtgtctaattaaccaaccctaatggagcgagcaatggtgggatgcatgggactatcgaatatggaagcgctagtgagaaggctgctgctggtctttgttaatggtggagcccaaagaaggatcttaaaaaatcgtggggttttgggatctgatgatgtaatgattcaggattagcgcttatggtactagtagactgttagtgtagcaatttgttcctgaactgtacttggataatgaccgggtggatccgttgtgctt

SEQ ID NO: 26 - DNA, 2266 bp, Zea mays
  misc_feature (46)..(46): n is a, c, g, or t
  misc_feature (2188)..(2188): n is a, c, g, or t
ttttttttttttgaagtaaaatatattttccttagtcatctacacntaattattcgtctatttattatttaactcatttttctttcactctcgtttgctcactttgctctcttcgttcttatctatacctacccgcttctcttcaccgccctacctgtagttttgcttttgtcccctcgtcctttgtcgctggctcgctgtcctccgggacaaaacagccaaggcgcaagcggtaatcttccgttgtgtgggcgtgctctgctgcagacagtggtgacgccgtctctctccgagaagaagggcgcgagggaaaggatggaggcgacggtcgacctcaagtacgagccgctgttcccgaacggcggcgtgtcatcggcgaccaagaagacgaggctcagggtggcggccggcggagagacgtgggtgtaccgcgagtgcctcaagaaccacgcggcgagcctgggaggtcacgccctggacgggtgcggcgaattcatgccgtcgccggaggccgaccgggcggacccgagttcgctcaggtgcgccgcgtgcggatgcaaccgcaacttccaccgccggctcgtcgagctgccaccgccaccgcctctcctcgccttgccgccaccactggcgccggcgccggctgtcgcgtcgcacgtaatgcgtgatagccgccgcacgatgcgcggcgaggaggcgcgcctgccggccgcattcgacgacgaggcggaggagtcggacgcgagctcggatttctacgaggaccgcccgctgtcgccgatgccggcgcaggcggcaattgtgtcgcccggctaccgccaggccacgacgcacacgctcctcgcgctgatcatcggcgcgccgagcccccaaacccccgcagcggcgccgcggccgcccccgcccacctccgtgggcccgatgccggcgcccgcgactgctcccggtgccgccgccgccgcggcggcggcggcgaggaagcggtcccgcacgaagttcagcccggagcagaagcagaggatgcaggctctgtcgtcgcgactgggttggcggctgcagaagtgcgacgaggcggcggtggaccagtgctgccaggagatcggcgtcagcaagggcgtcttcaaggtctggatgcacaacaacaagcacaacttcgtgggcggccacagcgcgcgccgcagcgcctcagcctcagcctctgctgccgcggccaacccggccatgcagcaaaggtccgacgccgccgctgtctacccttcctcccacggcgatggcgccccagcagcagccgtcgttgcccacccatccgctccaccgcccgtgcctgtccactctaacttcaacatcgaaggcaccgccgccgatgacttccgcgtccaaccgtcgacggcgagtggcggctcgccgcagtcctagtcaagttagtgctaatcagtcatggttatttgtagcttcgtgtctaattaaccaaccctaatggagtcctagcaatgttggatgcatgggactatgggggagttctagtgaagcctgctggtctttgttaatggtggagcccaaagaaggatcttagaaatgtgggcttttaggatctgatgatgtaatgaactaatgatccaggattagtgcttatgagtacagtagcagcgagtggtactacgtactagtagactgttagagtaactccaatagtctaattatagtcttagataaatttagagttagagttctatgaggatttaaaaaatagataacttcttaaacgatgggataaaccaacaaactctctaaatcttctttatccatgttcaaatcaccttacaaccggtcgttaccgcgcgaccttaagactgatcgtctgtcgtcgtgtaggccgagccacacaggttgcctccactgcttctcatggcctaaccttctcattgaaaacgaaatctttctcatctacgtaaacgatcaggtgagggaagggagggagtgcgatccggccgacccgatggaagccacactccctcttctatgtccactgcacggctagtaccaactggtggctggatggttgtgatctcaactgcctgcgggcccacacgtggcttcctaacacacatagggaggataatagggcgtggaagcggcatgaggacgacgagttccacatagcgcgagactgaaacggggcgtgaggganggaaggcccgcgacacgtaggataaaaacgagacggatacagacagatacagggttatctcgtattttactttaacgt

SEQ ID NO: 27 - DNA, 1223 bp, Zea mays
ctgcagaaaaaaatagtgattactggtaaaaacagaacaggaccctcgccgggctggcccatcatcgcttgcagttgcagcatcacaagcaaactgaagtcactcacagctctccagcttccatccagaaaggagaaggaaacaagctagtggacaaccaaccatgatcagcgccaagaagattgctcatctcgccaagaagtggcagaggatggctgcacaagggaggaagcgcctcgccttgggggcggcagcaaagcaagccgacgagtgctgcagctatgtggcgagcaagggccactgcgcggtgtacacggccgacggggcacggttcgaggtgccgctggcgtgccttagcaccccggtcttcggggagctcctacaaatgtcacaggaggagttcggcttcacgggcggcgatggcaggatcacgctgccctgcgacgcggcgatcatggagtacgccatgtgtttgctcaggagaggagcctctgctgagctagagcaggcgttccttagcaccatggccatgtcatgccactgtgccagccacatggcgccgtatgttggacgagctcacgagccagacagcagattgttgtttagtttctgttcagtgtagtgtagatagtggagcaaaggtattagctagataaatattattccaagccttctgatcgtgtgcaaggatgcgactaatcaagcaaggtcttaagaagttagagagacatgatttatgttctgtacttttcgaaaattgtgaggactactcacattacatagcgaaagactttcttgtgcccaactctgaattcaaatcagctgataggttgttcgttcaaaataaaaaatctgagaggttgctagtgcacaacacaaaagaaaaggagaaaggcaaaagatgagacataaaatctggctatcaggattcaggacataaaaactggctatcaggattcacgtggcactagtgcacaacgcaggtgcagagctctgtttggtagagcttcagcacttcaacgcaggtgcaggtgcagagctcatggagaattgactcccggaagcaggttcggatgcattcaaagtgtagagccaagctaatgtacggctgacatcctcgacagttttatcgcctcttcatggtacagtctatctaattaagcctgtccagcggctcagagaactttcaaacaactctatcgcctcttcagtttgcggtctgc

SEQ ID NO: 28 - DNA, 2935 bp, Zea mays
tgcagcagccgcccgtaccagagctctggcagctcaacactgtgtgactgcacgggtactctgtcagaaaggcacacggggggtgattggacagacgtgcggacggccgggggcagatgggcaacttatgcatgattctcaaatgattttccaagaacataaattcgaaacggggggcgtatatcatagtgtttgcaacgaatagtccgtgtagttcatttcacaccattccttatgattggactaaagtgaactttattcagaacgtgcttaactttattcagtccgtgtagttcatttcacaaagtcatacacaaacagctagccgctggctgcatggtgccaccggccacgacgctgactgcagtgtggcatggtgtggcctgaccatggagctcaagaacgctctcacgacttcttcttatgcgtctcctctaatcaaacccatcacgtactccgtccaccgtcgccgcgtcagggcttgttcggttctactccaatccatatggattgaggggattgagcgggtttcaatccctattaagtcaaaatctctctcaatccgtatcaatctcctccaatccatatagattgaaaataaccgaacaagccctcacagggcacgatgatctctgccgtcgccgctcgcgaacccaaactttgccacttggatgccatctgcataagtctcttggcattgatcatggttggttgccggctctcctttgctgagtggaattcagtgtctggtggtgttcagctagctagctagctagctaggtgtaatgcttagcttcctgaggggttgatgaggaatcgctgctaagatggtgcagtgcatttataggtgagaagaaacagcagagcaattccttagacaagcccacgacttagaacgacatgggagtgctgtgcaaggataaaacatggtgtggtactgattagcttttgctctggggtctgggctgggaccatctgtttggatccaccacccagtagcaatgtctgggtagctaggatatatcacaatgtgctgccatgctgcaatgcctcatgggccaccgaacaccacatgtacattgggttcaagatatctgacagttcctcgacagctttatcgtctcttcaattggcggtggatcgagtctactatctgattaagcctgtccagcgccggcggcccacacaagttgctcgacagctttatcgcctcttcaattcagtgtctgcagctggaccagtagcagcacgtcatgtgagcttttatttcgcagcattgcattgccatctctgatcgagtcgagagtcgagacactcagccagtgcttccgtgcccatgcacgttttgctgtcccttgcttgttgatcgccgatgcatctgaagacacaacaagcatggcagtccaggcactgaaagcgccccatgaccggcaccagcatgtgcccgacgacagacactcggccccatcaaaatctcatccaaaatcctgctcgctgacgcgtcttggaacatcgcactcttgcttgcccacccaaccatttcgctccagcggttgatcagtgagctatatatactcacggtcaggtggcctctggacatcatcgcttgcacttgcagcgtcacaagcaaaccgaagctagtcagtcacacacagctctccagcttccatccacaaagaagaaggaaacaagctaaccatgatgatgagcgccaagaagattgctcatctcgccaagaaatggcagaggatggccgcgcaagggaggaagcgcctcaccttgggggcggcggcggcaaaggaagtcgacgagtgctgcggctctgtggcgagcaagggccattgtgcggtgtacacggccgacggggcacggttcgaggtgccgctggcctgccttagcacccctgtcttcagggagctcctgcagatgtcacaggaggagttcggcttcgctggcggcgatggcactggcaggatcacgctggcctgcgacgcggcggtcatggagtacgccatgtgtttgctcaggagaggagcctctgccgagctagagcaggcgttccttagcaccatggccatgtcatgccactgtgccagctacatggcgccgtatgttggacgagccaggcagcatcagatcgttgtttagttagttgctgttccgtgtatgtagacgtgtagtgtagagcgatgattttaactaggtgggtgctattcaaagccttctgatccagcaaccgatcaagtgaggtgttgtaagtacaagagaataaagagacgtgattcttgctttgaacctgtgtttcatgccatgccatgttcaaatttcgatcaagagcgatacgagacaagatgatggacaacgactgtcaaacttcgatggttagtgacttcatcgtcaactaggtcactttgaaggagcgggggaactagcagccccttcttcatcgagctcgtttacctaattcaccaccggctccggcgaatccacacatatcaggtatcggcaccagcaacttcggtccgtgtcgagcagcgcacacaaggtggagtttgccaatctgttgtccaacaacgaggttgtttcatgtggcacaagtgcacaacttaaaggatataaagaaacacaaatgatggatcacaaaaaactggctatcaggatttaagagatgcaaaagacatgcgcccagcatgtcatatactcgtaactatctttatttgcgtaccatatttctggcctatatttttaccttcaatgcatatcactaccggaaacggacgctttgccgagtgcccgaagcactcggcaaaaccgtaaaaacactcggcaaaggctttgcccagtgtcgcactcgacaaagaaggctcgtcaaacagtgcatcggcaaagccttctttgccgagtactttttctcgggcactcggcaaagagggag

SEQ ID NO: 29 - DNA, 1137 bp, Zea mays
tgggccccgcgggcccgccgacatactacacacacgccgtcgcccgctgccagcgaacacgcacagcacacgccatctacgcacaggcacagcaaccgcaaccgcctgccgctcagtgcgtgccatgaagctggatgtcccggcgaggcagcagagcagccaggacgcagagcagagcggcaagacagtggccgcggccgtcctcggcactgaggcgtggagccacccggagctccctctcctcctccgcgacgccaacaccgacgacgccctggtgccgccgctcaacttcgccatggtcgacgacggcatcttccgctcgggcctcccggacgccgccaacttccgcttcctgctctccctcaacctgcgctccatcgtgtacctgtgcccggagccgtacccggaggagaacgcgcggttcctgcgcacgaacgggatccgccttcaccagttcgccgtcgaagggagcaagagtggtccgacagtgctggataccatgtcggcgcaggaaccattcgtccacatccccgaagaaacgatccgggaggcgctcaaagttgtccttgacgtgagaaaccagccggtcctcatccactgcaagagaggcaagcaccggactggctgcgtcgtcggatgcctgaggaagctgcagaagtggtgcctgtcctccgtgttcgacgagtacctgcacttcgcggcggcgaaggcgaggaccaccgaccagaggttcatggagctgttcgacgcgtcgagcctgatgcacctgacggcggcctcgcagtactgaccactgaccagagcggggcgagtggttcccgagcggtcccgatcctgccaccatgccgcatcaagcaagccgtttccccctgctgtttccgaagcaactcggcagagaataatgctggaaccatgagtgtgctgtgttgcgtgagtgctgtggttgcttcgtgttcaactggtttcagattctgaactggcacggcctgcattcacttgaatcactgaaaaccgaacatgtctgaactctgaactgaagctgttgctcagttcagacgttcccgccaatcttccgatccgaccagatggcacgaagtcatataccgaccatcatttttcgaaaaaaaaaaaaaaaaa

SEQ ID NO: 30 - DNA, 1025 bp, Zea mays
atctacacacgccgttcccaagtcccaaccgaacacacacagcaacagcggccacctgccgctcagtgcgtgcgccgtgccatgaccatgaagctcgatgccccggcgaggcagaagagccaggacgcagagcagaacggcaggacagcggccgcgggcgtcctcggcattgacgagccgtggagccagccgaaactccgtctcaccggccacgcgcaggccgacgccgacgccctggtgccgccgctcaacttcgccatggtcgacgacggcatcttccgctcgggcctcccggacgccggcagcttccgcttcctgctctccctcaatctgcgctccgtcgtgtacctgtgcccggagccgtacccggaggagaacgcgcggttcctgcagcagaacgggatccagcttcaccagttcggcatcgaagggagcaagagtggttcgacagtgccggatgccatggtggtgcaggaaccattcgtctacatccctgaagagaccatccgagaggcgctcaaagttattcttgacgcaagaaaccagccggtgctcatccactgcaagagaggcaagcatcgcactggctgcgtcgtcgggtgcctgaggaagctgcagaagtggtgcctgtcttcggtgttcgacgagtacctgcacttcgcggcggcgaaggcgaggagcactgaccagaggttcatggagctgttcgacgcttcgagcttgacgcacctggcggcctcacagtattgagcgctgaccagagcgagtggctcccgaccggtcccgatcctgcaaccatgctgcatcaagcaagcgattttcccctgctgtttccgaagcaactcggccgagaataatgctgctggaaccatgagtgtgtccgcgagaattgataggcaatggccttaggttttgttgtgtgagtgctgtggttgcttcgtgtgcaactgatttcagattctgaattggtgatggctgtgattggtgatggccgaactctgaaaaaaaaatgtttcgacgccctg

SEQ ID NO: 31 - DNA, 2803 bp, Zea mays
gcagcgagaggaaagagaaaaaggaaaggaaaggacaaaggagcggcggcgaggtctatggcgtcgacggctgggtacctggcgcggcgggcggcgcagaaggagcgggtgcgcctgctctaccgcagggcgctcaaggacacgctcaactgggccgtccaccgccacctcttctaccaggacgtcagttccccccctccgcctccctctcgatcttgatctcgatctcgatctgacgtcgtgctccctctcccgcgcaggcgtcggatctccgggacaagttcgaggccaaccgacacgtggtaaggcctcctcctgccgatccctttccgcagacctcgcctcccacgttttgcttctgtctggtgctctatatgatgttgggtttcgcgtggggttggtggtgcaggataacctggacgtggtcgataggctcatcgacgatgcggaggctcagtacaggaacttccagcaccccgatccctacattggtaagcttttttcttgttctccttatcctttctgaccagtgaaatgtttcgcatcaaatcatgtcgaatggcagcattgtttggatagaccattgcatatggattaaattgactttatagtgaatctttcagagttattgcagaagtttatagatttatacctgctagggtattcaaccacacttttcgttttggtcgaaaccttcaagtgcctagagtttagtttactggcatgcaatcctcatattgcgcagctcctagtaacagtttcaaataataattaaaaaaaaacaagtttgttcagccctagtaacaccgatggttataatcctatttgatgagatgagatgcaagtgaaaagttagttgtagttgattgtcgtcaaagttttaatcttatatagaatgattgtgctagtgtgtatgaactaccaaatgtgcgaggcaagtctctgctggaaccctaaagcctaatctttatatgcctcttcttatctctgcagttccatgggcaccaggcggcactaaattcacaagaaacccccctccacctcaaggggtaagaccacagcttacaccactctttatgcgatgtaatatatttgtgttatgctaatttgattcactacaatgccacaatccttaccgttcataatattttgcttctctgtctcctgtgatcgcttaaaaaagtacactgttcctagtttaagctaacttagtttgaacgcaagggatgtagcagtacttaaggtttcatctgtaatttctcaatggatgagcgagctagagtttttatttaaggcccctttggaatgcgggtttttttagttgcagtgctttggccaaaattataaattcatcgcaggaacttttaccaattcttacgcaaatgtagttgcttttacagttatttcataaccgagtatcctctacttggacgtgatggggtgaaccatgccaaacatctctgctgccatagtatcatattattggcttaaagtttacaaaatgacttcatcttctatggccacattaccctaccccgtcccccctcccacacacactgatttgctcgccaagttcgtttttcatagcaccgtttcctctatttggatgctacagagtatcttatagagttaacaaaacaaccttgttttttatggcggcattatcttgtttagctttgctgaactatcttcaggtacatgtagcaagattctgtacaccaaaatgttgtactaatggcgttgcacctcaagggatcgagatcatctacaattatggcaaggaggaccagtaaacaagagtcctgcaagcggggggcagaacttccacagttccaaatcacttcctgtttaatcgagttgttgtacgagaaataagaatggaaattactggactccatccatgcttctcatttgcttgttctgataatcatgtgctcttcatctagtgcatattgaagtcatgtttcctgtcataaaatggaactgtactatctttgtcgtgcagtttaaactgaccgccggcatctcagtttttttctttggtttttctgcgttttcacgtttttctagagaaagtatatagattcatgacataagatttatgtttttagatttactatgaaaaatactttcataatatatgattcatatgctgtaattcatatgctgtggaactataaggacctgtttagaagtattctcataatttctaaacaataccatgatttatatgaatactggagtattttatgttataaggtgtttggttttatgttataaggtgtttggttgtattcttaaaaactatgttttcaaattcatggtatggaattcttgataccattttttttggagtattgtaaactccattacaatataaaaattttatggtatggttagcttttgcttaaataccacggtttgcaatgttagactatcttcagtagattacccatcatcatctccatatttaaatttttctctataaacaacgtaatctacaatgtaaaacattgtttatggtaacaatatgtgtgaaccggacacggtcttatatctaaatattgtttctagttttttaagctgtacaaaactatagcattgttataacaattataaagtatagtattataaactatgttttttttaaaaacatcattggcacagtccaaaaggattttttattagaccaaataaatttgattttttattagaccaaataaatttgatgcgacatcgccgacatgtaacagaaatggaggaaatatgtatataagatggtaatctctctgtcccaaaataa

SEQ ID NO: 32 - DNA, 850 bp, Zea mays
ccgccttgggcgcctccaggccccccccgggaacctcccaacccgactactactgcagtgcagcgagaggaaagagaaaaaggaaaggaaaggacaaaggagcggcggcgaggtctatggcgtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacattgttccatgggcaccaggcggcactaaattcacaagaaacccccctccacctcaagggatcgagatcatctacaattatggcaaggaggaccagtaaacaagagtcctgcaagcggggggcagaacttccacagttccaaatcacttcctgtttaatcgagttgttgtacgagaaataagaatggaaattactggactccatccatgcttctcatttgcttgttctgataatcatgtgctcttcatctagtgcatattgaagtgatgtttcctgtcataaaatggaactgtactatctttgtcgtgcagtttaaactgaccgccggcatctcagtttttttaactttggattaacaacgattacacgtttttctagagaaagtatatagattcatgacataagatttatgtttttagatttactatgaaaaatactttcataatatatgattcataatatataatccggaaaaaaaaaaagcggcc

SEQ ID NO: 33 - DNA, 1968 bp, Zea mays
  misc_feature (1967)..(1967): n is a, c, g, or t
aatgctacactagaaccaaaagtccatacggcccggggcccgggcgtccccaaaaacctcacccctctcttatccgccccaacggccgcccgccggccaccacctcaccggcgagatgctgacctgcggccgctttatctcctcctccgctgctaccagcaccgcatcctttttcccgtttcggactctcactcgctccctcgttcgccgccccgctccccacctcctctcctctgcctccgccgccgccgccaccgccgtggaactcgacaccaatggagacggtagtgcgggaggtggtgccggtgtggtgaggccgcagtggaaggccgcgattgatttcaaatggatccgagacaaccgggatgccgtcgccgacaacatccggacccggaactctaccgccaatctggacctcgtcttcgagctctacgatcagtacctcacactgcagaaggaggttgaaaggctccgagctgaaagaaatgcggttgccaacaagatgaaagggaaactagacccatctgttcgccaagcccttgttgaagaaggtaagaacctgaaagagggacttatagcactcgaggaggatcttgttcagctgacagataagcttcaacttgaagctcaaagtattcctaacactacccatccagatgttcctgttgggggtgaggaaagctctgtcctcaggaaagaggtaggcagtcagaggagcttcaattttgcaatcaaagatcatcttcagctggggaaggaacttgatttgtttgactttgatgcagcagccgaggtcagtggttcgaagttctactacttaaagaatgaagctgttttgttggagatggccctagtaaactgggctatttcagaggtctccaagaagggtttcacaccactcataactccagagatcgtaagatcatctgttgttgagaaatgtggctttcagccaagggccaaaaacactcaggtatactcaattgaggacagtgatcagtgtctcataggcacagcggaaattcctgttggaggcatccacatggactcaatacttgccgaatccgctttgcctttaaaatatgtagcatattcacactgttttcgcacagaagcaggtgcagcaggtgctgccactaggggcctctatcgggtacatcaatttagcaaggttgagatgttcatattctgtcggccagaggagagtggaaaatggcatgaagaacttattacaattgaagaggatctttatgcatcacttggacttcatttcaaaactctggacatggcaactggggatctgggtgcaccagcctaccggaaatttgatatcgaggcgtggatgcccggcctagagcgttatggtgagatctccagtgcatcaaattgtaccgactaccaaagtaggcgactaggcatccgttaccgcccatcaccctcggagcctccatcaacgagcaccaagaaagggaagggagctgcctcaggccctacgcagttcgtccacacgctcaacgctacagcagtggcggtgcctcgtctgatagtttgcattctagagaattttcagcagggcgatgggtcgattgtggttccagagccactaagaccctatatgggtggactagagttgctctccccaaaattcaagtgaccctctacggtcacccgctgttgtgcttgtgtggacttagaactgtctggctgaagtacaagttaaaggaaggtcatttctcactacaaatatacactactgagtttcgtgattgggggcttctgtttcataagcagtcgactactctgatctgatctgcatagcattatactggtcggctactctgatctgcatagcactacaaagcttatgtgcatgcattaggccctctatggttcccaagaatcgagtgacatttaaaagtaatctaatactccttacattctaaaaaaaaaaaaaaaaaacccgcggnc

SEQ ID NO: 34 - DNA, 2411 bp, Zea mays
tgaaccacattatgagggagagagatcccaatgggcacggtctccccaataatatggatccagcatactcttataccctcgctcgcggagatggatcgcatccaaataatcttcatgattctaatcaccattgtggagaaaatgactctttgtcttctaggaaagtggcaatgccagaagcttctacaagtgtggatgctggtttcaagcttgattcacatcatacatctaatttaaaggatgatccaccatccctttcagttggtctggcttctaattttgcaccacagaatggaccgaaagaccatatcagaattgcacctactcagcagcaatcacaaatgacttcctcctcattgcagaaacaattctattctcatgctgtaactggttataatgaatttcaagcacagatgcgcaatggaagacccagaatggattcaaaggctagatcacaattacttccccgctattggcctagaataacagatcaagagctacaacacttatctagcgattcaaattctgttattactcctttgtttgaaaagatgctaagtgctagtgatgctgggcggattggtcgtttagttttgccaaagaagtgtgctgagacatacttccctccaatctcccaacctgaagggctccctttaaaggttcaggatgccagtggtaaagaatggatattccaattccgtttctggccaaataataatagcaggatgtatgtattggagggtgtcacaccttgcattcagtcaatgcagttacaagcaggcgacacagtaacctttagtcgaatagacccagaagggaaattgatcatgggcttcaggaaggcaactaacaattctttcgaacaggagcaagctacaaagcctgccaatggcgccctagcaacttcagaagcaaatggtaaagtttctgccccagattccagtccaaatgctgcagtttcccgtcaaaacaagctcaacacagagaccaaaagttctagtcctgtggaacaagccactgcattgaaaatggacaaggatggattaacacagaaggaagggcctggaactggtagttcttccccaggttctgtcaagagaaaaacaactattcttggtcaaaagaataaaagattacggatggataatgaggaatcaatggagttgaagataacatgggaggaagctcaagaattgcttcgccctcctcctaaggccccatccattgttattgttgatggccatgagtttgaggaatatgaggagccaccggtacttggaaggaagacttattttgtagcagataaatcaggttcgaaccatcaatgggcccaatgtgaagattgttccaaatggaggaaacttccaatagatgctctgttgccctccaaatggacctgctctgacaacaaatgggatccagagaggtgttcttgcgaatctgcacaggaaataagtatagaggagcttgcagaattcattcctataaaacctgccaaaaagcccaaattgaagatagaatctgatgctatcgatgcttcagatgggctggacacgcttgcaaaccttgcgattcttggtgaaggtgaagctctcccttcacagccaacaacaaaacatccccgccatcgtccgggctgctcatgcatcgtctgcatccaaccaccaagcgggaagggtccaaagcacaagcaaacttgcacctgtaacgtttgtatgacggttcgccgccgtttcaggacactcatgcttcgacgcgagaagaaggcgacaaaggatctgtctcgcaagaaagagacgggccaatccagtgagaaggccacacaacaagctgtgtccggtcctccaggagccaatgccactgcaaccagatctgcccagaaagcagatggaaacgccgatggacctgaagacatggccgtcgatcacaaggtgacaacatcctctcccgtcaagaaccatattgacctgaacatccaacctgaacgggacgatgagcagtcaccgaaatctggtgcggctggtttgttgagccgagacaatgcaacttagagagtggatagcgtggtttgattgatcataccataccaatgagtggacatagataaccgatcgaacatatccttccgaatgtctatacccttgttttttttaagatagatgtggcgtgaggcgtggggtcttgtagtgtagctgttaccttcccataccatagagccggtttccttttaccctgagactccagtggtaatgttatcgtgtataccaaagggcaggacacccgtaggtgttgcgtggggacttgcataaccctgtatgcatgtatattgcaagaccagctcgttttggctgaatgtgaaccgtaagttgctactgtacccctgcacatatttcccccgaaaaaaaaaaaaa

SEQ ID NO: 35 - DNA, 1868 bp, Zea mays
accatatcagaattgcaccaactcagcagcaagcacaaatggcttcctccccattgcagaaacaattctattctcacactgtaactggttataatgaattccaagcacaaatgcgcaatggaagacccagaatggattcaaaggcgagatcacagttacttccccgctattggcctagaataacagatcaagagctacaacacttatcaagcgattcaaattctgttattactcctttgtttgaaaaaatgttaagtgctagtgatgctgggccctcgggccggcgggttgtgcctaagaagtgtgctgaggcatacttccctccgatctcccaacctgaagggctccctttaaaagttcaggatgccggtggtaaagaatggatattccaattccgtttctggccaaataataatagcaggatgtatgtattggagggtgtcacgccttgcattcagtcaatgcagttacaagcaggcgacacagtaaccttcagtcgaatagatcctgaagggaaattgatcatgggctttcggaaggcaactaataattcttttgaacaggagcaagctacaaagcctgccaatggtgcaccagcaacttcagaagtaaatggtaaagtttctgccccagattccagtccaaatgctgcagtttcccgtcagaacatggtcaagacagagaccaaaagttctagccctgtggaacaagccactgcatcaaaaatggataaggacagattaacacagaaggaaggacctggaattgctagttcttccccaggttctttaaagagaaaaacaactaatcttggccaaaagaataaaagattacggatggataatgaggaatcaatggagttgaagataacatgggaggaagctcaagaattgcttcgccctcctcctaaggtcccatccattgttattgttgatggccatgagtttgaggaatatgaggagccacctatacttggaaggaagacttattttgtagcagataaatcaggtttgaaccatcaatgggtccagtgtgaagattgttccaaatggagaaaacttccaatagatgccctgttgccctccaaatggacctgctttgacaataaatgggatccagaaaggtcttcttgcgaacctgcacaggaaataagtttggaggagcttgcagaactcattcctataaaacctggaaaaaagcccagattgaagatagaatctgatgctattgatgcttcagatgggctggacacgcttgcaaaccttgcaattcttggcgaaggtgaagcgctcccttcgcagccaacaacaaaacatccccgccaccgtcccggctgctcatgcatcgtctgcatccaaccaccaagtgggaagggtccaaagcacaagcagacatgcacctgtaacgtttgtatgacggttcgccgccgttttaggacactcatgcttcgacgcgagaagaaggtgacaagagattcctctcgcaagaaagagacgggccaatccagtgagaaggtcacacaacaagccgtgtccggtccgccaggagccaatggcagtacaaccagctccccccagaaagcagatggaaatgctgatgcgcccgaaaacatggccgtcgatcacaaggtggcatcctctcccgtcaagaaccacattgacctgaacatccaacctgaacgggacgacgagcagtcaccgaaatctggtgcggctggtttgttgacccgagacaatccaacttagcccttgttgttattcctgtcccatatggattggatcccatatggaattatggattggatgagattggaaaacattatgaaaaattttgacttgtttagaatttaagcccactcaattccaccc

SEQ ID NO: 36 - DNA, 700 bp, Zea mays
aaaaaaaaggcgacaaaggattttttcctgcaaaaaaaaaacagggccaatccagtgagaaggcccccccaccaagctgtgtccggacctccaggagccaatgccactgcaaccagatttgcccagaaagcagatggaaacaccgatggacctgaagacatggccgtcgatcacaaggtgacaacatcctctcccgtcaagaaccatattgacctgaacatccaacctgaacgggacgatgagcagtccccgaaatttggtgcggctggtttgtttaacccagacaatgcaacttaaaaagtggatagcgtggattgattgatcataccataccaatgagtgggcataaataaccgatcgaacatatccttccgaatgtctatacccttgtttttttttttaaataaatgtggcgtgaggcgtggggccttgtagtgtaactgttaccttcccataccataaaaccggtttccttttaccctgagactccagtggtaatgttatcgtgtataccatagggcaggacacccgtaggtgttgcgtggggacttgcataaccatgtatattgcaagaccagctcgtttcggctgaatgtgaaccgtaagttgctactggtacccctgcacatatttcccccaagttggcaggaaaaaaaaaaaaaaaaaaaaaaaaaaaaccgcgggagggcgccccggcacc

SEQ ID NO: 37 - DNA, 1599 bp, Zea mays
agcctgaacgacttataatttgaaagatagcatgtttgaagtttcatttacttgcatgatgagctataactgtatttaatggtttgttgtagccaaaaagcccaaattgaagatagaatctgatgctatcgatgcttcagatgggctggacacgcttgcaaaccttgcgattcttggtgaaggtgaagctctcccttcacagccaacaacaaaacatccccgccatcgtccgggctgctcatgcatcgtctgcatccaaccaccaagcgggaagggtccaaagcacaagcaaacttgcacctgtaacgtttgtatgacggttcgccgccgtttcaggacactcatgcttcgacgcgagaagaaggcgacaaaggatctgtctcgcaagaaagagacgggccaatccagtgagaaggccacacaacaagctgtgtccggacctccaggagccaatgccactgcaaccagatctgcccagaaagcagatggaaacaccgatggacctgaagacatggccgtcgatcacaaggtgacaacatcctctcccgtcaagaaccatattgacctgaacatccaacctgaacgggacgatgagcagtcaccgaaatctggtgcggctggtttgttgagccgagacaatgcaacttagagagtggatagcgtggattgattgatcataccataccaatgagtggacatagataaccgatcgaacatatccttccgaatgtctatacccttgtttttttttttagatagatgtggcgtgaggcgtggggccttgtagtgtagctgttaccttcccataccatagagccggtttccttttaccctgagactccagtggtaatgttatcgtgtataccatagggcaggacacccgtaggtgttgcgtggggacttgcataaccatgtatattgcaagaccagctcgtttcggctgaatgtgaaccgtaagttgctactgtacccctgcacatatttcccccgagttggcaggaattgttacattacattcgtaggatgaatgagctttgtcttacgagtttgctccattctttatttaaaaatgatttatgacatgtaccatttaaggccaaacgaacaccggtacgcgtgttttcggtcagcagagtagagtgggatacaatacacccacggtttgcgcaaacttgagaggaatatgctaacgagactgtttaaaccaatactacttcaatcaaaaatatactaagttaaaaatcgttttagttaataggtttatagaatacttgacatatatattttatatatgtgttcaagtttttcatctatttagtatttaaatatagacataaaaacctgtgttcaagtttttcatctatttagtatttaaatatagacataaaaaccaagaaccaaaacgattactattttaaaacagatagtataaccgatggcataatgatgcggtaagttggtgagccgattacgttgtgaggtcaagtctggccacgcacggcaggtcaggtcagctcagattagggatggatatcgagcagctcggctcgttatagctcgttattgtaacgagctagctcggctcggctcgttatacta

SEQ ID NO: 38 - DNA, 6718 bp, Zea mays
atataaatttttacacttgggtaattaaccagataggcagcggtgcaagcaaaatgatgacccatataggtgagactactatgtgtcagcgtaacagaataatcatttgcatacaaataatcatctgcataaaaaagaatactttatttttgctttcccatagtgttatacaacttgggtttcaaatctatccactaacatataattaagttaagtaaagcatacaaccgagataacacaatatatatgtggaatcttaaatgtgatagccgttgacacaccagtattttaaccaagacaacaagaagtgcacaagattttgccaaatactcattggagccctacacaagggaatgcacacgcgagggttaactctcgataagataactttgtggataacctcggtccttctctatgcgtaagtgatgctccagttgttgcctctcctagattcttcgtactgtatccactatcgagtttttgactgaaacgcctagggccttgttccctctagtacatgatggtggccataacataatcataattggtatatgatctcataggattacaagctcctcctggtacaactaatacaatggtgcacgcaagcaccaagggtagaggtgtccattcctcacttctaatcattaggacaaacatagagcaagcgctactgaagtggtctaattaacctaaatacttcacaaaatacctatgctaatcatggagtgatgtttgagcatttgagtgtctagagctactagagatgagcattaactcttttgtcgtgttccttagctcccacacatctccaatagtcgattgggtggatatatatatatctctagtctaaaaatagatgttggaaatggcacataaattctgcatacttactggacatgtccgttatagtcatcgaacacgttcgatgtgtacacaatagttagtcgttggaactagccattgccgaccatttgaagctcgaacatctgatgctttgagcgttgtagcccctctcggatgcattgtagcccccttgagttaatgtgcaacctctttgagcgccctgtccagtggggtatccggtgtcacaacaacacgtttggtgccttatggatcttgcgtgtccggtgtattctattttagtagccatcttttaatttatggggtgtttggcgtaactccgaagcaaaactccaaggaggagctagccagagccaaccaactactctaaatctagagcctcaaactccttggagttttgagagtcgcatcataaatttttggagtacctcggcgtcaggactagtggcgccaacctcagtgctgagatccatggcgccgaggtccctgcccggccacatgcacgcatgacctgctgccctgacgaaccgaacacaagtacgtacgaggcacgtgcactagagcaggctgcaaacagtgacaggcacacactgactcatccaggcatccattcatcctcatgcatgcgtcgatgattgcgccgcatcgtggtcgtatgttgccgacattacttgttacatatagaagaattcaccatgccatagtagcgaagaaccaactcgtatagagctttggtccttgtgtggactaagagagtggcacccttttgttggtgctccagcgaggatgggcaatactgacttttcgagaactcaacaaaatctagaggtactcgagagaaaccttttcaaaaggacgatacacgtataggtggcttccgctcttagtctgtctcgtgtttcatctcctatcttattctttattttaaactttactctataaacagtttaaaacaatatcatctacagtgccgtgtctcctattttacacgatccaccgaagacagccttaaaaacgaaggtacctaatcaattcaggctccttccactgtggaatgcgcatagactcggtcaactctttcgagtcctcgtcctcagcctatagtcttcacaggtagacatgaatgcctgattgcaaagggtcagggctcagggcagacctgtccccctgtcctcatcccctttggatttcagggagtaaagtacatacatctacctccagttaatgctaaccaatgccgggtctccccaaaattaatggttcttgaattgaatgcacggagagacccctcacacctcccagtgaacatgcttttgacagacgaattttaaggaggattgagaccagaatatcatctctgtacatatatacatatccctaccacccaaataggagtatctactcggtcggttcaaggacaaaagagatcagaccacggacgtaacacactcgtcagcgtctcactctcacaaaatactagtagcatctctttaatcgatgacaattcacgacaccgctatcatgtgacaaacgacagcactcgcattgcagagagacaggcctggtactggtacgcaccgtgttctttggtctagtccgaccgtgccattctagaagacctcaccagagaaaacaggaggtgaccagatcaaagttcgaataatcggtagtggaaacctgaacgttagcaaagtattagcaatgaatgacgaagtcctgactgattagccacgaacgaccgtctcgttaaactactccaagccagcccctgcgcgctggctctttagccgccgccgccgccgccgccacaaatcagcaacacttccgttggcttcccaccattcgctctcgtctttcctaaaaaaaataatttcagccaacggtcagcatcacgtaacagatattagcgtttctgctcacaggtatgaatcaagaaaaataatgtgtgccgtgttcagctgcacaacaaaccagctggacacaagggctgcaaaaatcaattaaaatgaccggcgaattttcagcggacagagaaatcgaagagcacattccttacctacaattcatctaagaagaagccacagaattcttgtgtaatcattttcagcgcaagactggaattatgttatttggttatttggttgtgtacctgtcaaatagcatagcaccaggtcaaatacggcacattttgtcattaggccacgaagtggagccttgctgtccataaagacttctgtacccagccgccgccgcaaccaattactccagaagtccaaatccctctctcctccctcccagcaccagccctggctgctccaccgagctcccatccatggctcctgtcttcttccttctacctctcctactcggccagatccttctctgcgcagccggcgacaccatcaactcgtccacacccttgtccggcgcgcagaagattgtgtccaagggcaacaagttcaccttgggcttctacaccccaccccaaggtaccaacacctcctccaaccagggtaactactacatcgccatatggtacagcaacataccactgcagacgacggtgtggatggccaaccccgatctgccggtggctgacccgaccaccgccgccttgaccatcggcagtgacggcaacctcgtcctccttgatcagtccaagaatcggcaggtgctgtggtcgacgaacataagtactagctccaattccaccatcgctgtcctccaggacggcggtagcctcgacctcagagatgccaccaattcatccatggtttattggcgaagcatcgatcatcccaccaatacctggcttcctgggggcaagcttgggctgaacaagaccactggtgtgagccagcggcttgttccatggactaacaccgccaacccctctcctgggctgttctcactggagttggatccaagaggcacgacgcaatacttaattcagtggaatgattccataacatactggagcagtggtccttggaataataacatctttagccttgtgccagagatgacctctggttacaactatgacttccagttcatcaacaatgccaccgagagctacttcatctactcaatgaaggacaacagcatcatctcgaggttcatcatcgatgtggatgggcagatcaagcagctgacatgggtgcctgcctcccagtcatggatcttgttctggtcccagccaaggacacagtgtgaggtgtacgcactgtgtggggcctatggtagctgcaacctcaatgcactgccattctgcaactgcatcagggggttcagccagaaggttcagagtgattgggacctccaggattacagtagcgggtgcaaaaggagagtaccattgcagtgccagaccaattcgagctcttcacaggctcagcctgataagttctataccatggcaaatgtgaggctacctgataatgctcagactgctgtggctgcgagctctcaagactgtcaagtggcttgtctgaacaattgctcctgtaatgcatatacttataatagtagtggctgctttgtttggcatggggatctgattaaccttcaggatcaatacagcgggaatggaggaggcacactcttcctcaggcttgcggcttctgaactgccaggctccaaaaggagcaaggcagtgatcattggtgcagttgttggcggagttgctgcagttttaattgtcctttctattgtggcatacttcctatttcagaaataccgccgagagaggactctcaggatacccaagactgctgggggcacactgatcgcctttagatacagtgatctgcagcatgtcactaataacttctcggagaggctgggtggaggtgcctttggctcggtgttcaaagggaagctcccagattcaacagccattgctgtgaagaggctcgatggagttcaccaaggggagaagcaatttcgtgctgaggtgagcaccattggcaccgtacagcatgttaatttggtccgcctccttggattttgctcagaaggatcacggaggctgcttgtgtatgagttcatgccaaagggctccctggacctgcagctattccttggtgagacaacagcactcagctgggctaccaggtaccaaatagcacttggaacagcaaggggcttaaattacctgcatgaaaaatgtagggattgcattatacactgtgatgtcaagccagaaaacatactcttggatgagtcatttgtgcctaaggtggctgattttggtctagcaaagctcttaggcagagacttcagccgtgtattgacaacaatgagaggaacaaggggttaccttgcgcctgaatggatcagtggtgtggcaattacagcaaaggcagatgtctttagctatggcatgatgctcttcgaactcatatcaggcaggagaaattctgaccacggagaacagcatggatccacctttttcccaacctttgctgccagcaagcttcatgaaggagatgtgcggaccttgttggaccccaagctgaatggagatgcaaatgctgacgaactcacaagagcttgtaaggttgcctgttggtgcatccaagatgacgaaagtgctagacctacaactggtcagattgttcaaatcctcgagggattccttgacgttaacatgcctcctgttccaaggtcattgagagttcttggtgaaagccctgatgttataaacttcttttcagatatatcttcaaaccagacttcccagacacagaacagcacaacttcccagacacgcagtactacttcaggcagttcacatctccaaagtccatagatcagataacctgcaatttattagggcaatacttgaagagcatgagtaaatctgtacatgattagaacctaatatactcagtttttgtatcactatgcttcagtactgtaaatttagtgcagaatgtcataaccaaaacaaggaaggtactactgttgcatttacattacacatgcaagattccccattttctcttactaaatgtaaaaaatcaagatgactatctcatcgaagttgattgattgagatgcttaagttttctcggcccctaagaaataataacacaaatgatgtgcacataattttttgggggttacttgcttattttttgtattgtatttttatttttgaaaagcaatctcagcatcattcactaaagaaggatgtgcacagctaaacttattttaggagcaattagtcaaaaacacaagtattgctcataaatcaagtactttctagatatatgtagagtcatgggatcattcagacagggatgaagattcggtcaggttattatggactttagatgcaaagctagaatgttgcaggcatggtacaatgagggaaaccactgcttccaagatctcttagactaaagaacattttcaaagaaaacttccttcagtttgacagacaacagtttctcactatctctaactatcaataccatggggaacaggactaaaaaaattaggatatatggaaaaaatgcattgattgcattcaaaacgagagcacagtacaaagcaatttatactcaactaaataaacaaggaactagttagagattaactatcttatccatggaccatagctattgttatgcacgcttcagatttttagattttccactagactaattagatggagtacccagagaggtgatacagtacttggaagtttaacgcattaagaatcccatgtaactccatccaataaagtcgtagactcgtagtatagtagcataataagtgaaagaccatcaccacgaaagaaatggcagtagtatagtccccatgtatctataacattaacatgctc

SEQ ID NO: 39 - DNA, 1792 bp, Zea mays
tttttggcatggccatatttcatcactcatcagtccaccaacgtaatcgcatcaagccccctcacgtctccggaaattccaaactggggggcccctcccccgcgcctcggtgtgacgactggcgaggaccttgctaacaacagccagggcagcgtccagggggcactctgcaaagcgcgcgaccggacggcccggttcgttctcgacctctcgtctcgctcatccgcccgcccccgaggaaggaaccctagcctagccttgctccgaccggtcgccgcggcgactgcgacgatgatggactgcgctggaggccgagaccccgtggaggacttcctcctcggcggcgccggcgccggcgacgacggagatctcgtcgccgtcttctgcgacgacggagggtacggcgatgccgaccggagcacccctttctcgtcctagtatatacttacatgtggactgcgtttaggcttacggaccggtgcatggggttttatactcccgagggtcgttgtcgctgcggattccttttttgttttgttttgttttaattttgtgggcggtggtagactggttgcttgatttggctggtgtagattctaaaaactatgtgctaaccgaaacagcatgcgcatatatctttctctcttttttttctgtccaagggaaagaaggaaggcttgtgtgtatctgccagttttcggtctgcgattctgtagcctaacctatggtcatgcgactatgcgagttagattaatcagcgatctgcagtgctacttggtttgcattatcatgatcccctaggcgttttcttcttatcttttgactgaaatgctagcagcacaatagtttattagatgcttgagcagctactctgcactttcatttcctctgtatgtatttcctagtgtggaatttggtacttactttgcaattgtagcagacttgggattgagggtatccatggagatgcttgtggatttgagcaatctaatttggggaaaaggggtagagatgaaccatgttcatctggcccaacatccaaagcttgtcgtgaaaaaatgaggagagacaagctgaatgacaggttcctggaattaagttcagttatgagtcatggtaaggaagcaaagttagataaagcaaatatattgagtgatgcagcccgtatggtggcacaacttagaggtgaggcagaaaagcttaaggaatcaaatgagaagctgcgggagaatatcaaggatctgaaggaggagaagaacgagctccgtgaagagaaagtgagactaaaggtagaaaaggataggctggagcagcaagtcaaagctatgagtgtagctcctacaggatatgtaccccatctccctcatccagcttcataccatcctgctgcgttcactccatttgcgccgcctccagccaacaaaagtgctccaatcccagcaccgttccctgggatggcgatgtggcagtggttgcctccgaccatcgtggacacaactcaagatccaaagctctggcccccaaatgcttaggggcagctaccttggaatgttgtctcattgtgccttttcatgcatctggtgggcaaatcagtgtcagttaggtccctggagactggagaggaatcaagttcgcaattcgcgccatgtttatgctgtaacagctggtttccagcactagttatgaacttactatgttctactgaagggtggtgcctgtaattaatatatggatctcaaccctctagttggcatgtatatcatttgttctattcgagagctgcattttaagg

SEQ ID NO: 40 - DNA, 1396 bp, Zea mays
  misc_feature (8)..(8): n is a, c, g, or t
atcacccntttttttccgcccaccaccacgcaccaaccaaccctccaccaacttcatcgcatcaaggcccctggcgtctcccgaaaatccaaagggccccctcccccgcgcctccgcggggacccggggccccatcggggcgcacccagagggcggaattctgcaaagcacgagcccggttcgttctcgacctttcgtctcgctctcgcccgcccgaccccgcggagccctagcctagccttgcccccgaccgcggattccccctcggccgccgcgcgcccgcacccgcacccgcgatgatgaactgcgccggaggcggagaccccgtggaggacttcctgatctccggcgccgtcgacgacgaagatctagccatcttctgcgacggaggacttgggattgagggtgtcaatggagatgcttgtggatttgagcagtctaatttgggcaaaaggagtagagatgaaccatgttcatctggtctaaaatccaaagcttgtcgtgaaaaaatgaggagggacaagctgaatgacaggttcctggaattaagttcggttatgaatcctggaaaacaagcaaagttggataaagccaatatcttgagcgacgcagcccgtatggtggcacaacttagaggtgaggcagaaaagcttaaagaatcaaatgagaagctgcgggagaatatcaaggacctgaaggaggagaagaatgagctccgcgaagagaaagtgaggctgaaggtagagaaagataggctggagcagcaagtcaaagccatgagtgtagctcctacaggatatgttccccatctccctcatccagcttcataccacccggctgcatttgctccatttgtgccgccacagcaagctgcaggcaacaaaagtgctccaatccctgcacctttccctgggatggcaatgtggcagtggctgcctccgaccatcgtggacacaactcaagacccaaagctctggccgcctaatgcttaggggcagctagctgccttggggtgttgactcgccaatcgccatgccgtttcatgcattgggcggcagatcagagtatcagttagtaggtccctggagaggaggaatcaagtttcgcaactcgcgtcatgtttatgctgtaacagttgcttccagcagtcgtcatcaacttgctttgttctattgaagggtgatgcatgtaattaatatgtggatcttaaccctctagctggcaaatgtgtcctttgctgcctaaagaaaaaaaaaaaaaaaaaaaaaaaaaaaaaaacgccattcctgttcttggtgtccgagattttgccattagctttgtgagacacatacatagcaggaaaagaattcgatgaactaaatctttaaaccgtctcaaaaaaaaaaaaaaaaaa

SEQ ID NO: 41 - DNA, 1157 bp, Zea mays
  misc_feature (2)..(2): n is a, c, g, or t
anggcagcgtccagggggcactcggcaaagcgcgcgaccggacggcccggttcgttctcgacctctcgtctcgctcatccgcccgcccccgaggaaggaaccctagcctagccttgctccgaccggtcgccgcggcgactgcgacgatgatggactgcgctggaggccgagaccccgtggaggacttcctcctcggcggcgccggcgccggcgacgacggagatctcgtcgccgtcttctgcgacgacggaggacttgggattgagggtatccatggagatgcttgtggatttgagcaatctaatttggggaaaaggggtagagatgaaccatgttcatctggcccaacatccaaagcttgccgtgaaaaaatgaggagggacaagctgaatgacaggttcctggaattaagttcaattatgaatcctggtaaggaagcaaagttagataaagcaaatatattgagtgatgcagcccgtatggtggcacaacttagaggtgaggcagaaaagcttaaggaatcaaatgagaagttgcgggagaatatcaaggatctgaaggaggagaagaacgagctccgtgaagagaaagtgagactaaaggtagaaaaggataggctggagcagcaagtcaaagctatgagtgtagctcctacaggatatgtcccccatctccctcatccagcttcataccatcctgctgcgttcactccatttgcgccgccacagcaagctccagccaacaaaagtgctccaatcccagcaccgttccctgggatggcgatgtggcagtggttgcctccgaccatcgtggacacaactcaagatccaaagctctggcccccaaatgcttaggggcagctaccttggaatgttgactcattgtgccttttcatgcatttggtgggcaaatcagtgtcagttaggtccctggagactggagaggaatcaagttcgcaactcgcgccatgtttatgctgtaacagctggtttccagcactacttatgaacttactttgttctactgaagggtggtgcctgtaattaatatatggatcttaaccctctagttggcatgtatatcatttgttctattcgagagctgaattttaaggaccaaaaaaaaaaaaaaaaaaaaaataaaaaaaaagacaacta

SEQ ID NO: 42 - DNA, 1156 bp, Zea mays
gggtacctcgaggccgactctgcaaagcgcgcgcccggacggcccggttcgttctcgaatctcgacctctcgtctcgctcacccgcccgccccccgaggaaggaaccctagcctagccttgctccgaccggtcgccgcggcgactgcgacgatgatggactgcgctggaggccgagaccccgtggaggacttcctcctcggcggcgccggcgccggcgacgacggagatctcatcgccgtcttctgcgacggcgtggccggcgacggaggacttgggattgagggtatccatggagatgcttgtggatttgagcaatctaatttggggaaaaggggtagagatgaaccatgttcatctggcccaacatccaaagcttgtcgtgaaaaaatgaggagagacaagctgaatgacaggttcctggaattaagttcagttatgagtcatggtaaggaagcaaagttagataaagcaaatatattgagtgatgcagcccgtatggtggcacaacttagaggtgaggcagaaaagcttaaggaatcaaatgagaagctgcgggagaatatcaaggatctgaaggaggagaagaacgagctccgtgaagagaaagtgagactaaaggtagaaaaggataggctggagcagcaagtcaaagctatgagtgtagctcctacaggatatgtaccccatctccctcatccagcttcataccatcctgctgcgttcactccatttgcgccgcctccagccaacaaaagtgctccaatcccagcaccgttccctgggatggcgatgtggcagtggttgcctccgaccatcgtggacacaactcaagatccaaagctctggcccccaaatgcttaggggcagctaccttggaatgttgactcattgtgccttttcatgcatttggtgggcaaatcagtgtcagttaggtccctggagactggagaggaatcaagttcgcaactcgcgccatgtttatgctgtaacagctggtttccagcactagttatgaacttactttgttctactgaagggtggtgcctgtaattaatatatggatcttaaccctctagttggcatgtatatcatttgttctattcgagagctgcattttaaggaccaaaaaaaaaaaaaaaaatatcgataccgtct

SEQ ID NO: 43 - DNA, 1067 bp, Zea mays
gccggttcgttctcggacctttcgtctcgctctcgcccgcccgcccgaccccgcggagccctagcctagccttgccccgaccgcggattccccctcggccgccgcgcgcccgcacccgcaccgcgatgatgaactgcgccggaggcggagaccccgtggaggacttcctgatctccggcgccgtcgacgacgaagatctagccatcttctgcgacggaggacttgggattgagggtgtcaatggagatgcttgtggatttgagcagtctaatttgggcaaaaggagtagagatgaaccatgttcatctggtctaaaatccaaagcttgtcgtgaaaaaatgaggagggacaagctgaatgacaggttcctggaattaagttcggttatgaatcctggaaaacaagcaaagttggataaagccaatatcttgagcgacgcagcccgtatggtggcacaacttagaggtgaggcagaaaagcttaaagaatcaaatgagaagctgcgggagaatatcaaggacctgaaggaggagaagaatgagctccgcgaagagaaagtgaggctgaaggtagagaaagataggctggagcagcaagtcaaagccatgagtgtagctcctacaggatatgttccccatctccctcatccagcttcataccacccggctgcatttgctccatttgtgccgccacagcaagccgcaggcaacaaaagtgctccaatccctgcacctttccctgggatggcaatgtggcagtggctgcctccgaccatcgtggacacaactcaagacccaaagctctggccgccaaatgcttaggggcagagctagctgccttggggtgttgactcgccgtgccgtttcatgcattgggcggcagatcagagtgtcagttagtaggtccctggagaggaggaatcaagtctcgcaactcgcgtcatgtttatgctgtaacagttgcttccagcagtcgtcatcaacttgctttgttctattgaagggtgatgcatgtaattaatatgtggatcttaaccctctagctggcaaatatgtcctttgctgcct

SEQ ID NO: 44 - DNA, 2320 bp, Zea mays
cgcgtcgtccttgtttgtactatacagctgctctcaacctttcgttccgtggcccctctcgtttattcgcccctgccacgaccagccccccggcgcccgcccgccccccgcacgccctgcgctgtgcttgcctcgtcgcggccacgtccacctacctatacctctctgtccgacgacctcatcccctttcccaagatcccacccgcggcgtctccaagtacctcgctcgcaggagcaggttgcaaggagccagccactcctgcgagtttctggcgatggtggccgttgcggcgggaaggcgggccggcggcgttggtggccgccggcgctcgggctgcggcccggggcaggcacagcagaagctactagcgatcgccgtcgccgcgcgcttcgctgaggccgtggcgccgccgtctgcggaggcctcccgtgccggctccggcggctgttgcgtagagctcctcgagtgcctcctcggggctctgagcgtcaacgcggccccgccgcccgcgcagcacaggcgggccgtgcactcgatccgccgccgccgcccccgtggcggggggtccgccgacgaccgccacgccgacgctccctcgggccgcatcgcgggcaacggcgcatccgcatccgcagccgcgtcgctctacaccatgcagggcaggaagggtgtcaatcaggacgccatggtggtctgggagaattttggttcaaaggatgataccattttttgtggagtttttgatggccatggaccaaacggccatttggttgccaagagggtcagagatcttctccctgtaaagttgagtgcaaatttagggaagggtgaatgcaaagagatttctactagcgatgtcaagagtgggactactaaaggagttgcaaccgaacacagggttgaagatactgatgcttcccctggaaatgaagagaatggcgagtacccagaatttttcacagcactgagggcttcattcttgcaggcgttttatgtcatggacagggatctgaaggcacatagaaatattgattgtgaattcagtggtacaacagcagtcacagtaatcaagcagggacaaaatcttataattggcaacttgggagattctagagctgtcttgggcacaagaggtgaacataatcagctagttgctcttcagctgacagtggacctcaaacctagtatcccgagtgaagcagaacgaattaggcaacaaagtggcagagtattttctcttccagatgaaccagacgttgttcgtgtgtggcttccaactttcaactcgccagggttggccatggcaagatcatttggagacttctgtctgaagaaatatggaataatttctatgcctgatgttttctaccatcgcatcacggataaggatgaattcgttgtgctggcaactgacggggtgtgggatgtgctttccaatgctgaagctgttagcatcatcagcaatgctccttcacaggcctcagcagctcgatttctggttgaaaaggctcacagggcatggaggacacggtaccccacatcaaaaactgatgattgtgctgttgtctgcctctttctgaaaacagtagcagcaagtacatcctccagtgctgtaacaaaagattcggtgaagaacagagaaatgagcaatggtaagcattcattggctgttaaaacaagcaccaaggttcctgcaaatcttgttactgcaaaagatgagtggtcttttgttgatggttcctctgggtgtgtcgcgctgccaactttaccagagcccacttcagttgtgaaggatagctcaaaagattgagcttgcctgccaattgagatggcataatttttgctggaaatttgttcgccttcgtttgcaagcttgtgtgcatcagatttgttgtgacgtgaagaccagtgccagtttcattggcgagttgaggaagttattgcatagtggaatggataagtgtgcatattttgttctttttgtacagtattcaatcagtttagtgggatcagttggtagtaatgataactataataatactgtgcctattattgatggatgggggtgatcagatccatgcataggatgaagtttctcccttcttttgtaatataaatataaataattgtgtcggtttcagcagctctaataaattttcttttaggtgttgctttgttttatgtcataggttttctagttttgctttgtccaattaagtttagtattatatttccattgatgctatgacaaaccattccagttagatattggatgactaagtaagttttcctctgtaaaaaaaaaaaaaaaaagcggcc

SEQ ID NO: 45 - DNA, 2699 bp, Zea mays
  misc_feature (283)..(283): n is a, c, g, or t
tggagcttcaaagcacggttcatgtttcacaagaccccacaaaaacaatgtgccacaagagtgagcatcaaattagaaatatttcctgcccaaatagaacacatggaagaacaatcacatgtaatgatgagcagattccactctgcggggcatgtaactgtatagactacacagtcacatgtttaaaaaggcaggcacttggaaaatagtaaattacacattcaaacaaggagctgcaacataatcagagtgttagggggtgtttggtttctagggactaatntttagtccctacattttattccattttagtttcaaaattgtcaaatatagaaactaaaactctattttagtttctatatttagcaatttatagagtaaaatggaataaaataatgggactaaacattagtccctagaaaccaaacaccccctaacactctgattatgttgcagctccttgtttgaatgtgtaatttactattttccaagtgcctgcctttttaaacatgtgactgtgtagtctatacagttacatgccccgcagagtggaatctgctcatcattacatgtgattgttcttccatgtgttctatttgggcaggaaatatttctaatttgatgctcactcttgtggcacattgtttttgtggggtcttgtgaaacatgaaccgtgctttgaagctccatcctgtgttgtgcaagtatgctgctactgccgattgtgctctactgctctacgatccttgatgacattggtttcacttgttttgtttcatataagctggatggttgtttgcacatgcttttactagagcacaggcagcagcaggttgcccccaggcggccccggggccggccgggccgggagtctttccctgccacagtcatcagccgccgtagggagcaggagtgagggagcgcgatggcggagaagaagcagcgcccaggagggtccaggaaggacgaggtggttacccgcgagtacaccatcaacctccacaagcgcctccacggatgcaccttcaagaagaaagcccccaatgctatcaaggaaatcaggaagtttgcacagaaggcaatgggcaccactgacatcaggattgatgtgaaactcaacaagcacatctggagcagtggtatccggagtgtgccgaggcgtgtccgtgtcaggatcgcacgcaagaggaacgatgaggaagacgccaaggaagagctttactctcttgttaccgttgctgagatccccccagaaggcctgaagggtctgggtaccaaggttgtggaggacgacgagtagatctgcctgggtactgatctgtgtcaactgtcaaatcatttttttggtgtttttgagtttgttagcactaagtcgatagccttgtgagaaatcttgagttttctgatggcgcgcttgttctcggctggttttgaacttttgaagatacctgcaccaagtattgtagtctgtcgttccaaatcttttctggaggcatcagccatgcaacatgtctgagtctgacgaattttgtttcattcgcatttgaacttggtaagtacgaattatttcaaagcaaattagttacaattagttacaaaaaaaaaaaaaaaaaaagcggcccggccgaaatggaaacctcttcgttgctgcattgatttgtgatcttgttttacaattagttacaaattcttgctgcatttgtttgtgattttgtcttacaacattttcaaattaatttcaaagcaaaaaccaaattctgaatatggcagccgcaaatacaaccacgaagacgaaggatcgaatcaccatatgaattataaattcgggtgccgtggtgtattttttgaaagcctaagaatttggacgacacatctgaagtcattggatgtgaagggatcggtttctaagatgctcctagagagtggtgttaatgtaaaatttgtgccatattctacatataagaagctaaacaagtttaattaggagttgataaagaccaacgtaatgttcaatggttgaaggttttaatattactagatcaggtggcgccctacccggtacttgaaaaatatgaataaacaactatatatgatatattaaaattaaatggaggatgactaaatcttaaacagaattgtttagttcagagaacaagtatatcttcattggtaccagtacgaatccagcattatgctgggacgaagtgctctagataataaaaagaaaacatgtacactgacactaaaaaaatctattcttggactgcaaataaattaccaaactgtgcagcatgataaacggaaccaaaataaagagaggttcacatctttttttactgcaatagccaaaatggtttatcctccccaaaattattcagtaaccaaagccaaagaaaattttgtagcgtggtggtggtggcgtggtgccggtgcagctgaaaattttgtggccaccgccaaagagacatttttacacaagcagtagaaagctcacattgacgggatcatgggaaagcatgcaaagtgcagatcagcagatgcaactgcagaccgcgagacagtagaacgcgtgactgctggttctctgattaacacaactctgctactccatcccatagtccacgctcgaggtcactccaactgatatatgaatatatgatgtacaacttctccgccgccatgagaagaagggatcgtct

SEQ ID NO: 46 - DNA, 5286 bp, Zea mays
  misc_feature (2339)..(2339): n is a, c, g, or t
  misc_feature (3967)..(3967): n is a, c, g, or t
  misc_feature (4542)..(4542): n is a, c, g, or t
cctgcagttcgtctgcaacagggtccacttccgtagacggcccgcgggcacgagaccattacctagaacatcctaatcgaagcagtctgcactctcatctccactctcccccaaaaccctataggctatagcggcagggagaaagtgagcacccacctcaacccgcccgccgccatggcgctccgccgcatcacaccgcggaggagacccgttctccccgtcccccgtgccttctcctcgagtccgccgtttcctccacccccgcctccggcgaacgaccccgaccccgacgccgcccaacccccatcctcttctccgccccctaattccggcgcgccgcggaacccggagtcctcgttcttccaggacatcaaagatcgcctccgttcgtctcccacgtctccgtctccgcgccggatcccgacgaccctgccccgccccgaccctgcgcgcggcgctccttcttcgggaccgcccattggagacatccgccggatgctccagaacttccgcttaaccggctcaaccagcgacgcgccctccacctccgctcccggatccaacccctccttcatggacctgctcaagaaccacttggaccagggtgccaacgcccggcaggcggagctcggcttcaatgccatcggagagagcctcaagcgcccccgtccgccgaagccttttataaccccttcgtcgagaaacatcttctgccgggagctagagaggacctcgaaggctttaggtgcgcggcaggaagagaatggctctgccattgagcttaaggggagctacagctacgaagagcttgggaagagactaggggagctgcggccggcgggtgcaggtaaagacggtaaggagtggttctcgctcaaggagctgcaggggcgtatcgccaagctcgcggagcaggagagccagcttgccgggccgttttcggaaatgcggcggggcattaggaacctgcagaaacaaggaaaaccgggtcggcctgtaaacatccaagcactgctgaaccctgtcggtcagccgacgccagactacatgagtgggcctccgcaggtggaattgttagagaagtacttccatccagatcatatgtcatccgaagagaagatgaaattggagctccaaagggtgagggacgaattcaagatgtccgagaatgactgtggttctgcacgagttcaaattgcccagctgactctgaaaatcaagcatctgtcaactgttctacacaagaaggataaacattctagaaaggggcttcaggagatggtccaaaggaggaagaaatacctgaaatacttgcgaaggaccgactgggactcttactgtcttgttctgtcaaagctggggcttcgcgatgtgcccgagtacaaagctcctgactacaagagcaaagcaaccaccaaggccaaatctaagaagaagagcaagagcaagggcaagaagaagaaggtgaaggcataaaagtagtgaacaaatatgccctgtttctggtcttgaattgcatgctcagaaaataaatcgagaagacgctcaggcctgagatggcttgatccaatcttgcaatgctgtttttttttgcatggtcagaaaatgaatcgagaagacgctcaggccccaattggctcgatccaatcttgtaatgttgttttcgaagctgtttgtaataaccatttcactgattcggtccagccttcgaacaatgccttttagttctccccctcaatttgcgagaacggaagtggactaaccgacactagtactataccgttgcattatcaccagtttgtaactttgccagaattcttgtttgtccttgacgtaatttgggccccggtcccctacaaaaaatacatgaaccatatgtcaggcttgctagcttagcacgaatacgatactgtgtttggccgtatcgtgaagatcggagcggcaagacgtgttagatttggaaaaaaatcatatagattagttttaaaaactgtttttaaaaatgtttaaattataaaaagatcttatttttgaaggccgcgacccgacctgcggtcctcggccagcggctggttggctgtgccctggttcctcgtcctcctagtcaccacgcaaccagtaaaaacattcccccaatcccgaacccctccgccgccgccgccgccgccgccgccgtggccaaggagcaagaaagggacacggcctatcccttggtcgcggcgccagatctcgccgctgctcgcctctcatccatggaggcgagatcctcgtcgtccgcggccgcagtgccgccgcccctctccataccttcgtccagcgaccagtgcgtctgggctgangcctcgccgctcctcgccgccgcgtgccgtggtaaaactcgaggcacagctttcccttgctttatgctgatgtgaaacgtgatagtctctgttgtttggaggccttgcatgcagtgctctgttgtgcggtggatcgtgcgtgtagatcttggtgtatgtggatactggtgtggaactgtggatgatttctcgttttggtttgcacctagcaatgcgagacgcttggttgcttcgggagattttagtgtttacagaatatgggatgtacccagtcagttttaaccccttgagaaaaaatacgcacactgggtttggttgaatagtaacctggattaggtgcctttgctgtgggagaaccgtattgacaataggcacgggcattctggagaatggattgtctagatcctaggatttggtgttggttttatgttgcattataaatgcttgacccgaacatcttcccatgctaaggtagcctgtgagtgctgtgtcgttgaaaggcctgagaatttagaacatgtaatttcgtgccccaggagttaccgatttgctcaattcattattggcaacctgtaaccaaccttcccttttaaggatggatcaagggttttaggagggttatgtattttcatggatttgttttaaagattaggaagttctttcagctagctatatgtgcagtaagagaagcaaactcagatgtttctccattgtctgcttacgtgccctgaaggcactatttgaggaatagttttgtaactaagtgaagtataagatgcgatcacctagggatagtgtccaagtttgggggtggcagggcccttggctcggccccttgttggtaatgaaccaggggctgagtttctgggggttgtgacttgtgaggaaccatggccctgaaagctatgagcagtctggggggactcacctttatccaccaagttaaattgaaaagttttctgaccttccattatgtatcctttgccacatggtgctttcatgatttttgtttgggaattgacttttctataaatgcaaaacagtaaaatacaacatttgcataactgaattacattcaaacatttttatatacattattggtgctatgaacaacattattggaggaagtaatcaagttaaaatgctacacatgaaaataactctgatttgttaaaaatattttacaatttggtagaagtacacaatcttgttttttcaaaactaataagttggttcaatctcaagttgggatggtttgtagttttcttgcatctagagagtttagcgctgcttgagtgcttgttgccaaagaccactatgggagatgttgatgttggattttagatccatctcgaactcttttgtactgatagaaacttacaactaagagttgagcctgtgctaagatctactagctaacttatcttttatttgttgtctcctactgactgttcataattgtagatctcgaggatggggaacttgtacatggagaaaactttagtctatttgctgcaatgtctgcattggaagtaaggccacactacatcccctggtatttaattgtgcttcatcttcttttttctctctattgtgcattatgggtgttgaggcccatgatgctcttntttctactgaactattttgcgaatttaattgttatgatgacttagcaattggttgatcttttccttgtaggcatagtattttctaggtcacccgagttgcttttatgaactatcactcaacttgtttgggcacttgaggatctggatgcatgcatccttgtgaaaagcaatatcttggcaattcactcattgatgtgataggcaaatgttttttagttttagattggcttggccttcccattgagccgaaggacctgggttcgatgcaacctctctgtaaaatggaggggtaaggcttgcctcagctattccttccctagaccccactcatgtgggagccgccagcactggatctgtctttttagattggcttggtcaatgttttttgtatggagtgattcttctcaccgatcagagtttctttaaaaaatatgagacagagaacattaacttcatactctgctagcgaacccgctcactattccaaaatctaaaacatgcatgtaggtaggcaattcaagatgtggtatggatcaaaaaggcagatatgttttaggaacctttaaaaatattantgattagtgaatgcttcaaaggacattttagttcatagtgactaagccaaacatcatactgctgagagacattgagtgaggcaattcaatcgatttgttttgtttttattgtttcaatctattgcttgattttagttctcagtatggactccgtcctgatagataatggatccaaaaatggattctggaattgagagaagtcgatacaactccattgatgaagcaatagaagatggtgttgccccaatcccacttagcttggacaggacacttgatgttcaacgctctattgatgtcatggatcatcttttctcatgtgaggtacttaagtcctttgttgcatgtaatatgtgcaaccttttcaatttgactaaaccatgtattttaatgattcatttcccaggcaacatggcacaaggggcacactctagctcagactgtatttacatgtatctaccttatgagaatggaaagaacttcatcgcatgctgtactaaatagcttttgcaggattttgcgtgctacttgtaatgctgtcatttctgctgtttctactgcccgaactcatgaggtactgggtcggaccttggatgctatctatctccattttcccctggttacttttatcagtaaccttcggcatgtcaggaatttggaatgtgatggttctagaaatagtttatgcatattgactaccttgactaagttcgttcttttataccctacgtattgactatctccacc

SEQ ID NO: 47 - DNA, 806 bp, Zea mays
  misc_feature (785)..(785): n is a, c, g, or t
attctcttcactcaaaagcggctaggcgacggggcttgccctttccccgccccaagggtacacggtcgccgccacctgccctaggccgcaggagggagcgttcgccgccccgccctccgtctcccgtcgcctcgcccccgcgctctgtctgccgcccctctccgctgcgggtttatctactttttatctaggagaaatgtctgagcatctctttgaggacaccttcgtcgtcactagactcgaccctgatggcaaaaagtttgatagagtttctcgtgttgaagctcgcagcgagcagttagatatgtatatgcagctagatgttgccacagatgtttatcctatgcatgctggcgagaaatttaacatggttatagcgcctactctgaatttggatggcacccctgacactggctactatactcaggctggcagaaaaactctggcagacaattatgagtacgtcatgcaagggaaactttacaaaatctcagaagacacatcatccagccaaaacgctaaagtggagatgtatgcatcgttcggcgggcttcttatgctgctcaggggtgacccttccactgccgctagctttgagcttgatcagaggctctttctgctcatccgcaaggtgtaaaactgtggttgctgaccacttaggtgtttgccttgctcgccacttatttaatttccatccgtgggtgaagctgttatatactgggtgtaagtactgttttctgtatcgccatggattttatggtaacgagttcatgtttcttgctaanaagattgctccagcagattcc

SEQ ID NO: 48 - DNA, 885 bp, Zea mays
tcattgagctacgagacacgggctcatcatgggctaacataccagcccgcccggccccggccctttctttattctcttcactcaaaagcggctaggcgacggggcttgccctttccccgccccaagggtacacggtcgccgccacctgccctagccgcaggagggagcgttcgccgccccgccccgccctccgtctcccgtcgcctcgccccccgcgctccgtctgccgcccctctccggagaaatgtctgagcatctctttgaggacaccttcgtcgtcactagactcgaccctgatggcaaaaagtttgatagagtttctcgtgttgaagctcgcagtgagcagttagatatgtatatgcagctagatgttgccacagatgtttatcctatgcatgctggcgagaaatttaacatggttatagcgcctactctgaatttggatggcaccccagatactggctactatactcaggctggcagaaaaactctggcagacaattatgagtacgtcatgcaagggaagctttacaaaatctcagaagacacatcatccagccaaaacgctaaagtggagatgtatgcatcgttcggcgggcttcttatgctgctcaggggtgacccttccactgccgctagctttgagcttgatcagaggctctttctgctcatccgcaaggtgtaaaactgtggttgctgaccacttaggtgtttgccttgctcgtcacttatttaatttccatccgtgggtgaagctgttatatactgttgtaagtactgttttctgtatcgccatggatttatggtaacgagttcatgtttcttgctaaaaagattgctccagcagattccccaaaaaaaaaaaaaaagaggcccctaaggcca

SEQ ID NO: 49 - DNA, 864 bp, Zea mays
tcattgagctaccagtcgcggcctcgtcgccggccggccggccagcccggaccggaccctttctttattctcttcactcaaaagcggctaggcgacggggcttgccctttccccgccccaagggtacacggtcgccgccacctgccctaggccgcaggagggagcgttcgccgccccgccctccgtctcccgtcgcctcgcccccgcgctccgtctgccgcccctctccggagaaatgtctgagcatctctttgaggacaccttcgtcgtcactagactcgaccctgatggcaaaaagtttgatagagtttctcgtgttgaagctcgcagcgagcagttagatatgtatatgcagctagatgttgccacagatgtttatcctatgcatgctggcgagaaatttaacatggttatagcgcctactctgaatttggatggcaccccagatactggctactatactcaggctggcagaaaaactctggcagacaattatgagtacgtcatgcaagggaagctttacaaaatctcagaagacacatcatccagccaaaacgctaaagtggagatgtatgcatcgttcggcgggcttcttatgctgctcaggggtgacccttccactgccgctagctttgagcttgatcagaggctctttctgctcatccgcaaggtgtaaaactgtggttgctgaccacttaggtgtttgccttgctcgccacttatttaatttccatccgtgggtgaagctgttatatactgttgtaagtactgttttctgtatcgccatggatttatggtaacgagttcatgtttcttgctaaaaaaattgctcaaaaaaaaacccccccccgggcccctgcggcc

SEQ ID NO: 50 - DNA, 806 bp, Zea mays
ttttttttttttttttgctccactactcaaagttgagtggtaatcattttaatcatggaactagagacatgtagctgataaattaggagtacaagcaatatatataatgctgcctcgttatatatatacctctgaatataaatcctgagcagtaaatcaacaaaagaaaaaaagaaagaaaacctgggggagaggacaagatcgaagatgcaaaaagaacgactgctgcgggctgcggctaagccatgatcagcagggcagcagcagctaccatggcggccgacccaagaagaacgcgactccccctgcccgacgtggcggccgcggacgacggcggcgtcttgtagtaccaggggtaccacggcaggatggggttgggcggcggcggcgccgggtagccgccgtaccccccactaccgccgccgccaccaccacccgccgcaggctggaagtagggaatgtaaggccccggcggtgtcgggtacgagtacgacgccgcagccggcggaggcggcgggcagttggcggtgacggcgggcggcggcaggcacgggtaggggcagtcgccggccgggtacgcgctgccgtctgcggcggaagcagggcgtgccgggacgagcagcagcgccgagaagagcgtggcctcgaagaggaagatgagcctgctgccgtgcgccgtggccatatggctagagtgagtctagaggccggccgggcggagagagagatgtgacgagctgtaggctgactggtgattcggtgatgaagtggagtgtgcgcgtgtaaataagggaacccaacacaat

SEQ ID NO: 51 - DNA, 822 bp, Zea mays
  misc_feature (2)..(2): n is a, c, g, or t
anagcccaataatagcccggcccaatcaacacggatgctcgagaagaaaggctgagcctcctcgacgccggccggcccggaagtctgaacatactagaagcgtaaccctaagtctcggaccccaaccctcgaggaaggcgaccggagatggcggcgtcgtcggcggtggagaagctcaaggtcctctgggactcgcaggtcaacgacgaggagcagtgggcgctcaattataagctgctgaaggccgctggtctgtttgcgggatccatcttcctgatgcggaacttcggtgatctgatggccatttagtaggcttatcagcgttgtttacttggatcctatgagtgttgttttgatgttccaataattcctgctatgaatatgaaagttattttgctctgaagaggactagatctgtgccgatagtgcttgatcttagactttgtagccatagagattagaccctttaatattcggcgtgtaccgtggatattttggaacgatggtatcagtctgcacccataataatttttgatttgatgggttattaatattttaagaaaaaaaaaaaaaaccgcaacaaaaaaaaaaaaaaaagccacctagggccaaaaaaaaaaattcccgggttgaggcccattaaggatgcaatttgctgggcttctctattttccccgggcttccatcctcttctccgccggcgggaaaaagtgaaatgccgtgaaaatgggcgggggcggcggcaacggcggcaacaaaaaagctcaccgggatctctcagtcgcgagtttcagtagcctttacgggccgttttctctaccg

SEQ ID NO: 52 - DNA, 801 bp, Zea mays
acaataatagcccggcccaatcaacacggatgctcgagaagaaaggctgagactgaaacgtaggaacaccccgaagtctgaacatactagaagcgtaaccctaagtctcggaccccaaccctcgaggaaggcgaccggagatggcggcgtcgtcggcggtggagaagctcaaggtcctctgggactcgcaggtcaacgacgaggagcagtgggcgctcaattataagctgctgaaggctgctggtctgtttgcgggatccatcttcctgatgcggaacttcggtgatctgatggccatttagtaggcttatcagcgttgtttacttggatcctatgagtgttgttttgatgttccaataattcctgctatgaatatgaaagctattttgctccgaagaggactagatctgtgccgatagtgcttgatcttttagactttgtagccatagagattagaccctttaatattcggcatgtaccgtggatattttggaacgatggtatcagtctgcacccataataatttttgatgggtcattaatattttaagagaagatgttgcaccgaaaaaaaaaaaaaaaaaaaaggccgcagcaccgtctgcccctccccgcgccgttctttttggttccccactcctcagtccccgccgccgccgaaacccgcagatggaggtcgtcgtcgccgcgaagcagaaggcgaagaaacacatacaccccttctactgctcagaatgcgaggagctcgccctcaagatcgccgccagctccgacgccatcgagctacaatccatcaactggc

SEQ ID NO: 53 - DNA, 2999 bp, Zea mays
tacagcaccgctgttcattgatccgtcgccttacaagctaaaccagtacgtacgcaggtcgtgccttgcatgttgaacaacacatacgctcctactggcgcgctgatcggttcggttgtcctctattccctccattttgttttaattattattggatagtgcaaaattaaactatccagcaataactaaaaagaaacagagggagtactttgtaatattagttatcgtttaagttaggacaactacactgtcttaaaaatataactttattttaaataaatataaataaactcttagtccatttatatttttataaaatttgttaagataaattggtgtatataaacattatatttcaaaactacataataataaaatagttatttgtagtaaaaaatttataactttaactcaaacctcgtccaaaacgataactaataggacaccagatggagtactactagcgtgcttatcctacctcatctcagacctagggatggacaaaatactcgtggctcgttagctccctcggcttggttcggttcggctcgactcgttttgattttgtcacgagctaagctagtattttagttcgatttgttaacgagccagctcgagccgaactcgagctaactcgctagctcgaacgagctaacatttgtcagcaaaacaaagcatccacttatattggatgaactaaaaagtgatgaactatattaatttggtgttgaatttatgtggtatgtaaaattgtgagtattattactattttctagtgttaaattggtttggaattagcaattaattatattgttgtatatatgtacgtatattgtttttttgcttgcgaaataaacgagtctggtgtctggctcaatttcttaacaaaccgaaccgagccagcttgttaccttaacgagtcaatttaaacttaaacgagtcgagtcgagctgacccgctgctcggacctccgtatgcgtgcaagctgtccacaacaacgtaacgttaggtagctcactagctccatgtgcaaacgccacctacgtacgtcagtacgtgtgttgcatgttcatctgctctacctagagctgaccagcagggccagctttcaatggcgacgcagggaaggtatacagtatacacacaatacgtgatgcaccactgaagataccgcgtcgtcagtgatgtagtctcttcgctgatgtccagtactaccagcattattagtctcgatcgtacaaagcgtattttgacagaagatcgaacgtacatttttaacaacaaattaattagcgccgattgcaaataacgtgcagtgttgtttacacacacaagttgacgagagggaggagaacgaactaactagcacagtagtagcactatacacacatatgtaaaaacggaaataaaggagatgcactgagaaaaaggcgagtattattgtactcactgctcgctagccatgtcgccatgcacatatactgctctctgtctctccccctttcatcctagagtgctatacggggggtcgtgtttgcgacgtgtatctgaccggcttggcccacgctcgtctggcttggtccgcgttggtccagtctaagttgaaaccagcatatcccatctactgcaggcctacagctcactttgattgtgcacttgtgccaaataagttaggcccaaacgatctagtttgccacccaacagagagccggctaagaggctcccaaaatcgcctccccctgcgccgcgagcagctgagccctagaaaacggaccctgactttgttttcttggagagaagccactttttgcaggctaggctcctgagcagatgaggcaacacaaacacgggagttgtagcctacgagcgcagcctggccgctggaccaaggtggcaaacacgctcatagttgctccactactcaaagttttttttttttttttttgatcaaggaactagagacatgtagctgataaattaggagtacaagcaatatatataatgctccctcgttatatacctctgaatataaatcctgagcagtaaattaacaagaggaaaaaaaacctgggggtgagaacaagatcgaagatgcaaaaagaacgactgctgcgggctgcggctaagccatgatcagcagggcagcagcagctaccatggcggccgacccaagaagaacgcgactccccctgcccgacgtggcggccgcggacgacggcggcgtcttgtagtaccatgggtaccacggcaggatggggttgggcggcggcggcgccgggtagccgccgtaccccccactaccgccgccaccaccgccacccgccgcaggctggaagtagggaatgtaagcccccggcggtggcgggtacgagtacgacgccgcagccggcggaggcggcgggcagttggcggtgacggcgggcggcggcaggcacgggtaggggcagtcgccggccgggtacgcgctgccgtctgcggcggaagcagggcgtgccgggacgagcagcagcgccgagaagagcgtggcctcgaagaggaagatgagcctgctgccgtgcgccgtggccatggcggttagagtgagcctagaggccgcggccgggcggagagagagagatgtgacgagctgtaggctggtgatccggtgatgaagtggagtgtgcgcgtgtaaataagggaggaggactcagctccagcgccttcagcttcaaggtgacgacggtggttggtcggtggcggtgcagagtgtgtgtggagaccgcgcgcctgcttctgcctgactggcgcggggtactgtgataactgatgaggattgagtataaatacgcatgcgaattctctcccttctctcctcgtaaaacttaatggtgtgtttggtttaaggaatagaatgatctatctttttctcactcctcatatttttatttgatttgagaaatagaatgagttaatctatcaccactcttttttataaactaataagtagtatatatatatga

SEQ ID NO: 54 - DNA, 2040 bp, Zea mays
acggccaacgtgctgggccacccgaccccgagcctccgcgaccactacgcgctcggccgcaagctggggcaggggcagttcggcaccacctacctctgcacggacctcgccacgggtggactacgctgcaagagtatagccaagcggaacgtcatcaccaaggaggatgtcgaggacgtgcgccgcgagatccagattatgcaccacctggctggccaccggaacgtcgtcgccatcaagggcgcgtacgaggaccagttgtacgtccacatcgttatggagttctgcgcgggcggggagctcttcgaccgtatcatacagcgggggcattacagcgagcgcaaggccgcggagctcacgcgcattatcgttggggtcgtcgaggcttgccactcgctcggggtaatgcacagggatctcaagccagagaacttcctgctctcgaacaaggatgacgatatgtcgctcaaggccatcgacttcggcctctccgtgttcttcaagcctggtcaaatttttaccgatgttgtgggaagcccttactatgtagctccagaagtgctgcgcaaacgatatggaccagaagctgatgtgtggacagctggagttattctttacatacttctatgtggtgtaccgccattttgggcagagacacagcaaggaattttcgatgctgttctgaaaggtgtaattgattttgatttggatccctggcctgtgatctctgagagtgcgaaggatcttataagaagaatgctgaatcctatcccatcgagagcgcttaacagcacatgaagttctatgtcatccatggatttgtgaccatggagttgctcctgatcgtcctcttgatccagctgtcctgtcacgcatcaagcagttctcagcgatgaataagttaaagaagatggccttgcaggtgattgctgagagcctttcggaggaggagattgcagggctgaaggaaatgttcatggcaatggatacagataatagcggtgcaattacatatgatgaactgaaggaaggattgagaaagtatggctccacattaaaggatactgaaattcgtgatctcatggaggcggcggatatagacaacagcgggaccattgattatatagaattcattgctgctacattgcacctcaataaactggaacgtgaggaacatctagttgcagcattttcgtattttgacaaagatagcagtggttacattactgtggatgagcttcaacaagcgtgcaaagagcataacatgccagctgcttttcttgatgatgtgattaaagaagctgaccaggataatgatgggcgcattgattacggggaatttgttgccatgatgacaaagggcaatatgggagttgggaggagaacgatgagaaacagcttgaacataagcatgagggatacgcctgctggtgccctctgaagtctgagcatccaagaaatttgttgcagtatgagagaacgcctggtacgggctgcggaaagcttcttctaatcctttcctacacgaattctgcctacattttttggttgctatatctgttgaagcattgtagggttgtttcaggaattccgggtagggtaactcaactcctgctctttcctcgatgagaagtgtgaattgttatgcgttagttggattgcaaatgttcgtagacgtcgggcgtgtttgattttcttgtgcccttgcctcacctaacctagctgggcaagggtaccctcgccagccgaggcaagctgaagcggctcacctgatacctggccaagcatggaaaaatctttacggcacgggaaacgaggcagatggtaaagaatccaatccaaacacaaacaggctggattttgtccagacaggcgaggcaagcgcttggcgtcttggcgaggaaaccaaacgttcctgttgccctcactaattgcaagttttcatatgcagctgggccatcacgccaaaaaaaaaaacttctctacgtgtaaacgtgtatattcgacatcctgatataaataggaatttcaagctggcgc

SEQ ID NO: 55 - DNA, 2547 bp, Zea mays
  misc_feature (812)..(812): n is a, c, g, or t
tgcatgcctgcagcgagcccagcgtcctcgagcctagctaccaatcacgcccttagagaagtttatgcgcctgaattgattgatttggatgggtgagttttgcaaagttgagaagataccgtgggatagctgctggtccactcactctcggcagtggcaccaccccttggccgcatgcgtgcatgcatggggcggttaattaacaagatcatcaactaggaaatgttgcaccatttctaattaaactaagttagtgcagtgaacgaaacggaatcactataaatatataactgtctaaaaatggctaatagtctgtgatgaaattaattactatccatgcaagaacataaaataaaactctgtgcaaagtcaacgagaggcaccattactttgtgcacagcaagttctgtatataatccatcgtatatgatatatatgcgcctctagctagcttgatcactagtgctaatacgtgatctatccatcatctagctatcctcctagctagtgacacaagcaccatgcggagaagtgagctggtggactgaaattcatgtcaacttttattgcatgcatggtcaacttttcgcctctcgcagaaacagatgctgggtgacgcaggcgcaggttcttccagcacgcgcgcagtgcatgcggccgtgaacagcgagcgatcgaggcgatgccaactcccgagccattggcagggcggctagcttgttgctgctgctgctgcatcttctttccatccacgcaccagcactgcactgcatcagcatgcttgtagttgatagatatagatgcatggactntcatggaggatggcggccgaggagagtgatgacccactcacggccaccgatggggacggccggcatgcaggtcgatgagccggccggtgagagtgatgtgcacttcttatttttttcactagaggaagaaaaaattagtggacgatggatggatctcctagtggccatgcatgttttggtcttttgggtttcatccatgtactgcactcactatagcactagcaacatgccagtatacctggctgattattgaactcctgatgcatgcatgctctgattgcatcggcgcgcgcattataaatagctgctcccgctccacgccctccccacaccaattaagtgctcactcactcactcagctcgtcttcttcttcctccgctcggcctctcgttgcggccagggaaagagctagctagctagcgtgtgctcgatcgatggcgaaaacgacgatgagcgcggccaagaacctcgtgaggctcctcgtcctcgtgcaggtgtccttaggccttctgggcggcgtcgcggcgctcagcttcgactactacggcatgacctgcccgttcgcggagatgatggtgcgcagcgtcgtctacgacgccctcatgaaggaccccaccctggccggcagcctcctccggctgcacttccacgactgcttcgtgcagggctgcgacgcgtcggtgctgatcgactcggcggacggcaacacggcggagaaggacgcgcaggcgaacctgaccctgcgcggcttcgaggtgatcgaccgcatcaaggagctgctggagtcgcagtgccccggcgtcgtctcgtgcgccgacgtcctggcgctggcggcgcgcgacgccgtgctcctggcccggggcccctactacggcgtgcccctggggcggcgcgacggcacgcggtcggtggactccgacaccttcacggcgctcccgccggccttcttcaacgtgaccatgctcatgaagctcttcggctcccacgggttcacggtccaggacatggtggcgctgtccggcggccacacgctgggcgtcgcgcactgcgccaacttcaagggccgcctcgccgagacggacacgctggacgccgcgctggggtcgtcgctcggcgccacctgcaccgccaacggggacgccggcgtggcaacgttcgaccgcaccagcaccagcttcgacaccgtctacttccgggagctgcagatgcggcgcggcctgctcagctccgaccagacgctgttcgagtcgccggagaccaggggcatcgtcaacatgttcgccatgaaccagccctacttcttctacgcgttccagcaggggatgctcaagatggggcagctcgacctcaaggagggcgacgatggtgagatcaggcacacgtgcagggtcatcaactcctcctagacaaacacagcttactagtgttgtgaatcccgtacgtacgtgtggatgctgcaccagcgaagtgtgtccaatggtacgtgtgcttatttatatatatggtcccgtacgtgtagcttgtaaaagtaaatgtgtatgatacatgtgccccatgcaaaccaagataggagctaagaatgaagctcttgaagcaaataataataatgcaaggatatacactatattgtgtactatgtgtaaaaattatttggaagaagatccagagatccctgcttgtgtgtaaaaaagaagcatgttctatctggtccgattgcaccgtctgccgtttgat

SEQ ID NO: 56 - DNA, 1325 bp, Zea mays
aaagaacaagcaggcagagggaaactgtggagccggcacccgacggcccagtacactacagtgtgcggagacaagcaatagcttgctgatcgagcaggaaacgatggagcactctttatattattactgccgcagctggttgcttgtatgctcctcggttctcgcgctgtgcctcggtagccggggccagctgacaccgggtttctaccgcagcacttgccctcagctgtactacaccgtgcagcgccacgtgttcgacgccatgcgagctgagacgaggatgggcgcctccctcctcaggctgcacttccacgactgcttcgtcaatgggtgtgacgcttccatcctcttggacggcgacgacggcgagaagttcgcactgcccaaccggaactcggtcagagggttcgaggtcatcgacgccataaaggcggatctcgagagcgtctgcccggaggtggtgtcgtgcgctgacatcgtagcccttgccgccagctatggagtcctctttagtggagggccttactacgatgtgcttctggggagaagggacgggctggtggccaaccagtcaggagccaacagtggtctgccttcgccgttcgagcccatcgactccatcattcacaagttcgccgccgtcgacctcaacacgaccgaacgtcgtggtcttgtcaggagcccacacgatcgggcgagcccggtgcgcgctgttcagcaaccgcctgtccaccttctcggccacggagtcggtggacccgacgctggacgccggcctcgccgagagcctgcagagcctctgcgcgggcggcgacggcaaccagacctcggcgctggacgtcagcacccccaacgcgttcgacaacgcctactacaagaacctcctgctggagaagggcctcctgtcctccgaccagggcctcttctccagcccggaaggcgtcgccaggacgaaagctctggtggagacctacagccaggacagcgagcacttcttctgccatttcgcctcgtccatgatcaagatgggcaacatcccgctcacggcctccgacggcgagatccgcaagaactgcagagtagcgaactaattattaatagaaagtcacgacgatcatccgatatctcactgttatttctcgtttgtttgtgtcaactgtgaaggcaggcacctacgtaaggtttatgggtgcgacgttaagcatgcagctacactagatgcttaagaataaggacactgtaaatgtccaaattggtcccacatgtcaaacacagttgtccttttcatgaaagaaaaaacggaaatttcaaaaaaaaaaaaaaaa

SEQ ID NO: 57 - DNA, 1243 bp, Zea mays
gtccacagcagagtagagtagcacacgcactcgcctcttgtgtctttctttgtgagctgtggtgtggtggtcgagacacacacagcagcagcaacaacaacatacatacatgcacgctagcctcgcctcctacgccgcggcagctatgccggcgctggacctccgccccgagatagcgcacgcgcaccagcccgtcatgtcgccctctcaccacggctgggacggcaatggcgccacagccgtgcccacaccgatgcccaagaggctggacgggaaggtggccattgtgacgggcggcgcgcgcgggatcggcgaggccatcgtgcggctgttcgccaagcacggggcccgggtggtgatcgcggacatcgacgacgccgcgggggaggcgctggcgtcggcgctgggcccgcaggtcagcttcgtgcgctgcgacgtgtccgtggaggacgacgtccggcgcgccgtggactgggcgctgtcgcgccacggcggccgcctcgacgtctactgcaacaacgccggggtgctgggccgccagacgcgcgccgccaggagcatcctgtccttcgacgcggccgagttcgaccgcgtgctccgcgtcaacgcgctgggcgccgcgctcgggatgaagcacgcggcgcgcgccatggcgccgcgccgcgcggggagcatcgtctccgtcgccagcgtcgcggccgtgctgggcggcctcggcccgcacgcctacaccgcctccaagcacgccatcgtcgggctcaccaagaacgccgcctgcgagctgcgcgcgcacggggtccgggtcaactgcgtctcgcccttcggcgtcgccacgcccatgctcatcaacgcctggcgccagggccacgacgacgccaccgccgacgccgaccgagacctcgacctcgacctcgacgtcaccgtgcccagcgaccaggaggtggagaagatggaggaggtggtcaggggcctggccacgctcaagggccccacgctcaggcccagggacatcgccgaggcggtgctcttcctggccagcgacgaggccaggtatatatcgggccacaaccttgtcgtggacggcggcgtcaccacatccaggaacctcatcggcttgtgaatcaatgtcaatccgttccaaatatcccattcccatggctaggctaattagagaaggagagagagaaaactgctattagttgtacttgaagtgatcgattttcatttggttgattgattcatc

SEQ ID NO: 58 - DNA, 925 bp, Zea mays
ccgggctgaaccgaggctgcgactgcgagggcatcagggcagcgaggcttcttgtcgcgtgaatcccctcgagagccgccggcggagccatggcgcggtccccagctgcctcctcctcctcctacacggatagcacgggatcctcctccgactcaggctccagctcatcggcggtccgcgtccgacgacgacagctacagcacaagctcttatgacagtgaccgtgaggtgtctggcagatctcggaaacataagaagagcagcagatcaagaaagtttagggagagggagcggagcaaagatagacatcatagacgagacaagagtaaacacaaagaggctctttgacattggagctgggattggtgaacgggtgacaacatggtggattggcctgctgcttgttctgttggtgggttggttgtgttctattataaatgggggagctttatacagaagaaagagagtgagcatgctgatggccctgtccagctttccaagtttcttggacgggacaaagaaaaggaagaaggtactcaacggagtgcaatctctggtaaaaagataatgatgaagcttgagaagacaaaggaagacaaggcagcagagagcaagcgaaacgaactgttgaagtttctgaatgccagttacgattgatgtgttcgaatcgctggcgcagaaagtgcagaatgcccttttttatcgtctttgcactggtgcttttggtgatacttaagttataaacgttttgtttcttgtctataacttggccaccaaagttttgttatgcttaactagtgactgagtgaaggtctacatgtaattgatttgaattctgtgttgccagtcatggatttgcagcttttaaacccatcctttttgtgattgatccttgtctttgtcaatgtcaaactgtttcactggc

SEQ ID NO: 59 - DNA, 794 bp, Zea mays
attgtgttgggattttatctatacttccacacaagaggtccttttctttctgtcgtgcctgtttctgggttggctctttgacattggagctgggattggtgaacgggtgacaacatggtggattggcctgctgcttgttctgttggtgggttggttgtgttctattataaatgggggagctttatacagaagaaagagagtgagcatgctgatggccctgtccagctttccaagtttcttggacgggacaaagaaaaggaagaaggtactcaacggagtgcaatctctggtaaaaagataatgatgaagcttgagaagacaaaggaagacaaggcagcagagagcaagcggaacgaactgttgaagtttctgaatgccagttacgattgatgtgttcgaatcgctggcgcggaaagtgcagaatgcccttttttatcgtctttgcactggtgcttttggtgatacttaagttataaacgttttgtttcttgtctataacttggccaccaaagttttgttatgctcaactagcgactgagtgaaggtctacatgcaattgatttgaattctgtgttgccagtcatggatttgcagcttttaaacccatccttttgggggggggggtaagaaaaaagaattacaccaaacccttacctggctgtagaaccaaacagcaattgaagaaaaaagaggaactctgggtggttccctactggttaagggcgatttccatgacagtggtggcctgtattagtggttgcgagcttgctccatgctttggcggggggttggcc

SEQ ID NO: 60 - DNA, 903 bp, Zea mays
agcgctcgtggaaaggagacgtctctgaaccgaggctgcgactgcgagggcagcgaggcagatcgagccacgcttcttgtcgcgtgaatcccctcgagagccgccggcggagccatggcgcggtccccagccgcctcctcctcctcctacacggacagcacgggatcctcctccgactcaggctccacctcctcgggaatcgaccgccgccgccacgagcgggagcggcggcggtccgcgtcggacgacgacagctacagcacaagctcttatgacagtgaccgtgaggtgtctggcagatctcggaaacataagaagagcagcagatcaagaaagtctagggagagggagcggagcaaagatagacatcataaacgagacaagagtaaacacaaagagaagaaagagagtgagcatgctgatggccctgtccagctttccaagtttcttggacgggacaaagaaaaggaagaaggtactcaacggagtgcaatctctggtaaaaagataatgatgaagcttgagaagacaaaggaagacaaggcagcagagagcaagcgaaacgaactgttgaagtttctgaatgccagttacgattgatgtgttcgaatcgctggcgcagaaagtgcagaatgccctttttatcgtctttgcactggtgcttttggtgatacttaagttataaacgttttgtttcttgtctataacttggccaccaaagttttgttatgcttaactagtgactgagtgaaggtctacatgtaattgatttgaattctgtgttgccagtcatggatttgcagcttttaaacccatcctttttgtgattgctccttgtctttgtcaatgtcaaactgtttcactggcgattcattgttcttggcagcttactgccgtggatat

SEQ ID NO: 61 - DNA, 1232 bp, Zea mays
cggcaagataatttcactggtaggaagaacataaaataaattgatgtactttacacgggagcaagcagctagtttagtttcaatggtcgtcctcgcaaacaccaatgagtgctaaaacgttgtgccgtccatagtctatagagataagacttaacttggcagatcatctagagagagcgtaacaagtactgctgctaagacgattcgtaaaatgcatgttcccacatggctatttggatgtatttaatgatcaagtcaagatgctcctccattgattgtagtagtggactggacgcatccacttggtctccattggcgtgcaagctacgaaggtaaagaaccacggcatggcatcaagcactataaattaggcatgcggcattcggtggaactcatctcaactcaaacactctacttgtatctcacaatggctggcacaaagttagtatcacttggtctccttgttcttatgggcataggattagccaatgcagcgagggtggcgagatactctagtgctgatgggactggcaacggagagggacagggtggcggatatgtgaatggcgggggatcagggtctgggtccggtaccggatccggtgatagtagtccttatggtacccatgcaagtgctggagggggtggtgcaggtggtggagctagccaatacggtgggtctggatatggttcaggatcagggtctggttcagggtctagtacatatagtcaaggagggtattattcgggttatggagaatcttctaatgctggtggttctggtggaggtgggggtggagggcaagctggaggttatgggaattccaatgctcaaggatctggtagtggcaccggttctggctctagctatgctaacaggtattgggatggatcaagtgaaggaggtgcaaatgctaatggcaatggtggtggcacaggaaatagtcaaaatggtggcggtggcggtggttcaggtgaggggattggatatggcaatgcctacccatgaacttgacatcagtcgatctaatgttggagcccatcaacatttcttgtttgaagttgtaggattattattttccttgcctctttgttatgcttgtcgttgaaccaaattaataaagggtccaactatcttgtaaggtccaacttataagatgatgttgtaacaatgtctgtttatgaaaactatatatcaagaaatttcttatgtttatttatttggagttact

SEQ ID NO: 62 - DNA, 1035 bp, Zea mays
aatcacaactcaaacactctacttgtatctcacaatggcaggcacaaagctaatatcacttgggctccttgttctcataggcataggactagccaatgctgtgagggtggccagatactctagtgctgatgggactggcacaggagagggacagggtggtggatatgttaatggtgggggatcaggatctgggtctggcaccggatctggtgatagtagtccttatggtgcccatgcaagtgctggagggggtggtgcgggtggtggagctagccaaaatggtgggtctggatatggttcaggatcagggtcagggtcggggtcaagtacatacagtcagggagggtattattcaggttatggagaatcttctaatgctggtggtactggtgggggtgggggtggtggacaagctggaggttattggaattccaacgctcaaggatccggtagtggcactggttctggttctagctatgctaacaggtattgggatggatcaagtgaaggaggtgcaaatgctaatggcaatggcggtggcatggggaatagtcaaaatggtgggggcggcggtggttcaggtgatgggtctggatatggcaatgcctacccatgaacttgatatcagttaatctaatgttgggcccaccatctttccttgtttgaagttgtaggattattattttccttgcctctttgttgtgcttttggtagaaccgaattaataaagggtccaactatcttgtaaggtccaacttataagatgatgttgtaacagtgtttgttaatgaaaactatatatcaacaaatttcttatgtttattctttgaagttactaattttagaggcatacaccatggtatattgacgtggttatgttttcctccctccattccaaagtgtaagccctcctagcttttctatgtacatatatagctttttcctatgcatctcaatatgcattacatctgatacgtagttaaagctatgttcctaaaacaaaccagaatactacaattcataatggagagagcg

SEQ ID NO: 63 - DNA, 5730 bp, Zea mays
ccttcctcgcctactaaatagctcaatatataggcttgagaatgtaaatgtaattttatcaaagttgtactctgcgtctataaatagaggaacaatatcgtgcatttggacatctttaatcggagaaagagcgggcaactcttatctacgaggctgtaattattctttcgtcttgtaagcttcacaaagccaaaggtataattgtaatatctgatttaatactaaaaaaaccgaaggaagtaagtaatgtttataagaatacatgatatgtttcctagcagtgtttataaatactctatgttacagttgtaaataaatgttataaatactctatgttgtagcaagatttgtttgataaatcctttagataccatccgtcacttgttcactatttctttttttattacatgcagagtgcagtgtatgttttgaaaataaagcatcaattggaaactatgtgtatcttgcaaaaatgatcaaagtcataatttattctagtgacaaaaatatttgtattccatcttctcccgagtgaaggtcctatgtgaagcatgtgaaataacatgtattttccatttttaatttggcatgatatctacttggatatgtgaatggatattgattttccattattttactaaaatatgatattattattattcaaaatttacttgtttttgtgagctttatgaggccattttatctttgtctttgtattccaagcatttatgtttctatgatgcagctaaagtttgaaagtttttgtgcatggaaaccatgctgactattttttttacatttcttgcatataaattgggctgttagagtttgtatgggatgggacactcccacctgtttctaaaccctctcttgtggggcttttatccactaaacctaaatataataactagtttgacaaccctattttttaaagaaatttttattttctcaaaagaacttaatttattttctcttataaaattgaaatctctttaaaaaggaagttatcaaactagcactaaatacatgaataaaaccccagtgaagttttctcccactgcgaccactaaactagcccgaagcgattgatctcttccttgatgagcatagcttacgaggtgtgtcttttggtttggatgatactatcttcgtcacaaatatatgatactattgatttttttcgaaaactttggccactcatcttattcaaaatatttattcaaaaatataaaattctaagtcaaacacaaattaccttaagtgataaaacaactcataaaaatataaatgataaattattgttttttaaataagacgagtgatcaaagtttttaaaaaaatcaactgtgttatatatttatgaacggagtgagtataaaacaaacgaggaagaagaaatttgatggatgcaagctaaattatgtcattgtcagcaatcattacatttgctaatttcctgaatgagacactttagtcgctattatgagcttatataaaaataatattaatatttattgtttctaagtagtttttgctacaaaattattttataatcaaataataccatttatctaacattataatgtctgtgttttaatagatttaataaaatttaaagttatctgacttttaaggaaaaaacagagagctgtattttttagactagtaccaatcgttgtgtgtccactagaaacttcgcttgttgttttcaacaagtagcctgggatcttttaaaaaaaaggacctgacaaatcccagctgccaaggaaaacccaggcggacggcgtttacacgtttagcgcgtgaacacggagccgcccaccccccaccacacgttacatccccgccgccccacccaccggaacgagggccctgcagatacaactgccccaccgccagccacacgagcggtgccggcccttcgagaagccgccacgtcaccacgcggtcgcgggacggttcggctgccgctcgaacggaatgcctcagttaagctgcttcgcgactaagcaatttatttatatttgctataaaaaacgaatacatatagaaatcattcgaactgtcaacgaattgaattggccgcgagtttcctacctataaaacgacccggatcccccacccccacatttcctcatcgtcacaacgcgtcctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggtaagcgacgctccttctcgattcgatttggcggggtttggagggggcgtggcttctcatggcgattgatttggtcaggaggaggtgacggtggagagggccgcggcgacggaggagcaggaggaggagaggctgcggtacctcgagttcgtgcagcaggcggcggcgcaggcgctggtgctggcggccgcggcgtacgcgtacgccaagcagggcgccgggccccgctccgccccggggtcgatcaggtcgagggcaccgtgaaggccgtcgtcggccccgtctacgaccgtttccacgccgtcccgctcgacctcctcaagttcatcgaccgcaaggtgaggaggcggttctccgtatgttgaaattgtgctgcaaattaggcgttctatgaaatgaaatttacaggtgcaggtttccacggtggaattttgccaaaaaatatatattttggattgaaatcttgtcaacttaactatttctagcagttaaccatctctatattcaatctccactctgtaaatattgtcatctattttgagtgaccgtatgattgaactgccggacacagtttaagggtctggattggataatgttaattgacctgttgctagaaatatgttcttgttgtcacgtgtactggcagtctgaaagggtttagttgcaatgcgttggtatcatggtattattagtttgacaactgaagtagcaaattaggttttttttggaaggcagaagcatcaagcaccactgaaccaaccaaacaaaatgtgtatgaccaagatttgaggtttattgcttaaggattacaagcaccaacttctggcgagttctattaggaactatactatgtttgtttatgtatttgactaatcatcatggtacaattttaactgatgtttcagatacgttcatcagctccttgaatctgcctacccatgtagagctggtcacttactcgtgcccagtatattgttcatttttcacacgcttcttgcaagtcaggccgttatacgttattgtatacgcactacaaactctgaagtcgttgtgttgccattgtcttgcattgttccatcatctgatttgtgccactgagcgaagaaatgatcgacgatttgcacgttctgccccccacttgcaggttggtgagtccgttgaggagatagaccgccgcgtccctccagtggtgaaggaagccccaaccttggcccgctcggctgcgaaggaggttcgccaggccggcctggtgggcacggccactggccttgccaagtcagccatcgcccgcgccgagccaaaggcccgggagctctacacccgctacgagcctgtggcagagcggcgtgccgccgaggcctgggtggccctgaaccgtctccctctggtgccctcggtcaccagggccgtcctccccactgccgcacagctctctgccaggtacaattcggcggtgcgtgatggtgccaagcgcgggaacgccgtggccacctatctcccgctggtgcccactgagcggctcgcccgcgtgttcaggtaccccgtggctgacgttgctgcagcaccagagatgcagcccattccttcccagtagaagatgaaatggaatgtgaactgcataaaccaatatcaagaagtattactgtgttttgtctttgcgtaccttatggtgaactcatgcgtggttcagtatcgtttcattcctttttgttgcagtgagcctacacaagttcgtctttgttttatggataatatgtataacattatctattggaatagcaatgttgatgcttgtgctttgtcatcaaaaaaaaaaaaaaaaaagcggccgcctattggcatttcggctgttgtgttccaagtagcggccacagaatttaggatgcaaaaaagaagataataaagagatcacaattagtgctctagcgactcctctataagaggaaaatgttgtttcttcgctctatggataaccaaagcaaatatttttttaaagaaaacccagcaatttaagtatggtcggcagaatcccatcaaagatgtgatcatttctaccgacccaaatgagttcattagtatgataattttcatgtagagagaggcttccaattatcttccttcttaaaacttcaacccttccaggctccatagtgcgtaatcaattcctctcctatagccacgtccgtcctcacctcacgccgcccaacgcgtaggtcgtagcacatgacaccatccatctcttcggcagctgactattattttcggcagctgacgtatgacagcacatgacagccaccatccatctctccccaatcccatacgtcgtcatagtagccgatcatcctcgggggacacatacattgttacatcgcaatcgaaatttaagaacatcttgtagttgacgaggggcctggctgcattctcagatgaatatgcaggacacaacaacatactcagaacgtatactgtacacaaaccaacgcattattacatgttcacaacaaataaccaggggcctggctgccgaggatcgaacacgaacagcgcgcgcgtgttctcgggagctcagagcatcttgtagttgacgacggcgaggatgacggcccaggcgacggcgggcttggcgaggtcgccagccacagggttgacggcgccgaagccgcgcgcgcacgccacggcgcccacggccatggcggcgcagcaggcgaggcccgcgcgcgccgcggcgtggcggcccagcacgagcggcgcccacgcgagcgcggcgccgagccgcgcggcgtagggcagcagcgtggcggccggacgcgcgtgcagcccgccctctgcccacgccatccacgccgccagcgccagcaccgcctccgacgccaccgacccggcccgcaccaccgccaccgtggcggaactcggcggcggcgtggagtggcccgcggcgaagaaggacagagccacgagcgccgcggggatggacaccgcggcggcgaccgaacggaggccgcgccgcctcctgccgccgcccggcttcttgttgggacccgagaccgccgcgatgccgccgctggcgccgtcgtccctgctgccactggcagcgacgcgctgggtcacgccctcgtgcgcggcggtcgccatggctgatacgatcgcggcgaggttcgcttaattgatgatcgagtccgactgtccgagccgattctctcaggccggacaacccggatcgtcgcaagacgcgttctaaatacgcgcgaggcttgctccgagcatggacacgtgtggcgggaaggtgacacgtgcagagtggagccctttaaactatggagcttccatgccaggtgactgcgaggcttctggagttggaggtgactaggacgatcgagcaggacaaaacaaatgctgactgagtcttttttccccttataagcttata

SEQ ID NO: 64 - DNA, 1270 bp, Zea mays
atttatatttgctataaaaaacgaatacatatagaaatcattcgaactgtcaacgaattgaattggccgcgagtttcctacctataaaacgacccggatcccccacccccacatttcctcatcgtcacaacgcgtcctcgaataaaaatccagacgaaacccaaaatccccaccgaacgcaacctaaaatctccccatccctcctcgatccagccccgcggagaagagccatggccgattccgcaaccaacgacgcccccctggtcgccagcaaccagcccacggaggaggaggtgacggtggagagggccgcggcgacggaggagcaggaggaggagaggctgcggtacctcgagttcgtgcagcaggcggcggcgcaggcgctggtgctggcggccgcggcgtacgcgtacgccaagcagggcgccggcccgctccgccccggggtcgatcaggtcgagggcaccgtgaaggccgtcgtcggccccgtctacgaccgtttccacgccgtcccgctcgacctcctcaagttcatcgaccgcaaggttggtgagtccgttgaggagatagaccgccgcgtccctccagtggtgaaggaagccccaaccttggcccgctcggctgcgaaggaggttcgccaggccggcctggtgggcacggccactggccttgccaagtcagccatcgcccgcgccgagccaaaggcccgggagctctacacccgctacgagcctgtggcagagcggcgtgccgccgaggcctgggtggccctgaaccgtctccctctggtgccctcggtcaccagggccgtcctccccactgccgcacagctctctgccaggtacaattcggcggtgcgtgatggtgccaagcgcgggaacgccgtggccacctatctcccgctggtgcccactgagcggctcgcccgcgtgttcaggtaccccgtggctgacgttgctgcagcaccagagatgcagcccattccttcccagtagaagatgaaatggaatgtgaactgcataaaccaatatcaagaagtattactgtgttttgtctttgcgtaccttatggtgaactcatgcgtggttcagtatcgtttcattcctttttgttgcagtgagcctacacaagttcgtctttgttttatggataatatgtataacattatctattggaatagcaatgttgatgcttgtgctttgccaaatacaaaaaaaaaaaaaaaaaaaaagaaaaaaacaaaaaaaaaagcggccggcggctcgcgata

SEQ ID NO: 65 - DNA, 1842 bp, Zea mays
agtggctgcacctcggtcccagctgtcagcgaacggcaacgaggcaaacacatgacgcctctcttcgccgccgggtaggtctcgcttagaattcgtgtaccagaaaccccggccctaaccgcgcccgcaccctcgcccttggctcgccggagattaacgctacagccgtaatcacgtaaattccttttcatggagggtgtgggcgcgcggctagggcgcacttcggcgcgctacgggccggcgacgacgttcacgggccatgtcaggaagtggcgcaaggagtgggtaccagtggtcgccgccgccgccgccgccgccgccaacgccaacaccagcgccaacggtggcacgacgtcctccacggggatgggatctggcggaggatcccgcgggaataatcttctcctgtttaagtggaccccggtgaacggggctaacgggggaggaggggatggggagcagcagcagcaggctgagacggccacgagacgccggcggtatgtgccggtttctttaatggaagagcaaaggcaagaatctaccaaatctgatgatgagaacaaggctaatgatggagatccatcttcgaatgaaactgagccatcaaatggaaagactgatatcaatgatacacctatggatgaatctcaggcaacagatgaggatggtcgagattctggtaaaaacggcggtggaacagacctaaatttgaatttaggtttgaaagacccggatggtgataatgaagttgagacatcagagaaacatgtagcggcaaacaatccgcagacagagaatagatccaagaggaaatccgtaacccctgaccttgagatgacaatgtaacccagaaatttcatttgtcttaattttactatttgccatgagcccatgaggtgtgtaacttgggtacgttctcatcgtagaaacatttaagtaaaatcgattacaggacatacaatagtgtgaactgaagaaacctttttttactcgaacatggagaattgtctaaagtcattgtcaaatataatttaattttccagagaaaaaaaaaaaaggaaaacacctcttcagaacttatttgcaaaatgttcttttattgcaagtgtatcttgattgagaaaccggaaaccgagggaacttcccgcttaggccttgttcggttaatcatgttactatgtattggatgaaattggaaaaaaataataagaagattgatttatttaggatttaaacccatccaataccagtcaatccacatggattgagagctaatcgaataagcacttacatagttattttttagggaactacctcattacacagttattttttgtctaatttgaaactatatatccagggaaaacatataatttggtttgtggtcaatagtaatataattattatgactagtatgtgttttatgatggcattagggtatgtacatcactttatgactagcgtgtgttttatgatggcattagagtatgtacaacactatttgacatgaggtttcttgttagagggttaaatgaaaaaaagagacatgttcttcgcaaagagtatctttatacgactctccatacatattgtcttttaactgtatttatgttagatctttagagttgtattatagagtttcttaagtgtctcttatacttggaaaaccgaatcattgtctcagggttgtacataccctaataaaacattatttgaatgagttttcaataatgtcggttgattggataattattactttaatgaggttacaataatgttggttgattgagcaattatgattttcatgtatctgtgcagttaccaaacttgtttgatgtgcat

SEQ ID NO: 66 - DNA, 1498 bp, Zea mays
gggtacctcgaggccggccaaaaaaaaataaaaaaaaaaagagacccggcggcagcgatcgaggctttgctcctgcttcggcttcagccccccccaattctttataaaaatccctcgccagcccctccggctcccgccaaatcggccgcgggggagagagatatatagagccaatttttgcccgatttgcctgtctgctcgggactgagccggtattcctcttcctcgtcgacgagaataaataagctaagccagggccccggggaagaagaagatgagctccgccggaggcatggacgggtctccgccggtcgccgaattccagccgacggtgacgcacggcggccggttcctccggtacaatatcttcggcaacctgttcgagatcacgcgcaagtaccagcctcccgtcatgcccatcggccgcggcgcctacgggatcgtctgctcggtgatgaacttcgagacgagggagatggtggccatcaagaagatcgccaacgccttcgacaaccacatggacgccaagcgcacgctccgggagatcaagctgatgcggcacctcgaccacgagaacatcatcggcatcagggacgtgatcccgccgccgatcccgcgggcgttcaacgacgtgtacatcggcatggagttcatggagacggacctccaccagatcatccgctccgggcaggagctgtcggaggagcactgccagtacttcctgtaccagatcctgcgcgggctcaagtacatccactccgccggcgtgatccaccgcgacctcaagcccagcaacctgctgctgagcgccaactgcgacctcaagatctgcgacttcgggctggcgcgcccgtcctccgacagcgacatgatgacggagtacgtggtgacgcggtggtaccgcgcgcccgagctgctgctcaactccaccgactactcggcggccatcgacgtctggtccgtcggctgcatcttcatggagctcatcgaccgccgcccgctcttccccggccgcgaccacatgcaccagatgcgcctcataaccgaggtgatcggaacgccgacggacgacgagctcgggttcacccggaacgaggacgcgcggaagtacatgcgccacctcccgcagttcccgcgccggccgttcgcgagcctgttcccccgggtgcagcccctcgcgctggacctcatcgagcgcatgctcaccttcaacccgctgcagaggatcacagttgcggaggcgctggcgcacccgtacctggagcggctacacgacgtcgacgacgagcccgtctgcacggagccgttctcgttcgacttcgagcggcaggctctgacagaagaccagatgaagcagctgatattcaacgaggccatcgagctgaaccccagtttccgatattagagatggatcggatccgtgcacgattcctcgttaatgcacggcgtttgtaaataggcgtaatataagattgaaggctgcatttgtttgtttgtt

SEQ ID NO: 67 - DNA, 5293 bp, Zea mays
gtgaaggggtgcgttctcaagagggtgtcccttgggaattatctgtcgcactccttgaattgatcacaaaatacaatattttgtaacacaaacaatggcctatctctctctgactcccatcagctcgtcgagcctagtgacggccccacgtcttgatctgagaaccgtacggaatgatactcgccgccaaaagaaaattgcgaaaccatagataggatggccgtaacttcagcaatctgtctctcccacacagaaagatggagacgtgcaaaataaataggaatccggagatactttgctcagctcgcgtatcacgcgggaacaatagaaagttgggcttcgcaatcattcatggcatcggtttcttaagccctcccttgttccaatcgcccggggcaacactgtactgctagcagtacacatcagtttgttattaggggttcctcaatcctcatccattaggatattttcctgacaaaaaagaaaaagaaaagaatgggcacttgcactggaaactagtttcagttctgcatcgagccgccaagcatcgaccttgtcttttgcaggggccagtgcttgtgcttgtcgaccaatagtgaaactggattcgttaaacaaatcttgagcatatatattgaatgtgtcggatctgtttagagacgccgggaccgtcccaaatctgcctgcaggaggcattcgggaacattggggctgtaccggacatcttgaaatccttgttgtatagttttctttttgagagagcagccggaagaagatacaccacgtgatcacaccacactactaagtcaagttacacttgagccttctcactgctgaagtttagcacttacctccggaccgcggccgatgtcaacaacctataataggccatagcttggagtcgggagtcgggactcggctttccacacgttgccactgagccactgaggacgacgacacgggcggtcaaaagccaccgcggcaggcacggccagccacgcacgcagaccgcatcatcagccatggcccaacgcccaagcgccgcagaccggacgtcattccctgacgcgtccccgtccaatccggcgccggcgccagcaaaatcaacgcgtcggcggctatcggccaattgccaattcctcccgccgaacgctgagaccctgacacggtggcccaccatcgcagcagggcacccctgcctcctcctcctccactcaccagcccaaccgcgtgcgacgtccgttatccgatctggtgggtgcgtgtcctcgtttgaccgttgaagagccctgcccgccgtcggatccgaacagcttcccttccatcagattcagagcgccgtccgcagccgactagcaacagtggccgtcccgctcactttctcgctaccttcctcagccggagtcgtgggcagagcagagcgatcgaggcctgcttcagcagttcagctgcagccgccgcccgcccgtcccccagtccccaccttcttttataaatcccacgcctgcgcttcctcttttgacgaatcggtcgcgaggggagaaagataggagtcaattaatttgcctgttctgcttgctgctgaccttgtgagtgagccgccggtcttccccttcctcgccgaggggaaataataaggcagccacagccagggccgccccgaggaagaagatgagcggaggaggcgtggacggagctccggtcgccgagttccggcagacggtgacgcacggcggccggttcctgcagtacaacatcttcggcaacctgttcgagatcacgcacaagtaccagccccccatcatgcccatcggccgcggcgcctacgggatcgtctggtacgttctcgcgaactgcaggctctcggctgcttgggccgccgtgtggctgatttttctcgcgaactgcagcagatggttgccaggtgttagggttttttttttactagctattcgttcatagggatgatggatgggcatggattgattggttggacctggaccaccgtaccgataggctcttaatttgatcctgcacagcgcgtaatatatagatagcagttgattatagttctgaagaagaagaagaaaataatgatctgtactgtgctacggacggacgcgcgcagctcggtgatgaactccgagacgaaggagatggtggccatcaagaagatcgccaacgccttcgacaaccacatggacgccaagcgcacgctccgggagatcaagctgctgaggcacctcgaccacgagaacgtatgtcaaaacagagcatatctatataaaatagttgttggatgatctgacgccgattgctgctgctccgatttggaccaacaattaaaacagatcatcggcatcagggacgtgatcccgccgcccgtcccgcaggcgttcaacgacgtgtacatcgggacggagctgatggacacggacctgcaccacatcatccggtccaaccaggagctctcggaggagcactcccagtacttcatgtaccagatcctccgcgggctcaagtacatccactccgccaacgtgatccaccgcgacctcaagcccagcaacctgctggtgaacgccaactgcgacctcaagatctgcgacttcgggctggcgcgcccgtcctccgagagcgacatgatgacggagtacgtggtcacgcgctggtaccgcgcgcccgagctgctgctcaactccaccgactactcggcggccatcgacgtctggtccgtcggctgcatcttcatggagctcatcaaccgccagccgctcttccccggacgcgaccacatgcaccagatgcgcctcataaccgaggcacgagcacgacgcacgcaccacatccttcctataattcaattccttcttcttctgctgctgctgatgaacatcgccggcacgcggcaggtgatcgggacgcccacggacgatgagctcgggttcatccggaacgaggacgcgcggaagtacatgcgccacctcccgcagttcccgcgccggccgttcgtcagcctgttcccgcggatgcagcccgtcgcgctggacctcatcgagcggatgctcaccttcaacccgctgcagaggatcacaggtcagtcggcgcgggcctactacagcttagcctgttctttttcctccctagcttcttctctccatgtgcaacttgcaactgggtggctgctgaatcctgaactccgccgcacgtgttctttagttggcgtcggtagtcactgtgtggtactagcatgtgggggcatgcactcgcgatgcagtgtatagtgcgtagtatgtaggcaaggcaacgcagctgacaacatgtcgcatttccagagagagaggggggggcatgcgtttggtttgtccgcgcaattttgggtgttggactggcctggtaaggactcaggagcatatgcaatcttctttgtctgaactagaaactttcacgcgccaacaaaacggaacgatttggtagtcctctcctcttcgttgaattcattcagagttagagaccataacagaaaacagggcgtcagttctgtgattctagttagctgctgtttaaaattagttggagatataggctattagctgtttttaggtagagacatctaatatctctagctaataggctattaactgcttgtttctttctcctcctgcgtttcccaattctaatattgtgcatccagctcatcaaagttgtgcacgctgtggtctgcgggagctttctccatttgcatccaaattaatgccttgatgttactaccttctacgtttacattacagtactttgggtgctgctgctttgacccatcctcggctttgtatcctcctcctgtcctccatatcgcttttgccgaaatgacgatgacggggctatgtgcatagaaaataaacatgttttaagatagaaaaaaaactatcgatacatagtcttaagggctagtttggtaacactatttttaaaataaaaaaaaaactaattttcctttagaaaatagaaattccttgaaaagataggatgccaaactagccctaaatattagattcctccactggcaacactggcattggcaggcagctatctatctatacatgatcttaaacattagaatatccaggacttggattataccttcattatacttattgctctacaagttcacgacgagtgattgatcataccttcattacactaaataaactctgttgtgccgtgcagtggaagaggcgctggagcacccgtacctggaacggctacacgacgtcgccgacgagcccatctgcacggacccgttctcgttcgacttcgagcagcaggctctgacggaagaccaaatgaagcagctgatattcaacgaggccatcgaactcaaccccaacttccgatactagctagctagctagttcggacacacatcttaattatacgtatgtatgattcctcgtacgtggtttgtaaatagaagatcgagccggccgccggtgttattagactgaacgttgcatttgtttgttcgttgacgttcgcgctcgcaggtttcaggctgtgtagtctgctgcaggtttcaggtgttcgtgtaatgagctgtaccaagaataaaatgctttggactcatctggtgactggtgggtcacatgttcctcgggcatacagaatcacagttttgtctgccaaagttatagcagcttctcttctcatgcagttgttcatattcgccacgcagctaacttttgcaagcagtaatctaataacacggacgaactactcgtcagttccgaaccataggtcctttaaattttaatctaagctagtttaatttgtctatatttaatcgaacttatagaaaataagtcaatatatctacaacaatacaatatcgaatagatgcaaaaaaaatatttcatggtgcatctaatctaataacctctcttgattgtctaccacgagtttgatcatcaatggtgtcagtaacgtaagccactgaaggccgagacgttctgcccgaaccagtatagatctcgcgcactccgcgcagaccctctggagcccggaacacgcacaataattttacttatcggagcgagatacgaaatatcgacaaccctatttactctccacatttggcaatttgataggaactccctaacgtcccgtttggatcattgaaattgaattccattctaataatagtaatttaggcttataccaattaagctaatttggttttatacaaaaaagatttgtatactattattagcaagatgtcgaaaatatttatgtgcta

SEQ ID NO: 68 - DNA, 1766 bp, Zea mays
accttcctcagccggagtcgtgggcagggcagagcagagcaccagccagagatcgaggccgggcttcagcagttcagctgcagccgccgcccgcccgctcccaccttcttttataaatcccgcgcccgcgcgcccgcccgggacgaatcggtcgcgaggggagaaagataggagtcaatcaatttgcctgttctgcttggcttcctgctgaccttgtgacggagtgagccgccggtcttccccttcctcgccgaggggaaataataagccagccacagccagggccgccccgaggaagaagatgagcggaggaggcgtggacggagctccggtcgccgagttccggcagacggtgacgcacggcggccggttcctgcagtacaacatattcggcaacctgttcgagatcacgcacaagtaccagccccccatcatgcccatcggccgcggcgcctacgggatcgtctgctctgtgatgaactccgagacgaaggagatggtggccatcaagaagatcgccaacgccttcgacaaccacatggacgccaagcgcacgctccgggagatcaagctgctaaggcacctcgaccacgagaacatcatcggcatcagggacgtgatcccgccgcccgtcccgcaggcgttcaacgacgtgtacatcgggacggagctgatggacacggacctgcaccacatcatccggtccaaccaggagctctcggaggagcactcccagtacttcctgtaccagatcctccgcgggctcaagtacatccactccgccaacgtgatccaccgcgacctcaagcccagcaacctgctggtgaacgccaactgcgacctcaagatctgcgacttcgggctggcgcgcccgtcctccgagagcgacatgatgacggagtacgtggtcacgcgctggtaccgcgcgcccgagctgctgctcaactccaccgactactcggcggccatcgacgtctggtccgtcggctgcatcttcatggagctcatcaaccgccagccgctcttccccggacgcgaccacatgcaccagatgcgcctcataaccgaggtgatcgggacgcccacggacgatgagctcgggttcatccggaacgaggacgcgcggaagtacatgcgccacctcccgcagttcccgcgccggccgttcgtcagcctgttcccgcggatgcagcccgtcgcgctggacctcatcgagcggatgctcaccttcaacccgctgcagaggatcacagtggaagaggcgctggagcacccgtacctggaacggctacacgacgtcgccgacgagcccatctgcacggacccgttctcgttcgacttcgagcagcaggctctgacggaagaccaaatgaagcagctgatattcaacgaggccatcgaactcaaccccaacttccgatactagctagctagctagttcggacacacatcttaattatacgtatgtatgattcctcgtacgtggtttgtaaatagaagatcgagccggccgccggtgttattagactgaacgttgcatttgtttgttcgttgacgttcgcgctcgcaggtttcaggctgtgtagtctgctgcaggtttcaggtgttcgtgtaatgagctgtaccaagaataaaatgctttggactcatctggtgactggtgggtcacatgttcctcgggcatacagaatcacagttttgtctgccaaagttatagcagcttctcttcttatgcaaaaaaaaaaaagaaaaaaaaaaaaaaaaaa

SEQ ID NO: 69 - DNA, 1696 bp, Zea mays
  misc_feature (65)..(65): n is a, c, g, or t
attgggtacctcgaggccggccgggagttcagctgcagccgccgcccgcccgtcccccagtcccncaccttcttttatagggcacctgcccgcgcgccccctgccgacgaatcggtcgcgaggggagaaagataggagtcaattaatttgcctgttctgcttgctgctgaccttgtgagtgagccgccggtcttccccttcctcgccgaggggaaataataaggcagccacagccagggccgccccgaggaagaagatgagcggaggaggcgtggacggagctccggtcgccgagttccggcagacggtgacgcacggcggccggttcctgcagtacaacatcttcggcaacctgttcgagatcacgcacaagtaccagccccccatcatgcccatcggccgcggcgcctacgggatcgtctgctcggtgatgaactccgagacgaaggagatggtggccatcaagaagatcgccaacgccttcgacaaccacatggacgccaagcgcacgctccgggagatcaagctgctgaggcacctcgaccacgagaacatcatcggcatcagggacgtgatcccgccgcccgtcccgcaggcgttcaacgacgtgtacatcgggacggagctgatggacacggacctgcaccacatcatccggtccaaccaggagctctcggaggagcactcccagtacttcatgtaccagatcctccgcgggctcaagtacatccactccgccaacgtgatccaccgcgacctcaagcccagcaacctgctggtgaacgccaactgcgacctcaagatctgcgacttcgggctggcgcgcccgtcctccgagagcgacatgatgacggagtacgtggtcacgcgctggtaccgcgcgcccgagctgctgctcaactccaccgactactcggcggccatcgacgtctggtccgtcggctgcatcttcatggagctcatcaaccgccagccgctcttccccggacgcgaccacatgcaccagatgcgcctcataaccgaggtgatcgggacgcccacggacgatgagctcgggttcatccggaacgaggacgcgcggaagtacatgcgccacctcccgcagttcccgcgccggccgttcgtcagcctgttcccgcggatgcagcccgtcgcgctggacctcatcgagcggatgctcaccttcaacccgctgcagaggatcacagtggaagaggcgctggagcacccgtacctggaacggctacacgacgtcgccgacgagcccatctgcacggacccgttctcgttcgacttcgagcagcaggctctgacggaagaccaaatgaagcagctgatattcaacgaggccatcgaactcaaccccaacttccgatactagctagctagctagttcggacacacatcttaattatacgtatgtatgattcctcgtacgtggtttgtaaatagaagatcgagccggccgccggtgttattagactgaacgttgcatttgtttgttcgttgacgttcgcgctcgcaggtttcaggctgtgtagtctgctgcaggtttcaggtgttcgtgtaatgagctgtaccaagaataaaatgctttggactcatctggtgggctcacatgtttctcggccatacagaatcacagttttgtctgccaaagttatagcagcttctcttcttaaaaaaaaaaaaaaaa

SEQ ID NO: 70 - DNA, 2306 bp, Zea mays
ctctactaccaccccgcccgcgccgccacgcgtctcactcagttctgcgttcttccgctcgccccctcacaacgaaacctagagagtcccgcgcgtgacatggcggacggcgcgggctcggcgtctggtctggtggagaagctcgcggagctttcaacgggcggcgccgggcagaatcctccgccggcgggtgaaggcggagaggagctgcagctctcgaagaacgcgaagaagagagaggagaagaggaagaagctggaagaggagcggaggctcaaggaggaagagaaaaagaacaaggcggcggcggctgctgctgctagtggaaagcctcagaaggcatctgctgctgacgatgatgacatggatcccactcaatactacgagaataggctcaagactcttgattcactcaaggccgcaggtgtaaacccctatccacataagtttccggttggcatctctgtagtggaatacattgagaagtacaagaccttgaacaatggggagaagcttacagatgcgacagaatgtttagctgggaggatcatgaacaagagaacatcatcatctaagctattcttttatgatctttatggtggcggcatgaaggttcaagtgatggctgatgccaggacctcagagttggatgaagcagaattctctaagtaccactcgagtgtgaagcgaggtgatattgttggcatatgtggttatccaggaaaaagcaaccgtggggagcttagcctgttcccgaagaaatttgccgtgctctctccatgtcttcatatgatgcctcgacagaaaggtgaaggaagttcggtgcctgtaccgtggactccaggaatgggtaggaatatcgaaaattatgttttgagggatcaggaaactcggtatcgtcagagatatcttgatctaatggtaaaccatgaagtgaggcatatcttcaagacacgatctaaagttgtctcatttatccggaagtttcttgatgaccgcgaatttttggaggtggagactccgatgatgaacatgattgctggtggagcagctgcaaggccttttattacacaccacaatgaattaaacatgaggctttttatgcgcattgctcctgaattatatctgaaggaattggttgtcggtggattggaccgtgtttatgaaattggaaaacaattcaggaatgaaggaattgatttaacacacaatcctgaattcacaacttgtgagttttatatggcttatgccgattataatgatttgatggagcttactgaaaccatgttgtcagggatggttaaggagctgacaggtggctataagataaaatatcatgcaaatggagttacgaactcaccaatagaaattgatttcacacctcccttcagaaggattgatatgattaaagatttggaggctatggccaatctcaatataccaaaagatctagcaagtgatgaagcgaatcgttacttgatagaagcatgtgctaagtatgatgtgaaatgtccacctccccaaacgacatcacggttgcttgacaagttagttgggcatttcttggaggagacatgtgtgaatccaacatttatcatcaatcatccagagataatgagtccattggcaaagtggcataggtctcgacctggattgactgagaggtttgagctatttgttaacaaacatgaggtgtgcaatgcatacacagagttaaacgatcctgttgtgcagagacaacggtttgaggagcaactaaaggatcgtcaatctggtgatgatgaagctatggccttggacgaaacattctgtgctgcccttgagtatggtctaccaccaacaggtggttggggcttgggaattgatcgcctcacgatgttgcttacagattctcagaacattaaggaagttcttctatttccggctatgaagcctcaagagtagctatccgcatagccaaaagccacaaaatggcctcacagccaaaggccacaaaaggttcaaagcaaacatgatgctgcataggcgctggagggtatatcttagctcttggatctgtattgaacgatacatccttttgcccctgtgctcgggagctttccatttttttcattattttttgtaaactaccgcgtatttgctggcagcaggttattaaccagaaactgtaacgtcacagaaagttcagtttaacttcgaatggagttttttggaggttgcaaatactctgcgtctgcgtctacccaaggtgcacccgctcctaaaagaaagaatacaaggagcccatgactttttgaaggaagagg

SEQ ID NO: 71 - DNA, 896 bp, Zea mays
agaggcgacggttggaggaacaactaaaggaccgtcaatctggtgatgacgaagctatggctggggacgaaacattctgtactgcccttgagtatggtttggcaccaacaggtggttggggcttgggaattgatcgcctcacgatgttgctaacagattctcagaacattaaggaagtacttctattcccggctatgaagcctcaagagtagtaatccacagccaaaagccacaaaaggcaaagaacgatgattgcctattaccctgtgctgggcttgaggtggatgagggaacatacaccctacactatggtgatatttcaagatatctgtatgattctagattcactgggcgtgctgtgtccattgttctactttattggaagttctgtttgagatgctgcatcttcagttgtctactgccccggtgctgattatgttgtataattcagacgtgctcattgttgattttgtacacgagtttgcactgcataggcagataggctggaggatacgctaacttggatatttgtgtcacagctcaaagcaaacatgatgctacataggctggaggatacatcaaagttggacctgttgtgaattatacttatttttgctcttgtgcgtgcgaggtttccatttttcattatttgtatttcccagcagacagttattaactaaatactgtaacgtcacagtaagttcagtttaacttcaaacattgtagttttgaggagattgcaaatatttcgggtcaatgcaattggtgcttttgatagccatgcaaaatgcctcttctcgtcatgatcgtgtttgctttatgctgatgttcagccatcattcacgttaaactggcatgttaatgtaaaccgtgcaatcagctgggtttgatattgt

SEQ ID NO: 72 - DNA, 1970 bp, Zea mays
  misc_feature (98)..(98): n is a, c, g, or t
ggcggccagggaacttgaacttggcgcgacgcagagcttcactggcatgtgcagcattgttgtccttgcatcgaacagaaaggaggacctgaccaatntccaccctagcacaggtgccctgaggcttgccaaaggcacccctcattccagtctggagcctatcagccccagcacacgaaagcatcttgttgatacgaaggacatggaaggggtgaacccggacccgaaggtggaaggcatcctttcctgcagacttggtcatgtacttgttgcaggcaatacgggcagcctcaagagcctcactggagacattctccttctcccaagagacaaggtgcacacagtaggggaactcatcaacaccctttctcttcatgccaacatcgtagatcctgatcttggggtcagggacaccacggcagtacctggacttggggtatggcttgttcttgatctggcgatagcatctcgcaggccctacccaatgtttcagaaacataaaagcttgagtatcaattaacataataccaatgcaccacagtagtaaaaatgtccactgcatacaagtacaaacaattgactagatgaaagacagaacattgattttcacatttatatacaagagtaattacataagcacgcagaatgagcatatgcacagcatagtcagattacttctactgtgttttttcatggcatataatagaatactaaatgtattcattaaaaatccatgaaacacaactactaaccccatcttggcagctaactgtacaaggtctacaagcattagtctgaacaaaaacaagattttccgactgtaaacagcaaatcaattgatgccatgttctaccagtagtgtttttccgatggcatacaatagaatactaagggtttgttcagttattcccattccatgtgcattggaggaaattaggagttgcttgggaattaaacacagtcgggaccgcccggaaaacgattaccagccggattgcttatctaaaatatataagatttgatcagctggaacaattctggatctaatgctggagaaacggaaggcctcaacctcttccaatccacatgaattaacattagaagaacagaccctaaatgtattcgttaaaaatccatggaacaagcattagtccgaaacaaaacaagatttcccaactatgaacagaaaatcaaatgatgtcatgttctgccagtagtcagacaggtcttaaactatgagcgtgttatctccgaacttatcacgcgtcaagcacacatgaaaatttgggtgagtatatagtaccaaagccccagcgcttctcgtatttatacgatactaagcaaacacagcttcgtgagttccacaaatcaactcaaatactaataccgcgcagtaagcaacaagtagccatcaaaagtattaacccgatttcgtggggatctagtcgagatttgcaccggacgcaaagtgggagccctcttcagacaagcggttgcaacaaacatcgcagtagaagcgtacgaaggagctggatcgaaaacgcgaacttacttctccccatggcgacggcagcagagagcaggcggcggcggcgaatgaaagaagggatgcggctagggcttggagtggagtgagggaacactttatatagagagtgtggacgcggaatggggccgtgccgccgtgggttttgtgcgtcatggcatgcgactgtcagatgctgggccttggaagcagtggacccaaaaaccgaagagagcccagtaaaattggagactcctttctttcagggtcagcccatgcgccatgctgagagagagccaagattacagttggcctgtcaagttcccacgctaaagtctggaatgtcccgcgtgtgcccagttccagttccactccagcaacaaccgaagaccatggcggttgcggtggcgcagagtctcctcgcggcgaccacgaagatcatcgg

SEQ ID NO: 73 - DNA, 1033 bp, Zea mays
tgcagcgacatcatcctcccccgtcgcgcccttgccgccgccgcctcctctccccgccactcgcccactcgagctggacactgaaaaaaatcagtagcagggccgtgttgggctgagcccacgttgtccacatcaaaacactcaaacagggttgttagttctcacgggccaaaaaggtcagcccatgttgatgccgtggccgtggggatcagatggcttggcggctacgacggttttcctcactagtccccccccccccccccccctaaaaccctaccactctactaccatcacacctgcgcctccacagtccacactcaccgcgctcgccccctcacaacgaaacctagagagtcccgcgcgtgacatggcggacggcgcgggctcggcgtctggtctggtggagaagctcgcggagctttcaacgggcggcgccgggcagaatcctccgccggcgggtgaaggcggagaggagctgcagctctcgaagaacgcgaagaagagagaggagaagaggaagaagctggaagaggagcggaggctcaaggaggaagagaaaaagaacaaggcggcggcggctgctgctgctagtggaaagcctcagaaggcatctgctgctgacgatgatgacatggatcccactcaatactacgagaataggctcaagactcttgattcactcaaggccgcaggtgtaaacccctatccacataagtttccggttggcatctctgtagtggaatacattgagaagtacaagaccttgaacaatggggagaagcttacagatgcgacagaatgtttagctgtgaggatcatgaacaagaaaacattatcatctaagctattcttttatgatctttattgcggcctgatgaacgtttaagtgatcgctgatgccaagacctcaaagttggatgaagcataattctgtaagtaccactcgagtgtgaagcgaggtgatattgttggcatatgtggttatccaggaaaaagcaaccgtggagagcttagcctgctcccaaataaattt

SEQ ID NO: 74 - DNA, 2387 bp, Zea mays
ggaccctccaggccggcccccccggccggccgggattcctccgcgccgccactagctgtcctaaaccctaccaccacttgagcctccaccttctccgcgtctcaccttcttctccgttctccttccgctcccctcttcacaacgaagccctagtgtcccgcgacatggcatctggtctggaggagaaactcgcggggctctcaacgggcggcgacgggcaaaatcctccgccggcgggtgagggcggagaggagccgcagctctcgaagaatgcgaagaagagagaggagaagaggaagaagctggaagaggagcggaggctcaaggaggaagagaagaagaacaaggctgcggctgccagtggaaaacctcagaaggcatctgctgctgacgatgatgacatggatcccactcaatactatgagaataggctcaaggctcttgattcactgaaggccacaggtgtaaacccctatccccataagttcccggttggcatttctgtacccgaatacattgagaagtacaggaccttgagcgagggggagaagcttacagatgtggcagagtgtttagctgggaggatcatgaacaagagaacatcgtcgtcgaagctattcttttatgatctttatggtggtggcatgaaggttcaagtgatggctgatgccaggacctcagagttggatgaagctgaattttctaagtaccactcaggtgtgaagcgaggtgatattgttggcatatgtggatatccaggaaaaagcaaccgaggggagcttagtgtatttccaaagagatttgtcgtcctctctccatgtcttcatatgatgcctcgacagaagggtgaaggaagtgcagtgcctgtaccgtggactccaggaatgggtaggaacatcgaaaattatgttttgagggaccaggaaactcggtatcgtcaaaggtatcttgatcttatggtaaaccatgaagtgaggcacatcttcaagacacgatctaaaattgtctcatttatccgaaagtttcttgatgaccgtgaatttttggaggtggagactccgatgatgaacatgattgctggtggagcagctgcaaggccttttgttacacatcacaatgaattaaacatgcggctttttatgcgcattgctcctgaattatatctgaaggaactggttgttggtggattggaccgtgtttatgaaattggaaagcaattcaggaatgaaggaattgatttaacacacaatcctgaattcacaacttgtgaattttatatggcgtatgcagattataatgatttgatggagcttactgaaaccatgttgtcaggcatggttaaggacctgacaggtggctataagataaaatatcatgcaaatggagttactaaccccccaatagaaattgatttcacgcctcccttcagaaggatagatatgattaaagatttggaggctatggccaatctcagtataccaaaagatctatcaagtgatgaagcgaatcgttatttgatagaagcatgtgtgaagtatgatgtgaaatgtccacctccccaaacgacatcgcggttgcttgacaagttggttggccatttcttggaggagacatgtgtgaatccaacatttatcatcaatcatccagagataatgagtccattagcaaagtggcataggtcccgacctggattgactgagaggttcgagttgtttgttaacaaacatgaggtgtgcaacgcatacacagagttgaacgatcctgttgtgcagaggcaacggtttgaggaacaactaaaggaccgtcaatctggtgatgacgaagctatggctttggacgaaacattctgtactgcccttgagtatggtttggcaccaacaggtggttggggcttgggaattgatcgcctcacgatgttgctaacagattctcagaacattaaggaagtacttctattcccggctatgaagcctcaagagtagtaatccacagccaaaagccacaaaaggctcaaagcaaacatgatgctacataggctggaggatacatcaaagttggacctgttgtgaattatacttatttttgctcttgtgcgtgcgaggtttccatttttcattatttgtatttcccagcagacagttattaactaaatactgtaacgtcacagtaagttcagtttaacttcaaacattgtagttttgaggagattgcaaatatttcgggtcaatgcaattggtgcttttgatagccatgcaaaatgcctcttctcgtcaaaaacaaaaaaaaaaaaaaaaaagcggccgccatcattcaggtgaaactggcatgtaaatgtaaaccgtgcaatcagctgggtttgatattataaattttaatggcaaaaaaaa

SEQ ID NO: 75 - DNA, 2679 bp, Zea mays
  misc_feature (2317)..(2317): n is a, c, g, or t
  misc_feature (2466)..(2466): n is a, c, g, or t
tagcaagggatttctctacatagatctcttctattttctttgttaccaaatcagctttgaaggtgcaccaacggaaaatctgttcgccgcgtccatgactcccagtccctggtccctgcacgtctgcactgtaccggcaaccccatccccatgcacaacacggctcagaccccacgtacctttttatccccctctttaatgtgccacgatagcattacactttccgccatcatccatatgtcgtcgctctcgttagaagcaacggagcttatccatcgttagtccgttacaacgatccgccggcgccaaacgaccgccggatccaatataaatacccttgcacaggcatggtgatcgacacacagccaaagtacaagactcacttgcatttttggcacaccagcacagaagaagaaaaaaaaaacaggcactgagctgagatggcgaagcacttggctgccatgtgcaggtgcagcctcctagtgcttgtactgctctgcttgggctcccagctggcccaatcccaggtcctcttccaggtacctgcgcagcgtcctcgtctcttcccggccgatcgctcaacattaatcaggcgtgctagatagcacaagtctggatttaattttgatgctgatatatatatgctgcgtgtctgcgtgcaggggttcaactgggagtcgtggaagaagcaaggtgggtggtacaactacctcctggggcgggtggacgacatcgccgcgacgggggccacgcacgtctggctcccgccgccgtcgcactcggtggcgccgcaggggtacatgcccggccggctctacgacctggacgcgtccaagtacggcacccacgcggagctcaagtcgctcaccgcggcgttccacgccaagggcgtccagtgcgtcgccgacgtcgtgatcaaccaccgctgcgccgactacaaggacggccgcggcatctactgcgtcttcgagggcggcacgcccgacagccgcctcgactggggccccgacatgatctgcagcgacgacacgcagtactccaacgggcgcgggcaccgcgacacgggggccgacttcgccgccgcgcccgacatcgaccacctcaacccgcgcgtgcagcaggagctctcggactggctcaactggctcaagtccgacctcggcttcgacggctggcgcctcgacttcgccaagggctactccgccgccgtcgccaaggtgtacgtcgacagcaccgcccccaccttcgtcgtcgccgagatatggagctccctccactacgacggcaacggcgagccgtccagcaaccaggacgccgacaggcaggagctggtcaactgggcgcaggcggtgggcggccccgccgcggcgttcgacttcaccaccaagggcgtgctgcaggcggccgtccagggcgagctgtggcgcatgaaggacggcaacggcaaggcgcccgggatgatcggctggctgccggagaaggccgtcacgttcgtcgacaaccacgacaccggctccacgcagaactcgtggccattcccctccgacaaggtcatgcagggctacgcctatatcctcacgcacccaggaactccatgcatcgtaagtccccaaccgggtcggtccatcaccaaatccagaatcctggccgacacactgacactcttgtccttgcatctgtaattcagttctacgaccacgttttcgactggaacctgaagcaggagatcagcgcgctgtctgcggtgaggtcaagaaacgggatccacccggggagcgagctgaacatcctcgccgccgacggggatctctacgtcgccaagattgacgacaaggtcatcgtgaagatcgggtcacggtacgacgtcgggaacctgatcccctcagacttccacgccgttgcccatggcaacaactactgcgtttggggagaagcacggtctgagagttccagcggggcggcaccactagactagactagacccatattccgcccaactcctacagataattctcttttcaggtccattttgaacctggaaaagaaatttaagagaggctaaataaccggaatacgattgtgtactgagcttctttcagctaattattgaaagaagattataatgtttggatgcactattaattatgttggcatggggatttttgtaacctcttaaaacgaggaaataaagactgttcttattaagctgaactcccgctgacgttaagctagagaaactccttccataattaacttgctaaaccagtaagtttagcaagtttacaaaacaagtggcaacctcaaatttatttctctnctaatagtttcactttctaaacatttctggagtgaaaattctaaaccatctctaatcaaccaaatctcgccatttatcgtattctgacttgaaactatatattatttcttacattactcatgtgtctagtttactttgatccagttccnttgactataaatatatatgatgagttgaagaggatatttgataacttcttatttctaggagctttttttatatcaaactgttcaatataattttttcctaaaaatggaaacagagagttgttttgcaaaacttctagaccactcgagtctttctaagggggtgtttggtttttagggactaatttttagtccctccacttaattccattttag

SEQ ID NO: 76 - DNA, 1684 bp, Zea mays
  misc_feature (20)..(20): n is a, c, g, or t
tcgaggccggccgggccggngacacagccacactacaagactcacttgcatttttggcacaccagaacagaagaagaaaaaaaaaacaggcactgagctgagatggcgaagcacttggctgccatgtgcaggtgcagcctcctagtgcttgtactgctctgcttgggctcccagctggcccaatcccaggtcctcttccagggtttcaactgggagtcgtggaagaagcaaggtgggtggtacaactacctcctggggcgggtggacgacatcgccgcgacgggggccacgcacgtctggctcccgccgccgtcgcactcggtggcgccgcaggggtacatgcccggccggctctacgacctggacgcgtccaagtacggcacccacgcggagctcaagtcgctcaccgcggcgttccacgccaagggcgtccagtgcgtcgccgacgtcgtgatcaaccaccgctgcgccgactacaaggacggccgcggcatctactgcgtcttcgagggcggcacgcccgacagccgcctcgactggggccccgacatgatctgcagcgacgacacgcagtactccaacgggcgcgggcaccgcgacacgggggccgacttcgccgccgcgcccgacatcgaccacctcaacccgcgcgtgcagcaggagctctcggactggctcaactggctcaagtccgacctcggcttcgacggctggcgcctcgacttcgccaagggctactccgccgccgtcgccaaggtgtacgtcgacagcaccgcccccaccttcgtcgtcgccgagatatggagctccctccactacgacggcaacggcgagccgtccagcaaccaggacgccgacaggcaggagctggtcaactgggcgcaggcggtgggcggccccgccgcggcgttcgacttcaccaccaagggcgtgctgcaggcggccgtccagggcgagctgtggcgcatgaaggacggcaacggcaaggcgcccgggatgatcggctggctgccggagaaggccgtcacgttcgtcgacaaccacgacaccggctccacgcagaactcgtggccattcccctccgacaaggtcatgcagggctacgcctatatcctcacgcacccaggaactccatgcatcttctacgaccacgttttcgactggaacctgaagcaggagatcagcgcgctgtctgcggtgaggtcaagaaacgggatccacccggggagcgagctgaacatcctcgccgccgacggggatctctacgtcgccaagattgacgacaaggtcatcgtgaagatcgggtcacggtacgacgtcgggaacctgatcccctcagacttccacgccgttgcccatggcaacaactactgcgtttgggagaagcacggtctgagagttccagcggggcggcaccactagactagacccattccgcccagcaacccctacagataattctcttttcaggtccattttgaacctggaaaagaaatttaagagaggctaaataaccggaatacgattgtgtactgagcttctttcagctaattattgaaagaagattataatgtttggatgcactattaattatgttggcatggggatttttgtaacctcttaaaacgaggaaataaagactgttcttattaagccaaaaaaaaaaaaaaaaaaaaaatctaga

SEQ ID NO: 77 - DNA, 3314 bp, Zea mays
cattgggtacctcgaggccggccggggtctataaagtggccgccagaatccgcgcctcctactactctgccctctcctggctcctctccttcctgcttggtttttgctttcagctcttgaaccgaatccactgccgcggcgcttagcattggggactagggggccgacatggctgccttaggggcgaagatggagcgtctgtcgtcgatcgacgcgcagctgcggatgctggtgccggggaaggtttcggaggacgataagctcatcgagtacgacgctctcctcctcgatcggttcctcgacatccttcaggacctccatggcgacgacctcaaggaaatggttcaagaatgctatgaggtagctgctgagtatgaaacaaaacatgacttgcaaaagcttgatgaactcgggaagatgataacaagcttggatcctggggactctatcgtgattgctaagtctttctcgcacatgcttaacttggccaacttggctgaggaagtccagatagcctacaggaggagaatcaagctcaagaagggagactttgctgatgagaactcggcaatcacagaatctgacattgaggaaacacttaagaggcttgttgttgacctgaagaagtcacctgctgaggtatttgatgccctcaagagccagactgttgatctggttttgactgcacatccaacacagtctgtgaggaggtcactgctccagaaacactcgaggatacgcaactgtttggttcaactctactcaaaagatatcactccggatgataagcaggaacttgatgaggctctgcaaagagagatccaagctgcctttagaactgatgagatccgaagaacacagcccactccccaagatgaaatgcgtgctggtatgagctacttccacgaaacaatttggaagggtgttccaaagttcttgcgccgggttgatactgcattgaagaacattgggattaacgagcgtgttccttacaatgcacctcttattcaattctcttcttggatggggggagatcgtgatggaaatccaagagtgacaccagaggttaccagggatgtctgcttgcttgccagaatgatggcatcaaacttgtactgctctcagattgaggatctcatgtttgagttgtctatgtggcgatgcagtgatgaactgcgcatgcgagctgatgtgctgcatctctccactaagaaggatgccaaacattacatagagttttggaagaaggttcctccaaatgagccatatcgggtgatactgagtgatgtcagggataaactgtacaacactcgtgaacggtcacgagagcttttatccagtgggcattctgatattcctgaggaagctacattgacaaatgttgagcagctgttggagcccttggaactatgttacagatcactctgtgcttgtggtgactctgtaattgctgatggaacccttctggatttcttgcgtcaagtgtccacctttggactctcccttgtgaggcttgacattaggcaagagtcagataggcatactgatgtccttgatgccatcactacatacctggggataggatcttaccgtgaatggactgaagaacgccgccaagaatggttactgtctgaacttaatggcaagcgccctctgtttggctcagaccttcccaagactgaggaaatttctgatgttctagacacattccatgttattgctgagcttccctctgacaattttggtgcgtatatcatttccatggcgacagctccgtcggacgtccttgctgttgaactcctccaacgtgagtgtcatgtgaaaacaccacttagagtagtcccgctgtttgagaagttggccgatcttgaggctgccccggctgcattggccagactgttctcaatagattggtacagacagaggatcaatggcaagcaggaggtcatgattgggtattcagactcgggcaaagatgctggtcgcctctcagcagcttggcagctatacaaagctcaggaggagctcatcaaggttgctaaggactttggtgtgaagttaacgatgttccatggacgtggtgggactgttggaaggggtggtggtcccactcaccttgccatcttgtcccagccaccagacacgatccacggatcactcagggtcactgtgcaaggtgaagtcattgaacagtcatttggtgaggagcacttgtgctttaggacactgcaacgtttcacggctgctaccctggagcatggcatgcacccaccaaatgcaccaaagccagaatggcgagcccttcttgatgagatggcagttgtggcaactgaggaatatcggtccattgtcttcaaagagccacgctttgtcgagtatttccgccttgcaacccctgaaacagagtatggtaggatgaacataggaagcaggccatccaagagaaagccgagcggaggtatcgactcactccgagcaatcccatggatctttgcttggacacaaacgcggttccacctcccggtctggctaggatttggagccgcattcaagaatgtcctccagaaggacatcaggaacctccacatgctccaggaaatgtacaatgagtggccatttttcagggtgactattgatctggtggagatggtgttcgccaagggtaatcctggcattgccgcactgtatgacaaactcctcgtttcagaggaactgcatccattgggtgagaagctgagggccaactatgaggaaacccagaagcttctacttcaggttgctgggcacagggatcttctggaaggtgacctctacctgaagcagcggctccgcctgcgtgatgcgtacatcaccaccctgaacgtctgccaggcctacaccctgaagcggatccgtgacccggactaccatgtcgcgctgcgcccccacctctccaaggagatcatggactcgaccaaggctgcggcggagctggtgaagctgaaccctggcagcgaatacgcaccggggctggaggacaccctcatcctgaccatgaagggcatagcagccggcctccagaacaccggttaaaccacgaagaggggatcttttttctcctcctgatcattggctctaggtccttcgtattttcgcggattgtaacttcggccacctctctacaccgtgaggaaataatggtggtttctgcaaaagtggtggtaaataaaagggcgacaactatcttgtttttctcatagtaacttataactttacgatgcgataatggaacatggcttgcgttatctgtttctcgtcaagcatttttgcaggca

SEQ ID NO: 78 - DNA, 1887 bp, Zea mays
gcgacccctgcgacgcgcatttgttgagaggcggcctactacgaactaccgtcgatggcgttcctcgcgcctccgcagttcaagtggcccctttccacccgtgcggcggcggtgttcagggagcccaccggcggcgcaggctcccgccccagtcggataaactgttctttctcctccacggcagtcgtcgatgcagagtgcttatccgtcgggccgccgccttctcctcaccgaacgcttccgggctgtttcggtgaggcacttcttaacaaggaggcagtggtggcggccgcggccgggaagccgtcgctctggctcgcgcaggccgaggtcgccggagaagtcgcccggatggcgcagaatgatcacccggctgccttaccgccgcgcgatgacacggtggatagcttcctgtcaagagaggtcctccgctccgaggtggggctggatgccaggcgcgccgggctcgtcgaaatgctggagggcgaagagcacagcagcattttcagcgacgaatccgaggatgacgatgatggcgggcatagcatagccgtaacggtgaagtcggcgcggcggtccgagagaagggctcggagagtgagggcagcgatgaagacggccaagtgttccagcagcatgaagcccgttggagcgtcctccacaaggaggaaacggttgaagggttgcctgactcctctcgggtgcttgtacaagatgaccggcccgaggcttctgacggcggaacaagaagtcgaattctcagaaggcattcaggaccttctgaaactggaagccatccaaaaggaggttgcgcagtataatgctggtgaaccaacgttttcccagtgggcggcagcagccggaaccgatgagaacactctgcggagacgcctgaatcatggagtctactgcaagaacaggatggtgaaatctaacgtgcggcttgtaatctcgattgcaaaagaacacgaaggccccgggatggagttctctgatcttattcaggatggaatgcaaggcctgataagaggcgcggaaaagttcgacgcttccaagggttttagattctccacttactctcactggtggatcaaacaagcaatacgcaagtccgttttagaacaaacccagataatccgcctgccggcacacatggctgaagcgagttcccgagtgaaggaatgctgccggcgactcggccgtgagctgaaacggctccccagcaacgaagagatcgcggtggacactggcatgacgatccggcgggtggaggcggccatgagcctcccgaaatacagcgtgtccttcacgagcaaggtcgggtgcacggacgtcacgtaccaggagatcatgccggacacgagcgccgagacggcggaggagacgctgcaccggtggctgatgaagaaggacgtgaacacggcgctggacagcctgagcccgcgcaagaagcaggtgatgcggtaccggttcggcatcgagggcgggcgggccaggaccctgcacgacatcgggcagctcatgggggtcagccgggagcggatccggcagatcgagctgggcgcgttccggaagctgcggagcaagaacaggttgcagtcgctgcagcactacctgcggccggcggagagctggtagccatgtcaggtgctgcgctacgactacgatacgacttcgacgagaccataacccgcatcgttgcacatggctttccatgatgtatgtatgtacgccgttcctatttacaggatttaaagtatacgcgttcgatccattttcttgtctatgttatatagcactatgtgtataaagaagacgaaacaacatttttttaacgcaaaaaaaacaagaattatggagatagactataaaaaaaaaaaaaaaaaa

SEQ ID NO: 79 - DNA, 1327 bp, Zea mays
gcacgagcccagtgactccaaccctagcctctggagctcctccccaacgccatcgctcatctgccgtcgccacgagctcctccgtcgtcgcacctgatccacatcgagctctccgcgggtgtccccttccccccgcgagttttgaataaaggatgatttggaacaatgtgtacgagaaaggcttagtcgatgtgatgcatgatcacaaagataatccaaaattcaaaggtcaaaatggttggaatcgtgatggatggaatagtatcactaccaagttcaatgaaaagttccctctagctcatttctctaaacaacaactgcaagagaaggagagagagcttaaaggatactacaaggcaataagggattcaagaaaagaaagcggggttggttggaatgacaccctatgcatggtactagctgaaccagaagtttggccaaggctgattcgcgtatcaaagtttcgcaataggccattccctcttttttacagtttagaagggctatatgaaggtagtgtggctaccggagagttgaatttcacatcaaccgctgttgatcttcctccaccttcagctccatccaggagtgtgtctggacaaagtctcagtcctttgagtactaattcacttgatttggatggacaagaaaccacaagtgtgttcaatctatcttctgatgctcaatctgtcccagtcaatactaatgaacccactgaagctcaatttgtcccatctaatcaagaatcaagccagagagaaggtggcagtgggagaaagcgtaagcaaagccatgttggattagctcctgaaagctatgtggggtttaaaaagatccaaaatacagaaacacttgaaactcttaaagaacacaagaggcaagaggatcaattttctattagcaagtgtcaggctgaattgaaaggaatggatggattaacagcagtggacaaatcatatgctttggagctttttgtatctgcgacaaaccgatagattttcttaacaaaacagagcatgatgttagagaaatttggctcaagcgcaaaattaggttgcttcgtgggagtgatgcatggcctaaacaaatgatttgacatgaaaagctttgtgatgatctcttagggtaatttcatatctgaattatctccattacttttgtttgccctgtactgatgacatcatttctccaatgtcagggctacagacaaccatgtgtgttgtgcatctttgcgtgctggtgttgcattttcctttggtgctggtgttgccagttctatgctttaaaatattgtagcaactcgtgataaagctttgtttgacaaact

SEQ ID NO: 80 - DNA, 4170 bp, Zea mays
  misc_feature (1781)..(1781): n is a, c, g, or t
cgcccgacatatgactctgagaagttgtcagagagaatagcaaagctttctttctggtggggttgctgtgattaagaaatgttgttttttttaaagaagaaatgttgtttgatacatgttactggtgattttcaggctttggtggcacctgcagcgctgatagcgcataatatgctggggtggaaggtgaggtgattgtgagggaaagcgaacgggagttgggttataacgccatggcggacaagcacgatggcgaactgtggaagaactggactcggtgattggctggctagtccgctggtagcacagccagggcagggcatatggcggatggatatggtcgcatggcaaccccacgtggcagtaaattcatggtgctccttgcgcgccttatcctccttctcacatcacatgggactggactgggagtgccaatgcctccagcccagcttgcctgccacctggtcttgaccctctcctggataggaggagcagcagccagagggacatcaaactgtgctgcctgcgtgtgtgtcttctttcttgcctctcccttcttcaacctttgctagcttgccagggagggagtccatgaattccagcagaagcctcctctcttcgcccctctttgctagctcgtctccaaacttcaggagcagtgcttccgtctcctcctccccatccccatcccgcaccacaggtatatatagcccttgtatgtgtttctaatctgcagatactattgtccctgggcactggcagagctcatccgctaccatctggcagcagttccaatgatacatgacaccagcagcagcagagcatccacggcgtgccactactcgccgtcgcttgtggcagaggagcagcttcacggctccaaagacaccttgaccttgaagggcgagaaggctttgctcgagttgcttctaggcatggtgtgtgtgtctcactcacctcgttccttgttgtactacctgattttcataaccatctccgatcccctgcaggctctggaccagcacgttgacggcaggaagctcattacccaacaggaggctgaggatagtgatttcgagagctatttgagagaagcaacaagccgagtgctttaccagccaacattcatgtacggcaggcagcttctgttttccctcttccttcccaagtaatcttttggcagccgctgttgattctggcctgaatttattagcagtgaagaggatgatgatgatgattctgtttcggagagctcttcagcatcattggccaaaccagctggaacattggatcttggcaagctgacagaggaaccacagttggatgtaccacagcctcaccgccggtttgttccttcaacgtcaaacactctttttatgtcttttattatactaacacttgaccaccattgtgttgccaccacagcagtgtggatccaaaccattcgtatgatcaagtgtttattagatccactcggttactggagaggagatccaagaaacgcaacggcggccacagggctttggataatggtgtggcgtgcagtggtgtgaactcaaagagaaaagacaagtttggcagagttcttgatccagacgagccttttaggttgtttctacgggatcgagagacgacagagttcttgacagcgaaagaggagaaacagatgttcagtcaaatacaggcacggcttctttttctatcatcatttaattgcccttgtagtaggttaattaaattgattactggctgaatcagaagtatatacatatattttgcanagaatcttatgaagctggagggggctcagcgtaacctgcaagctcagtgtggtcgtgaaccaacagttgaagagtgggctcaagccgtaggaatgagctgcagggagctgcaatcctgtgtgcgcaccggaagacggtgccgagagaagatggcccgctccaacttccgccttgtgatacatgttgctaggaaatatgaaggatgtggccttgacattcaggacctggttcaggtttagattgcttgcttgcttgcttgcttgctgtttattacattacattacattactataggagtcgtagatatcttgattttcttgttctgaatgccaccaggatggatgctgtgggttgatgaaaacctttgagaagttcaacccgagcaagggatgcagattcccgacctacgcgtactggtggatacgccagtcgatcaaaaagtccatcttcaagaattcaagactaatccggttgccggtattaattgactgtttgttatgatcaattatatataaggcctctatttcatatttcccccgcgcctcctaaaaagtcaggaacggccctggttgcaggagagtgtgtatgcacttttgaggaaggtgggcaaagcgaggatggaatgcataatggacggggagcagccgacgaacgaggtggtggcaaggcgtgctggcatcacgattgaaaagctggcgaaactgagagcgaaaaccaggaaagtacggtccatgcaggatcgagtctggtcagacgacggtgtgacataccaggtacgtacggccatagtctagttgcttgatcatggatgatgatcttggatgcatgcattcatcattcactgcactgatggtggatgatgatctaatcttgcaggagatcaccgaggaccccaacattgaaggtcctgaggtgagcgtggacaggctgatgatgcggcagcaggtgcgcagcttcctggcggggatcctgagcccccgggagaaggagatcatcgagcaccggttcggcatccacgacggccagcccaagaccctgcatgtcatcggcgacatgtacggcctgtccaaggagaggatccgccaggtgcagaacaaggccctggacaagctcagaaacagcatctcagcacagggcttccacgtctactttgatttgctaacttaagactcttcaacacgcaaacattacatgtacaatgacattccattctgccaatgggtatattatgtatagatagaccaagaattcatgtttttttcctttcccttttgccatttgacattcattcatccttgtactcaacaatggatactcatacatggttgtttgaggagcaaagcttactttaaatgtatggatgtacgtttaagtgcacatatgtttatgaaacctctctttgtttcagtgtttctgcacagcacctaatggcaacattgaagaaactcgcaagcaccatcatcttcacaatgtatcagagcagcacagagacttttggactctttgatcgcatttgtttgcttttcacaattggtgaatgagttagttgtttttatttacatggtgccaattcctagctctgctcctgtacattttaacagagcattgatggaattatggcgtcttattgtgtggctacaattgcttgatgcaattatgtcatccaccaataaaaaaacaatttaccgcggagtgagagcgacgtgggcctgtaatgctggtccgtttcctcagtgggctgggctcgcccagtaggcagcgcaggtcagtcaagagaaagctgaagtactggcgtgctgcttgatttttagacccttgattaacagtaataatctctaaaaaggattaaaggctagtttggaaacttaatttttcttcgagatctttgggatcgaagcgaaaattaagataatttttcactcatattttgagaattacgaaggaaatttaagctcgtaacaggagaaagaggaggaggaaagtgggaatagaatagaggagaggagagggagaggactggactggtactcgcagtcgcactagtgctaggcgcatccggcatccccatcccttgcctccgaatcggatcgccgcccccgctgccgctgccgctgccgccgagcggaagcagccatcaccccaaaccctagccagccatccaactatggagccgcccgccgccgccgccgccgactcctcgcccgatccgacgccgcaggaccagtttcctgccccgtccccttctccctccgcctccccggccaagcgctccgcctggaagcacccctcccccaacggccccgccgtcatggatgccaaccactggcccgcgctctccgacgccgccaagggcatcaagctcccagactcctcgtcttcctcgcctgcg

SEQ ID NO: 81 - DNA, 2053 bp, Zea mays
ctcgaggccggccgggagcccagcttgcctgccacctggtcttgaccctctcctggataggaggagcagcagccagagggacatcaaactgtgctgcctgcgtgtgtgtcttctttcttgcctctcccttcttcaacctttgctagcttgccagggagggagtccatgaattccagcagaagcctcctctcttcgcccctctttgctagctcgtctccaaacttcaggagcagtgcttccgtctcctcctccccatccccatcccgcaccacagcagttccaatgatacatgacaccagcagcagcagagcatccacggcgtgccactactcgccgtcgcttgtggcagaggagcagcttcacggctccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcatgtacggagcttctgaatttattagcagtgaagaggatgatgatgattctatttcggagagctcttcagcatcattggccaaaccagctggaactttggatcttggcaagctgacagaggaaccacagttggatgtaccacagcctcaccgccgcagtgtggatccaaaccattcgtatgatcaagtgtttattagatccactcggttactggagaggagatccaagaaacgcaacggcggccacagggctttggataatggtgtggcgtgcagtggtgtgaactcaaagagaaaagacaagtttggcagagttcttgatccagacgagccttttaggttgtttctacgggatcgagagacgacagagttcttgacagcgaaagaggagaaacagatgttcagtcaaatacaggatcttatgaagctggaggaggctcagcgtaacctgcaagctcagtgtggtcgtgaaccaacagttgaagagtgggctcaagccgtaggaatgagctgcagggagctgcaatcctgtgtgcgcaccggaagacggtgccgagagaagatggcccgctccaacttccgccttgtgatacatgttgctaggaaatatgaaggatgtggccttgacattcaggacctggttcaggatggatgctgtgggttgatgaaaacctttgagaagttcaacccgagcaagggatgcagattcccgacctacgcgtactggtggatacgccagtcgatcaaaaagtccatcttcaagaattcaagactaatccggttgccggagagtgtgtatgcacttttgaggaaggtgggcaaagcgaggatggaatgcataatggacggggagcagccgacgaacgaggtggtggcaaggcgtgctggcatcacgattgaaaagctggcgaaactgagagcgaaaaccaggaaagtacggtccatgcaggatcgagtctggtcagacgacggtgtgacataccaggagatcaccgaggaccccaacattgaaggtcctgaggtgagcgtggacaggctgatgatgcggcagcaggtgcgcagcttcctggcggggatcctgagcccccgggagaaggagatcatcgagcaccggttcggcatccacgacggccagcccaagaccctgcatgtcatcggcgacatgtacggcctgtccaaggagaggatccgccaggtgcagaacaaggccctggacaagctcagaaacagcatctcagcacagggcttccacgtctactttgatttgctaacttaagactcttcaacacgcaaacattacatgtacaatgacattccattctgccaatgggtatattatgtatagatagacgaagaattcatgtttttttcctttcccttttgccatttgacattcattcatccttgtactcaacaatggatactcatacatggttgtttgaggagcaaagcttactttaaatgtatggatgtacgtttaagtgcacatatgtttatgacaaagcgccctc

SEQ ID NO: 82 - DNA, 2589 bp, Zea mays
cattgggaccctcgggccccgccggcatagaaggcacgcggcgaacccgccaggcgttcctcctcgccccgcgtcgagttgccagcacggcccctccctctcgttctcctcgactcctccccgtcgcggcagccagccagcaggcatcgtgatcgtctgccctggttcccgccctcgctccatcccccggcacccccgcacgggacgcgcgtgtggacgttcttcgcctccgcgacaggcttgcgccccggctcggctcgggtctgcctccactgcggccttcctggatctcggccgccgctcctccatattataacaggtcacagaactatcagacaaggatggcgacttacgagcccaagaacattctcatcaccggtgctgctggttttattgcatcgcatgtcaccaactgtctggtgaggaactacccgcactacaagattgttgtcctcgacaagctcgattactgctccagcctaaagaacctcaacccctcacgggcttcaccaaatttgaagtttgtcaagggtgacattgcaagtgctgatctggtgaaccaccttctggtcacagagtcgattgacaccatcatgcactttgctgctcagactcatgtagataattcatttggcaattcatttgagttcacaaaaaacaatatatatggtacccacgtccttcttgaggcttgcaaggtcactggccagatcaggaggtttattcatgtcagtactgatgaggtctatggagaaactgatgaagatgctgtggttggtaatcatgaggcctcacagctgcttccaacaaatccgtattcagctacaaaagctggggctgaaatgcttgtgatggcatatggaagatcttatgggcttcctgtgataaccactcggggcaacaacgtgtatgggccaaatcagttccctgagaaacttattcccaaattcattcttttggccatgagaggtctgcctcttccaattcatggagatggttccaatgtcaggagctacctatattgtgaggatgtggctgaagcttttgaggttgttcttcacaaaggggaggttggacatgtgtataatattggtactgtgaaggagaggagggtgattgatgtggccaaagacatttgcaggctctttggcttggatactgaaaaagtaatcaggtttgttgagaacaggcccttcaatgaccagaggtacttcttggatgatcagaagcttaagagactgggatgggcagagcgcacaccatgggaagagggcttgaagaagacaatcgagtggtacaccaccaatcctgattactggggagatgtcactggtgctttgctccctcacccaaggatgttgatgattcctggagttgaaaggcataactggactgaggatatcaaatctctgacttcttcaccagctgaagctagcacaacagctcctgcaaccagtgccaaaaggaccactgctgccccgccgcggccgtggtacaagttcttaatctatggcaggactggatggattggtggcctccttgggaagatttgtggcaagcaagggataccatatgaatatgggaaaggacgcttggaggagcgctctcagctgttggaggacattagaaatgtgaagccaactcaagtttttaatgctgccggagtcactgggagaccaaatgttgattggtgtgagacccataaacaggacaccatccgcaccaatgttgtaggcatattgaatcttgctgatgtctgtcgcgagcagggtctgctaatgattaattatgctacaggttgtatatttgagtatgatgccaagcaccccgaagggtctggtattggctttaaagaggaagacacacccaactttacgggttccttttattccaaaacaaaagcaatggtggaagagctgttgaaggagtatgataatgtctgtactcttagggtcaggatgcctatatcatcagatctaaacaatcctcgtaacttcatcacaaagatagctcgttacgacaaggtggtgaacattcccaacagcatgacaattttggatgagcttctgcccatctccattgagatggcaaaacgggactgcaggggcatatggaacttcaccaaccctggcgttgtcagccacaatgagattctggagatgtacaagaaatacatcaatcctgattttaagtggaccaacttcacactcgaagagcaatccaaggtcatagtcgcacctagaagcaacaatgagatggatgcgtcgaaattgaaggccgagttctctcaactgatgtccatcaaggattctttgatcaaatatgtctttgagcctaacaggaaggttccagctaattgaggatttaggatcccccgggcatcgaggtattagttactattaaacattaaattagctataatgtttgtcaatttttttatgcatcgtattttaacagaacgcgtagatgtccttatgttctatatagtggatgatgtgttgagatgtggttatggacgacccaataggtcgccctgttgggcaaattaaaaaaaaaaaaaaaaaaaaaaaaaaaaaaagaaaaaaaaaa

SEQ ID NO: 83 - DNA, 2755 bp, Zea mays
gcacgagacattgggtacctcgaggccggccggggggcactctcctccccgctctcgacttcccatcccctgcggccccgccccccgactcttctcgtcgcggcgcgcccaatcggctcggtggcaggcttgcgcaccggctcggctcgggtccggttctaccgccaacgcgggccgccgcgctcccggatctcggtctagtcagagagttagcagacaaagatggcgacttatgagcccaagaacattctcataactggtgctgctggtttcattgcatcgcatgtcgccaaccgtctggtcaggaactatccccaatacaagatcgttgtccttgacaagattgactactgctccaacctaaagaacctcaatccttcacggtcttcaccaaatttcaaatttgtcaagggtgatattgcaagtgctgacctggtgaattaccttctgatcaccgagtcaattgacaccatcatgcactttgctgctcagacgcatgttgataattcttttggcaattcatttgagttcacaaaaaacaatatatatggcacccatgttcttcttgaggcttgcaaggttactggtcagatcaggaggtttattcatgtcagtaccgacgaggtgtatggtgaaactgatgaagatgctgtggttggtaaccatgaggcctcacagctgcttccaacaaatccatattcagctacaaaggctggggctgaaatgcttgtgatggcatacggaaggtcttatggtcttcctgtgattaccactcgtggcaacaatgtgtatgggccaaatcaatttcctgagaaactcattcccaaattcattcttttggccatgcaaggtctgcctcttccaattcatggagatggctccaacgtcaggagctacctgtactgtgaggatgtggccgaagcttttgaggtggtccttcacaaaggagaagttggacatgtgtataatattggtactgtgaaggagaggagggtgattgatgtggccaaggacatatgcaagctctttggcttggatactgagaaagtcatcaggtttgttgagaacaggcccttcaatgaccagaggtacttcttagatgatcagaagctaaagagattgggatgggcagagcgcacaccatgggaagagggcttgaagaagacgatggagtggtacaccaccaatcctgattactggggagatgtcactggtgcgctgcttcctcatccaaggatgttgatgactcctggagttgaaaggcataactgggctgaagaaatcaagtctctggcttcttcgccagctgaagctagtacaatagctccagcaaccagtaccaaaagcatctctgatgcccctcagaagccttcctacaggtttttaatctatggtaggactggatggattggtggcctccttggaaagatttgtgaaaagcaagggataccatatgagtatgggaaaggacgcttggaggagcgctctcagctgttggaggacattagaaatgtgaagccaactcatgttttcaatgctgccggagtcactgggagaccaaatgttgactggtgcgagacccataaacaggacactatccgcaccaatgttgtaggcactttgaatcttgctgatgtctgtcgcaagcagggtctgctcatgattaattatgctacaggctgtatatttgagtatgatgctaagcaccctgaagggtctggtattggctttaaagaggaagacacgcccaactttattggttccttttattccaaaactaaagcaatggtggaagagctattgaaggagtatgataatgtctgtactcttagggtcaggatgcctatatcatcagatctaagcaaccctcgtaacttcatcacaaagatagctcgttacgacaaggtggtgaacattcccaacagcatgacaatcttggatgagcttctgcctatctccattgagatggcgaaacgggactgcaggggcatatggaacttcaccaaccctggcgctgtaagccacaacgagattctagagatgtacaagaaatacatcaatcctgatttcaagtggaccaatttcacactcgaagaacaggccaaggtgatagtcgcgcctagaagcaacaacgagatggacacgtcgaaactgaaggctgagttccctcagctgctgtccatcaaggattctttgatcaagtacgtctttgagcccaacaggaaggttcctgttaattgaggatttacgttgcgtggatgcggaggttatttgtgttggttattggactctaaattagctaatgttgcaccgtggtgcgtactagttgtgttcgattcttttgggacaatagcaagcatacctctttctggtcgtctattatacacgcaatctacaaacaggtagatatttagatgttcttttagtggctgatacgaaggcttggcctggtgaagtggtgagagctttcttgctgagccactaggtcatgctttcgaagcagtctctccgtgtttatggtatagtggctgatatgctgagacacggttatcgatgaacactacgaattgtcttaatatattatatatattaactaccaagagcagttgtacatggtcttgtaaatttttatcccttcgttgcaaaaaaatacaggcctcctgttctgggtttttctatgccattttcctgttcttgttgtttctatgccaaacgtagcatcaaattttcagttggttttgtgttgctcgtcaat

SEQ ID NO: 84 - DNA, 3035 bp, Zea mays
  misc_feature (35)..(35): n is a, c, g, or t
aggtatatagtaaaatcagtgtttctaacagtcantcatttattcagaacttctgttggtaacactatatgcttacttgtagtatatatataataaatgattcttactggtaatgttaattgtgtagcatacaaagcttttaggcaagagcatggtacccacgtatctggaattatatggattttgtatagtgttccagattagatccgatcatccgagtactacattttactacagtattacttaattgtgtccatgtttaaaataattcccctgtgatggcaaccagatctcttttttgttttgttttctctaatgtcattcctcaacttgtccttgtgagagtactcatgatctcattgtgtttgctagcatattataacaggtcacagaactatcagacaaggatggcgacttacgagcccaagaacattccctccgccgctccggctggcgttattgcatcgcatgtcaccaactgtctggtgaggaactacccgcactacaagattgttgtcctcgacaagctcgattactgctccagcctaaagaacctcaacccctcacgggcttcaccaaatttgaagtttgtcaagggtgacattgcaagtgctgatctggtgaaccaccttctggtcacagagtcgattgacaccatcatgcactttgctgctcagactcatgtagataattcatttggcaattcatttgagttcacaaaaaacaatatatatggtacccacgtccttcttgaggcttgcaaggtcactggccagatcaggaggtttattcatgtcagtactgatgaggtctatggagaaactgatgaagatgctgtggttggtaatcatgaggcctcacagctgcttccaacaaatccgtattcagctacaaaagctggggctgaaatgcttgtgatggcatatggaagatcttatggtcttcctgtgataaccactcggggcaacaacgtgtatgggccaaatcagttccctgagaaacttattcccaaattcattcttttggccatgagaggtctgcctcttccaattcatggagatggttccaatgtcaggagctacctatattgtgaggatgtggctgaagcttttgaggttgttcttcacaaaggggaggttggacatgtgtataatattggtactgtgaaggagaggagggtgattgatgtggccaaagacatttgcaggctctttggcttggatactgaaaaagtaatcaggtttgttgagaacaggcccttcaatgaccagaggtacttcttggatgatcagaagcttaagagactgggatgggcagagcgcacaccatgggaagagggcttgaagaagacaatcgagtggtacaccaccaatcctgattactggggagatgtcactggtgctttgctccctcacccaaggatgttgatgattcctggagttgaaaggcataactggactgaggatatcaaatctctgacttcttcaccagctgaagctagcacaacagctcctgcaaccagtgccaaaaggaccactgctgcccctcaaaagcctttgtacaagttcttaatctatggcaggactggatggattggtggcctccttgggaagatttgtgacaagcaagggataccatatgaatatgggaaaggacgcttggaggagcgctctcagctgttggaggacattagaaatgtgaagccaactcaagtttttaatgctgccggagtcactgggagaccaaatgttgattggtgtgagacccataaacaggacaccatccgcaccaatgttgtaggcatattgaatcttgctgatgtctgtcgcgagcagggtctgctaatgattaattatgctacaggttgtatatttgagtatgatgccaagcaccccgaagggtctggtattggctttaaagaggaagacacacccaactttacgggttccttttattccaaaacaaaagcaatggtaagttcgggatgatgttctttttttgtcaagcatttttcttttacttcattatgcctgaagctaatttctgtgctgttcatcatggtgcaggtggaagagctgttgaaggagtatgataatgtctgtactcttagggtcaggatgcctatatcatcagatctaaacaatcctcgtaacttcatcacaaagatagctcgttacgacaaggtggtgaacattcccaacagcatgacaattttggatgagcttctgcccatctccattgagatggcaaaacgggactgcaggggcatatggaacttcaccaaccctggcgttgtcagccacaatgagattctggagatgtacaagaaatacatcaatcctgattttaagtggaccaacttcacactcgaagagcaatccaaggtcatagtcgcacctagaagcaacaatgagatggatgcgtcgaaattgaaggccgagttctctcaactgatgtccatcaaggattctttgatcaaatatgtctttgagcctaacaggaaggttccagctaattgaggatttaggataagaagggcatcgaggtattagttactattaaacattaaattagctataatgtttgtcaatttttttatgcatcgtattttaacagaacacgtagatgtcctttgttctatatagtggatgatgtgttgagatgtggttatggacaacacaataagtcgttctgttgtgcattttaattatttgttgcaatgtgctttcttttctttctctttttcttctgaaatttgtttatggtgtttgtatgccaaaatcaaataatctccgtttagatatgttctgtgttaccaatgaatcccccggattttatgcagcaggttgctggattgttgttggggatattgttcatccagatcccactgaagatagccagcgcccagcgtagccacatgttcaatcatcatccccgtcgttgatatggttctcagttgctgaattgtttgcttaaggcatgtttgtttgagtcctaccatttggaattttgtctcaaaatctgggttttgactt

SEQ ID NO: 85 - DNA, 1004 bp, Zea mays
  misc_feature (932)..(932): n is a, c, g, or t
  misc_feature (946)..(946): n is a, c, g, or t
gggacctcgagccggcgggatatgattcaaggctaaccttaagagcacaattcattacgccttgacgggttgcatctagacggcgccacacgactgacggcttcatccgattggtgtggcctatttatctcccagtcccccactcgagctctcaccagctttccccttctctccggtccgggaatcggaagctcagggcagaagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagccaccttcgaaggtctgtgggtgctgaccagtatctcagtgcctcaactgatgacatagtccctttggacaactacctggacacccagtactttggacagatcagcatcggcacgccaccacagaacttcacagtgatattcgacactggaagctccaacttgtgggttccctcatccaagtgctacttttcgatagcgtgctacttacaccataaatacaagtcaaccaagtcgaagacttacacaaagaatggagaatcttgtacgataacatatggttctgggcaaatcgctggcttcttcagtgaggacaatgtgttggttggcaaccttgttgtgcaaaatcagaaatttattgagacaactcgagaaaccagccctactttcatcattgggaagtttgatggaattcttggtctcggatttcctgaaatttctgtaggaggagcccctccaatttggcagagcatgaaacagcagaaactggtcgcaaaggatgtcttctctttctggcttaatcgtgaccctgatgcatctgctggaggagcgagcttgtccctttgntggtggtgacccanaacactacaaagggaccatacatatgttcccgttaccgcaaaggctactggagttttg

SEQ ID NO: 86 - DNA, 1730 bp, Zea mays
gcacgagaccattacctagaacatcctaatcgaaaaataggaaattttggtccccatattgcagctttcccaaccaaccatgaactcacccgcaccacgccgttaacgggtccagaacctcgcttccaatctgccctcccgtgtccccctccctgtccgattccccacagcagcgcctcgccctcgtcctcctcctccagtccggatcgccatttcccaccgatccgtcccggcatcggcatggctgcgcccacgccaaaggcgccggcgcccagtgcttcggcagcctagcgtttgtttgcctccgaggatttccgcctatcgcgttaccggatcttcggtgggccggcgaccctctacgccactatgagctccgacgggcgcctccgccgcgcgctggccgcgttcggcggcgacgtgtgggacctcgtggacgcggcgctcgccgccgccgcgcgggacagccccggcgacctgcgcgcgcgccgcgacggcatcgtccagcgcctctacgcaggggcagcccgctgccgcaactgcgacgccgacgcaaccccggcgcctgctcagccgaggaaggccaatgacgccgtcgctgctgctgctgctgcttctcctgcggcggcggcggcgtcggcgtttccggcctcgcctgaacaggaggtcgacgcggacggcctcgacgacgtcgacgacgcggccgacgctggcatggagagcaagattctggcgatcagggatttcctggaggacccggaccagtctgaggacgacatagtgagcctacttcagaacctagcagacatggatatcacctacaaggctctccaggacacggatatcggccgccatgtgaatggcctgcgtaagcacccatccagcgaggtccggcaactggtgaagctgctcgttaggaaatggaaggaaatagtggatgattgggtgaggctgcacaactcaggtggtgatggtagtggctccatcataagcgacggtgactcacctgacaaagtccaatccaagtaccatcaaaatactcatgcttcagacttcaaatatccccccagcccacagaggcataatgttttcagctcagagagatctagcaaccacaatttggtggaatcaacaacggagaagcgtagatcgagccctgctcctgcatacaataataccaagcagaacaacagcaacaactattccagtatttcatcgtcagcaccagctagagcaatacgggagcaaaagaacactcttttggattctgagaagctagactcagctaggaagaggcttcaggaaaactaccaggaagcgcaaaacgcgaaaaagcagaggacgatacaagtgatggatatccacgacataccgaagccgaagaacaggaacaccttcgtgcgcaagagcggcagcagcggccggattcccggcaaagcaccggtgatctctgcctgaccaccatcggatctgtagcggactcagcgtatttatttctgtactagcaaaaagaaaaaaaaaaaagaaattttaagaagcaaactcttgttttcccagtttgatttgtagccctgcagtccagctcactgatattatagggatatatatactgcctagtccatgaggctacgcttttgtacctctctttaagattggagaacagaaggaaagcaaattgtgttattattcaatgacatccacatttcccgcctgctacggctttcgctggccac

SEQ ID NO: 87 - DNA, 2752 bp, Zea mays
gacggatggcttcatccgattggtgtggtctatttgtctcccagtcccactccgtccactcgagctctccaccagctttccccttctctccggtccgggaatcggaagctcagggcagaaggtaagctaccagaccatgtcgtagcccctagtttctactgcttgattattacttttcgcttttcttgggagtacaattttatttactcgccgttttggggctgttcatgtttctgttagtgtgtttggtgccttgattttttcagataattggtgcctttcttgataagttgatatacaaccgtggatccttggaacttcgatttagttagtgactccgtaggtatcagataaccaaaaaaagaggaatcacgtgaactaccggttatatttcccctggatttcgacaaagctttttaggaaatttcgtactttttttcatggagaaatttcgaagacaccaatgaagttctcgcataaaataataaaaaaaccctaagcatgctcgattttcatttttttttttgccatgaacaactgctagtcaagcacaaaacaaggatttcctaattctccacactcgacaaccattattttcacagcttcaagaactctcaacttcccctcaccccaacccaaaagaagtgaatacaaccataaccttcacagcttcaagaacttttcaacttcaaggaaatttctaaacagtaattcttttttaagctggtgaggtgtcccggccctcctgtttcctgaaaaaaaagcacgactgaactagatgttattaggtccgcacatgaattgcatacgaaatgttttcctgactggggctaaatcgctagttaagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagccaccttcgaaggtctgtgggtgctgaccagtatctcagtgcctcaactgatgacatagtccctttggacaactacctggacacccagtactttggacagatcagcatcggcacgccaccacagaacttcacagtgatattcgacactggaagctccaacttgtgggttccctcatccaagtgctacttttcgatagcgtgctacttacaccacagatacaagtcaaccaagtcgaagacttacacaaagaatggagaatcttgtacgataacatatggttctgggcaaatcgctggcttcttcagtgaggacaatgtgttggttggcaaccttgttgtgcaaaatcagaaatttattgagacaactcgagaaaccagccctactttcatcattgggaagtttgatggaattcttggtctcggatttcctgaaatttctgtaggaggagcccctccaatttggcagagcatgaaacagcagaaactggtcgcaaaggatgtcttctctttctggcttaatcgtgaccctgatgcatcttctggaggcgagcttgtctttggtggtgttgacccaaaacactacaaaggggaccatacatatgttcccgttacacgcaaaggctactggcagtttgacatgggagatcttattattggtggccactcaactggtttctgtgctggtggctgtgctgctattgtggactcagggacttcattgcttgctggtccaactaccatagtggctcaagtcaatcatgcaattggggctgagggaatcatcagtacagaatgcaaagaagtggtgagcgagtatggagagatgatccttgagttgctcatatcgcagacaagcccacagaaagtgtgcactcagattggtctctgtgtatttgatggtgcccattctgtcagcaatccaattgaatctgttgttgagaaacagaagcgtggttctgatcttttctgtactgcttgtgagatggctgttgtctggatacagaatcagctccgtgaaaacaagacaaaagaactcattttgaattatgctaatcagctctgtgagcgtctccctagccccaatggcgagtcaactgttgattgccatcagatctcaaagatgccaaatcttgcattcaccatagcaaacaagactttcaccttaacaccagagcagtacatagtgaagctggagcaagcaggacaaactatctgcatcagtgggtttatggcatttgacgtaccgcctcctcgtggtcctctctggatacttggtgatgtttttatgggtgcctaccacactgtttttgacttcggcgagaacaggattggatttgccaaatctgcatgaggactggagttctgcgctttagtagcatgtccagtttgttatcccggtattgtacatatatatgttgccaactggtgtaatccgcagtgtttaatagtatatattcatgcagaaatctagaagattgtggcatgatatgtgtttgcaaatggagctatgctatgtatggagctccaggacctagagttttatgtaaagggagacgatgaggattagggcttttaacctattctcatcacgttattgtcctgattactaaaaaaaagtataggttgctgagcttgtttgggagcaagacaattggaggggatgagtggactaaaattcccttcctatcaaaattgaatatgaagagtattttagctctctcaatcttcttcaattctcttgc

SEQ ID NO: 88 - DNA, 3958 bp, Zea mays
  misc_feature (781)..(781): n is a, c, g, or t
  misc_feature (964)..(964): n is a, c, g, or t
  misc_feature (1012)..(1013): n is a, c, g, or t
  misc_feature (3815)..(3815): n is a, c, g, or t
agattttttttgtcttgtgcaggttctacaattaatgaatgatttgaacgaagtgttcaagatgccgctatctcttgtattgaggttagttaattccatatttgatattgtctgtgtatgcctacttcagccgacattgtgttttttctagacccatggtgactggtatgatctctatttctattggacttgttcaatttcccaatagttacatcccatatttacaagctggagagattgaaacattttttataacatcttatctattaaaactccatgtcgtttgctccaccaggggcttccagtgcgctttttcccctcgatctcgtgtgatctgagtgtgagaaggttgttaaaatgtgcatctactcatatttttatttttaccagatatgtgtctaaattttctttcttgtgttttaatacaggcttatagtgtgcttgaggttcttcgacctctctataattcccctaagatactggaacaaaaggtaactgttgcgatatatgtcaatcttcaatttcgttgtcgcttagcagttgttgggctttggtacccagtctgtaattttgctgatgcaccagcgacacatatttatcattttttatttttaaatcaataacaaagcacaggtacaatataatcttatatagcttttaaggtatgtaaacatccactttagtgatgctaacaaatgtataaaataataataattattttttcatagcaatatattttatcatattgcatcttagttcatgctacctggatgtaaatgtngtgcggtttagtttaataagatcttcactaatcactacatagtgcagcactgggctgttaatattttttgtaccatgtgtcataagcatgagatgttgcctgtagagtaccgatgctttattgcagtcttcctcctcgtctgccccaatgtcggcaagtcagccctcttcaacaggtgagagncaccttaggaaggcatcggtcattgcctctcgcctgtagtttctatgnngctatgaggggtggtggcatttcctcaaatacgttgcatgtatcactgtaactgttcttccccttccgttaccattaacccatgcatctaattacttgtatattttacgttaccgttttcctgttctcaacatttcagattctagatgatggtacgacaaattattttaggagtgctttgacataatttaaagcttggaagggagctttctatgatttattttcctgactgtttcgtcacatgttctttccctagatgaaagtattgatttatttttggttctgcaggatcattgcgtctctgcgagctaatcaggttgggatactttgttatgtttggacagttctatgattgggaactgtgcagaatgtgacagcatttcttattttaatgtgcattgcagttctgtgagcgtctccctagccccaatggcgagtcaattgttgattgccatcagatctcaaagatgccaaatcttgcattcaccatagcaaacaagattttcaccttaacaccagagcaggtaactccctacttacagtttcttcagtgtttgaattagtagtgaaacattgtctagggaaccctgatctcattttcaaagttacagttcatttattggatattcttttggtgcaaacatatacttcttctatttctcttgaatccactgattgcctttgtgctgcagtacatagtgaagctggagcaagcaggacaaactatctgcatcagtgggtttatggcatttgacgtaccgcctcctcgtggtcctctctggtacgctgaacatatatgtacataagtggcagtaatccacactctacagtctttgctttctctagcaagaatcaagcatgcaatctgacatctatcttgtaaacattcaggatacttggtgatgtttttatgggtgcctaccacactgtttttgacttcggcgagaacaggattgggtttgccaaatctgcatgaggactggagttctgcgctttagtagcatgtccagtttgttatcccggtattgtacatatatatgttgccaactggtgtaatccgcagtgtttaatagtatatattcatgcagaaatctagaagattgtggcatgatatgtgtttgcaaatggagctatgctatgtatggagctccaggacctagagttttatgtaaagggagacgatgaggattagggcttttaacctattctcatcacgttattgtcctgattactatgtgtaggtatagttgctgagcttgtttgggagcaagacaattggaggggatgagtggactaaaattcccttcctatcaaaattgaatatgaagagtattttagctctctcaatcttctccaattctcttgctcccaaacatgtccttatagtttgggggtgtgcctctttttgtgttgtagtttggttttgatgttcgatataacataatcttgagtcgtgcaggttaaggtttctagctaatttgtacactaagtagatgccaaaccttctaattttgtataacttctatgaatccttgaaaaaaacattgttgctttgtaactgggtattaatcactacctctttttttgcatttgtttacttgatctcttctctgggatatcagtaatgccttctttgatttcattatatcagtaactgagtaatgccttcttcgatttcattatatcagtaacgctttatcataccatcgtagacaatgatgaagatggttacctcaacagcgtactgtctgtgacccgggctttaggggattgggacatgaaactaccacaaggctcgccatcgcctctatcactgaaccaaagatccgctgaccaccctgatggaagatgatgagttcctcatcattgtctatgatgggatatgggacgtgatgaccaaaaacatgatgtgagcacaatccgcaagggctctggaggcgtgataatttatgttccatcgcaacgcatagcaatgcatatgcactctacgattatatataaagtttgtatggtactgatggtttaatataatggtgaaatagctagattaaaataacaaaattcacgtatggctagaattataaatagattatgaaacattttctcaaaacaatatgacacacatttgtatataagttatcgtggtattatatgttcccgttgcaacgcacgggcactcacctagttttataatataaaacctagagtccattaccaccctatcggcattaggaggaaggggtgcaaccagcctcgcctgtcagcgtcatgcttaattgactggagcagaatattttttttttgtttgcattagccgcttcctagaaatttcacgtgagttagctggttagagttggcctctgatcttggtgcctgcagtgacatttcgtcgctgacactaatacgtacttttatgttatattattagtaattatctctcgatattaggggtggacactttttcatcgtataatgaaaatggaattgaactgtatcgaactgaaattttggtttttttcggtattttggtttagtttcgttcttttatctaaaaagtacggcgttcggtatcgtaatcagttttcaccgtatactcaaccggaatacccaaaaactaaataccaaactttatcaattctaaaatctgactatttgattgtgtaaactaaatgtgtgatacacttaaattgttattcacttagttgtatgatgtatgatgtaattctaaatctccgcatatatatttttatccttgtaaagaaatatatgtataatatatcatgtaagatctggtgtatgtgtngactcgagtataagttttggtgttcgatttttaccgaaaaatgaagtagaaagtcgagacctaacttctcggatttttattttctagaaaacgaaaagttctgaaatacgtgaagtaggtgatccgtattttttcttttacta

SEQ ID NO: 89 - DNA, 1577 bp, Zea mays
gcacgacgtaatggaaggaaatattggatgattgggtgaggctgcacaactcaggtggtgatggtagtggctccatcatatgcgatggtgactcacctgacaaagtccaatccaagtaccatcaaaatactcatggagtcaaattcagaacctgaggagtgctactcagatcacctaaccaactcagttaaatccttttttatgaaagatttgaaaggtgtgtagctcaatttcccttaatgttgtcattctacataaaagcaccgccctcccgtggttgctgattccctgtaccaggcacttggtattcctcccacgttctttgcgatagggacttggtattcctccgagcacggcttcaacgacggcaactgcgaccaggcacgcaggccgcaccgggtggtggtcgaatcgagggaggccatgcccctgtccttcgacaactccaccaccgaggattcagcggctgccgtgaagcctaagcccaaggtcagggtcaggaagaaccccatgaagcagtcatgcttcgacttcaccaaggtggacgtcgtgcttctccccatcgtcttcctcctcgtccgccccaatgttggcaagtcagccctcttcaacctcgagccgattcggctcgagggcatcggtcattgcctctcgcctgtagtttctatgccgctatgaggggtggtggcatttcctcaaatacgttgcatgtatcactgtaactgttcttccccttccgttaccattaacccatgcatctaattacttgtatattttacgttaccgttttcctgttctcaacatttcagattctagatgatggtacgacaaattattttaggagcgctttgacataatttaaagcttggaagggagctttctatgatttatttttctgactgtttcgtcacatgttctttccctagatgaaagtattgatttatttttggttctgcaggatcattgcgtctctgcgagctaatcagctctgtgagcgtctccctagccccaatggcgagtcaactgttgattgccatcagatctcaaagatgccaaatcttgcattcaccatagcaaataagactttcaccttaacaccagagcagtacatagtgaagctggagcaagcaggacaaactatctgcatcagtgggtttatggcatttgacgtaccgcctcctcgtggtcctctctggatacttggtgatgtttttatgagtgtctaccacactgtttttgacttcggcgagaacatgattgggtttgccaaatctgcatgaggactggagttctgcgctttagtagcatgtccagtttgttatcccggtattgtacatatatatgttgccaactggtgtaatccgcagtgtttaatagtatatattcatgcagaaatctagaagattgtggcatgatatgtgtttgcaaatggagctatgttatgtatggagctccaggacctagagttttatgtaaagggagacgatgaggattagggcttttaacctattctcatcacgttattgtcctgattactaaaaaaaaaaacaaaaaaacgagccggggggccccctacc

SEQ ID NO: 90 - DNA, 2487 bp, Zea mays
ataattggtgcctttcttgataagttgatatacaaccgtggatccttggaacttcgatttagttagtgactccgtaggtatcagataaccaaaaaaagaggaatcacgtgaactaccggttatatttcccctggatttcgacaaagctttttaggaaatttcgtactttttttcatggagaaatttcgaagacaccaatgaagttctcgcataaaataataaaaaaaccctaagcatgctcgattttcatttttttttttgccatgaacaactgctagtcaagcacaaaacaaggatttcctaattctccacactcgacaaccattattttcacagcttcaagaactctcaacttcccctcaccccaacccaaaagaagtgaatacaaccataaccttcacagcttcaagaacttttcaacttcaaggaaatttctaaacagtaattcttttttaagctggtgaggtgtcccggccctcctgtttcctgaaaaaaaagcacgactgaactagatgttattaggtccgcacatgaattgcatacgaaatgttttcctgactggggctaaattgctagtttagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagcaaccttcgaaggtctgtgggtgctgaccagtatctcagtgcctcaactgatgacatagtccctttggacaactacctggacacccagtactttggacagatcagcatcggcacgccaccacagaacttcacagtgatattcgacactggaagctccaacttgtgggttccctcatccaagtgctacttttcgatagcatgctacttacaccacagatacaagtcaaccaagtcgaagacttacacaaagaatggagaatcttgtacgataacatatggttctgggcaaatcgctggcttcttcagtgaggacaatgtgttggttggcaaccttgttgtgcaaaatcagaaatttattgagacaactcgagaaaccagccctactttcatcattgggaagtttgatggaattcttggtctcggatttcctgaaatttctgtaggaggagcccctccaatttggcagagcatgaaacagcagaaactggtcgcaaaggatgtcttctctttctggcttaatcgtgaccctgatgcatcttctggaggaggcgagcttgtctttggtggtgttgacccaaaacactacaaaggggaccatacatatgttcccgttacacgcaaaggctactggcagtttgacatgggagatcttattattggtggccactcaactggtttctgtgctggtggctgtgctgctattgtggactcagggacttcattgcttgctggtccaactaccatagtggctcaagtcaatcatgcaattggggctgagggaatcatcagtacagaatgcaaagaagtggtgagcgagtatggagagatgatccttgagttgctcatatcgcagacaagcccacagaaagtgtgcactcagattggtctctgtgtatttgatggtgcccattctgtcagcaatccaattgaatctgttgttgagaaacagaagcgtggttctgatcttttctgtactgcttgtgagatggctgttgtctggatacagaatcagctccgtgaaaacaagacaaaagaactcattttgaattatgctaatcagctctgtgagcgtctccctagccccaatggcgagtcaactgttgattgccatcagatctcaaagatgccaaatcttgcattcaccatagcaaacaagactttcaccttaacaccagagcagtacatagtgaagctggagcaagcaggacaaactatctgcatcagtgggtttatggcatttgacgtaccgcctcctcgtggtcctctctggatacttggtgatgtttttatgggtgcctaccacactgtttttgacttcggtgagaacaggattgggtttgccaaatctgcatgaggactggagttctgcgctttagtagcatgtccagtttgttatccgggtattgtacatatatatgttgccaactggtgtaatccgcagtgtttaatagtatatattcatgcagaaatctagaagattgtggcatgatatgtgtttgcaaatggagctatgctatgtatggagctccaggacctagagttttatgtaaagggagacgatgaggattagggcttttaacctattctcatcacgttattgtcctgaaaaaaaaaaaaaagtagcggccctgagcttgtttgggagcaagacgattggaggggatgagtggactaaaatttccttcctatcaaaattgaatatgaaaagtattttagctcaaaaaaaaaaaaaaaaaagcggcc

SEQ ID NO: 91 - DNA, 1939 bp, Zea mays
ttgggtacccccgacgcgggcgggggcccacgactgacggcttcatccgattggttggcctatttatctcccagtcccactccgtccactcgagctctccaccagctttccccttctctccggtccgggaatcggaagctcagggcagaagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagccaccttcgaaggtctgtgggtgctgaccagtatctcagtgcctcaactgatgacatagtccctttggacaactacctggacacccagtactttggacagatcagcatcggcacgccaccacagaacttcacagtgatattcgacactggaagctccaacttgtgggttccctcatccaagtgctacttttcgatagcgtgctacttacaccataaatacaagtcaaccaagtcgaagacttacacaaagaatggagaatcttgtacgataacatatggttctgggcaaatcgctggcttcttcagtgaggacaatgtgttggttggcaaccttgttgtgcaaaatcagaaatttattgagacaactcgagaaaccagccctactttcatcattgggaagtttgatggaattcttggtctcggatttcctgaaatttctgtaggaggagcccctccaatttggcagagcatgaaacagcagaaactggtcgcaaaggatgtcttctctttctggcttaatcgtgaccctgatgcatctgctggaggcgagcttgtctttggtggtgttgacccaaaacactacaaaggggaccatacatatgttcccgttacacgcaaaggctactggcagtttgacatgggagatcttattattggtggccactcaactggtttctgtgctggtggctgtgctgctattgtggactcagggacttcattgcttgctggtccaactaccatagtggctcaagtcaatcatgcaattggggctgagggaatcatcagtacagaatgcaaagaagtggtgagcgagtatggagagatgatccttgagttgctcatatcgcagacaagcccacagaaagtgtgcactcagattggtctctgtgtatttgatggtgcccattctgtcagcaatccaattgaatctgttgttgagaaacagaagcgtggttctgatcttttctgtactgcttgtgagatggctgttgtctggatacagaatcagctccgtgaaaacaagacaaaagaactcattttgaattatgctaatcagctctgtgagcgtctccctagccccaatggcgagtcaactgttgattgccatcagatctcaaagatgccaaatcttgcattcaccatagcaaacaagactttcaccttaacaccagagcagtacatagtgaagctggagcaagcaggacaaactatctgcatcagtgggtttatggcatttgacgtaccgcctcctcgtggtcctctctggatacttggtgatgtttttatgggtgcctaccacactgtttttgacttcggtgagaacaggattgggtttgccaaatctgcatgaggactggagttctgcgctttagtagcatgtccagtttgttatccgggtattgtacatatatatgttgccaactggtgtaatccgcagtgtttaatagtatatattcatgcagaaatctagaagattgtggcatgatatgtgtttgcaaatggagctatgctatgtatggagctccaggacctagagttttatgtaaagggagacgatgaggattagggcttttaacctattctcatcacgttattgtcaaaaaaaaaaaaaaaaaaaaaaaaaa

SEQ ID NO: 92 - DNA, 782 bp, Zea mays
gaagtggtgggcgagtatggagagatgatccttgagttgtctcatatcgcagacaagccccacagaaagtgtgcactcagattggtctctgtgtatttgatggtgcccattctgtcagcaatccaattgaatctgttgttgagaaacagaagcgtggttctgatcttttctgtactgcttgtgagatggctgttgtctggatacagaatcagctccgtgaaaacaagacaaaagaactcattttgaattatgctaatcagctctgtgagcgtctccctagccccaatggcgagtcaactgttgattgccatcagatctcaaagatgccaaatcttgcattcaccatagcaaacaagactttcaccttaacaccagagcagtacatagtgaagctggagcaagcaggacaaactatctgcatcagtgggtttatggcatttgacgtaccgcctcctcgtggtcctctctggatacttggtgatgtttttatgggtgcctaccacactgtttttgacttcggcgagaacaggattggatttgccaaatctgcatgaggactggagttctgcgctttagtagcatgtccagtttgttatcccgaaatctagaagattgtggcatgatatgtgtttgcaaatggagctatgctatgtatggagctccaggacctagagttttatgtaaagggagacgatgaggattagggcttttaacctattctcatcacgttattgtcctgattactatgtgtaaaaaaaaaaaaactcgagggggggcccggt

SEQ ID NO: 93 - DNA, 1971 bp, Zea mays
atctagacggcgccacacgactgacggcttcatccgattggtgtggcctatttatctcccagtcccccactcgagctctccaccagctttccccttctctccggtccgggaatcggaagctcagggcagaagaatcaacctgaacaagaagagactggacaaggaagctttgactgctgcgaaattggcgaagaaggagagccaccttcgaaggtctgtgggtgctgaccagtatctcagtgcctcaactgatgacatagtccctttggacaactacctggacacccagtactttggacagatcagcatcggcacgccaccacagaacttcacagtgatattcgacactggaagctccaacttgtgggttccctcatccaagtgctacttttcgatagcgtgctacttacaccacagatacaagtcaaccaagtcgaagacttacacaaagaatggagaatcttgtacgataacatatggttctgggcaaatcgctggcttcttcagtgaggacaatgtgttggttggtaaccttgttgtgcaaaatcagaaatttattgagacaactcgagaaaccagccctactttcatcattgggaagtttgatggaattcttggtctcggatttcctgaaatttctgtaggaggagcccctccaatttggcagagcatgaaacagcagaaactggtcgcaaaggatgtcttctctttctggcttaatcgtgaccctgatgcatctgctggaggcgagcttgtctttggtggtgttgacccaaaacactacaaaggggaccatacatatgttcctgttacacgcaaaggctactggcagtttgacatgggagatcttattattggtggccactcaactggtttctgtgctggtggctgtgctgctattgtggactcagggacttcattgcttgctggtccaactaccatagtggctcaagtcaatcatgcaattggggctgagggaatcatcagtacagaatgcaaagaagtggtgagcgagtatggagagatgatccttgagttgctcatatcgcagacaagcccacagaaagtgtgcactcagattggtctctgtgtatttgatggtgcccattctgtcagcaatccaattgaatctgttgttgagaaacagaagcgtggttctgatcttttctgtactgcttgtgagatggctgttgtctggatacagaatcagctccgtgaaaacaagacaaaagaactcattttgaattatgctaatcagctctgtgagcgtctccctagccccaatggcgagtcaactgttgattgccatcagatctcaaagatgccaaatcttgcattcaccatagcaaacaagactttcaccttaacaccagagcagtacatagtgaagctggagcaagcaggacaaactatctgcatcagtgggtttatggcatttgacgtaccgcctcctcgtggtcctctctggatacttggtgatgtttttatgggtgcctaccacactgtttttgacttcggcgagaacaggattggatttgccaaatctgcatgaggactggagttctgcgctttagtagcatgtccagtttgttatcccggtattgtacatatatatgttgccaactggtgtaatctgcagtgtttaatagtatatattcatgcagaaatctagaagattgtggcatgatatgtgtttgcaaatggagctatgctatgtatggagctccaggacctagagttttatgtaaagggagacgatgaggattagggcttttaacctattctcatcacgttattgtcctgattactatgtgtaggtatagttgctgagcttgtttgggagcaagacgattggaggggatgagtggactaaaattcccttcctatcaaaattgaatatgaaaagtattttagctctctcaaaaaaaaaaaaaagcggccctcgagctccacttggaatccttaggaggg

SEQ ID NO: 94 - DNA, 978 bp, Zea mays
gactagttctagatcgccgcaactgcccgtctgctcctgcttttcatccagtcgcaaaacaaagagaagagatctccgcgtccgcaaccgcatcgcttccctcccggcagaagaagaagattcggttgggttgtttgtctcttgcaaaccgcaatggctgctgctgccactgctactccggccgtggcgccggaggccggcgaccggaaggcggtggcaccgccggtcgacgcggtggatctggagctggagctggaggagaagcacgtgctggcggtggacgacagctccgtggaccgcgcggtgatcgccaagatcctacgcagctccaaatacagagtgacgaccgtggactcggcgacgcgcgcgctggagctgctggcgctggggctggtccccgacgtgaacatgatcatcacggactactggatgcccgggatgaccgggtacgagctgctgaagcacgtgaaggagtcgtcggcgctgcgggccatcccggtggtgatcatgtcgtcggagaacgtgcccacccgcatcagccggtgcctggaggagggcgccgaggacttcctcctcaagcccgtccgccccgccgacgtctcccgcctctgcagccggatccggtgaccgcccgcgcaaggatggaggatctggttgcgcgctctgacttaattagaggagttgttaggatccaattttttgtgtgttcgttcgttcgttcgttcttttctttctttcttcttggacatagatctgctgccgccgctgctgccgtcgactgaaacaagaagctaacttagttttagggtccaggttgttgttgttgttgttaggaaggcgagtcgttgggggcattcacggatgttcttcctcgtttcccctccctccgtgcctgaggctgcaaaaatatgccccccagacatgaaaaaaaaacaagacctgttaacagttccaagatcagagccttcgcttcttttc

SEQ ID NO: 95 - DNA, 2167 bp, Zea mays
cgccaccacgtggtgctgtaccgaacacattcgatatgctatgttcaatgcacaacacacttggactatgtttggatgatttgtgcatcatatgtgggcctgtctaatcttcgatgcatatgtatggtatctagtgtattctgaaaaatgcactcagagcacctcctcagcttcctagggacttgtagagacatgtgttcttatgcgtgagggctggtccatgggggatttataagtgccctagtgtgagggacccctatggtctgtgaagaggtccgagtagatagtaactgtgagatggatagtggatcgatgacatgggagtagaggagcgagggatggatacacgagacgagacagaaccaagggggaaagaagaaactaaaacaaaatccggtgaacctatttatttacgagcattgaccacgtcgctcagctccgtgttgtggccgcgtgtgggtacagcgagactgttggacgcgactgtaccgtctgacgcaaccgatcctggcgatctccaaaatcaaaatcggcttgtcatttcattcctcattcgtccagtcgagcgaggatacgatgctgccagcggatgcggatctccgccaattcactgccaagccccactgtgtcgtggacaccggcgggtggagatctcgctacggagcgaggtcgatcggtggcagtggcagtgccggctggcctggctatcgccgaccgcctgcagcacggaagggatacgacagggtgtcgggagagattccagcgcgcgacctgcgtaagtaaatggaaggttcgcatcgcatgggtggcgcgggtaaagcaaatgccatgcgtggtccaccgcgtccctgtcgtgaaggggcaagtgacctggctttggcaacaacacagccgctgtgcgtgccccggacgacgagacgagatccatggagatcaacgagggcgggtagggcaatctggtgtcccgatcgctacaaatcctactagtgcttttttgaatagaaagtagaaagaagaagaagaagcagaaatgttttggaaaatccgagggagatttttgcgaaacggcgcaccacctagaaagggccgctcgtcgtcagcatgcaaaagcgaagcggcaccaacacacacacagacacagtcagagagaggatccgtggcccatgcacgcagatctcggcagaatcccgagacgccaacacctgacaggcgtggacagcgagaggcgaggcagatctcgtccgcgcggatcccctctcagatctcgcaggattttcctcgctatccggccctgccgtgccgtgccgagtcttccccccttctggccttcttcttctttccacacctgcgtatatatacacgccccccgccccgcccggccggggctgcagcctgactgtctgttttcagcacccgcaccacctgactgtctgttcgcagcacccggacctgtgtcaatggccgctgcagccgccgctccagcatctgtggcgccgtcctcgcccaaggccgccggcgacaacaggaagacggtggtgtccgtggacgcgtcggagctggagaagcacgtcctagcggtggacgacagctctgtggaccgtgccgtgatcgccaggatcctgcgtggctccaggtacaaggtgaccgccgtggagtcagcgacgcgcgcgctggagctgctcgcgctaggcctgctccccgacgtcagcatgatcatcaccgactactggatgcccgggatgactgggtacgagctgctcaaacgcgtcaaggagtcggcggcgctcagaggcatccccgtcgtcatcatgtcatcggagaacgtgtccacccgtatcacccgctgcctggaggagggcgccgagggcttcctcctcaagcccgtccgccccgccgacgtctcccgcctctgcagccggatccggtgactgcgtgtggtgctatgttaggagctaggatcctcaaccaaaaaaaaaaagattcctcttctttctttctttctctcctgcttggacatagatcttcaaacaaggagctaacatttggggggagactttttagctttagggatctcaacaagttgttcggaacgggggggatggagcacagcgttggctggtcttttctccattcctcttaataacatcaggtgtcaatgccatgcacg

SEQ ID NO: 96 - DNA, 1063 bp, Zea mays
cgaggccggccgggccgggacctgagtatatatatatacacgcccgcccgcgccgccgccccgccgccgcaactgcccgtctgctcctgcttttcatccagtcgcaaaacaaagagaagagatctccgcgtccgcaaccgcatcgcttccctcccggcacaagaagaagattcggttgggttgtttgtctcttgcaaactgcaatggctgctgctgccactgctattgctactccgtccgtggcgccggaggccggcgaccggaaggcggtggcaccgccagtcgacgcggtggatctggagctggagctggagctggaggagaagcacgtgctggcggtggacgacagctccgtggaccgcgcggtgatcgccaagatcctgcgcagctccaagtacagagtgacgaccgtggattcggcgacgcgcgcgctggagctgctggcgctggggctggtccccgacgtgaacatgatcatcacggactactggatgcccgggatgaccgggtacgagctgctgaagcacgtgaaggagtcgtcggcgctgcgggcgatcccggtggtgatcatgtcgtcggagaacgtgcccacccgcatcagccggtgcctggaggagggcgccgaggacttcctcctcaagcccgtccgccccgccgacgtctcccgcctctgcagccgcatccggtgaccgcacgcgcaaggatggaggatctggttgcgcgctctgacttaattagaggagttgttaggatccaattttttgtgtgttcgttcgttcgttcttttctttctgtcttcttggacatagatctgccgccgccgccgctgccgtcgactgaaacaagaagctaacttagttttaggatccaggttgttgttgttgttaggaaggggagtcgttgggggcattcacggatgttcttcttcgtttcccctccctccgtgcctgaggctgcaaaaatatgccccccagacatgaagaaaacaagacctgttaacaattccaagatcagagccttattgcttcttttctttaaaaaaaaaaaaaaaaaaaaagcggcc

SEQ ID NO: 97 - DNA, 4829 bp, Zea mays
  misc_feature (3948)..(3948): n is a, c, g, or t
ttcaggaattgcaatataatttttttgtagtgcatctttgctgctccgaaatctagaaaactgtagagctactccatgctaaagctgtagagccgagccatcttcaattctgataaaaaagcccaagactagctagctctctagcacaagacaagacaaaaaaaaaacacgccttctttcctttcgagctagtaaacttttttcccacaagaaatggtcattactgaacccccttttgtgattcattatattggaatacccaatactagaagggaaaaaaatttaaaggtggtcacattccacatccaaagataaagtgaatattaattgtcatgtatgatcctttatcaatttgcctcgatctccatagcgaaacaactcactttttttggtaagtgaaacttgtttgttgttattaattttcaacataaaaaaaactcacttttttttatattctttgcttgcttcgaattatatcaattgtacgtggtcgatactcgatagtatgatgcatgctatccggctaactaacatgcatgcatgggatggggatgggagagcaagttggggttggacgctttccttgctgctcaaggagcagctagctagcagcttgctatagaaagtaggcattgcttttaatgcaatcgcacatcatcgatctaatattaatcttggccgtggcgttgaccttcttgcatgatatggttggtccggcgatggatggacatgcatgcatgcaacagctagtacgtacgacgtactacgtgcaggttgcttacaaacaagagatctgaatggaagagcatgcatttgctgatccgggactcaagggccaatccatccatccccagccggccgcgatgtgtaaatgtcaactgaagatgcaggctagggacatgcatgcattatatatataagctacctccagctttggctgcgatcaagacaccaattaagccagagcagtctacaatggctcacagtcacagaagcagtatgagcttctgcttggtgtgcatcgtcgtcatggcggcggcggcggcgttgttgcaacccgcatcttctcagcaggcggtgccggacatcccgaacctgaaggtgggctccaacgatcgcagcacgactctcaagtgcaccaacatcaagagcaacaagaccacctgcagcgccacctgcaacgcacgctgcccgcccgagtgcctcatccagtgcccaagctgcaagacattctgctgtacgtacggatcggagtatttcatttcgtccatcttaacaattaatttggttcctttccatcttaataatttgatatatatgcacatgcagtgtgcgacttctatcccggcgtgtcctgcggcgacccacgcttcacgggcgccgacggcaacaacttctacttccacggcaagaaggaccgggacttctgcatcgtctccgacgccgccctccacatcaaacgcgcactttcatcggccaagcgcaacccggccatgagccgcgacttcacctggatccaggcgctgggcatccgcttcgcgcaccaccacctctacgtcgccgcccagaggacgcccaggtgggacgccgccgccgaccacctggcgctggccctcgacgacgaggacgtcgacgtcgcgtccctgctgccgcgcttcgtcggcgcgcgctggtccccgcccacggcgccggcgctgtccgtcacccgcaccgcgcgcgtcaacaccgtcgtcgtcgagctcaggggcgccttccgcatcgtcgccagcgtagtgcccatcaccgccgaggactcgcggatccacaactacggcgtcagggaggacgacggcgacaccctcgcgcacctcgacctcggcttcaagttctacgacctcaccgacgacgtgcacggcgtgctgggccagacctaccgcccggactacgtcaacagcctcaacgtcacatccaacatgcccgtcatgggaggcgcgccggactacctctcctccgacctcttctccaccgactgcgccgtcgcacgcttcggcggacgccgacaccagcaagccaccgccgctaatattgccatgctcaccgacgacgacgacatggaatgaataacaaaggacacgtcgtacgcgcgatcgacgactttaccgtaccatttcattaccatctccgaggatatcgatccatcgttgtgtgtcttctacactagctagtgaatgaagaagcagcaataaacccattgaaattatatattatatattcaacaaataaggcttataaatacatatgcatgcatgtatactcctaattaattaattaaatactcctgattttattttacaatgcatggatgtttaagtaatcgatcgagcttcacttgatagttcgtggaattaagaaactgagcacaagataaaatgtaatcgagtgcttaacaattttgggactctcatcatcacaactcacaagcaaaacaaaaatggaaacaaacaattttagtttcttggtgggccttggcagtgtggagttgggcctgtggctcgtctaactcgatccggaggcccatctcacgaagtcacaacaagagaaaacagttttttttagcttccggaaacagtccatctctcgtccttgacagagtaaccaaaccaagcaccacgcgcggccatggccttccccgccgacgcgctggttctagagatcaccgacacatcatcctccgccaccgccgccgccgcccgtgctccatcctcaccttctcccccgccgctgtccatctccgacctcgcgcgcttcgacccgctcccatccccaaccgttgccgttcgcgtcgaccggcacaggcaagcgaccactctcccatctcaacctaccccctagctgattcctgcgctctggtaatcgaatcctacctcgtgggcaggctaatcgagagctcctcctacttccgcgcgctcctcggcggcagcttcaggtcagcgaaaacctaagcctcgagttactactacaagttagtggcgactgggcaggtatctcatcggcgctgtgtgtggatgcagtgaatccggcagagagcatgtgcgtgtgggctgcaatttggaggctgctgtgcaagtgctgcgctacctttttgagccttccgagagctttaacatcacgcacaacaatttcctccccctgttggaggtacccacagtcctgaaagtctaaagttgtgcttctcttggttgataacacaagacaacacccttctagattatctttttttattatgtttcataaattctatgccatgggaataggaattccattagtactgtgtaccatcgttagcagttactagtaaacctgtgcctgatagaaagctgctggaggaagatggtcatttatgccatagccatactcattgctaaatttgaggctagtgctactgccttcggttcatgtcaggtgctaccctaagtctccaacttcacttatcatccagggagctttgtttcttgctgttgagagccttctagtggagtgtcaaagatggttcggcaccatagcctctcaaacttctgccatgtcagttccattagatttcataattgaagtctggtactttgctgaagagcatggtgagttcttttgctatagtgttctgacatttccaggtaatattttccattttgaacaaaatctaatcaactctttaaggttttttttctggctttggatatgtttgcaggtgttacttttgttcaagacatttgccaaaaatttctagctcagaattttgtaggtacaattactgcattacgtgcatattctttgagaaatatatttcctggacgatggttaggttcctttctgatatgctcatgtattatgcaacatgctttctgtaccactgccgttctgtggaccatgcaggcacatgctatctcaggaaggtcatttaataaaatcccnttatgatttgctatgttcagcgatcaaatgtccacatctgacagtggataggttcgttgtatcttctctcagtgttattctataatatgattcccttctctgaagctaaaataatttgctgccttttgtccagtgaaaaacaattgtgtgaagcaattttgtattgggtttcagaaaatatgaaagcctgtgaacaatcaaaccccaactcagtagatggccacctcttcattcttagcaaggtacggcattcctcaaaatgtgtgggtagtatttaggtgtcaagtctattttgccatctttactatctgctgtactatattagttcatcaagcctctggatgtcttgacttatgcatatcttttcatttgaactgtttcagcaggggaccgtggcccgtttaccattaggatttgcggcaggtacagctccttgatctataaatttaaagttataacagacatttcccttgtttgttccttcttttacactacatatcttccacaatttcttgtcatgtattagtaatacagtggaagattctatttttattagggacaatgaggcattggtttgactttggaaacaagatcatatgcactattcttgatcttctcaaagacagtttgaaaactttattggatgctgttgatgatggtaacttggatcgatattgcattcgaataacagaatattcaaaggttattcactcgtgttttactaatattgccatgatacatttaagcagtctagaatgaattattgacctttatgttatgttttgttttcttgttgctttgcaaaatattatactgctacctttagtcagcgaaacctaatgcaactacttcatgtactttaatctgagatcaaatgcggg

SEQ ID NO: 98 - DNA, 821 bp, Zea mays
ccccatttcgaagccaccgaattcctcgcgattcctctcccctcgcctcctcgtcctccccctcctaggggatcgccggagaggaatcgcgacgagggcttcctcctatcagttaaatcaaagccatggagcacaaggagaccggctgccagtctcgggagggtcccatcctttgcgtcaataactgcggattctttggcagtgcggcgaccatgaacatgtgctccaagtgccacaaggagatggcgatgaagcaggagcaggccaagctggctgcctcctctttcgacagcatcgtcaacggtggcgatgccgcgaaagaacaccttgctgctggcagcacggcggtggcagttgctcacgttgaggcgaagacgcttattaccgcacagcctgctgatatcgccggtcccagcgaggcggcgatggagaaccccaaaggcccaagccggtgcagcacctgcagaaagagggttgggctgaccggattcaactgccggtgcgggaacttgtactgcgcgacgcaccgttactcggacaagcacgagtgcaagtttgactaccgcgccgcggccatggacgccatcgccaaggccaacccggtggtgaaggcggagaagctcgacagatctaaggaaaggggcctccctacggtcggcagaacataaggtcccaaatcaaatctgcgctacctcgtcatcgtgcgtctttgctgcattatcctttcatcatgttggcttctgcaaatcctagttgttgggcaatcgtgatgcatggcacacgcgccacggcggcagccccaggtcggaccggtctccttg

SEQ ID NO: 99 - DNA, 879 bp, Zea mays
aaaaaaaaacgggggccccccatttcgaagccaccgaattcctcgcgattcctctcccctcgcctcctcgtcctccccctcctaggggatcgccggagaggaatcgcgacgagggcttcctcctatcagttaaatcaaagccatggagcacaaggagaccggctgccagtctcgggagggtcccatcctttgcgtcaataactgcggattctttggcagtgcggcgaccatgaacatgtgctccaagtgccacaaggagatggcgatgaagcaggagcaggccaagctggctgcctcctctttcgacagcatcgtcaacggtggcgatgccgcgaaagaacaccttgctgctggcagcacggcggtggcagttgctcacgttgaggcgaagacgcttattaccgcacagcctgctgatatcgccggtcccagcgaggcggcgatggagaaccccaaaggcccaagccggtgcagcacctgcagaaagagggttgggctgaccggattcaactgccggtgcgggaacttgtactgcgcgacgcaccgttactcggacaagcacgagtgcaagtttgactaccgcgccgcggccatggacgccatcgccaaggccaacccggtggtgaaggcggagaagcttgacaagatctaggaagggtcccccctacagtcggcagaacataaggtcccaaatcaaatctgcgctacctcgtcatcgtgcgtctttgctgcattatcctttcatcatgttggcttctgcaattcttagttgttgggcaatcgtgatgcatggcacacgcgcctcggcggcagccccaggtccgaacggtctccttgttggctatgttgtgaagcttttattatggtcgtctctctgcg

SEQ ID NO: 100 - DNA, 3865 bp, Zea mays
aagtaggggcggagcgtgccatgctggccgtaatccaccggcagcggccacgaatcaaccagcttcacctgacaaacgaaggaatccccagatgaagaatcatgaatgcaaaggtctgctggaatgcttgtcacttcctccacgcggaccacaacccgaacagacgagtagtcgaggcccgaggtgcaacgccagtcgacttccacgactgagcaaaatacttggaacgcctggcggatgaactcctcgtgccagaaggtcagagggaacccatgaacagacaagaccgcaagcacatcaaccggctgtttgacactcctcccgtcgtggcgctcgaagaagatcgccacatcctcatgcaataggggggagcgactcacagcagcagtacaatcacctgccgactgaaagcgcaccagcaacgatccgaacgacgaggggagaacctcgaaggtgatgagcgggaaagcagcacggatcgcctcccgaataaatggtgccggggcagacactgccaattgcggagttatacgaacaaatgcgaatgcagcggccacgtcgtgccggccgagagagagaaaaacttcgagggatccctggcggaccgagctagtcagggaggcacactcgacagtttccgacaaggaactgatgggggtaacaccaacaggaggaggatgggcggaggtggtggaaggggcgtggcgcggtggtaaagcagggaatgcagggagaagaggcgaagtaggggagcgggagggagccggtggtggggcatggtgttgggaggttagaggagctgtagcagccatacgaggcggcgacagagagacctgcggcgtaggagggagaagcgtagggcagcggtggggcaagggggttagtttatggttaactggcatggggcactcacgacaacggtgaccctggcgtcgacaagagcgacagcggatgggatcccggcaagcagcaatttggtgatcagtggcgaagcagcggaagcaggcgaactgttttatttttgtgggggagcgacgagagggagaggtggatgagcgggcttcaacagcgccgagcaatagcacgtcccggacgagagggaataataaatttggattttatatttctaagtgcactctgaatttataagtttataacatttaggggctgtggtataactgaataagttcaaaaatctaaacaagtgttttttaagtttagaaaccggaatgatataatcagcaaccgaaataacatagataaataagtttgagatctaaaacgatggtatttagaggacgcgatgacacggctgaatcacggcccaggcacggcccgtgataagttcattgcgattctccgccacagagcaaaggcccacgaaactcagataatgtcgaagcgggttgaggttagagcgcacgagaatgttcaagagaagccgacaagcgtggagaaccccgccccgccgtcgcgaagctctctcccctcgcactcccgggaccaggctacggcatctgtccggaagcttcaacgtctttccccatccttccacggcactcgtgacatgacctataaaaggagccgtcgatccacggtctccaacaaccaggaaagcaaagcgcttcgcaagcacaggcagtgatcggtaaccaaatccggacagtcttgagctctctcagtctcagcatttcagttcccagattcacatagccccagcccccaagtagcgaaatggcagctgctccgttcgcgattgccggccggctctcccccgttgcgcgcctcccggtccgcgcctggaggcccgcgcacgggtttgcgtcgtccgggagagcccgctcgctcgccgtggcgtccgcggcgcaggagaacagggacaacagtgtcgacgtacaggttagccagaacggcggcaacaggcagcagggcaacgccgtgcagcgccgcccgcgccgcgcgacagcgctcgacatctccccatccccgttcgggttagtgtaagtcctcggttttttattttttatttacgaccggttctccttccaaaacagaggattgcagagaagaggaggctaacatcacgtggttaagcgtgcagggttagttgatccgatgtcgccgatgcgggccgtgccgctgatgctggacacgatggacaggctgttcgacgacgccgtggggttccccatggggacacggaggtccccggcgaccaccggcgacgtacgcctgccgtgggacatcgtggaggacgagaaggaggtgaagatgcggatcgacatgccgggcctcgcgcgcgacgaggtgaaggtgatggtggaggacgacacgctggtcatccgaggggagcacaagaaggaggagggcgcggagggcggcagcggtggcgacggcgacgggtggtggaagcagcgcagcgtgagctcctacgacatgcggctggcgctgccggatgagtgcgacaagagcaaggtgcgggccgagctcaagaacggcgtgctcctcgtcaccgtgcccaagaccgaggtggagcgcaaggtcatcgacgtgcaggtccagtagacaaactgagctgtcacgacgggtctttgtgtagcactagcgtgggttgggctcttcgcgccgaccgtatcagtactcgtgacccaacgtgtggaataatgtgaataaataaacgcttcaattctgctaaaaaaaaaaaaaacaaaaaaaaaaaaaaaagaaaaattattacgctcgtagaaacataagagtctagccaatttagatatagaaagtgactatttcaacgatttgtttgattttgtgtttacgttgattttagatagttttaactaaaacgattctcctaaccttgaaaagttagtatcatgattttgcatccttattcacgtaagaaatataaactaaacaattatgttgaggcctcaactaataataaaggcaaataatacgggcttgtttgttttgtcttaatctatatagatttggtgggtggatttaatttttaaacaagttaaaatcttttataatttttttaatcttatccaatttaaatgagaggaactgaataaggtctaatcatttttcagagcccaggaaatacacaaggtcatatacaaatataacatgcagtgcttggaaagcaagcagactagacaattcacctaaggctatctccagtttccctgtctcaccttatatttcattctttatttcaaaatttattttattaataatgttctatatttttgtgtcctctattttacactactacacgtggagacagtataagggataggtatgtttcgctgcaactagaagttgcagcacatcaaattttccactagaaagcaacgctcgactttgtattacaggctcctcccttgttgcatgtcattttattacgctagtgactgctgctattagtcattctatctttttgctccataaccgaagatcttgcagtggaattcctccatctgtagtttatattggttttctcagttaaatcaccaggattcattaatatcttagccaaccagtcagctactcagcttcaaagtaaagaagttcagtagctcagataaaaatatgaatgggggccccttaataatgcagacttgcagtacttttagcatcctgatatgagtatgcaagcagagagaaagaaaggtttagctatgtttgtgttgctgctgtaaatatctacaattgcaaggctggaacacaggcagctacaagcaatagagagagcacctggactgctgcattaatgctaatcccatcgtgcttactgctgaggcacagctagctcagtctttcctctagttcctcactggttctctaagaccgtgtccag

SEQ ID NO: 101 - DNA, 1071 bp, Zea mays
acgcccgccgacaaccaggaaagcaaagcgcttcgcaagcacaggcagtgatcggtaaccaaatccggacagtcttgagctctctcagtctcagcatttcagttcccagattcacatagccccagccccacaagtagcgaaatggcagctgctccgttcgcgattgccggccggctctcccccgttgcgcgcctcccggtccgcgcctggaggccggcgcacgggtttgcgtcgtccgggagagcccgctcgctcgccgtggcgtccgcggcgcaggagaacagggacaacagtgtcgacgtacaggttagccagaacggcggcaacaggcagcagggcaacgccgtgcagcgccgcccgcgccgcgcgacagcgctcgacatctccccatccccgttcgggttagttgatccgatgtcgccgatgcggacgatgcggcagatgctggacacgatggacaggctgttcgacgacgccgtggggttccccatggggacacggaggtccccggcgaccaccggcgacgtacgcctgccgtgggacatcgtggaggacgagaaggaggtgaagatgcggatcgacatgccgggcctcgcgcgcgacgaggtgaaggtgatggtggaggacgacacgctggtcatccgaggggagcacaagaaggaggagggcgcggagggcggcagcggtggcgacggcgacgggtggtggaagcagcgcagcgtgagctcctacgacatgcggctggcgctgccggatgagtgcgacaagagcaaggtgcgggccgagctcaagaacggcgtgctcctcgtcaccgtgcccaagaccgaggtggagcgcaaggtcatcgacgtgcaggtccagtagacaaactgagctgtcacgacgggtctttgtgtagcactagcgtgggttgggctcttcgcgccgaccgtatcagtactcgtgacccaacgtgtggaataatgtgaataaataaacgcttcaattctgctattccaagaatctagctcaatatagctatgggaaaaattattaaaaaaaaaaaaaaaaaagcttatcgataccgtcgac

SEQ ID NO: 102 - DNA, 1270 bp, Zea mays
ggcgggcgggccgccctaccattccccctgcccgccgccgcctcctctcggctccttcttccttcgagtttcagccatgggtaaggagaagactcacatcaacatcgtggtcattggccatgtcgactccggcaagtcgaccaccactggccatctgatctacaagcttggaggtattgacaagcgtgtgatcgagaggttcgagaaggaagccgctgagatgaacaagcggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggagtgaagcagatgatctgctgctgcaacaagatggatgccaccactcctaagtactcgaaggctcgttatgaggaaattgtcaaggaagtctcttcgtacctgaagaaggttggctacaaccctgacaaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggatgtttacaagattggtggcattggaactgtgcctgttggccgtgttgagactggtgtcatcaagcctgggtatggttgttacctttggtcccactggtctgacaactgaggtcaagtctgttgagatgcaccacgagtctctgctggaggcgcttcctggtgacaacgtcggcttcaacgtcaagaacgttgctgttaaggatctgaagcgtggctttgttgcatccaactccaaggatgaccctgccaaggaagcggccaacttcacctcccaggtcatcatcatgaaccaccctggtcagatcggcaacggctacgccccagtgttggactgccacacctcccacattgctgtcaagttcgccgagctggtgaccaagatcgacaggcgatctggtaaggagctggaggcgctgcccaagttcctgaagaacggtgacgctggtatcgtgaagatgattcccaccaagcccat

SEQ ID NO: 103 - DNA, 1067 bp, Zea mays
gggccgctctcagtccccccatccccgccgccgcctcctctcggttccttctccttcctcggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctgtggaagttcgagaccaccaagtactactgcaccgtcattgatgctcctggtcaccgtgacttcatcaagaacatgattactggtacctcccaggctgactgtgctgtgctcatcattgactccaccactggtggttttgaggctggtatctccaaggatggccagacccgtgagcatgccctccttgctttcactcttggagtgaagcagatgatctgctgctgtaacaagatggacgccaccactcccaagtactcaaaggcccgttacgaggaaattgtcaaggaagtctcttcgtacctgaagaaggtcggctacaaccctgacaaggttccctttgttcccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggacgtttacaagattggtggcattggaactgtgcctgttggccgtgttgagactggtgtcatcaggcctgggtatggttgttacctttggccccactggtctgacaactgaggttagcctgttgaaatgcaccctgagtctctcctggaagcgcttcctggtgacaacgttggcttcaacgtcaagaacgtttcttgtgaaggatctgaaacgggggtttgtttgatccaactcccaggatgacccctgcccagggagggggccaatttcccctcccc

SEQ ID NO: 104 - DNA, 814 bp, Zea mays
aaaaaaataaaaaaaacaaacgcgtactagtacaccagccgcagcaaacccggtggaggcagaggcagctaatgggctccatggccgcggaaatgactgccgtcgaggaggaggcgtgcatctacgccatgcagctgtcttccacggctgtcctgccgctcacgctcaagaacgccatcgagctgggcatgctcgaggtcttgatgggcgccggcggcaagatgctgtcaccgtctgaggtggccgcgcggctgccgccgacgacgaccaacccggacgcgccggccatggtcgaccgcatgctgcacctgctggcatcctacaaggtggtgtcgtgcgaggtggaggaaggcacgcacgcccggcggtacggccccacgcccgtgtgcaagtggttcacgcccaaccaggacggcatctccatggccccgctgctcctcctcaccaacgacaaggtccctatggagagcttgtatcatttgaaggatgcggtgcttgatggtggcctcccattccacaaggcacatgggatgacaatgtacgagtacaccaaaaccgacgcgcgcctgaaccacgtcttcaacgaggccatgaagagctacaccaccatcgtcaccggcaagctcgtcgagctctacacgggcttccacgacgtggccacactcgtgggacgtcggtggcggcgtcggcgccaccatccgcgccgtcacctccaagtacccgcacatcaaggggatcaacttcgacctgccccacgtcatcgcggaggcaccgcaatcccccggcgtggagcacgtcgccggcgacatgtttc

SEQ ID NO: 105 - DNA, 4019 bp, Zea mays
acggatacctagctagtgatattcatgaaccctgtggcctgacccagtgccagctcgttgacatgaaggcttaccgtccgatacgagcactccaaggcgatccaacggccgcgatctggaggaacggtctcctaacctccgatatttcctttctcccttatcgccttcgcctccgcggctccgcctcgctctccaaggttctgccgaggtttctcgcctccccgctcccccctctccgagtctccgtccttgccactcctcctcccctcttccacctcaatccaatccgaccctcaccattgtagccggaactcgcagcgggacactaggccgcgcatgccgctcctcctctaccccttctccgcgtgcgtgccgccgccgcgggcgctgctccgccgcctgtcgccgccgccgcccatggcggtcgtcgctccgctgccttccgccgtccgtataatcccctcggtgggaacgctcgaccttccggcgctcccgcccccgcccacggacgacttccactggctcgacctattcgcgttcctcaactcccctgccgacacctaccaccagatccccgcgcagggcgaagaggagctggaggcggggctggaactggaactggagctggagctggagaagcacgccgaggtggagaggcagcgggggcgggcgcgaagagcgcaactccggcggctgcggcagcggcaggtcaaggcggagacggaggcctgggcgcgggccgccgaggagtaccgcgagatcgagcgggagatgctcgaccgcaggctcgcgcccgcgctgccctacgtaaaggcgctcttcgtcggctggttcgagccgctgcgggacgccatcgccagggaccaggacgtgcagcgaaggaagcgggtcaagcacgtctacgctaagtacctgcttctgctcccagccgacaaggtggccgtaatcgtcatgcacaagatgatgggcctgctcatgtccagcaaggacggcactggcagtgtccgcgttgtccaggccgcgcactgcattggtgaggctgttgagcgcgagttcaaagtccagtcattctttcagaaaagtaggaagaagaaaatccaaggtgaaaatgatccagcattggagaaggagcaagctaaatgccgtaagcgtgttaagagtttagttaagaggcggaagatgagtgaagcacagaggctagttcaacaggagttggaattggaggaatggggcacagaagcccaagtgaagttaggaagtcgcctgattgaattattactagattcagcatttgtgcagccaccagctgatcagacaccagatagttctccagatattcgacctgcatttaagcatgtgctacgtcagcctataatagaaaatgggaggctaaagaagaagcattgggtgatagagtgtgaccaccttgtgcatgaggggtttgaaagcactgctcggcatgttgatataccctacctccctatgctggtacctccgaagaaatggaaaggttatgataaaggtggtcacctttttctgccctcatacattatgaggacacatggtgtgaaggaccaaaaggatgcaattaatagtgttcctagaaaacagctgcgaaaagtatttgaggcattagatatccttgggagtactaaatggagggtgaatagaagagttcatgatgttgttgagactatctggagtcaaggtggaggcattgcagggctggtggacaaggcaaatattcctttgcctgaacgaccagaatcagaggatcctgatgaaatgcagaaatggaagtggagtttaaagaaggcaaagaaaactaaccgtgaactgcatgctgagagatgtgacactgagctcaaactctcggttgctcgtaaaatgagagaggaggatggattttattaccctcacaatttagatttccgtgggcgtgcataccctatgcatcctcatttgagtcacctaggttcagatctttgtcggggtgttctagagtatgctgaagggcggccactaggaaagtcagggttgtgctggttgaagatacacttggctaacaaatatggtggtggcattgaaaagctttctcacgagggcaagctagcttttgtggagaaccaactgtttgatatatttgattcagcagcaaatcctgttgatgggaactgctggtggacgaatgctgaggatccctttcagtgtttagctgcatgcatggacctttctgatgccttaagaagtccatcaccttaccatgctgtctctcacctgcctattcatcaggatggttcatgcaatggtttacaacattatgccgctcttggaagggactatatgggcgcggttgctgtcaaccttgttcccggagagaaacctgcagatatttactcagaaatagcttctagggtactgaatgttgtatgtgaagactcgatgaaggatcctgctactaacccaactgcttcattagcaagagctttagttgatcaggtggataggaagcttgtcaagcagacagtcatgacatcagtctatggtgttacatacattggtgctcgtcagcagattacaaagagactgcaagagaaagggcttatcacagatgataaattgctgtatgatgtatcctgttacgctactcgggtaactttggatgcactgggacaaatgttccaatctgcccgtggtataatggcctggcttggtgactgtgcgaagatgattgcttcaaaaaatcaaccagtcaagtggacaagtcctgttggtctcccagttgttcagccctacaagaaatataagaattatatgatacgaacttctttgcaatgtctggctttacggcgggagggtgatgcaattgcaatccaaaggcaaaaggcagcttttccaccaaattttgtgcactcactggatagttcacatatgatgatgacagcgattgcttgcaaggagtctggccttcattttgcaggagttcatgactcattttgggtgcatgcgtgtgatgttgatcaaatgaaccagatattgagacaacaatttgtggagctttacagcatgccgattcttgaaaatctgctggaggagttccaaacgtcattccccacactagaatttccaccctgcccaccgcaaggtaactttgacgtgagggaagttctgacttcaacatacttcttcaactaagcttaacaggggcaagttctgcacatgaaacatggtgagaagttgtgtccttggatgtttggagtaaccagatcgtgaaatcattctatgcttgagccatatataggagttgatactgaactaattctcgcatggcttttagcataagcaagaaacaggagtcaatcaattatctgcactccagaccaagccaagtggttccaaggaatttgaaatgaacaaacctaaagtagttcctgctgagtttttaggttgatgcagaatctgcttggatgttcaggtcactcattggttgccatgacaactcatggtatactccaccctggagtgcaaaggtaaattatgagatgccagagcagaatactgactgacagttgatcgtgctgacctcattgatcatagacgacagcggaacacaaagttcgctgaatatacgtgtacgttgtaccatcaatttttttgctgtcttaggacttgtagatcgcataatgccgtggcatcaccctgtaataaatgtgtaagatatgatagccaaatagatgtatacgagactagttgctgttgacagcaagttttgaaaagagagacatgaatcaggcagacttcaccggttcactgatgttctgatctcttcctgaaataatcgtagtaccttcattttggtcttgctaattgttaaaataatcgttctggattatccatttaggatgacgttctagttgccatgtttattttttgcgaatagcatgccattttaaatacagttataatctatatagataaaaacaatgtacagaaaccggtacagattaaattcaaatcag

SEQ ID NO: 106 - DNA, 836 bp, Zea mays
gcccgccgggccgggtaaaatggtaatgttccggagaaagccagggtttcttcggaggctttatttatcgtttatccacggaacttccggtgccggcggcgaccacttgtggcgatccatccctcaccatgtcgtcggagaaggaggcggcgctcgccgccgtgctcgatgacagcccaaccatatttgacaagatcatcaaaaaggaaataccttctactgtggtttatgaggacgagaaggtactggctttcagggacataaaccctcaagctccaacacacattctcatcatccccaaagtcaaggatggactaactggcctggcaaaggctgaagagaggcacatagaaatacttggctatctcctctatgttgccaaggttgttgcgaagcaggaaggacttgaagatggctatcgcgtcgtcatcaatgacggcccaagtggatgtcaatctgtttaccacatccacgttcatctcctcggaggcaggcaaatgaactggcccccaggctaagaatatcttgtgattgatcagtgctaatgccaaggactgctactccatttctctagaataatccctgtaatttccataaaagctagtgcgcagtgcgctgaccttgtgctatatttgtggaattaccggaagcatgctgctgtgatctatgaatgaacacaagaaacttgtaactggtactcctatcatggattgacttgtccttattgatcagctgatgggggttgcccactggccttgctgatctgcacaaaaaaaaaaaaaaaaaagggcccctgcggccgtttttttgaaaaaaaaaaaaaaaaaaaggcccta

SEQ ID NO: 107 - DNA, 796 bp, Zea mays
gccggcctcgcgagggtttccttcggaggctttatttatcgtttatccacggaacggccggggccggcggcgaccacttgtggcgatccatccctcaccatgtcgtcggagaaggaggcggcgctcgccgccgtgctcgacgacagcccaactatatttgacaagatcatcaaaaaggaaataccttctactgtggtttatgaggacgagaaggtactggctttcagggacataaaccctcaagctccaacacacattctcatcatccccaaagtcaaggatggactaactggcctggccaaggctgaagagaggcacatagagatacttggctatctcctctatgttgccaaggttgttgcgaagcaggaaggacttgaagatggctatcgcgttgtcatcaatgacggcccaagtggatgtcaatctgtttaccacatccacgttcatctcctcggaggcaggcaaatgaactggcccccaggctaagaatatcttgtgattgatcagtgttaatggcaaggactgctactccatttctctagaataatccctgtaatttccataaaagctagtgcgctgaccttgtgctatatttgtggaattaccggaagcatgctgctgtgatctatgaatgaacacaagaaacttgtaactggtactcctatcatggattgacttgtccttattgatcagctgatgggggttgtccactggaccttgctgatcttcgcaaaaaaaaaaaaaaaaaagggcccgccggggggccgggtcccctagcttcgatacctgcaag

SEQ ID NO: 108 - DNA, 1552 bp, Zea mays
tcgtgcccggcctgcgcacatccatccagacatccacccaccagagccggtcgatccgttcgaaacgctccgggaaagattccacgacttgggacttctcacattcccacaccgcactgtgccactgccgccggcccgccgcactagccgttgcttctcccttcccgttcccaaggagttgtcctcgccggcggatccggggcgccgctgcaagaggaggaaggaggaggagaggataccagaatggcgtcgcgctcggcgtccaaggatatcatcacgctgcgaggctctgccgccatcgtcagcgagttcttcgggtacgcggcgaatagcatcctctacaaccgcgctgtgtacccggaggagagcttcagcaaggtgaagaagtacgggctcaccatgctgctcacgcaggacgagggcgtgaagaacttcatcgccagcctcacctcccagctctcagaatggctggaggccgggaagctgcagcggatcgtgctggtcataatgagcaaagccaccagcgaggtgctcgagcgctggaacttcaacatcgtcaccgacgccgaggtcgtcgagaagggggccatcaaggagaagagcgacaaggagatcatgagggagatccaggccatcatgcgccagatcgcgtcttgcatcacctacctcccctgcctcgacgagccatgcgtgttcgacgtgctggcctacacggacacggacgtcgacgctccgggcacctgggtcgagagtgacgccaagctcatcgacaacccgcagatggttaagctgcactccttcgacaccaagattcataaggtggacacgctggtgtcgtacaagaaggacgagtgggacgaggaggagtagagtttgcaccaaaagttaccctgctgctgctagagcttggcgtgaaggctgtgtgaatcgttcattcacgtctagcgtgtactgcactaatagtatactgctactttggggggaagaaaagtgtgagacgctcctaccatttagaatttcgagattgaaatgccggttttaatataacatgagtcacctttaagatctggctgcgaaaaaaaaaaaaaaaaaaaaaaaaaataaaaaaaaaaaaaaaaggggggttatccgatacccgtccatttttttttcccccccccccgggggggggaagaaggggagataattctcactccccccttttttccgttttttgaaactggccccccacactaaaaaaacaacaaaccccctggtcctgtagagaaaagcctcggggcgtcgtaacccccgcttataagtttacccttcccgatacgtcgttgacgctcctttttgtggaaccgctccgcgcgctattctaaccgctgataatgtcccgctcacccgatagtgacccaattactcccgaaaagtacgggttgccctctccacactatcccccctcccgcgccattcataacacgcccttttcaccatactcgtggaggtcatatcctaccgcaaagaaaagtcgtctccagcttacctgctccccccctactccctccaa

SEQ ID NO: 109 - DNA, 2141 bp, Zea mays
cgcgcccacatccgtccagccgtccacccactcaccaggaccggtcaacgctacgatacctgtgcactgcgcagcccccgccgctgcactagccgttgcttctcccttccgttcgcgttcccattcccaaggagttgtcctcgccggcggatccggggcgccgtcgcaagacgaggaaggcggaggagaggataccagaatggcgtcgcgaacggcgtccaaggatatcatcgctctgcgaggctccgccgccatcgtcagcgagttcttcggctacgcggcgaacagcatcctctacaaccgcgccgtgtacccgggggagagcttcgccaaggtgaagaagtacgggctcaccatgccgctcacgcaggacgagtgggttaacttcatcactagcgccacctccaagaactcagagtggctgggggcaggaaagctgcaggggatcgtgatggtcataatgagcaaggccaccagcgaggtgatcgagcgctagaacttcaacatcgacacctaccccgaggtcgtcgagaaggggtctatcaaggagaagagcgacaaaaagatcatgagggagattcgggccatcaagcgccagatcgactcttgcatcaccgacctcccctgcctcgacgagccatgcgtgtttgatatgctggcctacacggacacggacgttgacgctccggacacctggatcgaaagcgacaccaagctcatccacaacacgcagatggttaagctgcactcgttcgacacgaagttcctgtgctggagtggcaggtccacaaggtcgacacggtggtgtcgtacaagaagaatgaggacgacacctcttcgtcgtcaagctcagtaataagagaagcaagaatagagcttcttgaagctgaacttggaagatttgtgatgcttgctaatgagtcagctgaagagatgtatacaagattgaaaaaaatcatcaagaaaattagaagctatggaagtaagaaatggacagatcatgaagtggtgaaaataatgctaagggcttattttctaagaaactcggtattatgttttatgataagagatagtcctaattatgagaagatgacgccagaagtagtacttggtagatttatccgtcatgaaatgatggaaaatgaagggcttcttgaagctgaacttggaagatttgtgatgcttgctgatgagtcagctgaagagatgtacacaagattgaaaaaaatcatcaacaaacttagaagctatggaagtaagagatggacagatcatgaagtggtgaaaataatgctaagggcttattttctaagaaactcggtattatgttttttgataagacaaagtcctaactatgagaagatgacgccggaagtagtacttagcaaatttatcgatcatgaaacgttgttagaagaagccaaatatgttgatatcatgtccaaaagtgtcactgcatcaaagaatcaagacattgcactcaatgcaaacaagaagcaaaaggggaaatgtgtttttgaagaatcaacaagtgaagataatgaagatagttcaagtcttgatgaagaaaaaatagcactcatcaaaagcttcaaaaagataatgaagagccgcaactacaagagcaacaaaaagaatgacaaagaataaaagaaggaagaaaaaagagctatgtcaagaatagacatagcggtggagctcgcattagaaagtaatgacacttgaatggtgagagtttcgactcctccaaagttgaggaacattggccttgtggcaaaatttggcacaaagaaagtaaaatttggtaggacatatcaagttcctctcctaaatatacatctagtactgattatgatgcctctagtagtagtagttctagtgatgatgatcagttaacatgtgtcttaccttaataaaaaatactatttctaaatttgaaaagatatgatggaattaaataatatatatgagcttgtggagacgcaagaagatttgcttattccagaaaagaaaaagaatctaaaacttgaaaagctcttagctcaaaaaagaaaagcgcaaatataataaagagctccttagtttctatcattaattaaaagtcgtctagagcggagtgaatagggcgaaactgaaaatta

SEQ ID NO: 110 - DNA, 780 bp, Zea mays
cattgggtacctcgaggccggccgggcccaaccatttgcggcggctgccgcaacaggctcaacgctcacgcgcacacacaatccatagccgcctcccacatctcactctcgttccgagcttccggccatgacggtgacctccggcgcccccaacgacaacggccgggacgctggcgccgctgcgactgacgatgagcaccgcgtggatctggaagtcaagcacaaggacaccggcactagggactcgccagcaccgatagcggcagctgcgcctgcgtcccagtcccgagtggctggaaagcttggcccctcagatccaaagcacctcatctatgcgggatccaaatcaaagcatattaaagctgcacctgctgcaccagacaagaatcgccggccacctttgtctccaccagcacctgctgtcaatcgtggtcgtggatctgtgcgcacacctttgggtgaacaagtcaagtacaagtagcaattgacaagaaccttttggctctcatgaagaattgacatggatcttttggttctcatgtttttactcaatggtgaacttgtaatgaacttgtaacagatgtgcttttgggagcagtttgcacatctgttgatgtgcacctatgttgtaagcacattgtatgtgttaatttggaactttggatgtttaatgtggtgaactagtggcgccatgctaggggtggtggacactaagtggatgttaatctagctgtgagtcttattgttgatgtttcttaaaaaaaaaaaaaaaaagcggcc

SEQ ID NO: 111 - DNA, 1569 bp, Zea mays
ggcacgagattttttgccgcttcggaggcaccttcgaacaaagcccaaaagcagccagcgcaccgcatgtcctcgtcttcggcgcaccagaaggcgtcgccgccgatagaggaggaagcgacggagcacggacccttccccatcgaacagctacaggcatctggaatagctgcacttgatgtgaaaaaactcaaagatgctggtctctgcacagtggaatctgtagcatactctccaaggaaagaccttttgcaaattaaagggattagtgaagccaaagtcgacaagataattgaagcagcttccaagttggttccactcggatttactagtgctagccaacttcatgcacagagacttgagatcatccagcttacaactggatctagagagcttgatcaaattttggacggtggaatagaaacaggatctatcacagagatgtatggtgaatttcgctccgggaagactcagttgtgccacactctctgtgtcacatgtcagctcccattggaccaaggtggtggtgaaggaaaggctttgtatattgatgcagagggtacattcaggcctcaaagaattctccagatagcagacaggtttggcttgaatggcgctgatgtactagagaatgtggcttatgccagagcatataacactgatcatcaatcaagacttttgctagaagcagcctccatgatggtagagaccaggtttgctctcatggttgtggatagtgctacagccctttacagaactgatttctctggtagaggggagctatcagcaaggcagatgcatctggcgaagtttcttaggagccttcaaaagttagcagatgagtttggagtggcagtggtaatcacgaaccaagtagtggctcaagtggatggtgctgcaatgtttgctgggccacagatcaagcccattggagggaacatcatggctcatgcttccacaactaggctctttcttcgcaagggaagaggggaggagcggatctgcaaagtaatcagctctccctgcctggctgaagctgaagcaaggtttcagatatcatctgagggtgtcactgatgtcaaggactgaaagcatcctgcatttgcagtccacagcataacttgccaattcagacgaatctctgatctgctgcactcgtgtcggtcccttgtacaatcaaaataccagtacaggcttccagaatgcgaatgcaaatccgttggagtgtggcactgtcatcctgttgtctttaggtaccatctaaagttggcattgttgtaaagtggtagagcgcaaggctctactttgtagccgtggattcgagccctatggtgggcgttatttaatttttttggcgaaaaagcctttaattgagttgtttaggtgatatgaataactctttaggtcatggagttcgactccatgggagtttaagctgggttaaaaaaaattatggtcacgatctttttcacatgggctactgtaacatctcgtctactcctgaaccgatgttaagctttttaggactatagatcatcttcatatatcaacaaaaaaaaaaaaaaaaaa

SEQ ID NO: 112 - DNA, 1246 bp, Zea mays
gtgagagaggccgtggaaaggaatctttcagctcacacctccctatccctccctccctccctcccttctcctcctactgctactgctcgccaggtcccctcgctcgctcgtcgtcttcaacctcacacaattatttgtgctcccgctccttccgtccgtccttcctcccccctcccctctccctcttccaaccgccgctcctgctgccttgcctctcagccgagggacgccaaggtctctgccaggatggtgtaggccgtgcctctcgcgcattatgaggtgtggtggtgagggatgggcgatggcctttgcagatgaaggagcgacagcgctggcggcctgaggaagacgccgtcctgcgcgcctacgtccggcagtacggcccccgcgagtggcacctggtgtcgcagcgcatgaacgtggccctcgaccgcgacgccaagtcgtgcctggagcgctggaagaactacctccgccccgggatcaagaagggctcgctcaccgaggaggagcagcgcctggtgatccgcctgcaggccaagcacggcaacaagtggaagaagatcgccgccgaggtgcccgggcgcacggccaagcgcctcggcaagtggtgggaggtgttcaaggagaagcagcagcgggagctgagggacagccgccgcccgccgccggagcctagccccgacgagcggggcaggtacgagtggctgctcgagaacttcgcggagaagctcgtcggagagaggccacagcaggctgccgctgcgccgtcgccgctgctcatggccgcgcccgtgctgccgccctggctgtcgtccaacgccgggccggccgccgccgccgccgccgccgtcgcgcacccgccgcccagaccgccgtcgccgtccgtgacgctcagcctcgcgtccgccgcggtggcgccgggcccgcccgcgcccgcgccatggatgccggagcgcgccgcggccgacccggcgccgtacgggttcccgagcccgcctcagcacggcggcgccgcgcccccgggcatggcggtcgtggacgggcaggcgctggcggagctcgccgagtgctgccgcgagctggaggaggggcggcgcgcgtgggcgacgcaccggcgggaggcggcgtggcggctgaagcgcgtggagcagcagctggagatggagcgcgagatgcggcggcgcgaggtgtgggaggagttcgaggccaagatgcgcaccatgcggctggagcaggcggccgc

SEQ ID NO: 113 - DNA, 3552 bp, Zea mays
gtaagttcctaagcgctttggtctttttaatacttccttatgtttgcccaaaacctggtcctgccaaaaacttgttcttgtcaatcagttgtgtcaatatggacgacttacatccatgatgttgaagaatgtcatgtacccaaagtagtgtgaagagtccgataagaaaaatcacccaacattaaataaatagtgagatggagagtctgaatagctgatataaaatttagaagtaaaaatgtattgattgctgacaaaaaaatcgtaagatattaagatcaataacaatactatatgttatttatttttatctaattattatgctaatagtagctgatataaccacacacagttattatactagtttgacctgtgtaactgttggccacagaacaggctagctactcgtcatgggcactcactcaggcgtgcctgttgagtaggagcagtagtagtaaaaaagaagaaggaaaaaaaagcgatctctaatccgcgcggcgcgggggccatgctgccgtgatttgactcgtggaagccctcctccacgctcgctccccatctttttcgtcgctttccacgcgcgctgtgctcgctgccacgacaagacgcgacgccgacgacgtacggcgccttttcccaccgcccgcccgcgcgccggccagccccccagagatgctgccatttcatttcccaccccatcccatcgatcgtcactctactactactaatattgaaggagcgattaaagccagctattaacattgaaggagtagtagaagctgcaaattcaacccaaacggatagattgtataggactggaatgagtttatttctttgaatctgatttttttgcgtaaaatttgattcggggcgcggtatccaccccacccacgcggcgcacgccagagaggccggagccatgtccgtccatgtcgctcgctcgtcccatcaatcaactctccaacagtctcgcctcttctcttctcttctctctctcttttctttaacttctctctccttccatcccccgctgcctctgcgtgctcagcccagggccagggccgggcaagccagtactgcgaagtcagctcgcagcagagaaagcacccccggccccacccccacaacccacgtactgtatactgctgccactgcgccagccagcacgctcctccacctccatgtgcatgctgcagctggagctgcatgtgtaggcgtggccgtgtcccgtctctcgtctcgtgtgggggtgcctgtgctcatgccattgccattgccattgccatgctgcgtgccgctgttgcccgtgcttcacctgcgctgcgcccccctgctccactccatcctagtagctctacagcttcgagtagctcgctctcactcgcgctctctaccgctccggctcgctgagaccctgaccctgtgtccctgtctatatatacacgcgcgccccctttccgggcatcccttttcctcccgcccgcgcccccgtcttttcctttccgcgtgccctaatttctcgctgcgccttgtcccccacacctccccctccctccgccgctggtgctctctcctcctatacatacaaacacatacacacaagctcgctcgctcgctcacgggctgtgagagaggccgtggaaaggaatctttcagctcacacctccctatccctccctccctccctcccttctcctcctactgctactgctcgccaggtcccctcgctcgctcgtcgtcttcaacctcacacaattatttgtgctcccgctccttccgtccgtccttcctcccccctcccctctcccgctcctgctgccttgcctctcagccgagggacgccaaggtctctgccaggatggtgtaggccgtgcctctcgcgcattatgaggtgtggtggtgagggatgggcgatggcctttgcagatgaaggagcgacagcgctggcggcctgaggaagacgccgtcctgcgcgcctacgtccggcagtacggcccccgcgagtggcacctggtgtcgcagcgcatgaacgtggccctcgaccgcgacgccaagtcgtgcctggagcgctggaagaactacctccgccccgggatcaagaagggctcgctcaccgaggaggagcagcgcctggtgatccgcctgcaggccaagcacggcaacaagtggaagaagatcgccgccgaggtgcccgggcgcacggccaagcgcctcggcaagtggtgggaggtgttcaaggagaagcagcagcgggagctgagggacagccgccgcccgccgccggagcctagccccgacgagcggggcaggtacgagtggctgctcgagaacttcgcggagaagctcgtcggagagaggccacagcaggctgccgctgcgccgtcgccgctgctcatggccgcgcccgtgctgccgccctggctgtcgtccaacgccgggccggccgccgccgccgccgccgccgtcgcgcacccgccgcccagaccgccgtcgccgtccgtgacgctcagcctcgcgtccgccgcggtggcgccgggcccgcccgcgcccgcgccatggatgccggatcgcgccgcggccgacgcggcgccgtacgggttcccgagcccgtcgcagcacggcggcgccgcgcccccgggcatggcggtcgtggacgggcaggcgctggcggagctcgccgagtgctgccgcgagctggaggaggggcggcgcgcgtgggcggcgcaccggcgggaggctgcgtggcggctgaagcgcgtggagcagcagctggagatggagcgcgagatgcggcggcgcgaggtgtgggaggagttcgaggccaagatgcgcaccatgcggctggagcaggcggccgccgcggagcgcgtggagcgggaccaccgggagaaggtggccgagctccgccgcgacgcgcaggtcaaggaggagaagatggccgagcagtgggccgccaagcacgcgcgcgtcgccaagttcgtcgagcagatgggggcgtgctcccgttcatggtcctctgccaccgacatgaactgttgaactggacaaacgagccgctgaccacaccgtcgctagctatcgcgtgctacgtgctccggttcacggctttcttgcattctgggacgcgacttgtaaacgccatggattttcttgctcacgttcacttccgctttctttctttctttttttcttttctttttatttacaactgttgttacggtcggttcagtgcttctctctctatctactagtagttgatcagagtcaagaaatgtaatgctgccgttactgtcgtagtttcatcctctctaaacatgcgttctgtctgtttttgatcatgccaagcttcaaccttagcactgaataaatagaacgagaaaaaaaaatcagacaaagtttcaaatccatgtgtgctgctgggtcgacgatgcttcctgtcgtagttttaggtctgattagtttcacggcaccctgcctcgtcgtcgtcgtgacttggctgagctgaagcagcagcctcgtgggagccaggctcagtcatccaaacaagcgcag

SEQ ID NO: 114 - DNA, 2573 bp, Zea mays
atatattaataatcaaccattagttcgtgagattgaaaaaatatacacatataatataagaactagtacaacatacactatggctacaatcacctaatgaacacacactcagcgccttcgccacatcgcgttaggagtctgcgacgatttgtttgctctgtgactgcaatagactcatcgattcgtttctcagattttcaacaagctacagctagcgaaaggactaccgaatagtgtctcaactaagaccaattactaaatatccatagcacatatcatatacttatatttagtacatatttggggggcctataccttcggggccctgggcggctgcccacccctagggccggttcctgcttgtttggcagcaatgtttctcaaaatcatggctttacaatactatacttgcaattgttatgataataccgtggttttgatagctccaaaaataacatggttttgacaaacattgtttggatagaacattgtaaaccatgatattaagcaagagctagtcatatcatgaaaatactttggattggagtggagttttcaatactccaaaaatactttggtgtctacaaaaccatggttttgaaaatatactttccaggaaattgcaactaaacccatttcatgacatttaatactatggtattagccaaaccccaaaaaaaacttcactccaatcatgtcctttatagtaccacccaccatgcatgtgtcacgcatgcattgcaattgcatgcatgcagccgtagctagcagaatgccaatgtatgcaatgcaagcttccactggaatttcaatttcaaaggcatgcactgcacaaccacagcccacagctaggcgtcaccgtaccatttatcaaaccgcgtcgagatctgagagagagaacaaaaaagaaaaaaaaatccgcctttacttcgtcgtctctccatgcacggcgccatgcatatgcatatgcgtcgtatgcaaggccagcaagggtggtggtggtggctggtgaagtgacctggggaaattttaatggcggtcacaggatggcatgcagtaaagagcagcagcaggtaccctgcctctcctttaagccagcctctctcctccttaacgcccgccacctaccgcgctgctgctaccccgcgcggccgcgcccctctgtccgactgtcccggccggccgatgagctcgctgcgccgtcttcaataccgcccagccgtctcccccgctataaaagcccccggggtacctcgaggccggcgggacgatcacacaccactccacagcagtagcaagagggatagagcaaggccacacacacacacacaccactaggctaggttagccttttaatcgtcgtcgagaagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagcctacccgggttcagcttgcccggcagcggcagcatgcccctcttcggcggcggctccccgggcttcagcggcttcggcggcatgcccgggtcgcccaccgccggctccgtccccgagcacgccaacaagccctgaacgccaacaagcgtggtagtagagtggtgctactgttactgtagtacgtcgtcgtcttcatgcatgcgtggttcgtggtttcccctagctccatacgagcagtagttgggccttgcacgtaccgtacgtctagctagctatatatatatagcttgtgttctactgccttttagtttaattacctgcctgcattggagagttggatctgtttcatttggtggtgtttgctttactattaggtcagtatctgtttgtggagacttggtgtttaatttatttagccgtttgtgactggttgtagctagcggtggtgcggtggtgatgttcttgaggcatgaataatgctacatgcatgtgatgtatccatgttttgtgtgtggtaaacctgttgtttgtataagctgtatgcatgggtctttaatttgtttttgaagcagggttcacgttattaatttgtcactactttgttcggttcgcatcatttatttgacactacttttgttttgagtgactttcggaatctctgaaaaaaaaggtcattccaacgtactacacaagttaggaagcaaatgcagcagataacatatgcaaggcatatatattacacacccagacacgaacgaaagcatcaaacagctggacagtacagtttaggataaactaatgaagaaccatttcaaacgaagtgggaagaaaaatagtcaataataataaattacgagcaagcttttaagtcacggacatgtcagtg

SEQ ID NO: 115 - DNA, 1100 bp, Zea mays
gccggccggggaaaaaaaactcgacgccggccggcccgcaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagcctacccgggttcagcttgcccggcagcggcagcatgcccctcttcggcggcggctccccgggcttcagcggcttcggcggcatgcccgggtcgcccaccgccggctccgtccccgagcacgccaacaagccctgaacgccaacaagcgtggtagtagagtggtgctactgttactgtagtacgtcgtcgtcttcatgcatgcatggttcgtggtttcccctagctccatacgagcagtagttgggccttgcacgtaccgtacgtctagctagctatatatatagcttgtgttctactgctttttagtttaattacctgcctgcattggagagttggatctgtttcatttggtgtttgctttactattaggtcagtatctgtttgtggagacttggtgtttaatttatttagccgtttgtgactggttgtagctagcggtggtgcggtggtgatgttcttgaggcatgaataatgctacatgcatgtgatgtatccatgttttgtgtgtggtaaacctgttgtttgtataagctgtatgcatgggtctttaatttgtttttgaagcagggttcacgttattaatttgtcaaaaaaaaaaaacccgagggcgggccaggacttgtgagctcttgctgct

SEQ ID NO: 116 - DNA, 1034 bp, Zea mays
tcgattcggcacgacaggagcaagaagggtgcgcacgcaagcaggcaagcaagaagagagccgatcgaccgagagctagcacgcgatggcgaggtcttccaaaatgatggtggcggcagctctgctggccctggccctggccgtgtcgaccgccgaggcgaggaacatcaagacgacgacggagaagaaggacgacgcggtggtgcagccgcagaccttcccgcccttcgaccgcctcggcggcggcgcgtccccggcgttcggcggcctccccggcggcagcattcctggcagcagcattcccgggttcagcatgcccggcagcggcagcagccttcccgggttcagcttgcccggcagcggcagcatgcccctcttcggcggcggctccccgggcttcagcggcttcggcggcatgcccgggtcccccaccgccggctccgtccccgagcacgccaacaagccctgaactccgtctgtccgtccgatccgtcgctggagcgaggtcgggctagccagcgtgcgtggtagtagagtgatggtactgtagtacgtcgtcgtcttcatgcatgcgtggttcgtggtttcccctagctccatacgagcagtagttgggccttgcacgtaccgtacgtctagctagctatatatatagcttgtgttctactgctttttagtttaattacctgcctgcattggagagttggatctgtttcatttggtggtgtttgctttactattaggtcagtatctgtttgtggagacttggtgtttaatttatttagccgtttgtgactggttgtagctagcggtggtgcggtggtgatgttcttgaggcatgaataatgctacatgcatgtgatgtatccatgttttgtgtgtggtaaacctgttgtttgtataagctgtatgcatgtgggtctttaatttgttttaaaagcaggattacaattttgaaaaatatatattatatatattttatatttcttatatatgtaatttattttttttattaataaaaagggcgggctttt

SEQ ID NO: 117 - DNA, 2320 bp, Zea mays
  misc_feature (2113)..(2113): n is a, c, g, or t
  misc_feature (2117)..(2117): n is a, c, g, or t
  misc_feature (2121)..(2121): n is a, c, g, or t
  misc_feature (2131)..(2131): n is a, c, g, or t
  misc_feature (2149)..(2149): n is a, c, g, or t
cttttgttggaagagaaagtacatcaatgggacttataaccaagctaatcaatatttgtattgttggaagagaaaataaagaagagaaaatagatcttaactgtcatataagcaacatgctattcataggagccttggcggtggcgatcctaaataatactcccttcgtttttttacttgacgtttttaattaaaaaataaactatgcaacattaaatatttaagaatgaaggtagtattatatgtgatgaggaataaaaaagagaatagaagatatgttagcaaataataataataacaacaacaacaacagtagtagtagtagtaataataataataataataataataataataataataataataataataataataataataataataataataataataataataataacaacaacaacaacaacaacaataataacaacaacaacaacaacaacaacaacaataaacacttttatagataaatagaagacaatcatagtatatcttattcttgtaccttaatttaaatataagcatttgactatactattaatattgctcctaaatccgcacaggcagttttcatttattagcctctcttttctctcccatcgtttttgaattctctcacccctttgacatctaacaaagtcaagtgggcctgccgccctgtcgtgtgtcctctataaaactccaagctcaaaaaaaaaaaaaaaccacaacgaaaaaaacacagcatagaacagtaggcctcactcctttttaggacaggatccaatgcctttggccctctgcccatcactccccctctctctccttttactcttcctgtagtctcctcactcttccaaccaaaacaatcaataaactagcagaagtcagcgcctccctcctccgcccgtttcctcaagcgacaagaacccaaccactccgcgtcgtcgtctgctgccaatggaggaggagcgctgcttcaacaactgggatctggacgccgtcgtgcgcttgggctgccgccgcctcctctccccgtcgccgcagcccgacccgttcgcttcgtttctcccgccgccgccgcagaaggagaagcccgtggcgccagcgccggctaaagagccagagccacataccgcgtggcgcttccctgaccttggtgctggcggcgggcaagacggcgaagagctcctcagggccctgttagccgaccagcctcccctgcatcagcctctgccaacgccagcggcaacgccaacgccaacgccaacggcaacgcctcccccaccatcacaacagcagcatctacagccgactgtgacagccgtggacgtggctccaccccaggtgcgccccgctccggctagggcgcagccgagcgggcggcaggtgcccggtggcgtgccaagatccaagagaaggtacgctgcgctcgctgagtgcctcgacacggccggcggcagcggttcttcgaattgtttcttgggggaggttgaaagctcgggtatttgcaagctgctaacgctgtttccgtgcactccaggaagaaccaggtgaagaaggtggtctgccacgttccggcggacggctcgtcgccggacgtgtgggcgtggcgcaagtacggccagaagcccatcaagggctccccctacccaaggtcggtcagctagaacaacagtcccttgcctatctgtcggcttctcgccggcgtcgcgttcgcgtctcggagcgaattaaccgatctcaccgcctgctgctatgttcccggcacgaggggggatactaccgatgcagcagctccaaggggtgcgcggcgcggaagcaggtggagcgcagccgcgcggaccccaacactttcatcctcaccttcaccggggagcacaaccacgcggcgccgacccaccgcaactcgctcgccggcaccacccgccacaagttcccgtcgtcggcggcgcctcagccgccgccgccgtccgtcgtggtgggcggtgacgcgcaggaccggcagccgagcccgagcccgacgtccacgtcgaccgcggggctctcgcccacgacgccgctgcgcacgccgtccatggaggaggaggtggtggaggaggaggaggaggagganggangacnagctgctggnggaggacatggagatggntggcgaggacgagctcctgttcctcagcaccgacgccgacgccggggcaccgacgtcctcgctcttcgacgtcgtcggcgagcccttcctaagccctccctgggtgacagccggcagcagcgccggcgagccagccacaggggcagccggcgctgggagctgacttcttct

SEQ ID NO: 118 - DNA, 1024 bp, Zea mays
cattgggtacctcgacattgggtccctcgaggccggccggggggacgatcaccaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccgcctcggcggcggcgcgtccccggcgttcggcggcctccccggcggcagcattcccgggttcagcatgcccggcagcggcagcagcctacccgggttcagcttgcccggcagcggcagcatgcccctcttcggcggcggctccccgggcttcagcggcttcggcggcatgcccgggtcgcccaccgccggctccgtccccgagcacgccaacaagccctgaacgccaacaagcgtggtagtagagtggtgctactgttactgtagtacgtcgtcgtcttcatgcatgcgtggttcgtggtttcccctagctccatacgagcagtagttgggccttgcacgtaccgtacgtctagctagctatatatatagcttgtgttctactgctttttagtttaattacctgcctgcattggagagttggatctgtttcattttggtggtgtttgctttactattaggtcagtatctgtttgtggagacttggtgtttaatttatttagccgtttgtgactggttgtagctagcggtggtgcggtggtgatgttcttgaggcatgaataatgctacatgcatgtgatgtatccatgttttgtgtgtggtaaacctgttgtttgtataaaaaaaaaaaaaaaagaaaaaaaaaaaaaaaaaagcggcc

SEQ ID NO: 119 - DNA, 1649 bp, Zea mays
cattgggtacctcgaggccgcacgagaccattacctagaacatcctaatcaaaaaagaacccaaccactccacgtcgtcgtcgtttgctgccgctgcgcaatggaggaggagcgctgcttcaacaactgggatctggacgccgtcgtccgcctgggctgccgccgccgcctctccccgccacggcagcccgacccgtttgcttcgcttctccctccgaccctgccgtcgccgtcgccgtcgccgccgcagaaggagaagcccgtggtgccagcgctggctaaaggaccagagccagagccatacgccgggtggcgctttcctaacctcggtgctggcggcgggcaagacggcgacgagctcatgagggccatgttagcagtccagccttccctgcctcagcctctgccaacgacaacgccaacgccaacgccaacgcttcccccggcagcaggagagcatcgacagtcgactgttacagccgtggacgtgccgctaccccaggtgcgccccgctccggccgccagagcgcagccgagcgggcggcaggtgcccggttccgtgccaagatccaagagaaggaagaaccaggtgaagaaggtggtctgccacgttccggcggacggctcgtcgtcggacatgtgggcgtggcgcaagtacggccagaagcccatcaagggctccccctacccaaggggatactaccggtgcagcagctccaaggggtgtgcggcgcggaagcaggtcgagcgcagccgcgcggaccccaacaccttcatcctcacctacaccggcgagcacaaccacgcggcgccgacccaccgcaactcgctcgccggcaccacccgaaacaagttcccctcctcggcggcgcctccgccgcctccgccgtccgtggtggtgggcggcgccggtgccggcgacgcgcagcatcagcagccgagcccgagcccggcgtccacgtcgaccgcggggctctcgcccacgacgccgctgcgcacgccgtcgatggaggaggaggagatggacgacgacgacgacgagctgctggtggaggacatggagatggtcggcgaggacgagctcttgttcctcaacatcgacgccgacgccgaagctgactccggggcaccactggagcccatgccctcgctcttcgacgtcgtcgacgagcccttcctaaactccccttgggtgacggccaccagcagcgccggcgagccagccacaggggcagccggcgccaggagctgacttctccaacagatagagacaatgatgtgcggtccgtccgtctttgtagatgaaacaaaatcaagggaagcgaagagagtagaagaaatcatctgatctgccattgtaatgcatccatcagtagcatcgacatcatgatactagtattagtcctagcatcggtagtcagtcctgaccagtacagagcttgatccatcaaccctcaaagcagttcttccttcctcaccgctcagaacaacatctttgcattttgttctttttctgctctttttttaggtatggttgtgactttgtatctcttttgttaggtgcctgttttttttgcatttgtgtatagaaagtggtagatgatgaaccaacaaaaggagtgaaaaaacagctaaaaaaaaaaaaaaaa

SEQ ID NO: 120 - DNA, 854 bp, Zea mays
ggccgggcacgatcacacaccactccacagcagtagcaagagggatagagcaaggccacacacacacacaccactaggctaggttagccttttagtcgtcgtcgaggagcaagaagggcgcgcacgcaagcaggcaagcaagaagagagccgatcgaccgagagctagcacgcgatggcgaggtcttccaagatgatggttgcggcagctctgctggccctggccctggccgtgtcgaccgccgaggcgaggaacatcaagacgacgacgacggagaagaaggacgacgcggtggtgcagccgcagacattcccgcccttcgaccgcctcggcggcggcgcgtccccggcgttcggcggcctccccggcggcagcattcctggcagcagcattcccgggttcagcatgcccggcagcggcagcagcctacccgggttcagcttgcccggcagcggcagcatgcccctctttcggcggcggctccccgggcttcagcggcttcggcggcatgcccgggtcgcccaccgccggctccgtccccgagcacgccaacaagccctgaacgccaacaagcgtggtagtagagtggtgctactgttactgtagtacgtcgtcgtcttcatgcatgcgtggttcgtggtttcccctagctccatacgagcagtagttgggccttgcacgtaccgtacgtctagctagctatatatatagcttgtgttctactgccttttagtttaattacctgcctgcattggacagttggatctgtttcatctgctggttgctttactatcaggtcagtatctgttttgtggagatttggtgtttaatttatttagccgtttgtgactggt

SEQ ID NO: 121 - DNA, 1279 bp, Zea mays
gaagccaattcttatgactgctgtacctgctatacttgagcgtggccgcccctccgtgcatggggtacgaaaaaatgtagatgcaaaaggtgggttagcgaagagattatttgatattgcctatagccgtcgtctagctgctgtcaatggtagctggttgggtgcgtggggactagagaagcttttgtgggatatgctcgtcttccgaaaggttcgtgcaatcttgggaggacggattcgctttattcttgcaggtggagcacctctgtcaggggaaacacagagatttatcaatatatgtcttggggctccaatatctcaaggatatggcttgactgaaacctgtgctggtgggacattttcagagtatgatgaaacatctgttggtcgtgttggtccccctttgccttgttcatacattaagttgatagactggaccgaaggtggatacttaacaaccgattcaccaatgcctcggggtgaaatagttattggaggtccaaatgtaactaaaggctacttcaaaaatgaagcaaaaacaaatgaggtgtacaaggttgatgaaagaggcatgcgatggttctactctggcgacattgggcgcttgcacccagatggatgtcttgaaattatcgaccgcaagaaggatatagtcaagcttcaacacggtgaatatgtttctctaggaaaggtggaggctactttgagtgtgtgctcatacgttgaccagatcatgatccatgctgaccccttccacagctactgtgtggcacttgttgtaactgcacagagtgagctgaaatcctgggcctcaaaacaaggaatgacatatagtgatttctcagatttgtgccacaagcaagggacagtcaaagaagtcctccaatctttggtgaaggctggtaagcaagcacggttggagaagtttgagatccctgccaaaatcaagctgataccggagccgtggacgccggagtcaggcctcgtcacggctgccctcaagctcaagagggaggtgatcaagaaggcatacgagatggaccttgcccagttgtacagtcagtgacctgccgctacagtttctcaacgataggggtgatcctggtagctaccggcaacaacagttttttttatttgtacctcgtactatgttcctgtctttcttttaagacaatagttgactggtaaatcagttgccgataatgtgtagccttccattgcccgcccaaagagaactataattagcccttatttatttggctattatcatattcacctc

SEQ ID NO: 122 - DNA, 643 bp, Zea mays
  misc_feature (8)..(8): n is a, c, g, or t
  misc_feature (25)..(25): n is a, c, g, or t
  misc_feature (63)..(63): n is a, c, g, or t
ggaggatngcaggcattaactaaantctggagtccttgtgacttccccttccctataaattcnactaacgtatgcttgcccggccaatagaacatcaagtttagattcttgttcacgcgttcaaagatgcgtggggaaaacaacatagtcctccttctcctcctcctgtttgctgtaatttctccgaaccaagtaattggtagtgcttgtactccggaacagaaggctgccatcctaaatcaatgcgaagagtacatcaagcctggatacccccttatactgccatcgtacgccagtgtgtgttgcgacaaggtgagagatgtgccaaatagggacatgaactgcatcgtcgatctgctcacgcctccagagaaggcgaaacacggtgtcgacaagataaaacgtctgaaagatctctgcgacaactcgcctcatcatcaggtggtggtgtagacagacagcagctgtcattgctaatggagttcggaggcaagatatatggtctagtaaataaagtcgtcgatcaaagcatgacaactgtcaaatgtatctttgattaagtaaagtatcactcaagatttccagtttcaaaaaaaaaaaaaaaaaaggggcggccaaaaaaaaaaaaaaaaatcccctccat

SEQ ID NO: 123 - DNA, 1607 bp, Zea mays
cattgggtacctcgccgccggccccggccgggaggatgaatcggaagagagaatcctaccaaacctagctaccaactcgatcgtcgtcatcacgctcgaccgcacaactgcaccgaggggaggagacctaaaaactactacatcttttatagctacacatctagctaaagatcgagaggggtaaataaggacacaagcgagcgctagccagaagagcagctgcaggtactattatcatcgtcgtcgtcgtcgccaggatgaccgtcgtcgacgccgtcgtctcctccaccgatgccggcgcccctgccgccgccgccgcaccggtaccggcggggaacgggcagaccgtgtgcgtcaccggcgcggccgggtacatcgcctcgtggttggtgaagctgctgctcgagaagggatacactgtgaagggcaccgtgaggaacccagatgacccgaagaacgcgcacctcagggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcaggcggcgtgggaggcggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctcttccccgagtaccccgtcccagccaggtgctccgacgaggtgaatccgcggaagcagccgtacaagttctccaaccagaagctccgggacctggggctgcagttccggccggtcagccagtcgctttacgacacggtgaagaacctccaggagaagggccacctgccggtgctcggagagcggacgacgacggaggccgccgacaaggatgcccccgcggccgagatgcagcagggagggatcgccatccgtgcctgagagggcgatgccacacatgaacacaaagcaatgttcatactgctgccctgcacctgcaccttcccctgctgtgtaaacaggcctgtgtttgttctggctgatagtgatgtaccctaagacttgtaacgtcatgttcgttcttgtgaactatagcgagtgaataaaattggttaatgttggatattcaaaaaaaaaaaaaaaaaaaaaaaaaaaactcgagggggggcccggtac

SEQ ID NO: 124 - DNA, 1935 bp, Zea mays
cgcgccactcccccgcccgcccgcctcaggatgaatcggaagagagaatcctaccaaacctagctaccaactcgatcgtcgtcatcacgctcgaccgcacaactgcaccaaggggggaggagacctaaaaactactacatcttttagctacacatctagctaaagatcgagaggggtaaataaggacgagcgggcgcgagctagaagagcagctgcaggtactaccatcatcgtcgtcgtcgtcgccaggatgaccgtcgtcgacgccgtcgtctcctccaccgatgccggcgcccctgctgccgccgccaccgcggtaccggcggggaacgggcagaccgtgtgcgtgaccggcgcggccgggtacatcgcctcgtggttggtgaagctgctgctcgagaagggatacactgtgaagggcaccgtcaggaacccagatgacccgaagaacgcgcacctcaaggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcaggcggcgtgggagacggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctcttccccgagtaccccgtcccagccaggtgctccgacgaggtgaatccgcggaagcagccgtacaagttctccaaccagaagctccgggacctggggctgcagttccggccggtcagccagtcgctttacgacacggtgaagaacctccaggagaagggacacctgccggtgctcggagagcggacgacgacggaggccgccgacaaggatgcccccgcggccgagatgcagcagggagggatcgccatccgtgcctgagagggcgatgccacacatgaacacaaagcaatgttcatactgctgccctgcacctgctgtgtaaccaggcctgtgtttgttctggctgatagtgatgtaccctaagacttgtaacgtcatgttcgttcttgtgaactatagcgagtgaataaatttggttaatgttggatgttcaaaaaaaaaaaaaaaaaagaggcatcaattcagcttcggaaaagcaatcccgaaactaccaccctacctatcccctacaggctacagtagactgtacaagaccctttgttaccaaaccaaaaaaaaacatcggacaaactcaagactattcatgtttggtaacctacttgtgtagaaaagtgagctctattattggctgatgcaatatgccaacccttacatgcagcaggaaagcaaagaaagaacagtaaaacaaatgagttggtaaacagagaggactgcacaaaacaaggaatccggagaataacgatatctcaattttcaagaccaaatttggattaaaaaaaaagaaagcaagaaagagcgctaaaacaaaattgttgggaaacaaagaa

SEQ ID NO: 125 - DNA, 1550 bp, Zea mays
ccggccgggaaacaggatgaatcggaagagagaatcctaccaaacctagctaccaactcgatcgtcgtcatcacgctcgaccgcacaactgcaccgaggggggaggagacctaaaaactactacatcttttagctacacatctagctaaagatcgagaggggtaaataaggacgagcgggcgcgagctagaagagcagctgcaggtactaccatcatcgtcgtcgtcgtcgccaggatgaccgttgtcgacgccgtctcctccaccgatgccggcgccgccgccgccacggtaccggcggggaacgggcagaccgtgtgcgtcaccggcgcggccgggtacatcgcctcgtggttagtgaagctgctgctcgagaagggatacactgtgaagggcaccgtgaggaacccagatgacccgaagaacgcgcacctcaaggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcaggcggcgtgggagacggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctattccccgagtaccccgtcccagccaggtgctccgacgaggtgaatccgcgaaagcagccgtacaagttctccaaccagaagctccgggacctggggctgcagttccggccggtcagccagtcgctttacgacacggtgaagaacctccaggagaagggacacctgccggtgctcggagagcggacgacgacggaggccgccgacaaggatgcccccacggccgagatgcagcagggagggatcgccatccgtgcctgagagggcgatgccacacatgaacacaaagcaatgttcatactgctgccctgcacctgcaccttcccctgctgtgtaaacaggcctgtgtttgttctggctgatagtgatgtaccctaagacttgtaacgtcatgttcgttcttgtgaaaaaaaaaaaaaaaataaaattggttaatgttggatgttcaaaaaaaaaaaaaaaaaagcggcc

SEQ ID NO: 126 - DNA, 1036 bp, Zea mays
tactagtcttttaaacttattataatttttgaaatatgtatatatattcacatttaactattataaagaaatttcgaaattaaaaaaaaaacaaaaaaatcccaaacgtcggacgctcgccccagctctttttttttcttttctttcagacctatgacgtgtggggcccttgcaggtatttctttctcctccgttcattcgtttctctgcttaaacgctttgttcccaggcgatgctgttgtactctcttcgtctatgcccctgccgcacacagcacctcgccgtcgcgtacgcccacattcgagcccatgccgctgtcgtctcggcgacatggaatactgcgtccgtccgtttccttttccccaccgctataactgttggcattttctcctccattaatggcggccgtttatcagcttcaatggccattgaacacgccagcaattccctctcctcgcctataaaaacacctgcgcgctgcatcgaagccatcccggcctttcctccctctcctccgcacactactctctcttcctctcttacatactcctctgctgcttctcgctctactcctacgcaacgcctcgcaccgcgcctgttcatcgcagcatccgcgcccagacaccgtcatgacaccgctggagtctagtcgactctccttgtttgtgtcgttcctctgcatcttgcaccgctcgccggagttcgtcgccataatgtcgcgggagctctgcgtcctgcttactgctccagcatccttcctcccgcgatgccgtgattccggcaccgttgctgcctccccgctcatcagcaccacgacttcatcgtgcagctgattcccctgtccgagccccctacgtcgcccgttgtcgctccctcgtcgttgccttgttgctgttaccctcactggcgcctgcacatcactggagttcactgtcacggtgtcactagaacctctacgcccaacttgtggcgccaaccgtcatcgtcattctctgttccgctccgcgacgatttttttctatccgcaatccgaagg

SEQ ID NO: 127 - DNA, 1931 bp, Zea mays
  misc_feature (1711)..(1711): n is a, c, g, or t
  misc_feature (1716)..(1716): n is a, c, g, or t
  misc_feature (1738)..(1738): n is a, c, g, or t
  misc_feature (1744)..(1744): n is a, c, g, or t
  misc_feature (1749)..(1749): n is a, c, g, or t
  misc_feature (1755)..(1755): n is a, c, g, or t
  misc_feature (1765)..(1765): n is a, c, g, or t
  misc_feature (1775)..(1775): n is a, c, g, or t
aacttcgccggtaaggtagaagtcgtccacaagttccaaacttccaattgaacttgtcttctgttgtgcttgtgttctgtctgtctagacctggcgatgatttccagcaatgcccctcgtattctgactaggtgaaccctctgtgaccgacatgaagggcccaccgttataggaaaacgctgcaacacgccatgtacggcatgggcatgaccgttgtggcgtggcggtgtgccgttgtctacctcgtctcgtctctttgctcgagccggactcctgttttatttcggatcgcgacgccacaatcccaccggccacagcacagaccaggccgccgccgccgccgccgctctgccttgttcgcagctctgttggccgctcgctttcgcaacattattatacccacccaatcgaccgacgcaatcgaaaccgcctcccatctcatccgtctctctcgaatcccaccgtgcgctcactgcgatggacggctcatccaagcggatcggcggtggcggcgacgacatgcccagccccgaccacgaccagaacgccagccccaacgtcccgccgtccgccgctggtgacggcggcgcatcagccactgcggcggcagcgcccgccgccgggaggcggccgttcaccagcctcagccaagaggaggccgacctcgcccttgcccgcgtcctccaggagcaggagcgggcgtacatgatgctgaccggcggcgagtacgcgatctcggacgccgagagctacgactacgacgaggaggaagacggcgatgggagcgactacgaggaggaaggcgaggcgctcgacgaggacgagcaggttggggacgcggaagcggagggggctgagggggacctggacctggacccttctcagtacgaggacgacggggagggcgacgtctccgacaggctcatggcgctcgtcgggatcggtgattggcgagcaatggagcaggatgatgctggggacgaggaggacgacgaagatgctgaggttcatacacagggtgcatgggaagatgttgacccagacgaatactcttacgaggagctaattgcgctgggtgaagttgtcggtacggaaagcaaaggccttgctgctgacactattgcctcattaccttgggtgacttaccaggcacaagacaagcaagatggcaacatggaacagtgtgttatttgtcgtgtggagtttgacgagggcgagtcattagttgcactcccttgcaaacatccataccattctgagtgcataaaccagtggctgcagctaaacaaggtatgcccgatgtgcagtgctgaagttcccacttctgtgaacaagcaggcatgactactcaaacggaagaagatagcggtggcttggtatttatctgccattgatggaatgaaagaagcgccaactgttaaattgttcagggaagcaagggaattggctgggttctgattccctgttttcttcagttcgacaggcttagtcccccctcccctgtacgcatgctaattctatggccataccgctggttatttatgcattccattagatgcggaggattcattgcttgtagatgtaaatcaacaatcataccaccatagtcaatagctgttgttttaatgccaatagcaacgttcatgtttaaaatggtagcatttttgttccttgttttctagaccggacattttatgttcctgggaaaaanaaaanaaaaaaaaaaaaaaaaaaaaanaaaaanaaaanaaaaanaaaaaaaaanaaaaaaaaanaaaaaaaaaaaaaaaaaccttgggggggggcgcggggcccaaattccccttatggggaggggattaacccgccgccctggcgcggggtttaaaacgggggggaggggaaaaaccggggggtcccccaattaaatgcctttggaaaaaacccccttt

SEQ ID NO: 128 - DNA, 2462 bp, Zea mays
  misc_feature (2281)..(2281): n is a, c, g, or t
gttagcaaccgtaatggccttcggtacactgaaccgacaaataatattctgccaaaagaacttctagaccgtagccgaagtgattgtagctagagattttgaaaaatactccaccgctaatgcaacatattttaaattatttgaagatacaaatattactaatattagcccgccttgcctgcctgcagacgcctcctcggcttccacttcgcccctccgcaccggccgcccgccacccgccgccccgcctccttatataaccgaacgaagtccaaagccatccaaagaccaaaaaccctcacgaaattctgagatccatccagaaacgtcgctccatggcgattatctccgacttcaaggaggacgagaccccgcagcagccggcggcggtcggccccggcgtcgaggagaccctggtggcagcgctagagaggaccggcggtgcactcccctttctccaggcggccatcgatgtcgctcaccgcagtctggcctgttccgcgacccttcggcggtgagcaaggttaccgcgatggcgcggccgtcaggcgcaggtggagaccgaggagagggcagccagagaggtcaagaggaaggcggaggaggccgagaggaaggctgcggccgaggcgcagaaggctgacatggaggcggcgacggcgacggcggaggagaagctggagaaggaccgtatggatgcggataaggcggaggaaggcaacgttagacgtgagtgctctattcccttattcacctgttttgaaattgttccatacttttattgctactacgttttatggatttttgtgctaaataaatgaggttcataagcccgatctcgcataatctggtgtttagatttgtggagttaggaccagctccttgttagctagtagattcagcttgatgctctgatcaacctctgttgtttgatttagttatctaataactctaggctgcatccttatgtcatttgatattttcaatctgcatttcattactggtatcattaggcaacaaaatgcttgaacatataacggccttgtgaggaaaaaatctacgttcattttccctgtatttgcttatagttaccttagagtaaattagccatggtccaatgccaattgcagtctgacaaaagttcataagcccgatctcgcatattctggtgtttaggtttgtggagttaggaccagctcttggttagctaggtagattgggcttgatgctctgatcaacatatgtggtttgatttaggcatctaataattctaggctgcatccttacaccatttgatattttcaatctgcattccattactggtatcagtaggcaacaaaatgcttgaacatataacatccttgaggaaaaaaaatctatgtttgtttgccctgtatttgcttatagttaccttagagtaaattagccttggtctaatgtcgattgcagtctgacaaagccatggtctaatgtcgactgcagcttgacaaaacttatctctgtgttgtagtgttctgttgaggcttgggtttccgctgcgttgcaagtgagactatataaattgaaagtgctaacatggtgttctaataatcgatttacttcattattgcatataaaaataacaatgaagccttttagtctcaaacaagtttggatagactagaactaaaatctaacaaaagtcataaatcaaggttcagacacatagatagctgttttcattcgctcctatttaaggctaaaccatttgggtatattctatcctctgaagttttcttttatggcctcttgtcatgtcaacttcgacatttttctgcctctcttattattatcgtgccttaggatcccactacgcactggtgtccttgaagatttactttgaacatgtctaaactagcccaatcggtgttggataagcttttcttcaattattgatatccctaacctatcatgtatatcatagtttaggatttgattccttcttatataaccacaaatctaatggaatatacacatttttgcaacgcttatctatttaatctgttcatatgttttttttgctctggtgttaacttaagactagcaatcttatgtgatgagcatcaatatctatatttttcttctccgagtaaaaatttctaataaatgtagacattgatgttcaccatataagattgttgattttaagttaacaccagaggaaaaaaacatatgaacatatgttactgatattggatttggatgtttcaatgatatgttgtgtggtgaactttctgacganttgacatgatggctggtctgtaaagtgaattgtgtttcaaatgctttgctatttggtgataagtttatcctcatcgagctattgatttcaaagcttcttggaattctcaaaggaagtttggtaaataaggtagtacaaagtgtaacaagccatttagggcgtgtttggcatggctctagag

SEQ ID NO: 129 - DNA, 1567 bp, Zea mays
gcacgacgtgcttccacttcgcccctccgcaccggccgcccgccaccctccgccccgcctccttatataaccgtcgggacccgccggccgggaaaagaccaaaaaccctcacgaaattctgagatccatccagaaacgtcgctccatggcgattatctccgacttcaaggaggacgagaccccgcagcagccggcggcggtcggccccggcgtcgaggagaccctggtggcagcgctagagaggaccggcggtgcactcccctttctccaggcggccatcgatgtcgctcaccgcaggtctggcctgttccgcgacccttcggcggtgagcaaggttaccgcgatggcggcggccgtcagggcgcaggtggagaccgaggagagggcagccagagaggtcaagaggaaggcggaggaggccgagaggaaggctgcggccgaggcgcagaaggctgacatggaggcggcgacggcgacggcggaggagaagctggagaaggaccgtatggatgcggataaggcggaggaaggcaacgttagacaaccaaatgctggcaatggtcttgatttggagaagtactcatggactcaacagttgcctgaggttaacatcactattcctgttcctcaaggaacaaaatcaagatttgtggtcgttgatataaagaagaaccatctgaaggttgttctgaagggccagccacctatcattgatggtgagctctataagccagttaaggttgatgattgcttctggagcatagaggatggaaaaactctttccatattgcttacaaagcacaaccaaatggagtggtggaagtctgttataaagggtggccctgaagttgatacccaaaaggtggaacctgagaacagcaaactctctgatttggatcctgagactagacaaactgtggagaagatgatgtttgaccagcgccagaagcagatgggccttccgacaagtgatgaaatgcaaaagcaagaaattctcaagaagttcatgtctgagcacccggagatggacttctctagagcgaaaatgccttgaggatttgttcgggcagttatttctaccagtctgcttaggttgtctttgagtctggtatcggtgtcaaacaaatcttcatctgttttttttttgtaatgcgtcaggaatatcaggcttgttctttttcatctcaatccatatgcattggaagcgtttgggtgggtttaaatccatagtaggtcaaaagctttactaaattttccaatccaatccattccattggtcacgtggcttgaggatttgttcgggcagttatttctaccagtctgcttaggttgtctttgtgtgattgtgtctggtgttagtgtggaacagatgtctttgtgtgattgtgtctggtgttagtgtggaacagatcatctttttttagtagcgtcagaaatatcatttagaactgtgacgtctttcgaaactagagttcaagctcttggatatctctcctcgcgccgtcattaaaatctcagtaaagcttatttagaaacaaagtatttttatagctttcaggtactatca

SEQ ID NO: 130 - DNA, 1550 bp, Zea mays
  misc_feature (1522)..(1522): n is a, c, g, or t
tcaagcttaataaaaggttgctccgctcagctgccctctgcgcctcataaccgaaaaaacccaaagtcacgtttcctcctcaacaaaaaccctcgcaaaaatctgggatctatctagaagcatcactcaacaaaccctaggttgcctgatcggttgatcgctccatggcgatcatctccgacttcaaggacgacgaggcaccggagcagcagctggcggccggccacggcgtcgaggtggccctcgtggcggcgttggagaggagcggcggcgcgctccccttcctacaggcggctatggatgtcgcccaccgcaggtccggcctgttccgcgacccttcggcggtgagcaaggtcaccgcgatggcggcggccgtcagggcgcagatcgaagccgaggagagggtgaccagggaggcggaggccaagaggaaggcggaggaggacgagaggaaggcggaggccgaggcgcagagggctgccaaggaggcggtaatggcgacggcagaggagaagccagagagcacggtggagaaggacagcatggaggtggataagaaggaggaagccaacgtgagacaaccaaatgctggcaatggtcttgacttggagaagtactcgtggactcaacagttgccagaggttaacatcaccattcctgttcctcaaggaacaaaatcaagatttgtggtatttgatttaaagaagaaccatctgaaggttggtctgaagggccagccacctatcattgatggcgagctctataagccagttaaggttgatgactgcttctggagcatagaggatgggagaaccctgtccatattgcttacaaagcatgaccaaatggaatggtggaagtctgttataaagggtgatcctgaagttgatacccaaaaggtggaacctgagaacagtaaactctctgatttggatcctgagactagacaaactgtggaaaagatgatgtttgaccagcgccagaagcagatgggccttccaacaagtgatgaaatgcaaaagcaagaaattctcaagaagttcatgtctgagcacccggagatggacttctctagagcgaaattagattgaggatgtgtttggccgtttgtctgaatgcgttattagtatgaaacattttttgatcagtttgcatgtaatgcgtcagaaatatctggagatagacttctctagagcgaaaatagcttgaggatgtgttcggccagttatttctaccagtgtgcattggttgtctgagtgcgttattagtatgaaacaaaaattttgatcagttcacgtgtaatcgtcagaaatatccggagatggacttctctagagcgaaaatagcttgaggatgtgttgggccagctatttctacagtgtgcgttaggttgtctgagtacgttatcagtatgaaacgaattttgaacagtctcttgtaatgcgtcagaaatatttttttagaactgtggcatgtcttgaaccaatacgatggctggattatgtcgattttttttgtgcgnaaaaaaaaaaagaagaaaaaaaaaaata

SEQ ID NO: 131 - DNA, 3121 bp, Zea mays
aattcggcacgagggcggacctcagcagctccatatctcagtcacacactcacgcgcgcgcgggggccgggggccgctggacccgccgttctccttctcctccccccctcgttcctctcgtctcaccattactccctacacgcgccgcggctaggattccgccgaggagacgctgcgcgcgtggatctccggtgctgtcctgctagcgtgcgacgaggccaggcaggcgcgcggccggcgccatgagcttcgggagctattcgacggcgggtccggcggcggcggaggaggaggagggatgcagttcccgttcacgaccgggttctcgtcctcgccggccctctccctcggtctggacaacgccggcggcggcatggtcggccggatgctccccgtgggcggcgcccccgcggacggcgggatggcgagggacgccgccgacgccgagaacgacagccgctccgggagcgaccacctggacgccatgtccgccggcgccggcgccgaggacgaggacgacgccgagccgggcaacccgcgcaagcgcaagaagcgctaccaccgccacacgccgcagcagatccaggagctcgaagcgctgttcaaggagtgccctcacccggacgagaagcagcgcggcgagctcagcaagaggctcggcctcgacccgcgccaggtcaagttctggttccagaaccgccgcacgcggatgaagacgcaactggagcggcacgagaacgcgcttctcaagcaagagaacgacaagctgcgggccgagaacatggcgatccgggaggcgatgcgcagcccgatgtgcggcagctgcgggagccccgccatgctcggggaggtgtccctggaggagcagcacctgtgcatcgagaatgcgcggctcaaggacgagctcaaccgcgtctacgccctcgccaccaagttcctcggcaagcccatgcccgtcctctcggggcccatgctgcagccgaacctgtcgctgcccatgccgagctcgtcgctggagctggcagtaggcggcctccgtggcctagggtctatcccttccttggacgagtttgctggcggtgtgtctagcccgttgggcacggtgatcacgcctgcacgggcgaccggatctgctccgccgcctatggtgggcgtcgacaggtccatgctgctggagcttgcgatcagcgccatggatgaactagttaagctggcacaggttgacgagcccttgtggcttcccagcctcagtggctctcccgacaagaagctgctcaactttgaggagtatgcccactcgttccctccgtccgtcggcgccgtgaagcctgtgggctatgtatccgaggcctctagggagtctggcctcgtcatcattgacaacagccttgctcttgtagagacccttatggacgtgagacggtggtctgatatgttctcgtgcatgattgctaaggccgcagtcctagaggaggtgacatctggcattgcaggaagtaggaatggtgcgctgctgctgatgaaggctgagctacaggtgctctcacctctagtgcccatcagggaggtcacatttctcaggttttgcaagcagctggctgagggtgcatgggcagtagtggatgtgtccattgacggattggtgagagatcacaactctggaacagcatccaacgccggaaatatacggtgcaggaggttgccttctggctgtgtgatgcaggacactcccaatggctactgcaaggtcacatgggtagagtatacggaatacgacgaggcgtcagtacaccagctctatagaccactcatccggtccgggctggcctttggggccaggcggtggcttgcaatgctgcagcgccagtgcgaatgcctggccatactcatgtcccctgatacagtttcagctaatgactcgtcagtcataacacaggagggcaagcgaagcatgctgaagctggcacggcggatgacggagaacttctgcgccggggtcagcgcgtcatctgcacgtgaatggagtaagctggacggcgctgcaggcagcatcggggaggatgtgcgggtcatggcacggaaaagcgtggacgagcctggggagccgccgggcgtggtcctaagcgcagccacatcggtgtgggtgcccgtggctccggagaagctcttcaacttcctccgtgacgagcagctgcgtgcggagtgggacatcctcagcaacggaggcccgatgcaggagatggccaacatcgccaaggggcaggagcacgggaactcggtgtccctcctcagagccagtgccatgagtgccaaccagagcagcatgctgatcctccaggagacttgcactgatgcatcaggctcgatggtcgtgtatgctccagtggacatcccggcgatgcagctcgtcatgaacggcggggactccacctacgttgctctgctgccgtctgggttcgccatcctgcctgatggcccaagcagtgtcggcgccgagcacaagacaggcggctcgctgctcaccgtcgccttccagatcctcgtcaacagccagccgaccgccaaactcaccgtggagtcagtagagaccgtgaacaacctcatattctgcaccatcaagaagatcaagacagcgctgcagtgtgacgcttgactgtcgcgtgtcgccgcagggggggtggtcggtgatgacgagcctgagtcaagaacgaacctcgtgcgggaaagaaacctttgctaggtgataaggatccagcttggacgggtctttagcacggagcaatggtggtggttcgggtattgactcggtctctgtcatctgcttcttctccatggcaacctgttgtctgatacgggatcttgaatagtgcgtggacaatgatgtggttagatggttaaaatcttttgtttcagtcccatcgtttcatcagggaatcaaactttgagttttggccgcctcgttgttagttgtaatatacagttcattttatattgtgaggtaagctatatgccatgtgtaaacatgagagctcaggaatgttgggtagcatcatgagtgtagctaggcatcgaactatcggccaataaaatgtctgatcgataaagaggtatagttgtttaa

SEQ ID NO: 132 - DNA, 1009 bp, Zea mays
gtggacgtatgcaaaatctctatttatgtatagcagcatattgaaccgaggcggacctaatggtgtggatttctcgtcaaacatggttgttgtttgctcttttctttgacaacacctctgaacttttatactccatccgtgaagaaaaacaatagtggcacacactacatccacacgaaatagtaccacactatttattgacgacgaccacgtaccccggagttgaaagaacacaacatatatggattcttctgcggaatcctatattgaaaataaatactatataataaaagcacaggaagagtattctccgatccatacatctcaaagttggtacacacacatatgccgtctgcaacaacgatacatcgccggtcattttaattaccagcgccaaacattttttccagaagttccggcatcttttcgttccatggggatgtagaaggcatggatctgaaggtcaattttggatgtgctatcgaccgtcgttaggtatttcttgtatatgacgcctcgagccatagtaagttttccggtgcctccaacgattgaccactctcccttgaatacattaggccccattacttggagtgtggacccttccaacccgctgccttgctcgaagacgatgtcaaacgaagcatgccagcttgcttcttctctgctagcttggacatgcagacccttggcgtgcgcaactattttcccgttttggcagggatcttctagatcccaatcgttagcgaccatgtttcccagcttgttaaagcctccgggagatgcgacttctacttggtttgctttgctagtgccacaccagtgctgtatcaggatcagctggtagtgaagctcatggagctccagggagtgatcaaggggctcggaatcgtaaggcggcatggctagctgctactactgggagctgctctgctttcttgtatagctgatggaagtactcaatactctgacccgtgagactccagtcccggcccggccggcctcgagg

SEQ ID NO: 133 - DNA, 1099 bp, Zea mays
ggaccccgcacgtgatcccgatcgcgccccctttaccccaaccgccagttcaggatcggacgaaccgtgaggcggccacgtccgccccacctgacattgggccccgcgcacggtgcccgcacctgtcgacgggctcccatcgaactcgcaccctcgctacgccgatccgtctcttctcccctaatcctccttccccgatccagtcccgcagcaacgccgagggagagcgaggagagacagatacagatcgcgcgctcagatgtcgtcggactcctcgtcgtgggcgcgcgccctggtgcagatctcgccctacaccttctccgccatcggcatcgccgtctccatcggcgtctcggtcctcggcgcggcatggggtatcttcatcacggggagcagcctcatcggggccgccatcaaggcgcccaggatcacatctaagaacctcatcagtgtcatcttctgtgaggctgttgcaatttatggtgtaattgtggcaatcatcctccagacaaagcttgaaagtgtgccaacatcccaaatgtacgatccggagtctcttcgagctggctatgcgatctttgcatctggtcttatcgttggcttcgctaatcttgtttgcggggtatgtgtggggataatcggaagcagctgtgcactgtctgatgctcagaactcatcactctttgtaaagattttggtgattgagatcttcggcagcgctctgggactgttcggagtcattgtgggcatcattatgtcatctcaggcgacatggccagcaaaagcttgatccttaccgttagtgctctgtatattattcggatggaatgtatcggaatatgcatgcggtccaacggactttccctgttcttttttcttttgcatcttttcggcaaaacacgaaatgttgcaagcgttgcgctaccgattgtagagttgctattcctaatgccggagcgttccaatgtgttacgatatcttgtaggtgctattgcttttgcaagacatttggcaattggcgtattaaataaatgcttgaactgaataagattagaattaaaaaaaaaaaaaaaaaaaacgaaacaaatactcctcgtgc

SEQ ID NO: 134 - DNA, 971 bp, Zea mays
ctcacctgacgggctcgcatcgcacccgccacccccaccgcacgcaccctctcgtcctctctgcgccgacccggctcttctcccccaacacaatcctccttccccgatccagtctcgcggtcgcggccacgctgagggacagcgagaagagacagacacagatcgcgcgcggagatgtcgtcggactcgtcgtcgtgggcgcgcgccctggtgcagatctcgccctacaccttctccgcaatcggtatcgccgtctccatcggcgtctccgtcctcggcgcggcatggggtatcttcatcacggggagcagcctcatcggggccgccatcaaggcgcccaggatcacttctaagaacctcatcagtgtcatcttctgtgaggctgtcgcaatttatggcgtaattgtggcaatcatcctccagacaaagcttgaaagtgtgccaacatctcaaatgtatgatccggagtctcttcgagctggctatgcaatctttgcatctggccttatcgttggctttgctaatcttgtttgcggggtatgcgtggggataattggaagcagctgcgcactgtctgatgctcagaactcatcactcttcgtaaagattttggtgattgagatcttcggcagcgctctgggactgttcggtgtcattgtgggcatcattatgtcatctcaagcgacatggccagcaaaagcttgattttcaccatttgtagctctgtaaattattcagatggagtgtatcgaaatgtgcatgtggtctaactgcattttcatgttccttttatgtggcgtcttttttggcagaacacgaaatgcggcgcgcgtaccgccaccgattgtagagttgctattcttactgccggagtactccatgtgtgttggatatcttgttggcatattaaataaatgcttggacaaaataaaatgaatttttttgccccccttaaaaaaaaaaaaaaaaaa

SEQ ID NO: 135 - DNA, 850 bp, Zea mays
ccccagtcaccgatccaaccatcgcaaagagagagagagagaaaaaaaaatccccgatccagcaccgagcgcgcaccggtggagatcgtggtgggaggatgtcgtcggactactcgtcgtcgtgggcgcgcgcgctcgtgcatatctcgccctacaccttctccgccatcggcatcgccgtctccatcggcgtctctgtcctcggcgcagcatgggggatcttcatcacggggagcagcctcatcggggccgccatcaaggcgcccaggatcacctccaagaacctcatcagtgtcatcttctgtgaggccgttgcaatttatggtgtaatcgtggcgatcatcctccaaacaaagcttgaaagtgtgccaacatcccgaatgcatgatccagagtctatgcgagctggttatgcaatctttgcctcaggtcttattgtcggctttgctaatcttgtttgcggggtatgcgtgggaataatcggaagcagctgtgcactgtctgatgcccagaattcaacactctttgtaaagatcctggtgattgagatctttggcagtgctttgggcctctttggagtgatcgtgggcataatcatgtcagctcaagcaacatggccaacgaaagtctaattccatccatctgggaatctctgtaaattattttgggtgaagccctttggaatgtcaacatgtgttcaactgtttcttatctattcttttttcttttgcacgtttttggtaaatcacgtattttggtgcttgatgcatctgatcgtagagatactgttcctactgtaaagactccatatgcctgccaggtatcatcttgtaggtgctattgcttttac

SEQ ID NO: 136 - DNA, 997 bp, Zea mays
tcgaggccggccgggggtcaactatagctgtggaggatcggggtgaaatgttgatgatgtgacctctcgtcctctctgttgggccccgccggcccggccgggaaccaatcctccttccccgatccagtctcgcggtcgcggccacgctgagggagagcgagaagagacagacacagatcgcgcgcggagatgtcgtcggactcgtcgtcgtgggcgcgcgccctggtgcagatctcgccctataccttctccgcaatcggtatcgccgtctccatcggcgtctccgtcctcggcgcggcatggggtatcttcatcacggggagcagcctcatcggggccgccatcaaggcgcccaggatcacttctaagaacctcatcagtgtcatcttctgtgaggctgtcgcaatttatggcgtaattgtggcaatcatcctccagacaaagcttgaaagtgtgccaacatctcaaatgtatgatccggagtctcttcgagctggctatgcaatctttgcatctggccttatcgttggctttgctaatcttgtttgcggggtatgcgtggggataattggaagcagctgcgcactgtctgatgctcagaactcatcactcttcgtaaagattttggtgattgagatcttcggcagcgctctgggactgttcggtgtcattgtgggcatcattatgtcatctcaagcgacatggccagcaaaagcttgattttcaccattagtagctctgtaaattattcggatggaatgtatcgaaatgtgcatgtggtccaactgcattttcctgttccttttctgtggcgtcttttttggcagaacgcgaaatgcggcgcgcgtagcgccaccgattgtagagttgctattcctactgccggagtactccatgtgtgttggatatcttgttggcatattaaataaatgcttggacaaaataaaatgattttttgccatcgaggccaaccgcctctatggatcaaccttcgatg

SEQ ID NO: 137 - DNA, 1325 bp, Zea mays
gacccgcttgccccgcgctcggacgcgtcccgatgcgcctccgccggccggaaaaaccctactagtcctagggctcgcctcgcctggggccctgggggccggccggggtacctcaccctgccgatcttttccgtggtcgcggcgatcgggtacgtctactacaccacggtgttcgtggccgtgccgcggtggctgggcctgtccacggctgcgggggtagccaacgccgccgcgttcacagcgctagcagctgcctgcctcgccacctacgccgtcgccgttcgcagggaccccgggcgggtgcccccgggtttcgtgcccgacgtcgaggacgccgagagcaccgtccacgagatcaagcgcaagggtggtgacttgagatattgccagaaatgttgccactataaacctccacgtgcacaccattgccgtgtttgcaagagatgtgttctgaaaatggaccatcattgcatttggattaataactgtgttggacatgagaactacaagattttcttggtctttgtattatatgctgtggttgcaagcttctatgcattgattctgatcgtagggagcgttttgcacagtgttcctaaagatgagcagccaggcagcgattcttctcgaacatccattattatctgtggggtcattctttctccattagcgttagcgctggcagtgctcttaggttggcatatttacctcatattacagaataaaactacaattgagtaccatgaaggagttagagcgatgtggttggcagaaaaaggtggagatctctatcatcatccatatgaccttggtgtctatgagaatcttatttcagttcttgggcctaacatattttgctggctctgccctgtattgaatactgttggaaatggccttcggtaccgtacatcctatgatcttccggtatctacaccaccaaaaaaaatagcagcacattcacaataggtagtagtgctaatttgtgaaaggatttcccattaagctgctaaaacgtgtttggtctgaacgattccgaaggcaggtcgtgtaactctgcaacatacaagagatgatgactaccacagcctctcgccaggtgtttgtcctgaatcgagacatgaactgttaaccttgttttttatttcattcttgacatacttgataatgtctcgcttgtaatctggagtaggctgttcttaccaaaaaaaaaaactgcaattctgttgtaaagttagttcgtatgtttgggagccatgtaatgtagccaaaggccatgaaaccgattttcccagagtatgtgtacatttgtaaaaaaaaaaaaaaaa

SEQ ID NO: 138 - DNA, 1417 bp, Zea mays
  misc_feature (27)..(27): n is a, c, g, or t
gcgggcctctgctccttccgcccgctngatctagggagcgcgagctcttcttacacgggcgcccgccgcgcccgcccccgacccgcttgccccgcgctcggacgcgtcccgatgcgcctccgccggccggaaaaaccctactagtcctagggctcgcctcgccgccctgatggggggccggccggggtatctcaccctgccgatcttttccgtggtcgcggcgatcgggtacgtctactacaccacggtgttcgtggccgtgccgcggtggctgggcctgtccacggctgcgggggtagccaacgccgccgcgttcacagcgctagcagctgcctgcctcgccacctacgccgtcgccgttcgcagggaccccgggcgggtgcccccgggttttgtgcccgacgtcgaggacgccgagagcaccgtccacgagatcaagcgcaagggtggtgacttgagatattgccagaaatgttgccactataaacctccacgtgcacaccattgccgtgtttgcaagagatgtgttctgaaaatggaccatcattgcatttggattaataactgtgttggacatgagaactacaagattttcttggtctttgtattatatgctgtggttgcaagcttctatgcattgggagcgttttgcacagtgtgcctaaagatgagcagccaggcagcgattcttctcgaacatccattattatctggggggtcattcttttctccattagcgttagcgctggcagtgctccttaggttggcatatttaccccctattacagaataaaactacaattgagtaccatgaaggagttagagcgatgtggttggcagaaaaaggtggagatctctatcatcatccatatgaccttggtgtctatgagaatcttatttcagttcttgggcctaacatattttgctggctctgccctgtattgaatactgttggaaatggccttcgtaccgtacatcctatgatattccggtatctacaccaccaaaaaaaatagcagcacattcacaataggtaatagttgctaatttgtgaaaggatttcccattaagctgctagaatgtgtttggtctgaacgattccgaaggcaggtcgtgtaactctgcaacatacaggagatgatgactaccacagcctctcgccaggtgtttgtcttgaatcgagacatgaactcttaaccttgttttttatttcattcttgacatacttgataatgtctcgcttgtaatctggagtaggctgttcttaccaaaaagaaaaaaaaaactgcaattctgttgtaaagttagttcgtatgtttgggagccatgtaatgtagccaaaggccatgaaaccgattttcccagagtatttgtgtacatttgtttaaaatgaaatgtaacatctgctgtacttttg

SEQ ID NO: 139 - DNA, 1152 bp, Zea mays
ggattgcgtcccgcgtcgccggccggcgagctcttcttaaacgggcgcacgccgcgtgcgcgcccgacccgcttgccccgcgctcggacgcgtcccgatgcgcctccgccggccggaaaaaccctactagtcctagggctcgcctcgccgccctgatggggggccgcccggggtacctcaccctgccgatcttttccgtggtcgcggcgatcgggtacgtctactacaccacggtgttcgtggccgtgccgcggtggctgggcctgtccacggctgcgggggtagccaacgccgccgcgttcacagcgctagcagctgcctgcctcgccacctacgccgtcgccgttcgcagggaccccgggcgggtgcccccgggtttcgtgcccgacgtcgaggacgccgagagcaccgtccacgagatcaagcgcaagggtggtgacttgagatattgccagaaatgttgccactataaacctccacgtgcacaccattgccgtgtttgcaagagatgtgttctgaaaatggaccatcattgcatttggattaataactgtgttggacatgagaactacaagattttcttggtctttgtattatatgctgtggttgcaagcttctatgcattgattctgatcgtagggagcgttttgcacagtgtgcctaaagatgagcagccaggcagcgattcttctcgaacatccattattatctgtggggtcattctttctccattagcgttagcgctggcagtgctcttaggttggcatatttacctcatattacagaataaaactacaattgagtaccatgaaggagttagagcgatgtggttggcagaaaaaggtggagatctctatcatcatccatatgaccttggtgtctatgagaatcttatttcagttcttgggcctaacatattttgctggctctgccctgtattgaatactgttggaaatggccttcggtaccgtacatcctatgatattccggtatctacaccaccaaaaaaaatagcagcacattcacaataggtcgtgtaactctgcaacatacaggagatgatgactaccacagcctctcgccaggtgtttgtcttgaatcgagacatgagctcttacccttgttttttatttcattcttgacatacttgat

SEQ ID NO: 140 - DNA, 1573 bp, Zea mays
gcacgagaccattacctagaacatcctaatcaaaacaggtccagcgagcgggccctgctccttccgcccgctgaatctagggagcgcgagctcttaaacgggcgcacgccgcgtgcgcgcccgacccgcttgccccgcgctcggacgcgtcccgatgcgcctccgccggccggaaaaaccctactagtcctagggctcgcctcgccgccctgatggggggccggccggggtatctcaccctgccgatcttttccgtggtcgcggcgatcgggtacgtctactacaccacggtgttcgtggccgtgccgcggtggctgggcctgtccacggctgcgggggtagccaacgccgccgcgttcacagcgctagcagctgcctgcctcgccacctacgccgtcgccgttcgcagggaccccgggcgggtgcccccgggttttgtgcccgacgtcgaggacgccgagagcaccgtccacgagatcaagcgcaagggtggtgacttgagatattgccagaaatgttgccactataaacctccacgtgcacaccattgccgtgtttgcaagagatgtgttctgaaaatggtgctgctagtgttaattctgcgattccattcttttaactgctctccagttttgtattttcacctagttcgcatgtgcaggaccatcattgcatttggattaataactgtgttggacatgagaactacaaaattttcttggtctttgtattatatgctgtggttgcaagcttctatgcgttgggagcgttttgcacagtgttcctaaagatgagcagccaggcagcgattcttctcgaacatccattattatctgtggggtcattctttctccattagcgttagcgctggcagtgctcttaggttggcatatttacctcatattacagaataaaactacaattgagtaccatgaaggagttagagcgatgtggttggcagaaaaaggtggagatctctatcatcatccatatgaccttggtgtctatgagaatcttatttcagttcttgggcctaacatattttgctggctctgccctgtattgaatactgttggaaatggccttcggtaccgtacatcctatgatcttccggtatctacaccaccaaaaaaaatagcagcacattcacaataggtagtagttgctaatttgtgaaaggatttcccattaagctgctaaaacgtgtttggtctgaacgattccgaaggcaggtcgtgtaactctgcaacatacaagagatgatgactaccacagcctctcgccaggtgtttgtcctgaatcgagacatgaactgttaaccttgttttttatttcattcttgacatacttgataatgtctcgcttgtaatctggagtaggctgttcttaccaaaaagaaaaaaaactgcaattctgttgtaaagttagttcgtatgtttgggagccatgtaatgtagccaaaggccatgaaaccgattttcccagagtatttgtgtacatttgtttaaaatgaaatgtaacatatggtgtacttttgcgcgccgaaaaaaaaaaaaaaaagggcggcccgtca

SEQ ID NO: 141 - DNA, 1270 bp, Zea mays
gccggccagttccgggataaataacttggcttgcccccggggccggccgggctcactccacagagaccacccacctgcgctgcgcctcggttttacggcccttccctcaccgccccgcgcgagcgaagccatgaagcttgaggtcatgcccaagcagcgggtgctggaggcggagcagagggaggaggccatggagatgagtggcctggacctgtggaagcacgagaagcccccaaggatctgctccttgcccccgccgctcccggcgccgccagcgtgcgacgaggcggcgctcgtgccgccgctcaacttcgccatggtcgacgacggcatattccgctccggcttcccggagaccgccaatttccggttcctcaagtccctcaacctccgctccatcgtgtacctgtgcccggagccgtacccagagacgaacacggagttcctcgagaagaacgggatcaggctccaccagttcggaatcgaggggcgaaaggaaccatttgtcaatatacccgatgacaaaataagggaggcgctcaaagttgtcttagacccaagaaaccaacctctgcttattcattgtaagagaggcaagcaccgaactggttgtttggtcgggtgcttgaggaagctgcagaaatggtgcttgtcttcagtcttcgacgagtaccatcgctttgccgctgcgaaagcgcgaatcactgaccagagattcatggagctgttcgacgtctcaagcttgaagcacctgacaccctcacattgttaaccccaaggcgcgtgatcgcttgatcccccccaacttctagtacatctccaaggctatcttcctgcagctactgaaccgattcagccgtgaataattttggaaccccctagagtccatgaggtagtgatgaaaccattgcagaacattcgtgcttgagaggtttagtttcccccctgcttagcgcactggagagcctgagaaccagactgctgcggtcgatttgcgaggggttctcttttttggtagctctcgcgaggaattcgccattgtttttgggtactgaagcagcatgtactcgagcagcttctgaggaggaatgaactactctctaagtgcaaaaaaggcgtgtctcttcttgcacgagtgtggttagggatactgcatattaacaagaggttgaaatagcatgataattgcctatttaagcctcaattagcccccaaaaaaataagaaatatttatcttgcatttctcaaaaaaaaaaaaaaaaaagcggcc

SEQ ID NO: 142 - DNA, 515 bp, Zea mays
ccggccggcaactctcccacaacagagaccacccacctgcgctgcgcctcggttttacggcccttccctcaccgccccgcgcgagcgaagccatgaagcttgaggtcatgcccaagcagcgggtgctggaggcggagcagagggaggaggccatggagatgagtggcctggacctgtggaagcacgagaagcccccaaggatctgctccttgcccccgccgctcccggcgccgccagcgtgcgacgaggcggcgctcgtgccgccgctcaacttcgccatggtcgacgacggcatattccgctccggcttcccggagaccgccaatttccggttcctcaagtccctcaacctccgctccatcgtgtacctgtgcccggagccgtacccagagacgaacacggagttcctcgagaagaacgggatcaggctccaccagttcggaatcgaggggcgaaaggaaccatttgtcaatatacccgatgacaaaataagggaggcgctcaaagttgtctta

SEQ ID NO: 143 - DNA, 6306 bp, Zea mays
cgagcaagccacgctgaagatgggaacgggccgagcagcccggctcagctcgacgcggctcagtggaggtgcgaggcgagccatgcttaactcggttcggtaacgactcacgagccggctccagtcagctcgcgagcctcacactaaatcatgtttagagtataaattatattttttattatatataagataaaaaattatgtataatatatttttagactacaatataagtgtatcacgaatcaagttcaagaaattcaataaaataggttcggtttggttcggctcgcagttctggcgagccacaaaaataggttcggttcgggctcgttttggctcgcgagccggctagccgagtctcaccgagtcggagccaaatttccaccatactccctaatatatgtcaacaaggtgttgatgatggtagttaatgtatggtgaagtgatatgggaaatgattggagagatgaaggtatagggagaagaattttacgaggagagataataaaatagagtatacaataaaataattatacggggagttaaatagggtagattgttagagatgtcttagaaccaaactactcctacggtcctacctggctaccttcacgcagctcttactccgatcctccatcctcatctaaacaaatacttctcatcttactttttttcgtcttcttccctataaataactggccttcccaaatcgcccacaactctcacacagagaccacccacctgcgctgcgcctcggttttacggcccttccctcaccgccccgcgcgagcgaagccatgaagcttgaggtcatgcccaagcagcgggtgctggaggcggagcagagggaggaggccatggagatgagtggcctggacctgtggaagcacgagaagcccccaaggatctgctccttgcccccgccgctcccggcgccgccagcgtgcgacgaggcggcgctcgtgccgccgctcaacttcgccatggtcgacgacggcatattccgctccggcttcccggagaccgccaatttccggttcctcaagtccctcaacctccgctccatcgtgtaagcgtctctttcgctctcccacgccgcgccgtctctcccttgaatcaccgcgaaagttgtcgcgtgctcgtgaggcgctctgaaacgttctggcgcaccaggtacctgtgcccggagccgtacccagagacgaacacggagttcctcgagaagaacgggatcaggctccaccagttcggaatcgaggggcgaaaggtaagaaaaacttggtttcaacgaaatcctctgctgcttcgtggttggttagccatagttcatggaggcgtagaattactttggatggattaaaatatggtttgctttcggtaacttccatgatgtacggcttgtttgccccgagccgacgctgctgatcatatgtcgtctcgtgtatcctaatttaattagtatttagtactagctgcgcttccgctgactatgtttggggagagttccagtgctttgctcaatgaaatttatttgttattgtacctgacttgcctgaaacgcagtgttatctagagaatttttcaaaattcacggcgaatcggtagtggtccctttcagcattgctttcattaatcaagacagctgtgttgctgatttagaacatttttccccaaatattctccaagtgtttttttattgttgcgttcctctgaatacaagcctaccaccaccagcgtgtacgcatcaccgcttttggcttggagcatctccatgtgttgcctttatttcttttttttttgtgattttcccttattttggctccatgctatgttttctttcgctgtttctgcaaattaggtaaatcatgcaattactttgagtcgttcagttaatagtaccttttattacaactcccgtcatgttctactgtttgtatcctgtacttcgtagatgtttgctagatttctttttatgggcagtttcattggtttcagaggaaacaagcaattcttgctggcactatgttttcttttctccagtttgtgatgtttcttttgattgtgcatttgtgctgacagttatactgaacttggtaactttatcatatttttgcactctaaaatccatcaatcattccgttgtttcagcaccttgagctgttcagcttccttctgtgtttggcagcctaatcaattatggggagatatctatgtggtaatggctgtgtcaaacagcatacacgatttttttagaaatgtaaccgatttatctttatgagtttgtgagaaaagctgcaagatattcctgtaacttcagcaatgacgtctgaggataatgaatgcacgataaagaagtgtcacagaagttcgttgtagaatacctctatgttgatggtgcctaggaatagatacactgactgactgacgcattgcacaatacgtagcacaatgtgcattcatacatatcgctatttttttttttttttttccttatcagatgaatggtacttccggcatggggcctttttttacctgcaggggtaagacaacccacaagtattgtattaagaagactttctcacagaaaacccctgagaccctgcctcacccatacacagcggtatcgaagctcatgtgagaacgaccgcgacaggggctgagtcttagacctatgctttggcgcaggacagacgaggggatcttttaactacatctgaaattcgctcccacggggagtcaaacctagaacctgaggagtgctatctagaccaactaaccaactcgcctagaggccctttcgctaccagcatgggcctgatgtagtgttttgagaaaaaataatttttttacttcatgagtctgggcatggacaataaattgattttttttactggaaataaagttttgtaaccatgtctgaccttgctgccatgtaaaattgtaaatttctgtataaacttacatgtatatttaaatgaatctgtttcccatgtttttttgtccattgtactgaatcacagataccgttatatttgaaatgtattttcacactaattcagggcattcttatgttatgtcactatgcaaaaattgaatatgtaagaatggtacaatttcaacaacttttcttatatgaaaacataatttaaaggggagcatgattgttttatcttcatgattgtttcaacaacttttcttatatgaaaacataatttcattcttcatgattgttttatctttctgtttgaagtttaagtcctccatgacatgatgcaaaacttgacaacaagaataatttctgtcaactcattgaatggttgggagtaagtctgtctctcagctatatgaactagctgaaatttgctgggtgaaccgttcataggtccacagctgctgctaatccacagtttgccattatctaaaggtgtttttgaggttcatgtagtatttctcgataaaaataactctatcaggatgatttacatcattggaaattccattttacttttactttttttactaggaaaactttgactcctcattgacataggaaacttgtttttcctttgttaattattatgggcccagttgacataggagaccactgaaagctggactgtggagcactcatgcacaactcacattctgtcagttttcaaggaagtggtcgtattgtatatcctcttctattgaccttactgcatttctgcccagtcatttatgtacggcagtatgagtaattctctggacttcagtttctggataagaaaattgactcctttaggcagttataagaaaggagccttctgcataccgttttaactgcagttaggatttacaatcgtctaaaccttgtttgcctcgtttgtcgtcaaatatggttcttgttacagctgaactgctggagtccatgagtttttttttcatccaagtcctcattctcctcatgattggtctgataatcctcctttgggtcgtcctgcaggaaccatttgtcaatatacccgatgacaaaataagggaggcgctcaaagttgtcttaggtactgcacctttctaagtttttttatatgaagaatgtatagcttttcgctttctacaaatagggatgcaaacagccaactccctctgttgcaataagcatgcaattctagcctccatgccatgtcccacaaagaatgaattagagcttcataggctaggcaattggccccacatgtaaaaaaactactccgattcattcctgcccacatagctgtctgagccccccacggagtactagttcgaagcaaaagaaagtgagctgtgtgcgtgacatttctccggtctgctaggtgtgcctcgggaagctaggattgaacctttcttgcacacttgcatcatagaattgtaatctcacttgtatcttttattctcctttgcagacccaagaaaccaacctctgcttattcattgtaagagaggcaaggtaagatcagctctcagtttacaactgtttgtggctgctatcccaagaaacaactgtgaccctggttctgaactaactgttcgatatttgcatatctgcagcaccgaactggttgtttggtcgggtgcttgaggaagctgcagaaatggtgcttgtcttcagtcttcgacgagtaccatcgctttgccgctgcgaaagcgcgaatcactgaccagagattcatggagctgttcgacgtctcaagcttgaagcacctgacaccctcacattgttaaccccaaggcgcgtgatcgcttgatcccccccaacttctagtacatctccaaggctatcttcctgcagctactgaaccgattcagccgtgaataattttggaaccccctagagtccatgaggtagtgatgaaaccattgcagaacattcgtgcttgagaggtttagtttcccccctgcttagcgcactggagagcctgagaaccagactgctgcggtcgatttgcgaggggttctcttttttggtagctctcgcgaggaattcgccattgtttttgggtactgaagcagcatgtactcgagcagcttctgaggaggaatgaactactctctaagtgcaaaaaaggcgtgtctcttcttgcacgagtgtggttagggatactgcatattaacaagaggttgaaatagcatgataattgcctatttaagcctcaattagcccccaaaaaaataagaaatatttatcttgcatttctcactttggactcgcatttctcagtttggacaccataaacttaaaatgaaggaaattttcccttaaaaactgcatattaacatatgtgtgcattgaacggaattcaaattctggccttaaatgtcaaatgcacatatttaaatggattcaagatgagaaaggttgatactacactctttcaccaaaaagtttggaaatgattttttatgccaagtatatattgatgataccatctttggatcaataaatcgagatttttatgaatagtttggagagatgatagcccgagtttgaaatgtcaatgatttgtgggattagctacttccttggacttcaaatcaaacaaatgaaaaatgaaacatttgtgagccaaggcaagtatatcaaggatatgttgaagaaatttgggttggatgaacaaagccaatttacacaccaatgggcaataatggtcatttgaacttaaggtacaagtggtgatgtgattgatcaaaagctatattggtcaatgattgaaatcctactctatgtgactacatcaagcttagatataatgtttagtgtatgcatttgtataaggttttaagcctcgcctagagatagtcatttgaaagaaacaaagagaatgttgaggtgcttaaagcatacaccaaatactgctctttagtatcctaaggggttacattttgagttgattggatatttggactccaattatgtgggatacaagatggataaaaagagtgaatcacccacatgtcaatcttggttatccaagaagcaaaattcaattgcactatcaacaatcgaagcaaattacatttctgttggaagttgttgtacataagtattatggatgaaataaacattgctagattataaaaaccaaattcacacaaagtatcattgttatgttataataagaatgccatcaagatcgccaccaacctagttcaacactcaagaacaaaacataatgatagctaccatcacttcataagagatcatcaatccataggggatattaccattgagagtgtgcacactgaagatcaacttgtcgatatattcaccaaaccaattgatgaaga

SEQ ID NO: 144 - DNA, 1626 bp, Zea mays
ggaccctcgaggccggccgggctcatctatacaaatacttctcatcttacttttttttcgtcttcttccctataaataactggccttcccaaatcgcccacaactctcacacagagaccacccacctgcgctgcgcctcggttttacggcccttccctcaccgccccgcgcgagcgaagccatgaagcttgaggtcatgcccaagcagcgggtgctggaggcggagcagagggaggaggccatggagatgagtggcctggacctgtggaagcacgagaagcccccaaggatctgctccttgcccccgccgctcccggcgccgccagcgtgcgacgaggcggcgctcgtgccgccgctcaacttcgccatggtcgacgacggcatattccgctccggcttcccggagaccgccaatttccggttcctcaagtccctcaacctccgctccatcgtgtacctgtgcccggagccgtacccagagacgaacacggagttcctcgagaagaacgggatcaggctccaccagttcggaatcgaggggcgaaaggtaagaaaaacttggtttcaacgaaatcctctgctgcttcgtggttggttagcgatagttcatggaggcgtagaattacttttggagggattaaaatatggtttgctttcggtaacttccatgatgtacggcttgtttgccccgagccgacgctgctgatcatatgtcgtctcgtgtatcctaatttaattagtatttagtactagctgcgcttccgctgactatgtttggggagagttccagtgctttgctcaatgaaatttatttgttattgtacctgacttgcctgaaacgcagtgttatctagagaatttttcaaaattcacggcgaatcggtagtggtccctttcagcattgctttcattaatcaagacagctgtgttgctgatttagaacattttttccccaatattctcaagtgtttttttattgttgcgttcctctgaatacaagcctaccaccaccagcgtgtacgcatcaccgcttttggcttggagcatctccatgtgttgcctttatttcttttttttgtgattttcccttattttggctccatgctatgttttctttcgctgtttctgcaaattaggtaaatcatgcaattactttgagtcgttcagttaatagtaccttttattacaactcccgtcatgttctactgtttgtatcctgtacttcgtagatgtttgctagatttctttttatgggcagtttcattggtttcagaggaaacaagcaattcttgctggcactatgttttcttttctccagtttgtgatgtttcttttgattgtgcatttgtgctgacagttatactgaacttggtaactttatcatatttttgcactctaaaatccgtcaatcattccgttgtttcagcaccttgagctgttcagcttccttctgtgtttggcagcctaatcaattatggggagatatctatgtggtaatggctgtgtcaaacagcatacacgatttttttagaaatgtaaccgatttatctttatgagtttgtgagaaaagctgcaagatattcctgtaacttcagcaatgacgtctgaggataatgaatgcacgag

SEQ ID NO: 145 - DNA, 1329 bp, Zea mays
aacctgattgcacacgatattttctaggcaaaaacctctcatgctaccttttgtttttcgccttcttccctttggataccgttcgacgcggccggccgggcagcacccacccgcgcgccgtgcctcggttttagggcccttccctcaccgccccgcggccatgaagctggaggtcatgcccaagcccaaacagcgggtgctggaggcgcagcagagggaggaggccatggagatgagcggcctggacctgtggaagcacgagaagccgccaaggatctgccccttgcccccgtcgctcccgccgccgccgccagcgttcgacgaggcggcgctcgtgccgccgctcaacttcgccgtggtcgacgacggcatcttccgctccggattcccagggaccgccaacttccggttcctcaagtccctcaacctccgctccatcgtgtacctgtgcccggagccgtacccggggacgaacacggagttcctagaaaagaatgggatcaggctccaccagttcggaatcgaggggcgcaaggaaccatttgtcaacatacccgacgacaaaataagggaggcgctcaaagttgtcttagacccaagaaaccaacctctgcttatccattgcaagagaggcaagcaccgaactggctgtgtggtcgggtgcttgaggaagctgcaggaatggtgcttgtcttcagtcttggacgagtaccatcgctttgccgctgcgaaagcgaggatcactgaccagaggttcatggaaatgttcgacgtttcaagcttgaagcacctgacaccctcacactgttaaccaaggcgtgtgatcgattggtcccccaactctagtacatctcaaagcctatcttccgtcagctactgaaccgattcagttgtgaataattttggaatccgctagagtccgtgaggtagtgatgaaaccattgcaaaacgtttgtgcttgaatggtttattttcctcctgcatagcgcactgcagagcctgagaaccagattgctgtagtcgatttgcgaggggttctcttttttttttggggtacctttcgcgaggaactcgccattgtttttgggtactgaagcatgtactcgagcagctttgctaaggagaaatgaactattctcaaagtgctaaaaaaaaaaaaaaaaaagccaccagtgtagttagggatcctgcatattaagaagaggcctaaacagcatgttaattgcctagataggcttcagttatcccaaaacattggagaatattaattgcatgtctcggattgaagttcataaactgaaaatgacgtaaaatttccggtatattccc

SEQ ID NO: 146 - DNA, 1467 bp, Zea mays
agcagttcacagttaagtcttctcattcccatcatctctcgccatgcgcccaacacgctccgctgtgtcggctacggcgctgctcctgcttgccgtggcactggcactggccgccacggcggcggcccgccactcctacaccaccaccaccacccgcgtcccggcgccagcggagcgggcggacgaggaggtgcggcgcatgtacgaggcgtggaagtcgaagcacgggcgcggcggcagcagcaacgacgactgcgacatggcgcccggcgatgatgagcaggaggaggaggaccgccggctgcggctggaggtgttccgcgacaaccttcggtacatcgacgcgcacaacgcggaggcggacgctgggctccacaccttccgcctcggcctcacccccttcgccgacctcaccctggaggagtaccgtggccgcgtcctcggctttcgcgcccgcggccgccgcagcggcgcccgctacggctccggctacagcgtccgcggcggcgacctccccgacgccatcgactggcgccagcttggcgccgtcaccgaggtcaaggaccagcaacagtgcggtgggtgctgggcgttctcggcggtggcggccatcgagggggtgaacgcgatcgcgacgggtaacctggtgtcgctgtcggagcaggagatcatcgactgcgacgcccaggacagcggctgcgacggcgggcagatggagaacgcgttccggttcgtcatcggcaacggcgggatcgacaccgaggccgactaccccttcatcggaaccgacggcacttgtgacgccagcaaggagaagaacgagaaggtcgccaccatagatgggttggtggaggtggcgagcaacaacgagacggcgctgcaggaggcggtggcgatccagcccgtcagtgtcgccatcgacgcaagcgggcgtgcgttccagcactacagttcgggcatcttcaacgggccatgcgggacgagcctggaccacggcgtcacggcggtgggctacggcagcgagagcggcaaggactactggatcgtgaagaactcgtggagcgccagctggggcgaggccggctacatccgcatgaggcgcaacgtgccccggcccacgggcaagtgcggcatcgccatggacgcgtcctaccctgtgaaggacacctaccacgaccccggcaccgccacggctacggcagctgccatggatgtgatcaagatggttcttgcttaggagggagcgagcggagcaggcagcagagagccgagggtcttgtcgtgttgaactttacatagggtagctaggtaccactggggataattaagttaatccgttatggtgtggcaagttaattaatatgcacgtatctcttttgatgagtgccatatatgatgtaatgaagttacataaactcaaataaagtcgtaatcgtaatggtaaaaaaaaaaaaaaaaaacttccaa

SEQ ID NO: 147 - DNA, 5333 bp, Zea mays
  misc_feature (219)..(219): n is a, c, g, or t
  misc_feature (721)..(721): n is a, c, g, or t
  misc_feature (837)..(837): n is a, c, g, or t
  misc_feature (861)..(861): n is a, c, g, or t
ttcgctcctttgctgatattgatttggcgactgaggttgctctaagaaaacaagaactttggtgagactttatagaccctgttcatttcagtttttctgtagagaaatctaagtgtcacgaggattacatatatagaaagataaatgattttatagagtttaagatcaagatagtgacggatgcatactatcacgatatgcatactatcatgatggctntgcagattctatatttacgttaattttagatggttttcactaaaaacgattctcacaaaagcgagctgattctgacggtcagaagctgaaacaaacaagcccgttatcaaagaagaattacaggagtttgttaaaaaaaagaattgcacaagtaggaaattatgcttgaaaatcctaattttccggtaacaccaatacaccatggaccatggtgcgcggggtagttgcagctgttaggagcaccgagcacaataatttgtctgttcttcggcctccatccccgcaggagagagaaagagggagctctagacggggaggctcccaaatcgatattttttcgcatctgttcgttctccgacgcggcggcgaatctgagaacccctcgctgagtggtcggcggcgagtccgtgatggtcggcggccggcgggcgcggacatgcacaaccgctcctcctcctccgccgccgctgcgtcgtcgttgccgctctcccccgccgacggnttcctgcgcggtagtaaccgtgacgaccaacctccctcccccgttctcattctcgctactcttctgggattcccgtcgagcacctcgcttaccgcatgattttcgcctgtttcctnggtcgtctggtggtggctgtgcantgaaggacggcgtggacggaatgatcaagtacgtcgccaacgagccctccgtcgggctctacttcgtccagcagcacgcccgggcttccatgcccctcctccttgacgtcaaggtccaccgcctggccttgcttcgcttccttccctttgcgcatgttgagctgtgctttgggggattaggaggcgatttgtctgtaaggaaagcatatcacccaagggatggatgaaatcaaagatttgtgctttattgggagacaagctgaaaagaataagatattcttttgtgtgtctttgctgcattactagcaaattagggtgtgcatatctagtagcttgttagttggttgcatcgcagatttgagtttatgcacatccttactagattaccatgataccgttcaagtgcttggtctaatataatttcttgctgttgggtatctatatggtttagtttggatacagttaagctttagtgttgtgcttgattagcaactaggtttccagtggtgtaggattgcaggatatagtttcatgaaaactattcactgtttttaatggctttatgagcacaaatttgtgccacttttttagtgtaagataagatgtaggcccgtttggttagagggactaatctttagtcccgtttagtctcaattttgccaaaaggaaggactaaagtagggactaattggttctagtccctcacatgggtgctaaaagggactaaagggcaacatttactccaattgtccttgcctagaaaactggtgtgaaacaagaaaagaggtattttggtatttttgtgttgcatttaatgtttagaatatgtgtagtccctacaactaaacaaggtagggagtaaagtttagtctttgagctaaactttagtcataggactaatggaaccaaacgggccatactatcatctgaattagtcaaatacaattctgtagcaaacaaagtaatatttgtcttgctgctggtaaatctgctgaaccgtctgttggtgtggtctgctattggtagttggtacaacaaatcaagatgctgcatttcatgatctttgatctaacacaagttttgtttctgtcatcagggtaagctcgtagagaagacgcgtgaggtgacattgcacactgaagacatggaggattctatttgcgctgtgagatccatggctgattttggacttccacttgctgatgacatgatcaaggacataaatagatcactgcaaataatgtcaaagacccagccaaagagagggtacagatatactaattcttgggaactttactttatttttacgattattagctttacaagtatgctagacttttttcttcaccttttttatgactaaaatgtcttggcctttttgccttattcatttaagagcagtccaacttcatatcttctatatatagtctgaagttaattatcttttgcataagctctccagttaggttccaaaccaggatcttgcttcttagccaataaactactatagaacttcacttgtcaaacccataatgccctgttgtacatatcttgttttggctgaacgtcatcttgtatggtttgttttaagacaactttcattgctatcaggttgatccaaaaccccagttgggggttccagtcaaggaaaagcccaggaactggggccgaactgggctctaccaatggaagtagcagcaggaactacctctcttcaatgttcaacaccgcgaagcaaaaggcatcaggtctcaggtggccgcagcctgattttgcaacaaaagatgatactagcgagaactcggcgtcgtcttctgccctggaatcgccacaagctggtgggcaaggtgcatctacaccagatacagagaaggatgagctccccatttcaagtcggttgtcagagggtacggccgcaaaccgtagcctgcctgctaccggcgtctcggaaacagtggaggcttacaacaagttcaaagaagagcaggagctgaagcttcgtgagtggcttagagactctgaagaagccgtcaatgataaagactgagtgtgctaaagctgcttcggccctgtgcctctgttattagatatatggtacattctgaactaaaaagaaacatagcactctgttcatgaaacagaggttgattggtatagatgcacaagatgccgaaagactgtagtttgtgatgaaggggttggtccggacgattgtaacgtgacttatttatagatgccattgcatagtgtttgtctcaaacctcatgtaattgaatcacgatagataatagataaaagatgttgtctgtttctgttcttgtgatccaagtatacagctcccagcatataagcattggaaagtttctgtatctgactcctatgatcctatcagcagttgccccaacagcatctcaagttttcaacacagaacaaacaagatcacagctgctccgcctgtgtggtcagttcatctagttcttgtcagagcacgcaacgccgtgtcagccggtgctagtttttattccgaaactgattctatttttttacagtattttatctctgaattgtagcagtagcgttcgaacagctggtttaactggtttaaagctgcagcgaacagaattggtttgaagataattttaacgtctcctgattacgcattcccatgtgcgtacatgccgagtgcattcgcgtatatgctgaactctaaagccttagacgagtctccgtgtaccaatggattgaatatggcaatccaaaaaggatttcgcactaaacgagctacacttgaaattaggaataaaatatttttttaagtttgggtaaaataaacaaacatctagagttatcctaataactcagactatattttaagttggaccgaggtagcatttgaatgaattaatggtttactgccttgtttagaggtaaattgaagtcgaacgttaaataatgacaaatgaaagaagccaccaggataccgcgcatttatctcatgctaatctttcctgctatataaaccagaccaaccctgcaggctgcagggtgaagcagccggtagtactcaaccctcaacacacccagtcacaatggcgacatccgtgaagcgcagccacagctgcagatgccaagtactcttcctgcttgcgttggttcttctggcattcgtctctgcgagtcctacacccatcagcggcaagtagtgcacgactcagtctcgtattttggccatatacgtttcggtttgtacccgtcgtcggttcatctgttccttttccttggacatggagaagatcgattacatgtctgtttgcgatgttcaggtcagagcattgacgacggcaggaagagcaagacaacgggtcgtcgtcggcggcggcaacgaggcaatcgtcgacgaggacaacgacatattcaacgggtgccactacaataaccagaatccccattattcggtcggcgctgttctgctgcagcagggacaaagctgtgctgggcgtcgtttgccggagtgcgccgcccactgcccttgcaagacgaactgctagacgatgatgagcttcgagtctccagttcatacatgatccatggttgtgttattggatgaagatgtactagagaggcaatcgccaaagatgcagtcttgatagcaactgagaataatcgtacgatagatattgggctaaaccaggaccaggagtatccaaaaattgttttatagcacccttggccccggcgccccgccctcaccaatcatgcatgcgcactgctccacctcacgccgcctcctcctctccgccccctcgaccgcgcttccactaccggtggtcggcggctctcgctacctcacctcacgccgccgcgatctcattcctaccctctcctgaccacagtgttaccaacgaccactttgccacgacgcctctgccctagctccgcccaaccgttgcctcgaattgcatcctctcatgacccgattgtatcctctaatggcaaaataaacacaacacatcaccttggaccttaccacaatgcgggcgatccaaatttttccttgagactcttaaaaattctagttcaaaaatgaatacaaatagaggctgattataatccgattcgatccttaaattttgcttacattttgtagtgtaaaatctagagcccgttatcacccctaaccacaccgcatcacatctattggaaaatatgacatatgctcaatcccccaatggatgtgacggttatctcgccaagcaacacaccttttccttcacttttatatatatattaggtgagtgcccgtgcgttgcaacgagaccactacattgcaacctttaatatcatacagacttctctatatgatagtacaatacttgcacattgctacggtttatatatatcataatagctacatgttagatcaaggacacacataattgagaggtaaaaattagattccacatactttctcg

SEQ ID NO: 148 - DNA, 1339 bp, Zea mays
aattttccggtaacaccaatacaccatggaccatggtgcgcggggtagttgcagctgttaggagcaccgagcacaataatttgtctgttcttcggcctccatccccgcaggagagagaaagagggagctctagacggggaggctcccaaatcgatatttttcgcatctgttcgttctccgacgcggcggcgaatctgagaacccctcgctgagtggtcggcggcgagtccgtgatggtcggcggccggcgggcgcggacatgcacaaccgctcctcctcctccgccgccgctgcgtcgtcgttgccgctctcccccgccgacggcttcctgcgcgtgaaggacggcgtggacggaatgatcaagtacgtcgccaacgagccctccgtcgggctctacttcgtccagcagcacgcccgggcttccatgcccctcctccttgacgtcaagggtaagctcgtagagaagacacgcgaggtgacattgcacactgaagacatggaggattctatttgtgctgtgagatccatggctgattttggacttccacttgctgatgacatgatcaaggacataaatagatcactgcaaataatgtcaaagacccagccaaagagagggttgatccaaaaccccagttgggggttccagtcaaggaaaagctcaggaacttgggacaaactgggctctaccaatggaagtagcagcaggaactacctctcttcaatgttcaacaccgcgaagcaaaaggcatcaggtctcaggtggccgcagcctgattttgcaacaaaagatgatactagcgagaactcggcgtcgtcttctgccctggaatcgccacaagctggtgggcaaggtgcatctacaccagatacagagaaggatgagctccccatttcaagtcggttgtcagagggtacggccgcaaaccgtagcctgcctgctaccggcgtctcggaaacagtggaggcttacaacaagttcaaagaagagcaggagctgaagcttcgtgagtggcttagagactctgaagaagccgtcaatgataaagactgagtgtgctaaagctgcttcggccctgtgcctctgttattagatatatggtacattctgaactaaaaagaaacatagcactctgttcatgaaacagaggttgattggtatagatgcacaagatgccgaaagactgtagtttgtgatgaaggggttggtccggacgattgtaacgtgacttatttatagatgccattgcatagtgtttgtttcaagcctcgtgtaattgaatcacgatagataatagataaaagatgttgtctgtcaaaaaaaaaaaaaaaagcggcc

SEQ ID NO: 149 - DNA, 1260 bp, Zea mays
cattgggtacctcgaggccggccgggctttaagacccacatctggccgccgccccgccggcagccctaattttccggcgctacttccaaatagtcgccctctcaacttttgttgggtccgtctgtggattgtccccggcctcctttccgtcgcgtccaaatcatcctcacaccccgcagcatctccacgccgccacacctcgtcgcgtcgcgtcgtctccgccgagaagatggtcggaccaggcctctacaccgagatcggcaagaagaccagggatctgctgtacaaggactaccagacagaccacaagttcaccctcactacctacagctccaatggcgtcgctgtcactgctactagcacaaagaaagctgacctgatcttcagtgagatccattcacagataaagaacaagaacatgaccgtagatgtgaaagcaaactcagagtcaaatatcattactacagttactgtcaatgagattgcaacaccaggactgaagactatcttaagctttgctgttcctgatcagagatctggaaaggttgagcttcagtatttgcatgattatgctggagttaatgcaagcgttagtctgacagccaatcctgtagccaacctctctgctgcctttggcactaaggctctcgcagttggtgcagagatctcatttgattctgccactgggaacttcaccaaatacaatgctggattgatgttcactcatgaagaccttatcgcatcccttaatatgaacaacaagggagacaaccttactggagcttactaccacaaggtgagcgaattgacaaacacagctgttggggcagagcttacccacagtttctcgaccaatgaaaacaccctcacctttggcgggcagcacactctggacccactaaccgtcttgaaggcacgcatcaacaactctggcaaagccagcgccctgatccagcatgagtggaggccaaagtcgctggtcaccatctcggctgaggtcgatacaaagaccattgagaagagctcgaaggttggaattgctgtggccctcaagccctgattgattatcaagactattttttcttctaaggtcctagcatgactgtttgggtcatatcaggtcagctggggaaaacaaaactgttggggttaccggcatcttttggtcgttgcagtctgttgatttcatgaactgcaaaatgtttcattgaggaaatttttgggtcatctgcttagcgctctgttaaatgagcaacttcc

SEQ ID NO: 150 - DNA, 1644 bp, Zea mays
tcgagtagcacccggcgggccctgcgtggcctcatctctctcttcctcttctcccgccgcccagcttctctcttctctcggcggcgccaccacggcgatcaagcgcgatacgggcgtaaccgaagaatcgacaatgggcggcgagaaggaaacctttgatacgtccgacctcaacgcctccctccccgcggccgctgcagccctcagcgccgaggaccgcgccggcctcgtcaatgcccttaaggataagctgcagagcctggcgggccagcacgccgatgtgttagagacgctgtcgcccaatgttaggaagcgggttgagtttttgagagagatccagagtcaacacgatgaaattgaggccaagttttttgaagaacgagctgcccttgaggcaaagtaccagaagctttatgaacctttatacacaaagaggtatggaattgtaaatggagaagtggaggtagatggtgtttgtgatgaaccggccagtgagaatactgttgagggaaaagaaccagacgctaaaggagttccagacttttggcttactgccatgaaaacaaacgaggttttgtctgaggagatacaagagcgcgatgaagccgctttgaaatatctaaaagatatcaagtggtctagaatcgaggatcctaagggtttcaagctggattttttctttgatacaaacccattcttcaagaattctgtcctgacaaaaacgtaccacatggttgatgaagatgacccaattttggagaaagctattggaactgaaatcgagtggtatcctgggaaaaacctaacacagaagattctaaaaaagaaacctaaaaaaggttcaaagaatacgaagcctatcactaaaaccgaggactgtgagagtttcttcaactttttcaatcccccgcaggtccctgaagatgatgatgacatcgatgaagacactgctgatgagctgcagagtcaaatggagcatgattatgacattgggaccaccataagggataagattatccctcatgcagtttcctggtttactggtgaggctgtgcaaggtgaggattttggtgagttgggcgatgatgatgaagatgatgatgatgaagacgatgacgaagatgatgaggatgaagaagaggatgatgatgaggaagaggatgatgaggaagaaagcaagccagcaaggaagtcaggatctggtcgcagacataaggcgccacagaaggtgtcgcagggaaatgcggaacaaccagcggagtgcaagcagcagtagaatggcctgttgatgttggttgatgcagtattttccattgagctgcctagaggttatgtgtgcgcaggccagatgttggtgttgatatctcaagtgtggtttttattagtaggcggtgagggtgttgtctggagcactttggtgctgcgttggtggatggatattggtttgcaacttgtctgctagtgtcttggggattcagctacgtgcaatcggatgatattatatggttgtaattatctttgcactcggcctataacggctctttatttgcactgggtcaaaaaaaaaaaaaaaaaaaaaaaaaactcgaagaggggcgccggtaccaaacccacgcgtccgcccacgcgtccgcggacgcgtgg

SEQ ID NO: 151 - DNA, 1565 bp, Zea mays
gcttcaccctccctgctcactgccgcctaccctcgttgaagcgcgctctctcgctctcgctctcctcgcgcttcctcccactcccactggacagagaggagggttagtggagggaacagcgttagctaggggggaagcacggaagcgggaagcaatggcgaccggcggcggcagcagcaggagcgacgacgtgcgcgggctcaagtttggcaagaagatctacttcgagcaggacggcgggagcgggagcggggcgggggcggtgggcggcaggaaggggaagggcgtggccaccggtggcgcgaggccggcgtccgccgcctccgcagcccagccgccgaggtgccaggttgacgggtgcggcgtggatctgagcgccgtcaagcagtactactgccggcacaaggtgtgcaacatgcactccaaggagccgcgcgtcttcgtcgccggcatcgagcagcgcttctgccaacagtgcagcaggttccaccagctacatgaatttgaccaagggaaacgtagctgccgccgccgcctcatcggtcacaacgagcgccggaggaagccaccacctggacctctcacttcacgatatggccggctcgctgcatcacttcaagagcctggcaggttcagaagcttcctgctcgacttctcgtacccaagggttccaagcagcgtgagggatgcgtggccaggaatccagcacggtggcgacaggatgctgggcaccgtccagtggcatgggcaccaagaacctcctcacccacaccgcagtgcagctgctggctatggcaaccatgctgcatacaactgccatggcggcttggtagcaggcggggccccaatgctctcctctgccgcctttgagctcccgcctggcggatgtgtcgcgggagttgccgccgactccagctgtgctctctctcttctgtcaactcagccatgggacacgacctcccacgaccaccggtccccagcaatgcccgcggccggcgccttcgacggcaccccggtggcgccgtccgtcatggcgagcagctacgcggcgtcgagcgcctggacgggctcgcgggaccccgctgccgacggcgccaggaacgcgcagcgtctcgacgatgctctgcacctggtccacccaggctccgcggcggtccacttctccggcgagctcgagctcgccctgcagggaagcggcgggccgccacacctgccgcgcgtcgaccatggcggctccggcggcggcaccttcaaccattccaccaccagcgcgatgaactggtccctgtagcagcactgcctgccttcatccggtcgccacgccacgagatgtggagggagcacttttgcattggacaccaccctggttttgtgcgccttaccttgccgttctcgttttttcagggtggagaaactgggattcctaaccatagtagatctaccgtgaattcccttcccgtgtagtagcgcattgcgtccatgaactcatttgaccaaaaaaaaaaaaaaaatgtgcgtaactgcgtatctgtttggcgtaaaaaaaaaaaaaaaaaaaaaaaaaa

SEQ ID NO: 152 - DNA, 3710 bp, Zea mays
gcacgaggctaagactcaacacaagcgcccccccctcgtcgcagtcccgccgttacatggcccgctctgttcccctttccggcgcccgcgacggactgcgacgagcggatagatagatctgtgccccgtccctgtctcgccatcctcctttctcctcctccactccctatcgactatcgagcagagcgaatccttagcggggaagtctttccgagctcagggagtggggtttaaaacgcggctcgacgaaaggaaggccgcactcgctgctgctgctggtcgcttgctttcggtggcgagcgtctcggtaaagcggcgtcggcgtcggaggcggcggcagagactggacttgcttgctccttgctgcgcagtgtagtgctgtgctaccttggagacaggatcctgccgcagggactcagggcttcttctttctgtgtgccccttcataagagcgccacctggtttttccggtcccattctctcgtccctgctcggcccgtcccaccagtgctctgttccgtgcgaagaagatgtgaagcgatttttttttggtaaagatatgttaagcggacgtcctcgattgatgctttcacgcacaggcgagaagcgagatgcctgaaatctgaaaacaattgcagcatatgaggcgccgtgatttctttaacacgcgcagccgcaagaaacgggagtaccgtttttttcctctctagttgttgtgacctggactcataattgatcagtgtgccccaacataagagcgaaacgtgactgagtttgccagctcccccttcatccactgtggtcgctcgtctgctaatgcccgcatcggaggattgctcacggatatgcttctggtgatgggcaacccggggcgctcgcggcagttgtcagcgctggttgcttccgccgccatcttgctgtcactgtccgcgttgccaatttgtcggccctacacctacgagcaagatgtgtttgcgataaacggcttgtacacggcacttggagcaccacagctgcctaattggacttcaaatggtggtgacccctgcaatgaaggctggcaaggtgtttcatgtgtagcgtcaaatataacctccataattctcagcggtgcaaatttaggtggacagctgggcaacactttggggaattttacatcattaatcaccttggatctcagcaacaacaatattggagggaccataccagatggtctaccactcacaatgcagagatttttcctttcagctaaccaactaagtggtagccttccaagtacattgtcatcccttacacttttgacaagcatgtcactcaatagcaatcatttgactggagcgataccagatgtattttcagcactcactggacttgcaaatttagatttttctgataacaatttgaccggtccgttgccaccttcaatgggaaatttgacatcattgactagcctacatattcagaacaatcaaatatctggaactcttaatgtgttgcaagatctccctttccaagatttgaacgttgaaaacaaccttttctctggtcccgtgcctgtgaaattactgaacttgccaaacttcaagaaggatgggaacccattcaatacaagcatagctccatctgcgcagcctcccatcgcgccaacaccattaccgtctatcccaccttcgtcagggcatgtcccctcaaaagaacctgcacattcttctagtgttccaggtggtagtacttcaggatcaggaaaacatactacactcaaattagttggatatattcttattggagtggtattagcagtagttcttgtgctaattgcaatgtactgtttatccaagtacaaagaaaaaaggtcgagagatgatatttatatgaaaaacaagataggaagggtacctcagaagcttggagagcctaaaatcaaggagccaccattaaaactcaagaataatgctgagaaagcttcgaatgttgtttctgatggaagagaggagcataagttaaaagtgccaacatcagaaacttcaaatgtggtttatgatccaagtccaagggatgggcagaacttagattcatcaccgacagctgtacctttggctgttacaatgaataaaaaagagcatgtgattgatatggaaaaggctgataattttgttgaggaccaactgcatcctccgcagccaatggcactgcggactgaaaaagtcactgtcaatcccagtgtacgtacaagaaggggaagagtaccttcagttgaaaaggtggaatcgacgactactgtcaagtccttttccattgcatcccttcaacaatataccaatagtttcagtgaggaaaatatcataagagacagcaggtttggtaaggtgtatctggcaaagcttcctgatggagagctactggaaattttgaagattgactcttctaactcaaaagtgccagtagatgcctttcttgagctagttgtgaggatttctgaactgaggcatcctaacatacttggtcttgttggatactgtgcggagtttgagcagcgattacttgtctatgagtactgtagcaagatgaccctacatgatgaacttcgtcatgtggatgactcaagcaagccattatcgtggaatgctcgcctccaagttgcttcagaggcagcaaaagcattgcaacatcttcatgacggttgccaaccaccagttgtacaccagaattttgaaccctctgttgttctgctcaacagcaccttagttgtgcatatttctgaatgtggccttgcatcactagcatcaaaatcagtttctcagttgtctgtacacaccttattccattatgaagcacctgaagtgcatgaatctggatcagtaagcgatcgaagtgatgtttacagcttcggtgtagttatgttggagcttctaacaggacgtaaaccttatgacagttcgtatccacgagctgaacaacatctagtacgatgggccacttctcaactctatgatattgatgccataacgaagatggttgatccttccattcgaggacaatgttctgataaggcattatcccgttttgctgacattattagccgctgcattcagcatgaaccagaattcaggccaccaatgtctgaagttgtccaagacttaactcgcatggtaagtaatgtatcaagggcttccatgtaggctatcccttaaacaatggtaaaatgtggaggtccgtccttatagaaattagaattcgaggacgcacctcgttctggagcttcttgctagattcagttctctctggccatgattcaagatgcctttgacgaccattgatgcggtagtaggatattttggccaatgcaaaatgggtggaacacagtggcaggatgcagagactgcaccacgttttgtccactgccagtaatgctcctctgaatctctggtcaatttatagttcaaagctattgttgtaattctgtagtctgcactctgcacaatatatttcttagtgcccagttccagatcacgtggtgtgattatgcgtggttatctagaccatatgtaaataccaagaagttaaacaaatgtattatagcgtgcttgtttgaggaatgagaaagtacatcttcttactcctcactttattatttgatttgttaaatgaaatgagttggtccatcaaaaaaaaaaaaaaaaaaaaaaacacgaccgggggcccggccccca

SEQ ID NO: 153 - DNA, 535 bp, Zea mays
ctgtgcggcgctcaggcggcgggttccaccgtgccacgcctgcctctgctcgtgacaccccagcccctaaaccgcgcccgcaccccacgaaatcgtcgctcatcccgcctgcctgccgccgccgccgtcatgtaatcatatcagccctcttggcgtcgtcgccatcgtcatgtaatcatatcagcccccctggcgccggcgccggttcctgccgccggctcccattggaaatggtggacgacaccagcagatacaactgcttcgagcctgggacggtcttattatggagctcaacaacttgatggcgctcaactggcggcccaggtcgtattcgattgttaatgcattcaataaacagacattcgcaactcttacaaatttgtacacttagtttacattttcttttttggtggggggcaattttgtttggagtccagggtatttttgcttcagtgcaattcctgtgagatttgagcaatgcaagtcctttgaatttaagcattcatcattattaaaggtctaccatgagatacct

SEQ ID NO: 154 - DNA, 1187 bp, Zea mays
gaaagcataagacatagtggcttcttctccctaatagctaccttcttcctatcaggctggagttcatcaaggatttgaacctggaactggagcccacaagcacacagaggaggaagaacaccaagactggttcccaacctatccaaggtagaagcgagcaacgttagtgtggtagtaacatggtgactgtgagagaggagatgcgtaaggggccatggacagagcaggaggacattcagctggtatgcactgtccgcctgtttggtgaccatcgttgggacttcattgctcaagtctcaggcctcaacaggacaggaaagagctgccgcctgcgctgggtgaactatcttcaccctggcctcaagcatggccgcatgtcaccacaagaagagcgcattatcattgagctccatgctcggtgggggaacaggtggtctaggatagcaaggaggctgccagggcgcacagacaatgagatcaagaactactggagaacacacatgagaaagaaggcacaggagaggaagatgggcatgccatcaccttcatcctcatcctcctcactgacataccaaacctgccttcttgacaccattccagtcattgggatgggcagtggtgacactcacaatggtagctgtgtcaccagcaccctcgagaacacacagagtgtcatggatggatatcccatggatcagatatggaaggagattgaggcaccacatgcacctaacttgctgagtattgctgaagggaaagagaagacgtgcagcagtatcccctgtcatctaccatcacctgtaatgtgggactacaaatgccctgagatattctggaagatgggagatcaagaaatcatgatgtgatggaagatgaaatcaagatgttggctgcacgatttggttatgggcttatggtaaataaggccatcgctattgaaggctgaaggaatacatttatattggtcaggccactcagctatctgcctagcagatttgcagtatttgtacttcctaactatgcttgcattagtatgcagtatttttaaatctagtgtaacactggtggtatgctcataatgtatgtatctatgtagtgtgaaaaatagtttgtatcagtttgtgcaatagtgtggacgctctatatgcatgatatatctatttatctctgttcttgttgtgctgaac

SEQ ID NO: 155 - DNA, 1565 bp, Zea mays
gcacgagaccattacctagaacatcctaatcgaaaaacctcaaaatcaaaaccgaggttgcctgcctggctccgactactggaactgatcatcttcttcgtccaagggtcggcgcccgcgcgtggataacaatgatggagacggaggaggagcagcagcagcgctctacgcggcgttggcaacggctccagcgagcggcctccgtggaggtctggtggtgcctgcaggtgcagacgacgcagcagcaggcggcggtgacgacgacgaccttgaggtcacaagggatcctatggtggtcaggggctggcgacggttgaaggccgtgtccatggtggtcttcagcggcggcgcccgacccaacaccaccaccaccacgacgacgatggaaatggagccgctgtatccgccccatgaggctcgaagtgacgcagatatcaggttgagaagcccacagcggaaggcacgtgaggtagaagaagccagcgtggtactcaagagtccacaccgaaagaccgctgttgcggctcaggtatcatcgcaggtacaacagccctcgctacctccgcagcaacctgacgtggttggaaccaaaaattcagcagcggaggttgtaatggacgtcgcatcaccgaaaaccactcaggggggcgttgtccatggcaacccagtcgacgatgacaaggaacagcgggcgcgatacctcaaatactcgcagaaggcgctcggcttcgccgtctgcacgtttgtcggatacgcaagcaacgcatcgtccaccggaagcgcggccttcaagatggccgcggcacccttcttcgtggccatcatcgccgacctcctgacgctgaagacgaaggcgaagcacggctgcgccctggtctacctctcgtcgttccacctgatcctcatgacgtacctcatcttcatcgcgttcgacatggcccacgcctacgccgtcctcttcctgccgctggtcgcctccgcctcccacctccagcagaagctgtggccgccgccgcgtgacgacgcgagcgccgacgaaaggagcaaggccgttagcaaggacctggacagcatcctagagctgtcctcgctgatcctcaactggagcagcttcgtcagcgcgatcatgaccgtcgtcaggcacttcatcactgctgctggcaaggacaatgacgagatcgcgcccgaggctgtagggctcctgttcttcctcaccatcgttctcgggatctatctcatgctggccaccactgtgagagctccggcgctcaatctccctaccaagtacctcgacgtcctgctcatctgccttctcctcagcactcttatcgccaccgtcatgacgtttagtggtgcaaattggacgggaaagcagtcctctaccggcgggtcaacctaggtgtcttgctgtttcagtgtgttcatatatgtttcattcaatatttacgcctcttagagcatctccaagagggactcctataattggggtctaaaaacaaaattagaactgatttaagttgattaggacctacagtttttttgcaactccaaaaaaaaaaaaaaaa

SEQ ID NO: 156 - DNA, 1322 bp, Zea mays
ggccgggccggggcacgagaccattacctagaacatcctaatcgaaaaacccgccgcagtccacgcgcccgcaccgcaccgcgcgccgcgctcgctgccgtgcccgtgtccccttcctttcccgtttccccctccctctctctttccccacgcccgacgcccccaccactctctcgatccaaagccagatcggcacgacgagcagagggccccccggagcggcgcggagcaatggcggcgggataccgggcggaggacgactacgactacctcttcaaggtggtactgatcggcgactccggcgtcggcaagtccaatctgctctcacgcttcacgcgcaacgagttcagccttgagtccaagtccaccatcggcgtcgagttcgccacccgctctctccaggtcgacggcaaggttgtcaaggcccagatttgggacactgctggccaggaacgatatcgtgctattactagtgcgtattatcgaggtgctgttggggcgttgcttgtatatgacgtcactcgtcactcaacctttgagaacgttgagcgttggctgaaggagttgagggaccacacagatcccaatatagttgttatgctggttggcaacaaatctgatctccgccatcttgtagcagttcaaactgatgaaggaaaagcattcgcagagagggagtcattgtatttcatggagacctctgcactcgagtcgactaacgttgaaaatgcattcgcagaggtcttaactcagatctaccgtattgtgagcaagagagcagttgaagctggcgaagatgcagcatctgggcctggcaagggcgagaagattaacataaaggatgatgtttcggcggtgaagaagggtggctgctgctctagctgacctgccctgctgtattttttttggagctgtggtgatgtagcttatggtacggcatttccagcgaccgagaactggtagtggcattagcagcttctatgttacctagagagtttattgtcaaactgggggaaaaaaactgaaggttagatcggtgtagatctttctggtactgtattgtgtatccggcaataggcatggtattgttttttttggctgtgaatccactggtaccatgtttaaacttatgaattgttcaaaatagaaaggtgcttcatgcttgccaaataaaaaaaaaaaaaaaaaaaaaagaaaacaagagaaaatgaaaaaagggcggccgcgattctgtggttaggatgtggaaaatggaggaagggttattgattgatacatcccgtgcacttggaggcaccatccgggcgattgcagctgactcg

SEQ ID NO: 157 - DNA, 1099 bp, Zea mays
cggccgggacccgccgcgcttgctgtcgttcccgtgcggccgtgtcccccttcctttccgtttttcccctcctcttcctttcccccccacccccactactctctctcgccccaaaaccagatcgccacgacaagggcagagggccccggaggggcgcgtagcaatggcggcaggctaccgggccgaggacgattacgattacctcttcaaggtggtcctgatcggcgactccggcgtcggcaagtccaacttgctctcacgcttcacgcgcaacgagttcagcctcgagtccaagtccaccatcggcgtcgagttcgccacccgctctctccaggtcgacggcaaggtcgtcaaggcccagatttgggacaccgccggccaggaacgataccgtgcaatcactagtgcgtattaccgaggcgctgttggggcgttgcttgtatatgacgtcactcgccactcaacctttgagaacgttgagcgttggctgaaggagctgagagaccacacagaccccaatatagttgttatgctggttggcaacaaatctgatctccgccatcttgtagcagttcaaaccgacgaaggaaaagcattcgcagagagggaatcgttgtacttcatggagacctctgcgcttgagtcgaccaacgttgagaatgcatttgcagaagtcctagctcagatctaccgtattgtgagcaagagagccgttgaagcaggtgaagatgcagcatctgggcctggcaggggcgagaagataaacataaaggatgacgtctcggcagtgaagaagggtggctgctgctctagctgagctgccgtgctgtaatttttttttgggagttgtgggatgtagcttatgttatggcattttcagcgactggaaattggtagtggcatttagcagcctctattacctagagaggttattgtcaaactgaaaaaaactgaaggttagatcagtttagagctctgttactgtattgtgtatccggcaataggcatagtattgttttttgttttttttttttttttgctgtgaatctactctaccggtaacatgttaaaacttaaaaaaaaaaaaaaaaaagcggcc

SEQ ID NO: 158 - DNA, 1862 bp, Zea mays
ttgcatgcctgcagctttgcatgtagcaatgaaaacagggtctattcaaacaacaatggctaatcgtagtcaagaattgtattactacctccgttctcgaatatttgtcgccggctagttcatttttgaactaaaacgcgacaaataaaaaagaacggagggaatatttaccagtggttggtacttcctgattagtgattttatatgagactagggcttattgactataataacctgcatgtagttgtctgctgtcttaactcttatgctgttccttccaccaatatcccactacaacacaagcaatttgatgcaatgaattccatttaacaacatgatgacctagtggatggtcgatgagctagtaatgctttttgttgagtgctacatctatcactattgttttttttttgtaagaaagttgacttattgttttttttgttagcattctgtataataaagtgacagtgatctaatggtatccttgtgcttaagtggagttcgttattactttttgttttggctgtaccgctgtagcactgttgttgctgttaggagtgaattctatacttcccatctcaagtggagtaattgccattgtctcattggtgcttgattattttaatatatcatttagcaaattatcctaagttcttttcaattatttacacagcttgggttccctgtccaccatgcgtccaaaataaagggaatctgtcgcccagacctttagataaggaaaacaccagcactctctctgaacagacaacctgagtacctgaccaaagtttaggacaagactgttgcagatgagcaaagttttgaataatgcggtagggtgcacatatttgtttgttgacttgcttggtcagttgtcttaatgttcttttatcagcgttaatggaactgaatttccttgcaattcagaattctctccatttggtttacttatctcactgcagttcaatatcactgcagataccgtgcaatccactaagtgcgtattaccgaggcgctgttggggcgttgcttgtatatgacgtcactcgccactcaacctttgagaacgttgagcgttggctgaaggagctgagagaccacacagaccccaatatagttgttatgctggttggcaacaaatctgatctccgccatcttgtagcagttcaaaccgacgaaggaaaagcattcgcagagagggaatcgttgtacttcatggagacctctgcgcttgagtcgaccaacgttgagaatgcatttgcagaagtcctagctcagatctaccgtattgtgaacaagagagccgttgaagcaggtgaagatgcagcatctgggcctggcaggggcgagaagataaacataaaggatgacgtctcggcagtgaagaagggtggctgctgctctagctgagctgccgtgctgtaatttttttttgggagttgtgggatgtagcttatgttatggcattttcagcgactggaaattggtagtggcatttagcagcctctattacctagagaggtaattgtcaaactgaaaaaaaaaactgaaggttagatcagtttagagctctgttactgtattgtgtatccggcaataggcatagtattgttttttgtttttttatttttgctgtgaatctactctatcggtaatacgttaaaacttgtgaactgttcaagcgctgcggtacagtaaaaaagaaacagtatagtacaggagagaagaaacggaagtccagcaaaactagcccggactggtttgtcgagtcacggtcaaaaaagttgagagcgtgagaaacgtgacgtgggagaaacatttgatggtttatagcgtttggctgcgtagtctgacatgaatag

SEQ ID NO: 159 - DNA, 2050 bp, Zea mays
ctgcatgtctctccatacagcgcaacaacactgagcatctcgctaataatcgacctaagacgctgtttagactatatatgaactaaattttagtttcacatcagctcttaataagtcttcaaataggaggtttatggtttagctgacctcttgtgaaaatttcagagcacacatacaaataaactaaaacggtttaaagttttaaatcccaactttagacaatgactagaccatatagaccagagaatgatgaaacgacaccctacttcgtgagcttataaaaagttacgaggaaaataaaccacagaggctagaaaattacagccccacttggccactccaccgaggaaccacttacccggaagttgcgtgggctgacgcatccgagcacgtgtccctttgaactctctctcactcaagcgctacgttgtacaacagcagcaaagaaaaacacataaaaaaaaattctcaatatctctatgcgacgatcaccaagataaatagccgggcacccgcccgcctccacccgtgcattcagcgcggccaggacagtgcagtgctccccgaggtccccaaaagacaagcaggcaagcagcaaagacacgcctccctgcttgcactccccacacgcccagtcgcccacacctccaacagacaaagacaatctagcaagcacacacagcatcaggaggaggagatcgagtaggagcagaagcaaagaatggggagagctccgtgctgcgagaagatggggctcaagagggggccatggacgccggaggaggacaagatcctggtcgcgcacatccagagcttcggccacagcaactggcgcgcgctgcccaagcaagccgggctgctgcggtgcggcaagagctgccggctccggtggatcaactacctgcgcccggacatcaagcgcggcaacttcagcaaggaggaggaggacgccatcatcaccctccacgagcagctcggcaacaggtggtccgccatcgccgccaggctgcccgggcggacggacaacgagatcaagaacgtctggcacacgcacctcaagaagcggctggagcccaccaccaagcagctggagcaggagcagcacggggcgcatgcaggtggtgacgccgccaggaagcgcagcaggcccaagcgcgcgggtgccaggaagacgacgacggccgccgtcgccccggccaccaccgcgccggcgtcgcctgaacggtcggcggcctcgtcgtcggtgaccgagtcgacggagcaggagcagggaaacacggggacgagctcgcccgggttccccaaggaggagagcttcacctcgtcctcggaggccgccgaggagttccagttcgacgacacgttctggtcggagacgctgtccatgccgctggacagcttcgacgacgtccccacggagccctgcagctccggcgcgttcggcgacgtggccgcctcctcctcctcctcgtccgttggcgccgacgccgacttggactactggctcggagtgttcatgaagtccggcgacgcgcaccaacaactgccgcaggtttagagcgcgcacgcgcgcccgagaattttcagttccctggctaattgattcatcgttctttctctctccctgcacgtcttgcaatcggaattcggaggggacagtcacaatagcagctaattaatagaggggtgtgtgtgttgaggaccacgacgagattaggaagaaacaacgcgacatgccattgcatctatctcttgtttgccttcttgtatataaagatcgatcgatcgacaagatatcggtgatcgaaacctatatatgctacccattttgagaggaattcttctgcacgcgcatgcggatttccatgtaacagtagtgatgagcaccagaaacgcactcggcgtctcggcctcttccaattcgttgattaaatccatctttgtgtgctactcgtgcgttcgggtacggaatcacgtcatgtcaatgctgaactcgtgcacggcttctgtcctgcgacctgttcatctccgctgcacgcttcgtccccag

SEQ ID NO: 160 - DNA, 1319 bp, Zea mays
  misc_feature (587)..(587): n is a, c, g, or t
cccacgcgtccgcccacgcgtccgggacagtgctccctcccgtccccaaacacaaacaggcgagcagcaaaacacacacgctcgaaccgagacaagccaatccaataatggggagggctccgtgctgcgagaagatggggctgaagaaggggccatggacgcccgaggaggacaaggtcctggtcgcccacatccagagcttcggccacagcaactggcgcgcgctgcccaagcaagccggcttgctgcggtgcggcaagagctgccggctccggtggatcaactacctgcgcccggacatcaagcgcggcaacttcagcaaggaggaggaggacgccatcatcagcctccacgagcagctcggcaacaggtggtccgccatcgccgccaggctgcccgggcggacggacaacgagatcaagaacgtctggcacacgcacctcaagaagcgcctggatcccaccaagcaggaacagcagcagcagcacgggacgacgccggtggctggcgccggcaagaagcacaggcccgcggcggcggcgaagcgcgggggcggcggagccaggaaggcgacggccgacgccgtncgtcgtcccggccaccgctgcgccggcgtcgcccgaacggtccgcggcctcgtcgtcggtgaccgagtcgtccatgacggagcaggagcaggagcacggcaacacggggagctcgcccgcgttccccaaggaggagagcttcaccacctcctcctcggacgccgaggagttccagttcgacgacagcttctggtccgagacgctgtcgatgccgctggacagcctcgacgacgtcgtccccatggagccctccgacgacgcgttcggcgacgtcgacgtcgacgtggccgccgcctcctcctcgtccgtcggcgccgacggcgacctggactactggctcagagtgttcatggagtccggcgacgcgcacccagaactgccgcagatttagaccgctcgcgcgagaattttcggctcctaattgattcatcgttcttttgtctctatctctctctgcacgtcttgcatcggaggggacggacaaggacagcagcagctgattaacagagaaggaaatcaggcagaaacaacgcgacacgccgttgcaacttggatcgatcttgtttgccttcttgttgtatagatactagaatccatccaagcctatgcgttctgagaacagaagcacgctgtgctgtgcatgcagattcccatgtatgtacagtagccacggccgccgccagaacagaaatggatccggcctcttccaaattccaattcgtgagtctctct

SEQ ID NO: 161 - DNA, 840 bp, Zea mays
actcactatattggattcgagctcggtacccccgaggaattccgatctcatttcctttggcttcaggataggcctaataagaaaacaaataattccaattcatatatgaacatttttgcctccttatttcttgaaaatgtggattcggaattcatttcctttggcttcaggataggcctaataagaaaacaaataattccaattcatatatgaacatttttgcctccttatttcttgaaaatgtggaattggaattccccgaggaattccgatctcatttcctttggcttcaggataggcctaataagaaaacaaataattccaattcatatatgaacatttttgcctccttatttcttgaaaatgtggaattggaattccccgaggaattccgatctcatttcctttggcttcaggataggcctaataagaaaacaaataattccaattcatatatgaacatttttgcctccttatttcttgaaaatgtggaattggaattccccgaggaattccgatctcatttcctttggcttcaggataggcctaataagaaaacaaataattccaattcatatatgaacatttttgcctccttatttcttgaaaatgtggaattggaattccccgaggaattccgatctcatttcctttggcttcaggataggcctaataagaaaacaaataattccaattcatatatgaacatttttgcctccttatttcttgaaaatggggaaattgggaaattttccccccgagggaaaatttccccgaattccccccaatttttttccccccttttttgggggccttttcaaggggaaaaagggccccttt

SEQ ID NO: 162 - DNA, 7942 bp, Zea mays
tgttcccgtttctttttttttttggcccacgaacaaggcagcagccatcccactctctgcgtgcgagaagatgataccatcaaagcctatcacaccctcagccgatatctagaacacatctgcgtgtccaagtggcaaggcaaaagcaaaaccgtgcctcttcgttgcagctagctgttttggttgtttttttctctttgtctttggggtgtgtggtcgttccggaacacgacgcctttttctttgtctttgtaaataaaaaatagaacccaacttgtgaaccaaaaaaaaaggtgttccaatgaatttcaggatacggaacattcgagcgaggaatatactagagccacgataaaataaaaagcccacaagggccgcgcgcgtaagcccatacacaacaaagtgcttgcggcagagcccaaacgaaaaaaaaaggtttccggactaggatcgggggtattgaacccgacgtgaatcgaacacgcaaccttctgatctggagtcagacgcgctaccattgcgccacggatccggctgtgttatacttgttgatgattagatatatgtatttaaacattgaatgtaatataataggatcgtacgtacgaggcagagaccacgtcttcatctgttttacgagacgggctatacagttacaaactgatcgttatgctaccagaccatttcgacacccatagaaactgtttgggtcatgactcatgatggatagatactagcccaaagatatccgaaaaccagacgcctagtgcaccggccacgacgaaccggcacaagtgaacgaccaccggcatcgtgttgggtgggtcttagcttagctctggtggtactactacttaattaagccaaagtacgtggcggtggtacctaggacgacgtacagtacgtgctactacgtctcatgcccaaggtttattatagcgacgcgcgatcaacttaacgatcgagtaggccgctaggctagcaaatgctgcacgctcatgaatgcacgcccggtccggtccgatccgatccaatccatctcgagtcgacatgtactacgagacaccccgcatcgacggctataactacgggttgtcccggccggcggcgatcggaaccgtaccggcgtttgtcacggcgtaatcacgctggcgggcggtaccgccatccgatctaacctgcctgccggctggctagcggctaaacacgaccccgcccgtccaatcgcgcgccgcgacacggtagctcgcccaacctagctactccgtagctatagccgcgcgacgcgctcccggcccgggcggcgccttcattgcacacgcgacgcgggccggagcaaccagcccgggccgggggcgggcggtggccgccggcgccgggcgagccagccgcgccgcgcgaggatcagggtcaggaccaggatcaggatcgcacgctggcggctgcggacacggcacgggcgggctttttcagggaataatcctaatccgcgtcccctattgaaggaaccacgtgtccctgtcgccgcccggtggttgcgccgtctattcggcccgttcgcgcgccctaacgacggcgaggcgaccaacagctgcctgatctgcatgcgtcggcccacccatacatgcggcctggaacctctgcgttccggaattgggtgcagcggaaaatcgctttcatcgtgcagtttcactgcttcatggttcgacccagccttagttagagctgccgggcaacccaagcttcgtcaggttgagctgctgtgtcctcacgttctgttgttgtggcagatggctgccctagaaacaggatttttcgcaaacgaggccagtcacccagcgtgttgttgtggcagatggctgccctagaaacaggatttttcgcaaacgaggccagtcacccaactgacaccacgacagactgtgcgttgcgcttcgatctggtgacgacacgctcattattgcagtaaaaggagtaactaagaggggttctgagacttgagcagatctctttgctgatgcaacgggactgaccataagctacaacaagagcgctagctatggtggcggccatcgacatggaggaaaacatgatttcagcaacgacgcgtcgaaatcttaggctgcaggcataagcagaagggcgttcctgcgatcctgaggctatggcctctgcaaaaacgttcagttgcatggcagaatgtctgcaccaaaagggacctgaggacacgcgcggcgcgccccacgctttcttgctcgctagctctttacagccactgcactctcatcagaaagaagcccacggttcgtcagactctctcagcaaatcatttcatgaaaaaaccgctggcaacccctattatgtgcaaccgattgtgtggtcgaggaagaaaccccggagcagaagaactctcatctctcataaggcttcctataatgcaatagtaataataataataaagccactgatgagcgatgcaggattttttcaagcctccgatccgtcgatcaaatggcttagtccaatgcatcgtttctatcgaagtaactatatatatctggtcgatatatatgcagctaacctaagccgccaagccaaagacatttcagttaatgagttcatgctcatttctttaccagagcagcagcacggccgtgcatgtgccgtgctcatgtcttaccagacccacaaaaatgctctgcttcttctcccatgtactacacagtacacggtacaacacaaccacagtagcgccattccagttcgatctttacgggccataaattcactcgtgtcggtccacgctgctcctacgagcgagcattgaccgtgccagtggcagtgggtcactaataaccaccagtcaccactcaccacccctgctgaattccttctcccccgagctagtcgcgcattcacctctgcagtttacggacagctgcgcagcgctcggctcaggggttaaactctgcgacctgctgcggcggatcctcatcaatgcgaggcgaggtccgtaccggactgttaggttggtgctcattcttggtgcgtgaaacaggagaggtacccgatcatggtagtgctagccagcacagcagtaacttaaaccagtcaatcagtattcttgctgggtgtgtttttttttttggttgttgttgttcttgtcgagaactagcgtgggtgatctcttctctctctctcgctgacatttcacatgagcactttaataaatcttggactgttgagcagcgtgcggggtgcagagcgcctacgggcatccgaggagcgccgcctcctgatcgggtggcaggtcacgtcccctgggctcaggcggcgtgacgctgaccgtcgcgtcgccatcggcggctaggtcgctcatgggtttatgatcacgctgacagctagtctgttacgcatgcatgcatgggatttcggaacagaacttctactactaatcttcgttatttctgctttcatatgtacaagcaaaggtttagatgtccgctgagtagaattctgaggggatagactagactagagatggcaattctttttgggtatgtgcatgtcttccacgctgacgaccgtcgaaaacccagaaacgaaactgagaccggtcggtaattccttgggtaggagtaggaatgcacatgggcttccggacagatctgtttacactccacagggacagggtggtggtcctgtggcaatttgccatggaaaccgcacaattaatggcctaactgatccactgttcctaccatggctccactgtatgcgttgtattgtaactgggcatagttttcacagaggcctcctacagtcctactccatctgcaaagttctgacctcagagttttttttcttctttttgcctttctttgttttttccatatataacaacagaggaaaagaacgctgctcagacagttgtgctttcaggattcagagagcagggaaaggcatccttcccctcatctcttcatcagaaaccgaggagcagagcggaacgagttgctgaaaatgccgagagggtcagatcaattgcgcagcgacacggcgcgcgtccttttcacctgcaagcggcaatcggcttcaccataactcccgcgcgcccggaacagtgtagggccagatgaagagcggagcaggagcaggacgctgccgcctgccactgccactgccaggcacagtaaactgccccagaccaacatgcatctcaattctcagctgtggatgctccggcagccactcaagatgagctcgcgccagatgcagtcaaacatccggattcgtaccgccaggaaaatttaaaaaacctgctactaagctaggcagcagcagcagcacggcgcccgacgcggccaggagacgacgaccggagaatgcggcacgggcgagagccatgggagtttaagcgcatgcatgaacacgcagctcggccggcgcgccgtcactatccatctgtacgagtacgacgacggcgaccctgctgggtagccgccgcgctctcccgtagcccgcggcgaaccaagccggccggccagccgcgcaccaaccgctgtcgccatctatctgccggagacgtaccaccacgtacctttggttcgtttgctggcacccgggcctcggtcggccgcccggcggcccaacggtggcgcacgtgcagcgcgcatgtcgagggggggacgggaaaagcggggtgcgccgcctgacgtctgggccacccttggccgtggccgcacggaaagccaggaagattctcgccaacccggccggcgctggcgcactgccgcactggtcagtcactcagtcagtactactactggggtactctcggtctcggctgcacgcacgtacgggaagtcgcccaggccccagctagtagctagggcaccgcgcacgcggcacgccccggcccccgctctatttatgccgctagctagcgacaccgaccaggtcacttcattcccttgtcactagctagatcgactgactggagaggagctatcgtctacctctgggcgagctgcgtgtccctgccgtccttctcgctcctgtggtcgccgcgcgcggcgctgcgatggggcggtcgccgtgctgcgagaaggaggccgggctgaagaaggggccgtggacgtccgaggaggaccagaaactgctggccttcatcgagcagcacggacacggctgctggcgctcgctgccggccaaggccggtgaggatccgacgacggagctcgacgatatatccatcgacctcacgttttcttcgcattccattcgttttattatatttgccatccagcagaatataatgctcatctatgcggctgcgtctctctgcagtgcgtctctctgcaggtctgcggcggtgcggcaagagctgccggctccggtggaccaactacctgcggccggacatcaagcggggcaagttcacgctgcaggaggagcagaccatcatccagctccacgctctcctcggcaacaggtgatcattcttcatcatcatgcacttgtttcgctttgccatgcatgacacagcacagctcgcgtgtgcctcgtgctcgcgtcggcaggaatgtcgtgagtgaaactgaggccggcgtggcaaaaggagtactatacatcttgtctgtaacaacgtgcatgggtgaaactgaggtgtggcaaaaagagtagagtactcgcatcgcacggggccagtttattggtcttgtcacgtttgtcattaatgttggcgcgagcccgcttgcctcgctgtgcctcgccatccatgtcagggcgttggaccatcgtcaccgcccgcttgtcgccctggccatgccatgttgacctcgccacgcccccatcattgctgtccgtcctactccaccacgagctccttcaatgcaccccccctacacgcctctaaccattacgccaaaccttctttactgttcgagttactagtaacattgcttgcttcatcagaggtgaaaaaaaaatgactgacaatgacatgccctcgcgcaacccgcaggtggtcgtcgatcgcgacgcacctgcccaagcgcacggacaacgagatcaagaactactggaacacgcacctcaagaagcggctcgccaagatgggcatcgaccccgtcacgcacaaggcccgcgccgacgtcgtcgtgggaggctcctctggcgccggcaacaactctggagcgcgctacagggccgccgcgcacctcagccacacggcgcagtgggagagcgcgcgcctcgaggccgaggcgcgtctggcgcgcgaggccaggctgcgtgcccttgcctcgccgccgccgccgccagggcccgggccgggccccgcgtttagcgggctcgagtcgccgacatcgactctgagcttctccgagagcgtgctgttcgccagtgcggcgcacgacacccacgccctgacgtcacgcgcttacgcagaggcgttcggggcggagcagcaacagcgcttcgctgacactgccgccgccgccgacgccgcgccaggcttccttgcaggcgtccttctcggctgctccgtcgccggcgcggagaaggggttcgcggcctcgtcgacggacgccagcgtctgtgagcagcagcaggaggaagaggacaagggctactggagcagcatattgaacatggtcaactcctccatgtcgtcgtccacgtcctcgctgacttccgatgctgtcacggaccccgccgccgcgtacttgccgccggcgacggcggcggccgagttctgagtgattgtcgtgcaataataacgaacctgtgctaatgttaccttgtcatgtgtgttgcttactagtaagtgcgttttttggtgctagttagtttatttacgtgctaatggggtgtcgtccacgtgtgcttgtgctttatgatgtgcaataaacatgtacgtactgattttgtttgcgcgggcgtgtcgtcgatcgccgatgtggcccccataacgcccaacactataacaaaacagcattaaacttgtgtacatatggtttcggttatcgagtcgataaaaataaaatggcagactcgactcaagactcgtcactcactgtacgtaaacatctttgttaccggcgggttttcttaatacaaaacagcattatattttactaacggttttctttaaaaaaacagacaatagaaatcatttttgtactgctaaaagatcttggtcgcttcttagtccttacggaacggattctcttgaggtaccgttcgttgtggtggttcatcattccaacctcgaattgatcaccacgacatcttatttgaatacattaaagctaatagttagttagctaaaaagttactagtaaaattagttagctaataaatatatggctaactattatctaatttgtaaaaatagttaatagttgaactattagatatattttttggatatatttagctaattttagtagttaactattagatatagtgcattcaaacaccccttaatatatataatcgtaaaattattgatcatgcaaaaacgtcccttcatttctcacacggcatgttgttcccatcccgtctacagtggagtgaattgggacctgggagggagagattaaaagatatcatatagcatcttcaagagctcactagaaaataactcctcaaaatcagttttaagggacatctaaataattagtggggtagattttaatttttttctccaacatattctttaaatcggcagattgtttctgggagcccaaaaatacccttatttgtagctacaaatgagatagtattaagagctatgaaaaagttaagagtgctttagaaaaaccattagagacacgtttttgtgtttttccaaaaaaacctagatttaggggtctccacagaccacaggtgttccttccggtcacgatttaacttcttccaaaatacaaataaccta

SEQ ID NO: 163 - DNA, 1336 bp, Zea mays
cattgggaccctcgaggccggccgcaggtcacttcattcccttgtcactagctagatcgactgactggagaggagctatcgtctactacctctgggcgagctgcgtgtcctgtcgtccttctcgctcctgtggtcgccgcgcgcggcgctgcgatggggcggtcgccgtgctgcgagaaggaggccgggctgaagaaggggccgtggacgtccgaggaggaccagaaactgctggccttcatcgagcagcacggacacggctgctggcgctcgctgccggccaaggccggtctgcggcggtgcggcaagagctgccggctccggtggaccaactacctgcggccggacatcaagcggggcaagttcacgctgcaggaggagcagaccatcatccagctccacgctctcctcggcaacaggtggtcgtcgatcgcgacgcacctgcccaagcgcacggacaacgagatcaagaactactggaacacgcacctcaagaagcggctcgccaagatgggcatcgaccccgtcacgcacaaggcccgcgccgacgtggggggctcctctggcgcaggcaacaactctggagcgcgctacagggcagccgcgcacctcagccacacggcgcagtgggagagcgcgcgcctcgaggccgaggcgcgtctggcgcgcgaggccaggctgcgtgcccttgcctcgccgccgccgccgccagggccagggccgggacccgcgtttagcgggctcgagtcgccgacatcgactctgagcttctccgagagcgtgctgttcgccagtgcggcgcacgacacccacgccctgacgtcacgcgcttacgcagaggcgttcggggcggagcagcaacagcgcttcgctgacactgccgccgccgccgacgccgcgccaggcttccttgcaggcgtccttctcggctgctccgtcgccggcgcggagaaggggttcgcggcctcgtcgacggacgccagcgtctgtgagcagcagcaggaggaagaggacaagggctactggagcagcatactgaacatggtcaactcctccatgtcgtcgtccacgtcctcgctgacttctgatgctgtcacggaccccgccgccgcgtacttgccgccggcgacggcggcggccgagttctgagtgattgtcgtccaataataacgaacctgtgctaatgttaccttgtcatgtgtgttgcttactagtaggtgcgttttggtgctagttagtttatttacgtgctaatgggctgtcgcccacgtgtgcttgtgctttatgatgtgcaataataaacatgtacgtactgattttgttaaaaaaaaaaaaa

SEQ ID NO: 164 - DNA, 862 bp, Zea mays
  misc_feature (834)..(836): n is a, c, g, or t
ccgggtcgacctcgcgtccgaaaagctgtcgccacgttcagagccaccttcagacccttcgaaatatactgctgctgatgttcgaattactgatcaaaaattacgcctctgtgacatatgtggagcatttctgagtgtatatgacaatgatcgacgtcttgctgaccattttggtgggaaattacacctaggctacatgctgattcgtgagaaacagaaagaactacaggaattagtccatgttgcgtgattggaatctcatgcgatcatcttcatacccatggatacaacagtcactgtctgttggcaaatgtaagcataggagggtgcaagaccatggagcagagaaataaaaggagaccgggcaaagctgaagatgatagacgatcaagagagcacagcaaggatcgcaacggccggtcgtccagggatagagaaccagaaaggagagacagggttgagtctcgagatggtagaagagattatgaaagggatcgtgatagacgtcatgatagggacaggcgccatgaccgtgatcgggatagggattatgaccgctcccgtggacatgattcaaggaggagagagcgttcacgctccagggagcgcagcaggcgccacgagagatactaaatgttacaccatgcctgacagatttaggagtactggcggcgtctgttcaagatatggtttgagcttgtgcttcgtatcttctgaagaccggtctacttgacgctaaattcgcatggagtgtaagcatttattaaacgcatctggaatcaaatgaagttgtacttgcgaacggcttcacttaaaattcgcgccatttctaannnattgtaataagctgtgcttgaacctt

SEQ ID NO: 165 - DNA, 1830 bp, Zea mays
cattgggaccctcgaggccggccgccggtccagcccacagtccacgaggacacgatccccgacctcatatcaggttcccctccccatcccggagagaaaaagcgcttctctcgctagcgagttcggcagtagaaaccctaaaaaaaagacaccgccctccccttcgctagcggaaccgccctcccctcgccggggtaggggtttcgggggtagacgcccgccatggacgcgttccggaaacagctggacgtgctcatgggcgccaaccgcaacggcgacgtcgaggaggtgagccgcaactactacgaccgcgacgtctgccgcctcttcctcgccggtctctgcccacacgacctctttcagctcacgaaaatggatctcggtccttgttctaagattcattctcttcaactgcggaaagattatgaagaagcgaaagcaaagggaacagaaaattttgatagagaactcgaggatatgatagaaaggctcattgtggagtgtgacaggaaaattcagagggccctaaaacggcttgcagatgatgatgccaatgctgctattgcgatatcggtctctgaggttactctgacggatgacatactgcagctgtcaaaacagataaaggagaaaatggcagaagttgatgcctttgattttgaagggagaactgatgacaaaataaaggcccaggaagtagtggaagagctaagagctaaaagagctgatatgcaggctaccctcttgcttgatgcttttaacaaggacagagcttcattaactcagcctgctccacctcaagtggcagcagttccaccaccagctccacctgatgctcgtactcaagaaattatcaacgaaaagcttaagaaagctgaagagcttggtgaacaaggcatggttgatgaagctcaaaaagctttggaagaggcagaagctctgaaaaagctggcgccacgttcagagccaccttcagacccttcgaaatatactgctgctgatgttcgaattactgatcaaaaattacgcctctgtgacatatgtggagcatttctgagtgtatatgataatgatcgacgtcttgctgaccattttggtgggaaattacacctaggctacatgctgattcgtgagaaacagaaagaacttcaggagcagagaaataaaaggagaccgggcaaagctgaagatgatagacgatcaagagagcacagcaaggatcgcaacggccggtcgtccagggatagagaaccagaaaggagagacagggttgagtctcgagatggtagaagagattatgaaagggatcgtgatagacgtcatgatagggacaggcgccatgaccgtgatcgggatagggattatgaccgctcccgtggacatgattcaaggaggagagagcgttcacgctccagggagcgcagcaggcgccacgagagatactaaatgttacaccatgcctgacagatttaggagtactggcggcgtctgttcaagatatggtttgagcttgtgcttcgtatcttctgaagaccggtctacttgacgctaaattcgcatggagtgttaagcatttattaaacgcatctggaatcaaatgaagttgtacttgcgaacggcttcacttaaaattcgcgccatttctaatattgtaataagctgtgcttgaaccttagctgtctctgtgtactcgacgtaccactcgctcccacaaatagcttcgaacatcctgtacctgaaacatgacgctgtttggtggaggtggagctgtaagtgttcttttgcacaattcattataaaaatccaaaaaaaaagtactcggacgcgtgg

SEQ ID NO: 166 - DNA, 1776 bp, Zea mays
ccgatactgcgcgttgcaagctcccacttcctgaggaacaggaactccatgagatccgcggcatccgccgtcccgttcatctgcacaaaaagaccgtaatccttctttttcctctcctccccatccgcggagtgtaaatcgtctctcgctagcgcgttcagtagaaaccctaaaccccgcctcctcccctcgccggggtaggggctacgggtgtcaacgcccgccatggacgcattccggaagcaactggatgtgctcatgggcgctaaccgcaacggcgacgtcgaggaggtgagccgcaactactacgaccgcgacgtctgccggctcttcctcgccggcctttgcccccacgacctcttccagctcacgaaaatggatcttggtccttgttctaagattcactcgcttcaactgcggaaagattatgaagaagcgaaagcaaagggaacagagaattttgacagagaactcgaggatatgatagaaaggctcattgtggagtgcgacaggaaaattcagagggccctgaaacgacttgcggatgacgatgccaaggctgctattgcgatatccgtctcggaggttactctgacggatgacatactgcagctgtcaaaacagatcaaggaaaaaatggtagaagttgatgcctttgattttgaagggagaactgatgataaaataaaggcccaggaagtagtggaagaactcagaactaaaagagctgatatgcaggctaccctcttgcttgatgcttttaacaaggacagagcttcattaactcagcctgctcaacctcctcaagtggcggcagcgccaccaccagctccacccgatgctcgtactcaagaaatgatcaatgaaaagcttaagaaagctgaagagcttggggaacaaggcatggttgatgaagctcagaaagctttggaagaggcagaagctctgaaaaagctggcgcgacgtccggagccaccttcagacccttctaaatatactgccgctgatgtttggattaccgatcaaaagttgcgcctctgtgatatatgtggagcatttctgagtgtatatgacaatgatcgacgtcttgctgaccattttggagggaaactgcatctaggctacatgctgattcgtgacaaacagaaagaacttcaggagcagagaaacaaaaggaggacaggcaaaactgaagatgataggcgatctagagagcagagcaaggatcgaaacggcccgccgtccagggatagagattcagaaaggagagacagggttgagtctcgagatggaagaagagattatgatagggaacgcgataggcgtcacgatagggaccgtcgccatgaccgcgaccgggatagggattatgaccgctcccgcggatatgactcaaggagaagagagcgttcacgctccagggagcgcagcaggcgccatgagagatactaaatgttactccatggctgacagattttggattgctggcgtctgttctggtttgtgttgtgctttgtgtcttatcttccgaagtttcctgttcctgctcgagaaatccgaaagccaatctgcgttctgcatcatgtcatgtcctagtgtcgtactgtttagttatatgccgagaacatctctttcatcaaatgaatatttggaaacaccaacgcacttgacgctaaatgggaatgaagtgtggagtatttaaacgcctctgaaatcaaatgaaagttgtacttgtacgaatctcttccacaaaaaaaaaactcgagggggggcccg

SEQ ID NO: 167 - DNA, 830 bp, Zea mays
gcacgagaccattacctagaacatcctaatcgaaaattaagttatcctgaaagctttgccaacatttgctgtaagtgacaacttgttctattttttatctgctacctccataagtttgcaagttaaactttgctgaagcagccttgcctgtaaagtatgactcccctttctcttggaacgttgtcgctgacttcatgtatggcaaaatatcatcatttctactgtcaataaataaaatacactatgccaccttgcaggagcagagaaataaaaggagaccgggcaaagctgaagatgatagacgatcaagagagcacagcaaggatcgcaacggccggtcgtccagggatagagaaccagaaaggagagacagggttgagtctcgagatggtagaagagattatgaaagggatcgtgatagacgtcatgatagggacaggcgccatgaccgtgatcgggatagggattatgaccgctcccgtggacatgattcaaggaggagagagcgttcacgctccagggagcgcagcaggcgccacgagagatactaaatgttacaccatgcctgacagatttaggagtactggcggcgtctgttcaagatatggtttgagcttgtgcttcgtatcttctgaagaccggtctacttgacgctaaattcgcatggagtgttaagcatttattaaacgcatctggaatcaaatgaagttgtacttgcgaacggcttcacttaaaattcgcgccatttctaatattgtaataagctgtgcttgaaccttatataatattataataaaaaaaaaaaaaaaaaaactcgagggggggcccgg

SEQ ID NO: 168 - DNA, 5027 bp, Zea mays
ccttttactagtctttggatctgctaaaccctcgcctcactaggttgtcgctgttgccgaaggaaaactgtcatcaccacctccttgaatacgctacggctttgtttgggtactctaggaataagagggaatggagcggattgagatgtatcgtgagagtttttgacttattggggatttaaatactctctaatcccttcaaaccacttcaatccaagagtatccaaactaggtctacggaggcaccaaatctcaagatttaagaagttaaaccatgtctgtctcaagatttaagaagttattgtagagaactttgttgttgccagcaatgccatttaccacttagaaataaataccaagaacccctgtcagatcaggtccaggaccttaattaatcttcaatacacatttcccaccacaagaaacccatattaccattcatgtgacagaaatcctagtcaaatagaggccatattatgctgtgcaagagagaacaaaaaacaaagcagaaaaggcaggaaacacaaacctccttattagctataggcatatgctccacgccaccaaggaggcaccagcatttgtgctaatttttttgcttggttttccatgtgctcaaaactccaccgatctccaccggagctggcctttacatgcgtccacactagctatagttggctcgtattttctacgctcaaatcagtagcccggccttcccccttttttttttcctcaagccggtcccacgtcccgcgcgccgagcgcgtgccccgcgagctctgctgcctccatgcccatggtgcggtgcgagtgcgagtgagctagccggggacaggggcccaggcgatggagtcaaccagtcaaactccctcctacttacccgtgtacgctagccgatcgattaattagctgttaactaaaatataataatccccagtaattaatccaccatgcatccagtctgaaaaaaataattaatcgcctccgattaacccctgaacttttggctttaatagaagggggacgaaatgaaaagggataaactaatctccctggttgcggcgtgctcccccccaacatgctcctttcttcccacccaagtccaccagcctacctccctttctcctggccgggccggctcgctccgtccgtctgcgtctctcgtctatataagccagacccctcctctcccgccccgccccacctcatctcactcttcttcctcttccttcctggcctgccttctcttctcccgccttctcctcctcccagcacagcagcagctgtgaccacatcaccacacacacacacatatatacttggtcatcatccagcttccagcagccagctgcccgccgatcaacgtgtaggcggttcaaagggaaatctgctgatggacatggcgcacgagagatcagacgccaccaccgaggaggaggtgatggccggcgagctgcggcgcgggccttggacggtggacggcgccctccagctggtcaactacgtcgacgcgcacggcgagggccgctggaactcgctcgcccgatcagcaggtgtgtgggaagctagctagctaggaataggatatatatgcatatacatgtaggtaggtagctagctagctttgcatcatcgtgagttgagcaacaactaacagccacaattcgtagccgccgcctcgctcgctcatgggttctatcctatcacatcgcgcgcccacagatcaccgccaagagatgctccagctttacttgcgcatatcgttttcttctccgcgttgccgtacaagcctgggcactcgtggtggcacgtgcacgttcatgctaatatatggaaacagataggctagctgctaggtaggaaaccatcccagctaaccagagccgcctacgctgatgagtgagaaagagatcgagcgagatagtactttttagtggttattaagcatcattcgttcccggccgtagtatatgcagcttgccatcacatatacacattacacactctcatgtctcgtctacatcactaatcagcagctagcaatggcgtcgtgtggattactaaatacgttcctgcctatgatatgatatgatgcacaggtctgaagcgcactggcaagagctgccgcctccggtggctgaactacctccggcccgacctccggcgcggcaacatcacgccgcaggagcagctgatgatcctggagctgcactcgcgctggggcaaccgctggtccaagatcgcgcagcacctccccgggcgcaccgacaacgagatcaagaactactggcgcacgcgcgtgcagaagcacgccaagcagctcaaatgcgacgtcaacagccagcagttcaaggacgtgatgcgctacctctggatgccccgcctcgtcgagcgcatccaggccgccgcagccaacaataacgccagcggcgccggggttccgccagctggcgccgccgcggacgacacgccgctctcgtcgtcgtggcagcacggcggcggcgccgacgacgacggcggcctctacgcgtcgccggagctgcccacggacgcctgctggcctcccgcagactgctactactacccagccgccgctgaccaccagctactgaacaaccccgccgccgccgccgtcttcccggacctgtcaagcaccacggccgggtcgtcctctccgtcctcggattccggcgcggggacagcacaaccctggcccgcgccgctgggtggcgcagagtggttgaccaccggcgcctgctgcgacgcctccagcgccgccgccgccctgggcgggcagcagcaacaatcgtgcctggtcggggagacgtcgtgggcgtcatccgagctccccgagctgggcgtcgcggacttcgagatcggcagcttcgacgtggagagcatctggagcatggacgacagcctgtggttcacgcaggcgcagggcgtgtgaatccaagccaccaacacacgcggcgcgcgggcacggaaatcgatccacgttacggcatcatatatcggcggtggacatgcacccgcgtccatcggacacaagcagtacgtcagccgccgagggcgcctagctagctagcagaggagcagagcctgctgaagacacggggtagaagaaggagagacagagagggatattatttggaggaagccaagacgacggcgtacagtactcagttcaagatgctgttcttgggccgcccttgccttgccttgcctccggcaggagggactattcctccactccagttctactccgtttcttactaattctgttctcctgccttaattccgtagcggcaagtagctagtagtagggtatatacgcgcgcgccaaagaagaagacgaaaaaagaagtccagaaaaaataacgtagcttagcgttaataaggtgtttgtacgtcgcccgtctaattaatttttactcattcttttttgagtaaatacatagtatatatagtacatgaacgactgaaagttactgacgatggtaatctctgtgcggccgcatgtttatatataagtatcaagacgaaaagtcataacgaaactaaaagattttgacaacttctagaagcgaaggacggaaaacgatgagcgagtgagttcggacgtcaagtcgaagactggaagtcgtctacaagtactaccggaggcggcccgaggagggtccagccggcgtacgtacgcacccgccaaattccccgccgctaattgtgatcctcatggtctcagaggcgaccgatcaattcgtctttccgtttctgctgcactgcagtggttagttatcaccagcatgcatgattattataccgacggcgactgatgttccatttgttcatgccgacatggtttgtgtgtgtttcattccgcctgagattatcagggcatcaaatcaatcgacgagccaaggaggggcgatggaggaagggagccgtcgcgtcagcgccaacagttcccgcgcggcgcgatcgatgcgaagggcgggcagcccgcggcgctacacgtgttgttttcgcaccagttctgctacatggtgcctggttgagtgaaaatggttccaacaaagatctttcctacaacatgtttacaagaatcaattttaccaacaaaggtctttttcacctgagtagctgagtgggtataggcgcaatgcgtttcgcagctcgtatgacgagggcagagatgagttcgcggtcgctgatgagagcaccctggcgcgatagcagattattagcggcgcaaaaggtactaaaatgagtttttcaagtgttgccgatcgagcagataagctttaaaaactgcagcactaacgacatggatgggcacacgtagagatagcaataggaacggggaacccgatcttccatttctcgtgggatttcctccgttagaagataggtatagagaggtttcatttccaatgggtcctcggggtggtaaacagggatgtgataaggaaacattctctattcctgttccatgcggacactcattaaacctacacgtgacaatgttttcatgtaatggttaatgctaaaactgaataactaccttataaagaaatcactcattgtacaaatatgttaattttaatatgcaaataataattttttatacatgacaatatgtataactgatgatgttttacattaataacgaatgaagtacacttttatagtaatttaaatagtgatgggggattattctcacgaaattgttcgtggataaatattttttttaacaaatgttcgtggggatcttcacgataattattattttttatcacgggtacatgtacgaggagctaaaaccgaccagatatttttttccattaccatcacttcgcacgcggatgtgcgatcgccaggactcaggacggaggacgccgatggtaacgcttgcatgcaagctgctgcgcggcgcgggcccgtacttggcttcggatcgaatgatcgatcgatagggggaaaagagcacaggtgctgaagtggcggggccgccgggcattcagagg

SEQ ID NO: 169 - DNA, 792 bp, Zea mays
caggccggcctggccgggataagtcagcctcccaacattgccaagaacatgacctgttcttaatagacaacgacagcaagagcaaggataccagaagctgattctttggccttggtcgattggattgcagagccaattagctaggtagcagtgatggcggcgcatttgccgtctttctgttctcgtcatgccagcatggcggtggcggcggcgctgatgattgtaatggcgacggaggctccggcaggcgtggcgctgctgaaggacgacattggattcatgtggggcccggaccacagcttcttctacgacgacggcaacgcgctcgcgctgtgcctggagaagtcccacggctcggggttccgctccaacgccgccaacctctacgcccgctacgacatcgacgtgaagctcgtcgccaacgactcggccggcaccgtcaccacggtctacctgacgacggacgacgtgcggccggggtaccatgacgaggtggacatggagttcctgggcaacgtcaccggcgagccgtacacgctgcacacgaacatcttcgtgaacagcgtcggcaaccgcgagcagcaattccggctctggttcgaccccaccaaggaattccacacctactccgtcgaatggacgcccaagaacatcatattcctcatcgacggcacgcccgatccgcgtgtacaagcacgagccctcgctcggcgggacgttcccgacgcagcggcacatgcggctggacgggagcctgtggaaacgccgacgactgggcgacgcagggcggcc

SEQ ID NO: 170 - DNA, 829 bp, Zea mays
aagccgctcgagccgatcagcgagcgggcctctgggagaggtagggagccatggggaggtcgccgtgctgcgagaaggggcacaccaacaagggcgcgtggaccaaggaggaggacgagcggctggtggcgtacatccggtcgcacggggaagggtgctggcggtcgctgcccagcgcggcgggtctgctgcgctgcggcaagagctgcaggctgcggtggatgaactacctccggccggacctcaagcgcgggaacttcaccgacgacgaggacgagctcatcatccgcctgcacgccctcctcggcaacaagtggtctctgatcgccgggcagctgccgggccggacggacaacgagatcaagaactactggaacacgcacatcaaacgcaagctcctggcccgcggcatcgacccgcacgcgcaccaccgcccgcaggcgctgcaccacgtggcagcagcagccctcgtcccggcccccgccgcgaagccgaagccgaagccggcggagtcgtccgacgacggcgggcgcagcagctgcagctgcagcggcagcggcagcagcgcgggggagccgcggtgccccgacctcaacctcgacctgtccgttggtccgccggacgcgcccacctcgccgccgccgccgtgcctgtgccaccgcgcctgggaagcgtgcggctgccaggcaggctgacggctgaggcagcaagagttcagattttttttttgttaggcagttgaaacaaggctagtgtgaaccgagaggagatcagtagctaggacactgtctcagagaaagaaagaaaaaaaaaaccaaaaggatttttg

SEQ ID NO: 171 - DNA, 818 bp, Zea mays
aactcctttcccccctccagttccaactttcttgtgtttaggcaccccccgatcccgcccggaaaaacggccgtccctatctatcggattgcttccagttccagctcgagcactggggcttcgcaggcgagatgaagaggctgcttgctcatggccagtccggttgcccttcccggactttggttggcagaatccctgccctgcctgtactttgcaacaacgttcttcccgaccataggtactattcagccgagaaacacgatgacgacaccacgctaggtgagatcggggataaggcaaggtcgacagccgaggagttcctgagggtggccaaggagaagaccgacgacgtcgcggagggcgcgaaggagacgctgcactagacgaaggaagcggtggtcggggagtcggacgacgagaaggagaagttcaaaaggagggtggaggaggggaagtaccatcatcagaagaaataagtggcttgtgttctcttggctgcgtatgcaagtcatggcttggattactatacatactcgataggccttgtagtttgtacaagtttactctttgcatccagacgtgtcgatgtcctgtagaataaataagaagttgccttttgtgcttcaatacttacatgccatctctcactgaataaaaagttttgccttgtgaagaaaaaaaaaaaaaaatcactttgggatcggttaagcgacctgggtatatgagtatgaagcgattctgttggggagtcgtcctgtgtgccgtgtaacggatgacaaaatagtgtaatcagatgggaatggtcatattcatgtcgg

SEQ ID NO: 172 - DNA, 4397 bp, Zea mays
  misc_feature (3219)..(3219): n is a, c, g, or t
gatttatttaccgagtgcttgataaaaaacactcggcaaagagccggattctagtagtgttttgattgctagcaggcatgattattatatatatatatattaccgttttatactttatgttgatcacaaaattagttgattgcatgatgcttaacgaaaatccgaatggccatggctacaaaataatgaaaaggctcgcacgctggttcgtgtgtggttaacaagttttccgaaacttaatgattcgctggtgcaaatacgtgcgcaaagaacgacaaagaagctaagggtgcaggagcaagcaagagggggtgaggtgactctagaaagctcatcccaattgcaaatgctgacacatgataggaggagcatttctcagtgcggggtgcccatcactgacctcacctcgcactagcttgcttgctagcttttttccatggatcatcgatcgtcgtcttagcagcggcacttgccttgcatttttcatttgccagatctaccccaccgctagtagttgttgtagtactatactacactcctctccttcttggctagctagcaattcaaccagctctctctctctctctcttttgtatgtatgtatatgtgtatataaataaccgtgcacgcagtgtgactagcaaccagtacacagaggatctggtaagcaactaagcaagtgtactgaggacggaggcatcgatccagcgttccagctagcacgcacgcagccagcacccagcacccagcagtagaatctatatatcgtacgcaagtagtggatcgaggcatctatctgcagtccctttcttcttcttcctcttgattgataggtgcgccgaagcttgttttgttgggtggcctttgtctctgtcgtctcgtctcgtctcgtcttccgcccggccgccaccacctgcaggctatactagctagctattaagtccggccaaccaagcagctcgatcaggtcggtcgacggcggggacagttcggagggaggaggcggccggagaccgaaggacgcctaccatcaactcgcggtcctggccgcgctgccgaaaaattaaaggaagaggacgaaggctgaccgatggacgatcgttatcctcatcatcagtcgtcgatggcgacaccggcagcagcgagcaagatgagcaagaagctgcagggcggtggtgaccgtagtagtggcagtagtagtaggggcagcggcaacagtgataagcagcaggtgccggcggcggcgatgaggaagggcccgtggacagaggaggaagacgctcagctggtatggttcgtccgcttgtttggtgaacgccggtgggatttcttagcaaaggtctcaggtttgcgcggtggcgggtgcatccgatccccaagcatgcatgcatgcatgcatatgtagatgcatgcgtgcgtggggatggattgatgtaggatgggctatggcgatgggtgttgattaaccatttcttttctctctctcttgtgcgtgccctgcttcttctctgtgcatgcgcatgtgtcggcggcgtactcgtgcaggtctgaggcgcaccggcaagagctgccgcctccgctgggtcaactacctccacccggggctccggcgcggccgcatcaccgccgacgaggagcgactcatcctccagctccacgcgcagtggggcagccgctggtcgcgcatcgccaggagcctccccggccgcaccgacaacgagatcaagaacttctggaggacgcgcgccaggaagcagaaggcggcggcgcagcagcagcagcagcagcaggacagccggagcagcaagacggcgacggcgtcggcgttctcagggtcagcgtcgtccgtgactaccaccacgtccagctgctctggctctcctagtccgaccagccgcggctgtggcacggccacgtcatcgtccgctctgaccgagtccgcgctgcggcaaagcggcggcgaagacgaggacgccgagctcgacgaggcgtccaccaccaccaccaccacggcaagccagcgtcaacaccaagacgacgaccaccagcagcagcaccaggagtgctacgcctcggaccacttctggaacgacatcgcggcggcggaggcggccatctacatgttgatcgacggcggctggacagggtccggccccggccatcccgccgccgatccgccttcgtcgccggcgtgggagtactgctctgattactcgctctggaggatcgacgacgacgagtactacgagaagatgctcgactcctcctcctgattcgattatccagccatcacacgcatatgcatatctatcattagcttatttctttcttttttttgtgctgattagtctagcatacagcagctatgagaatccaaagcttcggttcggctttcgttgcatctctttgtataatactgtaacatatctatatatatatatgtatgatatgatactgctctcgatcatatatattgtaccaatatgtgctaggatatatagacatgtagtataatcatcgtcgtcgatcgtgtgtttagtgaagaatcagatgatgaggcgagacacaacacaatcgattgtagtgtgtcctgctgcatctatgtatttattcatgtactaagtactatatatatatataagtgatgatgagattgtatatgattcagttcgacaaatacattcttcagtagtttctgagaaactatatatgcttgtttgtccttgatggatcttgatgcatgtgcaacctgtctacttttttcagataaaataattccgatcctgggcgaaacccggccgaacatccaaggtttatgcgcttggttatattgtaataatactcctatataatccacccgaagcttactcctaataattaagttctgacaggacttgttgagttgcaactcaagttatgtgcaacctgaaccagaataatctgcacctcggatcgaatgaactttttacattatgatgggaagaataataatctatatgcatgtcgaacttgatgccatggaatggaatggaagatgggaggagggatatgatagaagaaggtgtacaaggcccatgcattggagcatctttcaaataaaccgtccattcaagagctcatttcacccctcatgtctagctaatagtactttctatcttagcataaaagttttataccctactaggttacaaccctgcactagcatgacactacctatgnactaaagagatctgtaatacccaaaatatagaatgagtgaattagttctttaaattataaagatctgtgtgatttctctctttcagtgtgcatatgaacagtaaagacttgattaaaacaactaataaccaaccaagtgaatgaaatagtgatgcatcatgttggtatttatgtttgtcgcattcaattgacttagaacacaaatgtaaacttgaaacttaaagttggatttgggaataaaatagaaaaccgaaaaatgaaatagaaaagaaaaaaaaactgttttgggccggaatcagcatcagcccaccaaatcccgtgcgctcctagcgaacccagtttggggtcgactgcatcacggcgccatgtggagtcgtgtgactagtcactctgtcacgcacgcgcttcatccgtagtttggtggcgtgtgggccccacttggcgaacatccttctccacgtgtgtcgtcgctccgacgcttcccgtgggcctcgctgtcaaccttgccacgccagcgtcgtccacgttcgcttccaggtggggctaggatgctagggttattgcttctgcactgtgccagctcacacgaacgtcaggtcctcgtggccgccgacccgccgttaccggattaacatggagtttctattaaatgggccccacgaatatatagtaaagatatgacatttgtttctgtatcatgagtcatcatatatgcgagacttgatcttatcatacatttaattcaggctcgagtttgtccttaaatctgggtgtgacagaagtgatatcagagaaatgttgactgtaggacgtaaacccttacctacttacctttgctactctgattatttctaaacttttcttaatcttttctcatctattactgcttaactctgattactgttaccttttctttctcgaaaccaaaataggatttcacaccttggaatcctggacctaaagtgacccttatgagtaggagttctaatcataagaagaacaaaactatttttataggtattgatgcacttgaatgcttgttcttatgaaccttgtttgattttgttctttgattgagtctgatgagttgcgaagtaatgtccatgatttcatatatatatgcacctaggtgcattctatatattgaatgcacccaggcgtaatatataaatacaccc

SEQ ID NO: 173 - DNA, 1417 bp, Zea mays
atgcgactgtctcctgtcctgctctgtcccctccgcccgcccggcccgctcccttgcctattatactttcttatagtcttccacggccgcagttagccacatctcgccgtcggcgacgagggacagggaggcaggatactcctgtcaggccgcgacgtagccctcctcctcttgctctccccgccatcctctgcttctcgtccacctgggattagatctatttcttggtacctgagcgatcgagtgaaatcgatctagccaaggtgcggcggacgcggcttattcacgaattttctgtgttctttggaaagccgccatggacgagtggattcgccaagccgaggtgtgggtgcgccaatccgagagctggatccgccagcagcccccggagcagatctatgtcgcggccacggtggtcgccgtcacaatcctgctgcttatcgtagcatcttatctgaaatcctctaaaccaagcaccatagtgctatccgggctcagtggcagtggcaaaaccactattttctaccagcttcgggacggatcatcacatcaaggaactgtgacttcaatggaagaaaacagtgatacttttgtgctgcattcggagcaagaaaggaaaggcaaagtaaaacctgtgcatattgttgatgttcctggtcatgctaggctcaagcccaagcttgatgaagtcctgcctaaagctgctggggttgtctttattgttgatgctcaggatttcttgtctagcatgcaagctgctgcagagtacctttatgacattctgacaaaagcatctgtagttaagaaaaggatccctgtgcttatattctgcaacaagacggataaagttaccgcccactcgaaggaattcatcaagaaacagttggagaaagaattgaacaagcttcgggaatcaaggaacgccatatcttcagctgacatctctgatgaagtccagctcggggtccctggagaggcattcaacttcagccagtgccagaacaaggtggctgttgcggagggtgccggttcaactggtaatgttttggccgtggagcaattcatccgtgaacatgtgagggcgtaggtcgttcttattgttctcagggctccaaatggctctcttgatctaatgaggcaagatgtacattgcgtcaatggggttgcctttcaatgtgactcttcatccggtcctctgaagttgcttaagaagcagtgaggcgcaatcatattctgcactggttcagctgacccatgtttacatgttgcaatgtgtatgcctgacagtcatcggatatgaatagagcatggtataactgtctggctatggttgttttgcacttttgctccgtaagtttttatattttcctgatgttcccgtcgaaaaaaaaaaaaaaaaaaaaaaaaaaaaaaaaaa

SEQ ID NO: 174 - DNA, 1390 bp, Zea mays
cttcgaggtggcacgccgcacgtgccgacggcctcttgtcctggtccggccatcgcccgggcagctatactttcccactgccgcagttcgccactctcgccatcggggacgagggactgggagccaggatacttctgccgcgcggcgaccggtcgagcgaaatcgatctaccccaggtgcggcgggcgcggctttattctcaagattttttctgtgttctttagagagcagccatggacgagtggattcgccaaaccgaggtgtgggtgcaccaaaccgacagctggatccggcagcagcccccggagcagatctatgtagcggccgcggtggttgccgtcacaatcctgttgcttatcgtagcatcttgtctgaaatcgtctagaccaaacaccatagttctatctgggcttagtggcagtggcaaaaccactatttactaccagcttcgggatggatcatcacatcaaggaactgttacttcaatggaagaaaacagtgatacttttgtgctgcattcggagcaagaaaggaaagacaaagtaaaacctgtgcatattattgatgttcctggtcatgctaggctcaaacccaaacttgatgaagtcctgcctaaagctgctgcggttgtctttgttgttgatgctcaagatttcttgtctagcatgcaagctgctgcagagtacctttatgacattctgacaaaggcaactgtagtgaagaaaaaggtccctgtgcttatattctgcaacaagacagataaagttaccgcccactcgaaggaattcatcaagaagcagttggagaaagaattgaacaagcttagggaatctaggaacgccgtatcgtcagccgacatctctgatgaagtccagcttggggtccctggagaggcattcaacttcagccagtgccagaacaaggtggctgttgcggagggtgctggtttgacaggtgatgtttcggccgtggaacaattcatccgtgaacatgtgaaggcataggttgttcttattgtttttggggctccaaatggctatcctgatgagataagatgtacattgcgtcaatgtggttgttacctttcatgcatgtacaccttcatccggtgctctgaagttgcttagagacagtgaagcacagtcatattttgaactggttcagctgaccttgttatagaggcattgcatgttgcactgcttatgcctgacagtcatcggatatgaacagagcatgttgaaactgactggctttggttgttttccacttttgctccctaagttttactagcgcaaaatgccttgtcctttccaacgggtttcaaatagatgatttcatgacaataaaaaaaaaaaaaaaaaaagggcggccgctcgcgatctagaactag

SEQ ID NO: 175 - DNA, 769 bp, Zea mays
cagagcattactctgtttcatcatttattagtgttgttaacattcctttgcgctgctttcggcccttggcagggtacctttatgacattctgacaaaagcatctgtagttaagataaggatccctgtgcttatattctgcaacaagacggataaagttaccgcccactcgaaggaattcatcaagaaacagttggagaaagaattgaacaagcttcgggaatcgaggaacgccatatcttcagctgacatctccgatgaagtccagctcggggtccctggagaggcattcaacttcagccagtgccagaacaaggtggctgttgcggagggtgccggttcaactggtaatgttttggccgtggagcaattcatccgtgaacatgtgagggcgtaggtcgttcttattgttctcagggctccaaatggctctcttgatctaatgaggcaagatgtacattgcgtcaatggggttgcctttcaatgggactcttcatccggtcctttgaagttgcttaaggatgcgtttggttgcgggacaaatgaggacggaatagaatgatccctgggttgggggatggaatgattcctggtattgtttggtcggagggatgagatgatccttgttttttgtttggttagaggtataaccggggatggattggtcctgtcctttgtttggtttgagagataactgttacacttgtccttcacaaaaaatggaattcagtcaaaatgcttgcagattaaacaaggaaggctagcgccctg

SEQ ID NO: 176 - DNA, 1737 bp, Zea mays
ggcaggaatttccccggggggcccttttttttggaagacctctttttgttgaaaaacgacgcacatgcgacggtctcctgtcctgctctgtcccctctggcctccctagcagcttatactttcttattgtactttcttatagtcttccacggccgcagttagccacatctcgccgtcggcgacgagggacagggaggcaggatactcctgtcaggccgcgacgtagccctcctcctcttgctctccccgccatcctctgcttctcgtccacctgggattagatctatttcttggtacctgagcgatcgagtgaaatcgatctagccaaggtgcggcgggcgcggcttattcacgaattttctgtgttctttggaaagccgccatggacgagtggattcgccaagccgaggtgtgggtgcgccaatccgagagctggatccgccagcagcccccggagcagatctatgtcgcggccacggtggtcgccgtcacaatcctgctgcttatcgtagcatcttatctgaaatcctctaaaccaagcaccatagtgctatccgggctcagtggcagtggcaaaaccactattttctaccagcttcgggacggatcatcacatcaaggaactgtgacttcaatgggaggaaaacagtgatacttttgtgctgcattcggagcaagaaaggaaaggcaaagtaaaacctgtgcatattgttgatgttcctggtcatgctaggctcaagcccaagcttgatgttctcctgcctaaagctgctggggttgtctttatggggggtgctcaggatttcttgtctagcatgcaagctgctgcagagtaaattttgtgccccctgttttactttttagcaaatactattggtgtctatttcatctacttttactgtcctttgtggtaagttgaaattaacagtgtaattaggggaccttttcaaaccgagactgcagatattactctgtatgaatatttttctatagttaccgtttgtgtgactaggagatttcactgttcccaagattgcagagcattactctgtttcatcatttattagtgttgttaacatttcataacaatattatcatccttttgcaggtacctttatgacattctgacaaaagcatctgtagttaagaaaaggatccctgtgcttatattctgcaacaagacggataaagttaccgcccactcgaaggaattcatcaagaaacagttggagaaagaattgaacaagcttcgggaatcaaggaacgccatatcttcagctgacatctctgatgaagtccagctcggggtccctggagaggcattcaacttcagccagtgccagaacaaggtggctgttgcggagggtgccggttcaactggtaatgttttggccgtggagcaattcatccgtgaacatgtgagggcgtaggtcgttcttattgttctcagggctccaaatggctctcttgatctaatgaggcaagatgtacattgcgtcaatggggttgcctttcaatgtgactcttcatccggtcctctgaagttgcttaagaagcagtgaggcgcaatcatattctgcactggttcagctgacccatgtttacatgttgcaatgtgtatgcctgacagtcatcggatatgaatagagcatggtataactgtctggctatggttgttttgcacttttgctccgtaagtttttatattttcctgattttcgaaaaaaaaaaaaaaaa

SEQ ID NO: 177 - DNA, 1371 bp, Zea mays
cgacctgcagcatcttatctgaaatcctctaaaccaagcaccatagtgctatccgggctcagtggcagtggcaaaaccactattttctaccaggtaacttccaatatttttggtcgtgttcttacaattgaagaacaaggctgtgttatcttgtttgcaaaataatttctgaacctcattttttttattctatttacggtgtgagattagcattctagatggatatcagttctgctagttatcatgcttacatgtatgtctttgttattctgattgacttccttttttctatataaactagttggtttgtttttagttgactaaccaggatattttccccttttatctactcttagatcatttggcatttgtatcaatagcaagttttacaagtaggtgggtcatcttatacaatcttttgttgctctcctaatttgtctgtgcttgccagcttcgggacggatcatcacatcaaggaactgtgacttcaatggaagaaaacagtgatacttttgtgctgcattcggagcaagaaagggtatggaaacttctagagctcattctttttccaacatattgagataaaaatgaagtgaatagctttttctcttatgaagaaacatgcagttgctgactgcaatagttctgctaaaccttcctgttgcccttccgtgcagaaaggcaaagtaaaacctgtgcatattgttgatggtcctggtcatgctaggctcaagcccaagcttgatgaagtcctgcctaaagctgctggggttgtctttattgttgatgctcaggatttcttgtctagcatgcaagctgctgcagagtacctttatgacattctgacaaaagcatctgtagttaagaaaaggatccctgtgcttatattctgcaacaagacggataaagttaccgcccactcgaaggaattcatcaagaaacagttggagaaagaattgaacaagcttcgggaatcaaggaacgccatatcttcagctgacatctctgatgaagtccagctcggggtccctggagaggcattcaacttcagccagtgccagaacaaggtggctgttgcggagggtgccggttcaactggtaatgttttggccgtggagcaattcatccgtgaacatgtgagggcgtaggtctttcttatttttctcagggctccaaatgtctctcttgatataatgaggcaagatgtacattgcgtcaatggggttgcctttcaatgtgactcttcatccggtcctctgaagttgcttaagaagcagtgaggcgcaatcatattatacaggcattacatgttgcaatgtgtatacctgacagtcatcggatatgaatagagcatggtataactgtctggct

SEQ ID NO: 178 - DNA, 957 bp, Zea mays
  misc_feature (943)..(943): n is a, c, g, or t
aaaaggcccccttggtttttcaaatttatataagcaacgatagatatttgtaatagtactaaataagcatcattagaatcagatcccacaacatgattttagcctgaccatctgatgttgctgcagctgcgtagcaccacagggggcagcatacctcattgactacaaaccaactcttgggtagtcacccaataagtcgataaaacaagaaaacaactgtttacacatgctgacgaggctggcaaaagtatccggctcttcgggttaaaggggaactccagcatgccataccctaaggtaccatcatgtacagattttccttacagcatataacatcaaaaggaacagcatatagaaaaataagtaaagcagcaaacactcaattgcaaagctgctgttccccatcgtactatttactcatcctcgtcctcattaccatcctgctcatcatcctcaacctcagattttgacttgttagaaccttctgcttcatctccctcccgaacatcagctttggccttcttggagctagtgttctccttcttgcttgctttgccatcctgcttcttgctaccgccatacttcgccttctcctcatccgacatagagcgccacttctccccagccgccttgctcacctcctttacgcccttgagctcagggtgcttctccaggtactgcggcctaaactcagccaaaaacgcgaagaagggggtgagcccgcgcttggcgccgccgaccttcttgcgcttggcgccggtggccttgaacgaggtgtccttcatggcgacgagcggttagggtttgctgagggctagggtgcgggtgggactggggagcggaggggaaggctctgccgctctggtatggttcccttgggaaatgcggtgcgtgaaggttgggctgggtgcctccggcggtgtttgttccccgccccggccgngcctcgaggtaccc

SEQ ID NO: 179 - DNA, 842 bp, Zea mays
cccacgcgtccggttattgggaagatattggtacaattgaggcattttatagtgcaaacttgggaataaccaagaagccaataccagatttcagcgtctatgaccgttctgctccaatctatacacaacctcgacatctgccaccttcaaaggttcttgatgctgatgtgacagacagtgttattggtgagggatgtgttattaaaaactgcaagatacaccattctgtagttggactccgttcttgcatatctgaaggtgctatcatagaggacactttactaatgggtgcggactactatgagactgaagctgacaagaaactccttgccgaaaatggtggcattcccattggtattgggaagaattcacacatcagaaaagcaatcattgacaagaatgctcgaattggagataatgtgaagatactcaacgctgacaatgttcaagaagctgcaagggagacagacgggtacttcatcaaaggtggaattgtcacagtgatcaaggatgctttactccctagtgggacagttatatgaagcggatgtgcgacatgcaagccagagtgtcatcgacaatgatcagcatctggttacatgcctgatctgcagttcagtgtgctggagatcatggaaacaataaaatgtgtcattcaaggcactttttctctctctctgatcttttgtccttaaatgttgtgggttatatataatgttgtagcagaaacagttagtacaatgctgaatcaaaactggatggctggatttgggatgcatcttcgatgctgtgtcattgatcagtttaattaccataccgtgctgctttgagccaagccattt

SEQ ID NO: 180 - DNA, 1941 bp, Zea mays
ggattgtatacgcaaaactactttcctcgaattccccattctataaattccagttaaacttaattcgtaagatcaatcataattctcgagttgcaaaccatggacatggctttggcgtctaaagcctcccctccgccatggaatgccaccgccgccgagcagccaattccaaagcgtgacaaagccgctgcaaatgattcaacatacctcaatcctcaagctcatgatagtgttcttggaatcattctgggaggtggtgctgggactagattgtaccccttgacaaagaagcgtgccaagcctgcagtgccattgggtgccaactatagactgattgatattcctgtcagcaattgtctcaacagcaacatatccaagatctatgtgctaacgcaatttaactctgcttccctcaaccgtcacctctcaagagcctacgggagcaacattggagggtacaagaatgaagggtttgttgaagtcttagctgcacagcagagcccagataatccaaactggtttcagggtactgcagatgctgtaaggcagtacttgtggttgtttgaggagcataatgtgatggaatttctaattcttgctggcgatcacctgtaccggatggactatgaaaagttcattcaggcacacagagaaacaaatgctgatattaccgttgctgccctaccgatggatgagaaacgtgcaactgcatttggcctcatgaaaattgatgaagaagggaggatcattgagtttgctgagaaaccgaaaggagagcagttgaaagcaatgatggttgacaccaccatacttggccttgatgacgtgagggcaaaggaaatgccttatattgctagcatgggtatctatgttttcagcaaagatgtaatgcttcagctcctccgtgaacaatttcctgaagccaatgactttggaagtgaggttattccaggtgcaaccagcattggaaagagggttcaggcttatctgtatgatggttactgggaagatatcggtaccattgcggcattttataatgcaaacttgggaataaccaagaagccaatgccagatttcagcttctatgaccgttttgctccaatttatacacaacctcgacacctgccaccttcaaaggttcttgatgctgatgtgacagacagtgttattggtgaaggatgtgttattaaaaactgcaagataaaccattctgtagttggactccgatcttgcatatctgaaggtgctatcatagaggacagtttactaatgggtgcggactactatgagacagaagctgataaaaaactccttgccgaaaaaggtggcattcctattggtattgggaaaaattcatgcatcaggagagcaatcattgacaagaatgctcgaattggagacaatgttaagatactcaatgctgacaatgttcaagaagctgcaatggagacagacgggtacttcatcaaaggtggaattgtcacagtgatcaaggatgctttactccctagtggaacagttatatgaagtgaacgtgcgacatgcagctgtgtgtctcgacattcgacaatgatcagcacctggttacatgcgtgatctgcagatcagtctgttggagatcatcggagcaataaaagtgtcatccaaggcattttttctttctttttgctcttttgtgtccttcaatgttgtagggtagaatgttgtagcagcaaatgttagttacatgttgaatcgacattgggggcctggatttggggatacatcatgctgtaaattgatcagtttaattaccatactgtgctgctttgagcgaagccatggagaccatgctccacttttgtgcctgacgaatataagcgttgctggtttggagtgcggattctaaaaaaaaaaaaaaaaaaaaaaaaaaaaaaaaggtacccgccccggccggccaag

SEQ ID NO: 181 - DNA, 1930 bp, Zea mays
  misc_feature (8)..(8): n is a, c, g, or t
ggccgggnaccgcacaccaacgcgatctcccccgcccccggcccgcgggatttggccattgggaaggggcaggtagtaacgtaggctggcgctgcagatcaaaaggctctcgcctcggcttggcagtcggcactccctctccaccgcgctgcaggggcgacgcaaggccgagcgctcctcgatccagatccaaggtaggagatggctctcacgagaattggcctcgccggcctcgcggtcatgggacagaaccttgccctcaacatcgcggagaaagggttccccatctcggtctacaacaggacgacctccaaggttgatgagaccgtgcagcgtgccaaggtcgaaggaaacctcccagtgtttggtttccacgaccccgcgtccttcgtgagctccatccagaagccccgtgtcgtcatcatgctcgtcaaggctggggcgccggtggaccagaccattgccacgctcgcggcgcaccttgatcagggggactgtatcgtcgatggtggcaacgagtggtacgagaacacggagaggagggagaaggcgatggaggagcgcgggctcctatatcttggcatgggcgtctccggaggagaggagggtgcccgcaatggcccgtccttgatgcccgggggctccttcgaggcatacaagtacattgaagatattcttctcaaggtggctgctcaggtacctgacagcggcccgtgcgtcacatatattggcaaaggtggatcaggcaacttcgtcaagatggttcacaatggaattgaatatggtgacatgcaacttatcgccgaggcttatgatgttctcaagtcggtgggtaagctaacaaacagcgagctgcatcaggtgttctctgagtggaacaagggtgagctcctcagtttcttgattgagatcacggccgacatctttggtatcaaggatgacaagggtgaaggctacctggtcgacaaggtcctggacaagaccgggatgaagggaactgggaaatggacagtccagcaggctgctgagctttctgtagctgctcctacaatcgaggcgtccttggactccaggttcctcagcggtctgaaggacgagcgcgttgaggcttccaaaatcttccaaggtgactactccactggcctaccggtggacaaggcacagctgatcgaggacgtgaggcaagctctatatgcctccaagatctgcagttacgcgcagggcatgaacatcatcaaggccaagagctcagagaaaggatggggcctcaaccttggtgagctagcgaggatctggaagggagggtgcatcatccgtgccatcttcctcgaccgcatcaagaaggcgtacgataggaaccctaaccttgccaacctcctcgttgaccccgagttcgcccaggagatcatagacaggcaagctgcctggcgcagggttgtctgccttgccatcaacaatggcgttagcaccccaggcatgtctgcaagtctggcctacttcgactcgtaccgcagggacaggcttcccgccaacctggtgcaggctcagagagactacttcggcgctcacacgtacgagagggttgacatgcctggttctttccacaccgagtggttcaagattgcgcgcaactccaagatctgaacatggcctcgtgtttgcatatgccagtatgccaccgtgtcgagtaatcaatcatattactgcttgcagggaggaactgtgtttgatttttattttccatgcgcaatgcttaatttaggtcaggaagtccaaagtctctcccattgttttcctgtaagagctaagcagtaccagatggagaaccttatatttgctggaacatgaataaaagcatttgacatgcttgtgtttaaaaaaaaaaaaaaaaaaaaaaacaaaaagtaactctgcgttgttaccactgctt

SEQ ID NO: 182 - DNA, 3203 bp, Zea mays
tttcctccaattcccatccatcactaacttggcgggactgcgggacatcgacgcatcccatatctataggcataatggagcactacgactcctatctatgcagcggcagcatgcatagctacggcggcgttggcggagccacggacgcggcgttggacgccggcggtgacgacatgcagcgcctgctcaacgcgctcatggacgacatggctgccgagtccgactccttctccgacgacatggaggcagcctcctccgagtcctcgtcctccgcctgctcggccaacagccagcaggaggccacccggcggccacagcagcaaccggacggtggccacagcaacggtagcaacaagagctccaagaagcagcatcagcagcagccgccggctccctacatcggcgtgcgcaagcgtccctggggcaagttcgcggccgagatccgcgactccacgcgcaagggcgcccgcgtctggctgggcaccttcgacagcccggaggccgccgcgatggcctacgaccaggccgccttctccgtgcgcggcgccgccgccgtgctcaactttcccgtggagcgcgtgcaggagtcgctgcgcgcgctggcgctctcttccgcctcctctgccgcgggctcccctgtcctggcgctcaagtgccgccactccatacgcaagcgctccccgaacaagaacaagaacaagaacaagaagcaggagcggcagcaacagggtggccgtggccgccgccgcaccacagcagccgccgtgccccaccagcgttgtggagctggaggacctgggcgccgattatctggacgagctcctccgggtgtcatccgagttccattggcaataacccatagcgaatggcggtcctgcgaggtgcaagcgatagcgaggttgatgggttggggatcgagttcagttgtcatcacaaatacagaatgcctgcagattgttgctctgcactcctgctctgctctgtccttgctcgccaattgcgaatcgacgacgagttgcaactcttctttatgttcgcttgtattcaatctgtacaagcgccaccacggtttctctttgcttcagttttcctgtggattatttttttcaaacacagcggagtacgaataagatatgtctactcctaaaaaagtagattaaattcatttaatctactcctaaaagatttttacctctaaaagaattaagctctttagattgaattcatttaacaaaattgcaacaatatatatcttactttagataggtacatcgtttagtagcactgtttcgtgacagataatgcaaatatccatcctatgtcgctcttcatgtgggaggatgacttcttagctgcctctcaccccttctcactacagataattcactgttttatactacctccattctcaaatattttttaccagctaatttaattttaaactaaaaacgttaaataaaaaaacggagcgagcattaatttatactataggctgtgttgttcgtacaattaaatttgaatatagagatatggatagataatttgttggacagtaccgtctataacagtttacctaatctcatactataaacagcttatctatccttatatccatatttaaacatcattttacgaacaataccgtctatagtataaaataatgtttttggtaaccatatgagtgaactagtagacatagtcttatatataaaaaaaggtattttatgttaattgagcggcataccatccattgttcaattaaataacacacaaaatatctttgcgaccatgccaagtgcagaagacttgtccgagtacgagaaactaactggttgaaccactttctgtttgctttcttttcttgaggtcctcagggatttgacattttggcttcagcattttcaagtattttttgtttttgaagaaagatgatgagacttgcctctactgcaatatgcaatataatatgcaagaaagaaccaacagtttacatcaggaaagaaagaaggtgagaaaaaagtaaaaaaggatctgtatgattaaaaataagcctccaaccattattcctcatacaaaaagggaaacaatatttcaagtgactttcgatacctttctcgtttttttccgaaaaaaaacccgagatattatatatatatatatatatagcgtggcagccatgcacactgctttaataatctgagaggcattctatatatgcggctcgctgtacgggccaacagaattcggcgtggcagaagcaaatttgccgaggtgcatggccatttttttttacatgtatgagtatgacatgtgggacggactcggttgaaaagtggcaatatgcagtcttcatcctggacaatcaaagaccatcttctccattatttgttgtgcaattaaggtggccccgttgcttttttatgttagtaattcggaagcttccacgaatggcctgtgccctggggattggtttggtgcatatatggataacgagccgtatcacaatgttgattattactaataatatagataaatctatggtagcgatgcaaccgtatggtgtatattattatatactatatgatatatatattccgtttgtttgcacgtggcacagtgcatacaaaggagagatgaaggatccgacccagtctcctttccatctgtctgactctcgcctcacgtcagcccccacgtagcatctagctgactatgtacttggtcagtggcggcgtccgacaagcaaagcaaccaaatccgagcaacttctttccttctcccttcatcattctggtcgtcaatgcatggtaaactataataatgcaatgtcttgttttcttcgtttgacctccatggacgagggaagacaaaaaatgcatgtgcagtgcagatcaaagtaacttcttgtctacgtaattttgcaacaggtagatcgacaggacgtataggtatgcgtggccttcttataggagttgtgcaactcttacaatttacgcgagtctaggtgtgggtagaaactatagtcatgtccaaaaataaatataaagggacgtttgtgtccccagcttcttctataaattatctttaacttttattttctatcgcgtctagaaaattatttcaataggcgattggactcaatataaatattttctccctaaaattggaatttgatgttgttagatatgttctctaactcggtc

SEQ ID NO: 183 - DNA, 2295 bp, Zea mays
  misc_feature (2065)..(2066): n is a, c, g, or t
  misc_feature (2080)..(2080): n is a, c, g, or t
  misc_feature (2083)..(2085): n is a, c, g, or t
  misc_feature (2088)..(2088): n is a, c, g, or t
  misc_feature (2090)..(2090): n is a, c, g, or t
  misc_feature (2092)..(2092): n is a, c, g, or t
  misc_feature (2099)..(2102): n is a, c, g, or t
  misc_feature (2105)..(2105): n is a, c, g, or t
  misc_feature (2107)..(2107): n is a, c, g, or t
  misc_feature (2112)..(2112): n is a, c, g, or t
  misc_feature (2114)..(2116): n is a, c, g, or t
  misc_feature (2124)..(2124): n is a, c, g, or t
  misc_feature (2126)..(2127): n is a, c, g, or t
  misc_feature (2129)..(2129): n is a, c, g, or t
  misc_feature (2132)..(2134): n is a, c, g, or t
  misc_feature (2139)..(2139): n is a, c, g, or t
  misc_feature (2146)..(2146): n is a, c, g, or t
  misc_feature (2148)..(2148): n is a, c, g, or t
  misc_feature (2152)..(2152): n is a, c, g, or t
  misc_feature (2154)..(2154): n is a, c, g, or t
  misc_feature (2159)..(2159): n is a, c, g, or t
  misc_feature (2161)..(2162): n is a, c, g, or t
  misc_feature (2164)..(2164): n is a, c, g, or t
  misc_feature (2173)..(2173): n is a, c, g, or t
  misc_feature (2175)..(2176): n is a, c, g, or t
  misc_feature (2180)..(2180): n is a, c, g, or t
  misc_feature (2186)..(2186): n is a, c, g, or t
  misc_feature (2190)..(2190): n is a, c, g, or t
  misc_feature (2194)..(2197): n is a, c, g, or t
  misc_feature (2205)..(2205): n is a, c, g, or t
  misc_feature (2208)..(2208): n is a, c, g, or t
  misc_feature (2210)..(2210): n is a, c, g, or t
  misc_feature (2212)..(2214): n is a, c, g, or t
  misc_feature (2221)..(2221): n is a, c, g, or t
  misc_feature (2223)..(2224): n is a, c, g, or t
  misc_feature (2231)..(2231): n is a, c, g, or t
  misc_feature (2236)..(2239): n is a, c, g, or t
  misc_feature (2246)..(2246): n is a, c, g, or t
  misc_feature (2248)..(2248): n is a, c, g, or t
  misc_feature (2250)..(2250): n is a, c, g, or t
  misc_feature (2253)..(2253): n is a, c, g, or t
  misc_feature (2257)..(2257): n is a, c, g, or t
  misc_feature (2259)..(2259): n is a, c, g, or t
  misc_feature (2262)..(2263): n is a, c, g, or t
  misc_feature (2269)..(2271): n is a, c, g, or t
  misc_feature (2275)..(2275): n is a, c, g, or t
  misc_feature (2278)..(2280): n is a, c, g, or t
  misc_feature (2282)..(2282): n is a, c, g, or t
  misc_feature (2286)..(2286): n is a, c, g, or t
  misc_feature (2291)..(2294): n is a, c, g, or t
ccactctctttcccaccgccttcttccactactcttcaccctcccctcctccccatcgcgaactcacaagagaaccaagtagacgagggagaaggagatggcgaagaagaaggagaaggcggtgaacgtgtcgggcaagccgcggcactcgaacgacgtcaaccgccccaatgacaagaagggcgcgggcggcggcgccggtggcgggagccggtccgcggctaccgtgcggcggctcaagatgtacaagacgcggcccaagagggaccgctccgggaaggtgctcaggaacgattttcagtctaaagagctccccaacacccgcatcgagcccgaccgccggtggttcggcaatactcgcgttgtgggccagccacagcttgaaatgttccgggaggaactccagagtcggctttccgacaacttcagtgtcatcctgaaagaacggaagctgccactatcgctcctgcaagatcatcaaaagcaagcgaaggcacatctgcttgaagttgaaccttttgagcatgcttttgggccaaagggcaagaggaaacgtccgaaactaactgctcttgactacgaatctttgctgaagagagctgatgattcccaagatgtgtttgagcaaaagtatgcttcatcaaagttgccaagggaggaagaagaagatggcttacgtgatctagtgaggcatacaatgtttgagaagggacagagcaaaagaatctggggtgaactatacaaagttattgactcttcggacgttgttgtgcaggtgttggacgccagggatccaatgggcactcgatgctaccatctagagagacatctaaaagagaactgcaagcacaaacacttggttttcttgctaaataagtgtgatctaatccctgcttgggctacaaaaggatggttaaggaccctttcgaaggactatcccaccctagcattccatgcaagcatcaacaagtcatttggcaaaggatctcttctgtcagtattgaggcaatttgctcgtttgaagaatgacaaacaagctatttctgtcgggtttgttgggtaccccaatgttgggaagtcatcagttattaacacactacggtcgaagagtgtctgcaaggttgctccaatacctggagagacaaaagtgtggcagtacatcactctcactaaaaagatatttttgattgattgtcccggtgttgtatatcaaaacaatgattcagaaactgatatagttctgaagggtgtggtccgggtgacaaatttggcggatgctgctgagcacattggtgaagttcttaggcgtgttaaaaaggagcatctccaaagagcgtacaaaattcaagattggtctgatgataacgattttcttgtccagctgtgcaggaccactggaaaacttctcaagggcggggagcctgatctgacaacagcagccaagatggtacttcatgactggcagaggggtaaaatccccttctttgtaccccctccgcagcaaagcgacggcggtgcatctgaaagtgctgaacaacctattgggattaccaaagaggacggagtaagcagcgacaggactgccgcagccatgaaagccattgcaggaataatctcgtcacagcagaacatgaatgtgccctgccataaggaaaacaatgcagacaatgaagacactgaaaatgcagataacgaagacattgagagttcagataacgaagacaatgatgacatcgagcctgcagagcgatctgagtgatctttgggtacagatgtggattattagagttgatatgtcaaggctaatgaatttgtcagcccaggtgttgtgtagctacttgaccatatcactggcgtgccaggaaaaaaaggatcatgttgagttgcactttttgtaactatcgtacctgaatctttgtaatagggcaagaagagcagttttgctaggtacctggttgtatcgggatgcttatctgtgctgtctactacagatacagttacatctattttacttaaatcaagtggaagttatctctaaaaaaaaaaagcggcttcggcccctttnnctttcccagtttgnttnnntcntngnccttctnnnnccncnttgcngnnnccttctcntnncnatnnnccttnctttttncntttntntcctngnngnttttttttntnnttgngctgcncgtntttnnnntccactcnggngntnnnttttctngnnctggttnttccnnnnctttttntncngtntgtncntgnntttttnnnctcnccnnntnttcntctcnnnnc

SEQ ID NO: 184 - DNA, 5377 bp, Zea mays
gcctgacgcgcacgtgcgagccacgctgccctctcctgtcaaaaccctagtttcccaacatcgtcggctcctctctttcccaccgccttcttccactactcttcaccctcccctcctccccatcgcgaactcacaagagaaccaagtagacgagggagaaggagatggcgaagaagaaggagaaggcggtgaacgtgtcgggcaagccgcggcactcgaacgacgtcaaccgccccaatgacaagaagggcgcgggcggcggcgccggtggcgggagccggtccgcggctaccgtgcggcggctcaagatgtacaagacgcggcccaagagggaccgctccgggaaggtgctcaggaacgattttcagtctaaagagctccccaacacccgcatcgagcccgaccgccggtggttcggcaatactcgcgttgtgggccagccacagcttgaaatgttccgggaggaactccagagtcggctttccgacaacttcagtgtcatcctgaaagaacggaagctgccactatcgctcctgcaagatcatcaaaagcaagcgaaggcacatctgcttgaagttgaaccttttgagcatgcttttgggccaaagggcaagaggaaacgtccgaaactaactgctcttgactacgaatctttgctgaagagagctgatgattcccaagatgtgtttgagcaaaagtatgcttcatcaaagttgccaagggaggaagaagaagatggcttacgtgatctagtgaggcatacaatgtttgagaagggacagagcaaaagaatctggggtgaactatacaaagttattgactcttcggacgttgttgtgcaggtgttggacgccagggatccaatgggcactcgatgctaccatctagagagacatctaaaagagaactgcaagcacaaacacttggttttcttactaaataagtgtgatctaatccctgcttgggctacaaaaggatggttaaggaccctttcgaaggactatcccaccctagcattccatgcaagcatcaacaagtcatttggcaaaggatctcttctgtcagtattgaggcaatttgctcgtttgaagaatgacaaacaagctatttctgtcgggtttgttgggtaccccaatgttgggaagtcatcagttattaacacactacggtcgaagagtgtctgcaaggttgctccaatacctggagagacaaaagtgtggcagtacatcactctcactaaaaagatatttttgattgattgtcccggtgttgtatatcaaaacaatgattcagaaactgatatagttctgaagggtgtggtatgtatcttcagctgtgcaatttgcaaatgttttttttacctgggtagtgctggaggctcccgcatgagtgaggtctgggaaagagatgaaccgaggcaagcatcccccgcaaatgtggagagtctgcttcgaaccctaaacctggtgactcagggacagctctcacactgcaccatgcctgctcttgttctttttacttgtggctggcaaaaataattatttcaagcttgtagtgccccctccccctaccttgaatatatatcagaaagtattttagttcaagatgatgtttattcctgggatacatgtaaaacaatgtttagctcatacacttttccaagtggagttgacgatgaccagtcctgttctgtattaaatatatttgatgtcaactactcatcttagaatgttgtgaactgcgatgcacttgcaagatagtcccagtactcagccctcccgtaggaggcccctagagtaaaccagatctattcttcttccctctctctactaacaccctgcccctccttatagagaggtaatcctaacttaatagctaagcaacataacaaaccctatctggacggcgctgttcacgcgctacagtaaccgcacgtgaacagtggccgcggctaacctaaccataatgacatagctaatgggcttaaggcccataacatagaaacactgatctttttagttgttcctttatcaatacatgtatgctctctaatttatgtatttgtctcaaggtccgggtgacaaatttggcggatgctgctgagcacattggtgaagttcttaggcgtgttaaaaaggagcatctccaaagagcgtacaaaattcaagattggtatgttgtttagaacaatgttattgtttagtattaatatgattgcacctttcatattgttaggaatacaccaatcacttgtttatatgatgtgtgctccaagataaataaatattattggtttctagcatgctcctatgtataaacaccgattttttatagttacacttgaagcatgttttcccccttatattctaaaatgcatctatttgttgattatgaatatcataggccaaactttgattcaattaaaatccatagcaaggtctgattatggatttatcttttctctgcaggtctgatgataacgattttcttgtccagctgtgcaggaccactggaaaacttctcaaggtactgcatttgttcttaatatatgattatatcttgctatgtttctacaagtatttctccctgtagaaaaatggatatttaaccagatttttacaaaattctattactcctgtgttagaaaggcacagttgattttgttgttcattcacatggtaatggtattctttcccttaatataataattacacttttggttctcagggcggggagcctgatctgacaacagctgccaagatgatacttcatgactggcagaggggtaaaatccccttctttgtaccccctccgcagcaaagcgacggcggtgcatctgaaagtgctgaacctattgggattaccaaagaggacggagtaagcagcgacaggactgccgcagccatgaaagccattgcaggaataatctcgtcacagcagaacatgaatgtgccctgccataaggaaaacaatgcagacaatgaagacactactgaaaatgcagataacgaagacattgagagttcagataacgaagacaatgatgacatcgagcctgcagagcgatctgagtgatctttgggtaccgatgtggattattagagttgatatgtcaaggctaattaatttgtcagcccaggtgttgtgtagctacttgaccatatcactggcgtgccagaaaaaaaagcatcatgttgagttgcactttttgtaactatcgtacctgaatctttgtaatagggcaagaagagcagttttgctaggtacctggttgtatcgggatgcttatctgtgctgtctactacaaatacagttacatctattttacttaaatcaagtcgaagttatctctaaatttttattgcggcttcatgaatttttgcgtacctacatatttcaagccccatcttttcgattgtgccacgtagaggtcgataagctaaaaatgatcgcagaggtttagaggtatctttgttgaggaacaattgtttgtcctaatatgagatgattaattgtgtcgcattcaaattttatttgtgatactgtgattgaaaggtaactgccaatggaactaacatgtttttcgatacaggagaagccaaaaaagcagagacaaagattggattgaattaaaaaaaagtccctgaagaatgtacacaagattggattgaattagaaaaaaaaatccctgaagaatgtacacaagattggattgaattggaaaattccctgaagaatgtgtattgcgatgacccaataaagttaaaattgtttgcttttgtgcttttctcagacggccttggccctatttagattcgcgtatctgacaatcgcggcgtgtttggatccgcttataagtggattatagccagaagaattaagcaataatcctacccaaacactttgattatttcttaattttctggaaagccgcttctccctaccgcatcgaatacacacgttgcttcgcttattccttaccgcgattacctacactatatatgatgaacccagtgccagataaacgatcccggatccaatttaatattatgtatcgttacgatagggacgcagccagaaaaaggtttagtagagaatgaactaaactgttgtagtatagaagctgcttctacgttatattatgtatattttagatttttaggaggttctagtgaggctctatgggatcgaaaacggtaggagggctcgagtctcgcccgtcccaccgctggatctgtctccgcatactaatgattctatcttagaaatttatgactataagtcgatgcacacatgcgcgaacatgaatcaggacctgcaagaaggtccatcaagcatgtaactatgtaagacatggtgctagatatatatcggactctcgagttatcgtatgcacatattacagccacatgtcggagaatgtagcaaccggacaaacgatacacatttagtcgtgtaagatcaatctacatgaaacttaaacgaaacattagattgatggtaaaaaggataactagcagtcttgtcaacaaaaacgcttagcacaagaataagacggagcatcatatagctctgatgtgatctacttgagactatatcagggtagcatgacgtttatcttggaaaacccttaaaaagaggttgcaatatgccgaagggataaggaaatatgtgctattttggaacgcctatcttctgtttatttattgacaagaattgtatattttatagttcgtagactctaagcaacaaacacttaccaattaactctatctggctgatacacgacccattgggccaccttgacgctccagaccgattgacttagcgatccaatctagttaggatttagcgacaagaaccctactgtctagatgatactatagtttcaagcatgtttactgaaagtcaaacgggtaatcaatattgtgtgtcccttagtttaatctctccttttgaatgttttaagtgtttagtagcaatgtgaagtggaactatgtcgctttatcagccctatgaagcaggagtatttaagcgttttttatttacattaatattaatacatgaaacgtgacacaagactaaatgtcatatatagtaaggtcctggtaacacccagtattatctaatctaacagctttgcattcaagcacatcgcttcttgttaaaagttacaaggatttggagcccctgcgctcggcggggcttttgcccactgcgtctgtgccggacccgatttgttccttccatttaagtttattttcagcaaatcatgtataaggacatgcaaaacactatttatactttacaaagtgtagtttaaaaataagaattgagatatgaggtggattagggagagatagcctaactacgcgga

SEQ ID NO: 185 - DNA, 827 bp, Zea mays
ggagcgtgaaattcagagattatctgccaccatcataaatcatcagttaaagagactggagttgaaactgaagcagtttgcggaggttgagacaatgctcttgaaggaaagtgagcggttagatctgatgaggcagcagctggtaactcagcgtatccggatgttatcaacccggttcacttccacaggtggtacaatacctggaggcagcagcggtatggtttcaaacctgatgaatcaggccagcggccttagaccgccgctgatgatgccaggctcggtgacccagtccagcatgccggcaatgtatgcaaataacatgcaggggcatccccagatggctctgctgcaacagcggcaacagatgctctcgttcggacctcgtttgcctctctcggccatcaaccccggctcatcctcgtcggcacccaacatgatgttcaaccatggcatgcccaactcggcagctcctaatcatcaccctttgctgagatcaccctcaggggacaattcaaatgtaggttagtgagatgagtttttcattttttgggtcttagattcctgagctgtagcccttgactcgtgatcattaaccattgtaattcgattgcacaatcacatatagaggttgttaccagcgataggttctcattttctcttaggctgtggaccgtgtgtgcgtgactgtttgctcggatgagattgatgttgctagtggcttaggcgatgcacagaggatgtagagtttctttcaccctgactaattgttattactgcgccaccttagaatgatgtaaaaaatgaatccgcatgaattcccccttctt

SEQ ID NO: 186 - DNA, 1585 bp, Zea mays
attacgatgaacacagtccagtccaagtcgcttctgggaggcgtttcctatcgtttcggttcggcgcaggcgccgctaccgcctcctctcgaccgctcgccttcccgttcgccatgtcgttgctcgccgcggccattcccagcacttcctcccacttctccgcacccttcctcccctccttccgcatgccccgcaagaacctcaccgccccactccaccggatccgccgtccgcggccgttcaccgtcgtctcctccgtcccagaccccgcggcggggccggtggaatacacgccctggctcatcgccggcctcggcaacccaggcaacaagtactacggcacgcggcacaatgtggggtttgagatggtggatcgcatcgcggcggaggaggggattacgatgaacacaatccagtccaagtcgcttctgggaattggttcaattggcgaggtgccagtcttggtggtaaaaccgcaatcatacatgaactacagtggagaggcaattggacctcttgcagcctattatcaagtaccattacggcacatcctcttgatttatgatgatacaagtctgcccaatggtgtactgcggcttcaaaagaaaggtggtcatggtcgccacaacgggctacagaatgtgattgagcatttggatggtcgcagagaatttcctcgtttatctataggcattggtagcccacctggaaaaatggaccctcgggctttccttctgcagaagttcagttcagaggaacgagtccagatcgacactgctctggagcaaggggtggacgctgtgagaacccttgtgcttaagggttttagtgggagtactgaaagattcaaccttgtgcagaagtacaagttccacagggtttgaatgtttgaggatctgtgaaatacttgggcttacttctgcaaacaacctgatacacatcaatatcatttgaagtgttggatgtggtgatttgctgttctgaactatgcatgagcttacaagttcgatgaatctgtttgttaatcagtatagctgacaattggcaaccttctattgttccttcggtttttgcataacactctaggatctggagaaacggcaaccagtacttagctccacttgactataatctgtagaagccagagataacttgtgatgtgatatatccaaataacaataagggggcttgtctaatacatcgaacaagatgtgatgttcgtcaaaggagtagttctgacttcagtttcaagacataaaaacatctaataatcgcacttccactgccttttgctgttaaagaacatgtgcctagttcttttcaaattgagaagtgggctctaaagttttacatgttacatttataaagccctttcttccaccatcatgttatctaagcactttgctaatccctttcttaaaggcataacacagctagggcgttaagtaattatatatctccatctgttgatcactcgcatgcagattgtaatagttttttttttccaagtgtcgcaatcgtagctgtattagcttattcaatgctttatactggatccctgtgctctaaaaaaaaaaaaaaaaaa

SEQ ID NO: 187 - DNA, 1159 bp, Zea mays
ggccgggagcgcggggccccagggcctctccgctcctgctcctgcagtcctgctctctctctctctcttggcgtcgattgggcgaccgccgccacctcccccaggtcttcgctgcgcccgtcgccggtgacgagcacccaccaggttcggaaacattgctgacattcacctgtaccacagtagttcagtagagtagctgtcggactcggaacacacatgccggcgatggcaactgctcctgtgaaattttctgtggctacgaactccccctgtgtccagcctagcttgcccctgaggcgtacacctgccaccatctccttcccctgtcgtccatggtcagccgcaatgacctcatgtactggattgttgaggcgctctgacgtggttgcagctgcggggcaccacaagttgatgggatctttgaccactaacgagggactcaggtttggggtggttgtggcacggttcaacgaggtcgtgacaaatttgttactacagggtgccctggaaactttcgagcgatactctgttaaagaagaaaatataacagttgttagtgttcccggaagctttgaggttcctataacagcacaaaagcttgggaaatctggaaaatttgatgcaattctgtgcattggagctgtgattagaggtgacacaacccactatgatgctgttgcaaactcagctgcatcaggtgtactcaatgctggattatctgctggtgttccttgtgtatttggtgttctaacctgtgaagacatggatcaggcgctaaaccgcgctggtggcaaggctggaaacaagggtgctgaagctgctcttactgccattgagatggcctctctgttccggcatcacttaggctgacactttgcgtattctggtttctatacacgaggcaagacatcatttcttcctatcaagagtttcggctaatagagcttttccgccgcggctagtataattattttcaattctgttggtccggtgctgattggttgctttctttctatgagatttgaaaagctcacgagacatgtttgtaaacctggcacaatgaataattgtcaccatgaacaaaatatggtcatgaataaggttgcacacttcatgaattgaaagatcaaaaggccccccgctcgcgatctagaactag

SEQ ID NO: 188 - DNA, 1109 bp, Zea mays
agctatgggccgctattgctgaaaagagtaaaaaaaccgacagccacagggcagggagccagggccgctccgctcctgctcctgctcctgctcctgctctctctctctctctctctctctcggcgtcgattgggcgaccgccgccgccgcccccaggtcttcgctgggcccgtcgccggcgacgagcacccaccaggttcggaaacattgctgacgttcacctgtaccacagtagttcagtcgagtagctgtcggactcggaacacacatgccggcgatggcaactgctcctgtgaaattctctgtggctacgaactccccatgtgtccagcctagcttgcccctgaggcgtacacctgccgccatctccttcccttgtcgtccatggtcagccgcaatgaactcatgtactggattgttgaggcgctctgacgtggttgcagccgcggggcaccagaagttgatgggatctttgaccactaacgagggactcaggtttggggtggttgtggcacggttcaacgaggtcgtgacaaatttgttactacagggtgccctggaaactttcgagcgatactctgttaaagaagaaaatataacagttgttagtgttcccggaagctttgaggttcctataacagcacaaaagcttgggaaatctgggaaatttgatgcaattctgtgcattggagctgtgattagaggtgacacaacccactatgatgctgttgcaaactcagctgcatcaggtgtactcaatgctggattatctgctggtgttccttgtgtatttggtgttctaacctgtgaagacatggatcaggcgctaaaccgcgctggtggcaaggctggaaacaagggtgctgaagctgctctgactgccattgagatggcctctctgttccggcatcacttaggctgacactttgcgtattctggtttctatacacgaggcaagacatcatttcttcctataagagtttcggctaatagagcttttccaccgcggctagtataattattttcaattctgttggtccggtgctgattggttgttttctttctgagttttgaaaggctcacgagacatgtttgtaagcctggcacaa

SEQ ID NO: 189 - DNA, 1154 bp, Zea mays
ctcgaggccggccgggccgggaacgccagtcagtacgtcgctgcctttcctctcccgactcccgttcaccacactactttccctcgtgcggccgccgccctacaacaggtgccccaggtcttcgctgcgccattcgccagcgacgagcacccaacaggctcagaaacatcgctgacatccacatgcaccacagtagttcagtagagtagctgttggaacccacacaccggcgatggcaactgctcctgtgacatcctccatggctacgaactccacctgtgtgcggctgcctagcatgcccctgaggcgtgcacccgccatcgtctcctttgcctctcgtccatggtcaaccgcaatgacctcatgtactggattgtcgcggcactctgatgtggttgccgccgcggggcaccagaagttgatggggtctttgaacaacaacgagggactcatgtttggggtggttgtggcacggttcaacgaggtcgtgacaaatttgttactacagggtgccctggaaactttcgagcgatactctgttaaagcagaaaatataacagttgttagtgttcctggaagctttgaagttcctataacggcacaaaagcttgggaaatctggaaaatttgatgcaattctgtgcattggagctgtgattagaggtgacacaacccactatgatgccgttgcaaactcagctgcatcaggtgtactcaatgctggattatctgctggtgttccttgtgtatttggtgttctaacctgtgaagacatggatcaggcactgaaccgtgctggtggcaaggctggaaacaaaggagctgaagctgctcttactgccattgagatggcctcgctgttccggcatcacttaggctgacaccttgtgtattctgattttctatacacgaggcggcagcatttcctcctatcaagagttttggctaatagagagcttttctgccgcggctagtataatttatttccaagtttgttggtccggtgcggattggttgctttccttctgagacctgaaaagctcacaagacatgtctgtaaacctgacatcgtgaataattgtctccacgaacgaaatatggtcatgaataaagctgcacaagtgttttgtcaaaaaaaaaaaaaaaaaagcggcc

SEQ ID NO: 190 - DNA, 9114 bp, Zea mays
  misc_feature (9072)..(9072): n is a, c, g, or t
tcggtaccctggtttctgttgttgctggtaacgcttcatgcaatattgtttttctctctagcactttagttttagtttaccacaggttagcaatattcctagtgttctatattttaatgatattttctcctaatggatctctattattttactgtaccctgatttgctatttcattgaaagaaagtactgagaatttgtttgatgttctaagttgctaattttgcataccatcttaccatctgccaagtatatatcaactgtttctttcttccaaaaggcatgtttgtgcgacctactatatggagatctttattgtcaagcaagactgagtaacagtgatgttggttaataactaatattaccagtatgacagttgattcatgactagtaaagaattgttatcctgctagctgtacttctaacaaagacgcgtagctgtgtataccacattcattgtgtaggtatattttctattctaaatatttcctttgattttatcatacagagcttgatgtattgacaagtcttgctattgcaagtggttattttgagggaccaagttgctgtccaactataaaagaatcaaatggcacagacgatactcctactttccatgctagaaatcttggacatcccattctacgaagtgattccttaggcaagggttcatttgtaccgaatgacgttaagataggtggtccagggaatgccagttttattgttcttactggtccaaatatgggtggtaaatcaactctcttgcgccaagtttgtcttaccattatactggctcaggtaattcaccatctttatcatgtatatatatcagcattgcttgttcatgacaactgatttcatattctttgccagattggagcagatgttcctgcagaaaaacttgagctttctcttgttgaccgtatcttcgttcgaatgggagcaagggatcatattatggctggccaaagtacattcttggtggagctcgaggagactgcctcagtgcttgtaagttcttccttggagatatgaggatttatattaatttttaattttgtatgttctcaaccgtgttcaacttttgctccagtcatcagctaccaagaattctcttgtggtgttagatgagcttggacggggtacatcaacttctgatggacaagctatcgcgtaagttggattactggtcataacattggttgctgcctacttctgatatctatttattctcttgtagtctcatttacctttaataatgctcactatgagatcactgactcgcccttactactacaacagggcttcagttctggaatatctagttcatcaggtgcagtgtctaggcttgttttctacacactatcataggttagcaatggaacacaacgataccaaggtaatcgacacataccttgtccttttttgttgttccttaatccaactttatccaatgttgtaacctgcatatatgaatactgaacatcgcaggtatcgctgtgccatatggcgtgcgaggtggtcgagggagtaggaggtctggaagaagtgactttcctttatagattaacacctggtgcttgccctaaaagttatggtgtaaatgttgctcgattggcaggtaattctcaagctaatgcacttgtttcttaatgtcttctgctctgaattcaaatgctctttttcctcgggccgtgttatgttgacacataataccatgcccatttgctgtcttcgctcttgatactcaggaattcctactaaattgcttcaaagagcgaatgaaaagtcgagtgaatttgaggccaattacgggaagcgacacaagatgaccaacgataagcacgtcagtgcacagagcgatgataagttttctgccataagggatctgtttcgaattgtgaagacatggcctcgtcctgaagatcaggaagcgagtataagcatgctccgtaaattgcagaagcgtgccaaggtataggctgtggaaggctaggtaggcgattgttacatagcatgctcgcctggtagagatggcctcgttttgctaccttggtggcattttttttgttggattggcgtcataccgagaggggagaaaattacgtggacacgggttccaatcgaggacagcattgccctaggtttagtgtggaagcagaaaaaggctcagtcccatcggatgtgtcaggattcattgatgggacgtggattgagaattctgcgtctacagctttactatcccttccaacaattttgtgccctcactaattctcctaccaggccaggagccccaaggtattggtctgtcctggtttgttcgagctcggtagggtgttggatcagtgctgacctgagacgtggagaaacatcccggactgtaactttcctgaagggttaattatgattactatatgtaaatcagaactactctctcgaagttgcaaggcaacttaggattaattttagtgcctttttgtattctgaaaagttcgagcttgtatttagtcgagatttgagctgtaatccaaaacaaaataggccccactccaacgttttatagccttatcgtagaacgatacaggacacgtggacatgaatcttactacggttattcccatctgggttagtttgtgaacttaaatcctttgggatctcctggggtgaggaattttaggagatactatttaaataagatatttaattatttatgataggttttttctctttacctctccttgttagatctgagcatagaccttctgatccaacgaacttgctcgaaaaaaaactgattaatgcaaatctgattaatgcgatgtatgggtatatgctagtgtttgaccagtaaccatccatgggttaggtacagttcatcccaaacctaatctaagctaaaaaaatccgacccaatctagaaaaaatctaacccgacgtgttcaatagaggcatgggctaatctaacataactcgatactatgcatgagttggacatgagccggatcaaacgatccaatatttacacgatccaatctttacttgacccgacgtttgaacgatccaacctttatgtgacccgacgtttgaacaagtccacactttgctttcaaactagcactttaaatccattcaatctccttccatctatatgaattaagattaaaatgaacatgtaaagagtgctaataaccttcccacgggaccttgcagaatactagcaataccgattaccgtaggagtcgatgaatctaaaagtaaccaaaatgtgaaagcatataagcgggtccacggtccaaaactccgaatcaacgagccgaagaacagcagagcagtcgtagaaaaaggatgtgtggaagcggaaagggcactgcatggaagccagcctgcgctgcttgtgccccggaatctgattcccaaaaagcacatagatcgagcccacacgggaatgaatcactcgagtgaagcgtccataaaagatcaggctcacaagttacaagtagtcaagtacggctgcaagcaaagcgaagcacaccaaagcgagcatcaagcagcgcctcgcacgctaatcccttcctttcctctgctggccgcccttaacagcactcggtcctcgctctccctgcggcggcctttttcacactctgcacctcctcccctccggccagtcgaaaccgtcgccgccgccgccgggaggagaagagctccatggactacagggtgagtgcgtgccaacatgagggtttcatgttatgtcagtcctagcaaaattgttgtcgagagctgaaactccgagaggcagttaagtgacgtgtgctctttactctcagcagcagtcctactgcatgaccctgaggatgaacatcgactgcaacgggtgctaccagaggatcaggagggcgctcctccagatgcgaggtaaacactctagccgcccatctgcggtgatgcctgaaaggctgaaacctcggtttgtgaagcttctctgaactgaacctttttggtttttttttttgcagagctggagaaacacctgatcgacaagaagcacggccgggtcgtagtgtggggcgccttcagcccgcaggacgtggccatcaagatcaggaagcggaccaaccgccgcgtcgagatcctcgacctcagcgaggcctcgccggcagccccagaaggcggccccgacggccacatgtcctgaaggaaccacgtcaccaatacgtactctggagaactgcttgctattctcttcactcttcaccaaggcaggcccgcctcagaggacgtaaccatatgcctgcctggcatcttttaccttcttgtaatttaggaatcctgcatcattttgttctgtaactgtgaaggcttgttgaagtaaccagaaaaaaaatctaggtaccgttctaaaagtccatctgatgcgaccagagaggctatgctcgtttgctttaactttactcaaaacaggaaaaaatgatctgttgaatttcctgtcaattagtattgtccagttaagacataaacaagatctatataggaaccaggaagcagcctctatcattattaatgccccaaagtgtttacacaattcatggtttcttgaatcagggtctccctccaagaatagataaacacacggagcgaaaacgatcagtgtataaactgtacacaaaaatctgtatgtggagatataacattgaaaagtgtctttttattatctatattggcattgtcttccaattgtgaataaaaaaaaattgagaacttgtatgaagcttcccttacaatgtgaggcattcaggatcctcaacaatctttgcaaatgtttgcaggaatgctgccaaatcagcaccatagataatcctgtgatcagcagtaacattcccctgaaaaacaaatggcaggatcaaccatctctgcagggaaaattggttgctattatggaccaggatcgtggggggttttttttttgcccctgttctgtgagtatgatgcctaccccacccccaaattgctcagcacaaaagacttcgttgttgttttgagaataggatggtatggtgttgtataaatctagaatagttcttattgacaacaaaaattataacacatcattggagatcattagtatgtacttatgtgacagaaaataatcagtgttaatcactagtactgaataaggaggccaagcattgtaattactgatttatcatgacatgattgataccaccaaacaaaactttatcacaacacataattatgatttagtataaaaaccaacttagatacacacaaaaaaaaactaatcatcaccttgctaacatagaagtgtgaatctgaaaccgcagcaagcctacaccgtgcctcttacattcaggcgcagtcagccaatccttggcttgcatatatttgatatttgaaatgatgttatgacataaatttcacttacatgttctagggaacaagcagacggatcacagattatttgggctttaaggtttagctatgttaacaccaaataaatttcataacatactactgcggtttagcatttctaatgaaatgtgctaaggaaaatacacaattgatcttcacaattacatgtaaatgccagaaatactaaacatcagtcagtaaccagagcttcggtatactcaaattttagatacagatacgagaataaactaaccagcatttcactcttgatactaaagaaaccatccttatcagccactacagtaggtcttgacgctccaacagccatgatagccccctgcatataaccatgcaatcttcttgtgtttaataaaatagaatacaattctatcaacatttcatactaactagacaaacatcagacaccagggaagaaacccatacaattctatcaacatttcatactaactggacagacaacatacaccagggaagaaacccacctgaccagcaggaaggattgcgtcgaatttatccaccccaaacatacccaaattggatagtgtaaacgtccctacagacagtcagctcttcaggtaagcaaagttttcgtgaacagctgatgtcaatagagcaaaggatatgttgtataccagagttgtattcatttggttgcagctgcttcatgcgtgccttcttgagcagcactctccactttcgtgcaagcagatatatatccatctgccatgtcaatttttggagctacttagtagacgaaaattgtatgcactcgacaatccactcataccctaaaatgctgcgttgccaccctcgagtgcaataagcaccgaccttatcagcatcctctaatactggagtaagaaggccaccctcgagtgcaacagccactccaatgttgacatcattgttgtaggagaagctctttccatctctgcacctagcatttactacagggtgttgggtgagcgccacagctgccgccttcaccagcagcactgtctttgtaaccccctttgacttaacctatatcaaactcaaatcaatcagtacagcatggtcgaggtatgaaatccaacgctctgcctgagatcaatagaaaattgtaccttctcatagagtgcgtcaagcttgtcagtgatcatggagtagctaacccggaatgtcggtaccctcaagctctccaccatgttcttgctcaccgccgcctgcattgtcgtgaacggcaccaccgtgccaccgggtactggtggcagcaccgcacttgcgggcactagtggcgcagcgtcaacagaagcagggggtggaggtggagggggtcgcttgtgcttgatgccagcagctgcctcgacgtcagccgccgtgacgcggccgtgtggcccggtgccgacaaccccggcgatgtccaccctgtgctgcttcgcgagtttcttggcgtaaggtgtcgcgatgccctttgtcgctggaggcgccacaggcgctggaggaggtggccccagggcggcggcggcatggggaggagagggtgcctggctttgtccctgcgagagggcctgagcgcgcgcccgcgccagcgcgacctcctcctctgattcagcgaggagggcgataggggcgcctacgggggcggtcccaccggccgggacgaggacgactgcgactatgccatcgtggaacgtctccacatccatatcggccttgtcggactccacgaccaccactgggtcgcccttgcccacgcggtccccctcggcggccgtccaggagacgatcttgccctccatcatcgttgagctcagcgccggcatgaatatctcccgaatcttcgccctcaccaccgccatcctcctccgccgcggcgcccccggagcagcaaggcgcgcgcgtcccggggcggtggggacggagaggcagggaggaatcagagacgccatggtgcactggttgatgatcactgaacaaatgtcccccctttcaggactcggttgggttgggtctaggagaacgcgggcagggcggcggaatccggcgagcggcgcgaggtgggagacgaaccagatcgttaggtgaagccgtgaaggcggccagccactgcagtgtgggcccggggcgccagccgccgttaatactccgtaccctaatactatctcctgcagattacccatccatgtaccagattacccatccatgtacctgtattcaaattttactctgcgattattgcggtctataatggaaaatagtatatatagataaaatttgaataatatgctggagttgacctaccatgtggactaaacgcctcttagtaaaagctatgccgtagcaactccaagagaaagctaaaaaaagtcccaaaacgttttaagggagaaaagggccacatcttctctccaacagcatactgttaatacttttccaatttttaattatcgacagccttcctcctgcgtatttatgcaaaccaatgatatccaatttatatctatactatatttaaagcatcagtttcaacggtcatcccgcgtcatctttttacaaataatccctcatagttatttcaaattaatccgttgcacgcctatagatggccaaaggcgggcatggaccagacgcccgcggggcacctctagcccagacacgtcatgctgacctactgactgtgtcggaccagctcgttagcccgtcgacccatttgattaaatcaacgtaaaatgtaacagttatttcaaattaatccgttgcacgcctatgaatggctaaaggcgggcacggaccagacatccacggggcacaactctggcctaggcccttggattcgtttcgcaaagggagaacatcttggctaaacactgacacaatctacaaataccacttccaatacaatttgtagaaactccgactcccgttcagaaagaaatgggacttcctccgagaggggattcactacttgatgatggcccgtcggctcatttgattaaatcaacgtaaaatgtggaggtggtgattgaacccatgctctgatagaagaagagcgggagacactgtctaaccagtagaacatcatgctcaaatatttttaatattgaatataaattatatatgtatatacgtttttttgtaaaataaaaaaatataatcgtgtcggaccggaccgggccgggccagcactacagaccgaggctaccacaacagcacgcacaggtcatttttcggcggccagaggccgccgaaaattagctattttcagcggctttaggcctattttcggtggtctctggccgccagaaaaaatcagccgaaaattagcacttatttttggcggctgacatctggccaccgaaaatagcttattttcgacggccaatagaacagtcgtcgaaaataagtgccaattttggcggccagacgtcgctgccaaaactaagggctgccgaaaataacccatgcttattttcggtggctcactgaggccgccgaccaacagaacagccgccaaaaataagttctcttcccatcaactatatgtcatctatgttggttcccaagagtgtgctcaatgccattgatcgttgtaggcgtgccttcctctggtcacggaacgatgcctcgttgcctcgaatgangtttgtcgtcccaaaaaattgtggcggccttggccttcctac

SEQ ID NO: 191 - DNA, 872 bp, Zea mays
gggcccggcccccccccgggggtcgcttacgtgggccccccccccttttatttaacctgattcactcaagtacatttttctgcagtgatgaaaacaagagaagttcatcagttgttctttatgaagatgcatcaaagaaactgcttcaacagtttacttctgcgctttgtggatgccagcagatgttccatgcatgttcttctattagtacattgatatgctcagagggatctcaacttattgatttgctgtcaccaggcaaaggcctatcaaatatttcatctattttagaccgattcagagatgcatttgattggtcagaagcagaccgcaatggtcggatcattccttctgaaggttgtgatcctgaatatgatgccacttgcaatgcaatagaagagatcaaatccagtctaaaagagtacttgaaggagcaacgaaagcttttgagacctgcatcggtagtgctacaccatacttctttttcaagctttgcatgattaatgatttgttagtctctttgccaattaactattattcaacaaccattcaggttaattatgttaatgttggaaaagatatgtacctaattgaagtgcctgagagtttgggaggttcagttcccagaaactatgagttgcagtctacaaaaaaggtaatcaaaatgtttctccctcttgtatttaagtgtaaataaatacttaaatgtataactgagctactactattgcatacatttgattcgctaatatatatctactacttgttttacaaataatgtgtaccttactacctactactaataacgaaaaaaaaaaaaaaaaaacaccctttttgaaaaaactatgacaataaagtcttaaccgcccgca

SEQ ID NO: 192 - DNA, 6576 bp, Zea mays
  misc_feature (6078)..(6078): n is a, c, g, or t
cgttgtgctaacaaaatcctgtaacgaatttattggatgttggtgcgaacatgtgaacattaagcaactggtattctattcgagccctattacataaagaaatcggtccccctgaaaaatatgtatcctactttctgttaatttagtatatattttaaaaaatttaagacggccttaagagaatatccaaatgacacatgcaactataacgtatattcaattagggagtttttttctctcaaattatggtttccctcctaacaaactttgctaatataagtttagaatttcaggacagagaaagtattaagaaaacatttgctgcatatatgatatatcttcctgttgacaatttggcatgcagcgctctgtgcatatttggaaaacaaaaaatctggagggccaggctggaaaattccattgccagcttgctgcgcgcctgcgcttccttctcgaggcggcccgcggccggctgtcaaatactacgaccccatcccccgattccaaccccacgagaacccaaagtcccaaaccaaacggccgaacccctgtgccgcgcaggctgctgcaatgctctccgtctccgcctccgatggcgatcgctcgccgtgtccggtggaggcacgccgcatcgtggttacccaccgcctccccctccacgcggagcccaatcccgacgcgccgtacggcttcgatttctccctcgacgccgacgcgctcccgctccagttggcccgcggtcttccccgccctgtggtcttcgtcggcgcgctcccctccgccgcggcgtcgatctctgcgtccgaggagctcgaggccgatctcctcgcgcgcttcggctgtagcccggtgttcctggaccccggcctccacaaggacttctacgacggattctgcaagcgctacctgtggccgatgctccactacctcctgccgttcacgctcacgcccttcttcggcagtggcggcctgaaattcaaagcgaacctctaccgcgcctacctcaccgccaacacgcagtacgccgaacgcgtgctcgagcaactcaaccccgacgaggacctcgttttcatccacgactaccatctgttggcgctccccaccatcctccgccacaagtcgccgcgcgcccgcataggcttcttcctccacacgcccttccccacctccgagctcttccgtacagtcccggttcgcgaggacctcctccgatccctcctcaacgccgacctcgtgggcttccataactacgattacgcccgccacttcctctccgcctgcactaggctcctcggcgtcaccagccacacccatcgcggctacatcagcatcgactactgcggccgcgctgtttccgtgaagatcctcgccggtggtgtcgacataggccagctacgtgaggtgttgtcgtcgcccgagactgaagcgaaggccaaggaggttgccacgaagtttgccggtcgtcagttgttgctcggagtagacgatgttgatttgttcaaggggattggcctcaagctcttggctatggagaggctgctagagtcgcagccggagctacatggccaggtggtgctcgtgcagatcaacaacccggtgcggagtcctgggtatgacaccgacgagatttgtgcggagctgcaggcgatgcgtaagcggatccacgcccgcttcgcgacgccggcggggtatgaaccgatcgtgatcatcgaagaccccatgacgatgcacgagaagctggcgttctacacctcggcggacatctgcctcgtcaccgcggtgcgcgacggcctgaacaggacaccgtacatctacaccgtgtgccggcaggagggtccgatctccagtggcgtggtgggggcaccgaaggagggcgccatcgtcctgtccgagttcgtcgggtgcgcgacgtccctgggcggcgcggttcacatcaacccgtggaacgtggacgccgttgctgaggggatgcacatggcgctgaggtttaatgggcgcgagaagcaggtgcggcaagagaagcactacaggtttgtttccacgcacgacattgcctactgggggcgatcgctcgaccaggacctgcagagggcgagcaaggatcacgcgtccatgaagtttatgagcgttgggctcgccatgagctaccacatcgtcgtgcttggtcccaacttccagaagctctcacctgagcacatcaatccatcgtaccagcgggcaggcaacaggctcatcttactggactatgatgaaaacagtaatgtcccatccggggctgctcgacagacatcctagccagcggttgattggcatcctgaatgaactgtgctcagatccaaagaatactgtcttcgtagtcagtgggcggagcaaggatgaactggctcgatggcttgagccctgtgaaagactggggatctctgcagagcacggctacttcacaaggtaaacaccgtttcctcgatcccatgttcccatggcatgtacatctttttggctttgtgaaacagattgctgcattgctcttgttggcatttggtaagtgacaggtggataagatggcctaggctaggcccctagctaggtgtgggcaattttcagtgtttggtgtttgctaattcctttgccatcaggtcaatacgtacactgttctgtttgactaactgctaatagaaattttgtcgctaatggttctgaattagcgagctcaccattgtacttttgacatacgcgttgaacatacatgcatgcagttcttgaaataaataaatctgaccatgcatcatcttggtagtgagttgatgatgttgactgtctttactccatattgtagtatagtatgacaagtagtgcttcctatacgacggcagttccatttgtctctgtattctactaccaaagttattattccgtgcgcatgtagctgcaaggacattcaggaataagattagattattggctgcttcttgaagtaactattatgtgtttgtttatcaggtggagcaggtattccccatgggagtcacccgacctgaaggtagactatggttggaaaaagatggttgagcctgtgatggacctttacgtggctgtaactgacgggtcatccgttgagactaaagaaacagcattggtctggcactacgagggaactgatccagttttcggaccaagtcaggccaaggagctccgggaccacctgagcgacgtgcttgccaaagagcctgtatctgtgagaagcggctacaatatcgtggaggttaatcctcaggtacgtcaacatctaacaatctcacgtgctaacctttttagattagatagctactggtattatacaccactcttaatcatctgtaccctctgtgtgtgggcacaagccaagacgaaaagaacaagcctcgaaattccaccggtagctgtcgcgatcaatcaagtgtagctttcagaccaaaacgcatttagattagactggaggttaatcaagtgtagctttatgttcaaccaccatatatctctttagcatatagtttaacatttttagtcgtctgtattggctgataaaattttgatgagccatgctcgcgttgcctaggcttgactctattctattgattatgttcaccactgcctagttatctttggttcccaaatgtgccaagttaatctcgatgaacggatttttttttcctcacaacaagttattgtattcttttgaaggaggtggacaaaggaaccgccgtgcagagaatcattgcggccatgagagatcggggaagaatgccagacttcatcctatgcgtcggcgacgacgcgtccgacgaagacatgttcaaggctgtcactgcaccgtccaacaagtccgcgttcccagaggatgccgaggtattcgcttgcaccatcggaaccaagccaagcctggccaagtactacctggacgaccccgtggaggtactgtcgatgctcaagggcctgatcaagtcgtcggtggaggagcgtcccggggacggggaagggccgtcgcgggtctcgttcgactgagagaagaggctcattttgtcgagatattcttcgttcttttttgtaacaaaagggttaggaaaatggccaggagggtgcaaaggaagaaaacaaaaatccactaggctgataggttactgatggctgatcattagcgcgaatgacaacagggttctggttcattttttgcaatcctcagtagtagtagtgtccttgtacaattcctcagaaattttgtccaaagattggaacgaaggaaagacagggtacaaagaaatcatatcgctggacgctccatctggtagtaccgtaccgtagtagccggcacaaggacacatgacagcagtgggcagtgtagcagtacaattgttacgtcttcccgcggcacacatgacagattgtttttgcttcaagaccatcgactcaatcgtttcacttattaagcgcccccgcactgtccagtggcatttgttgttggcgtttaaagccggccgaccgtgtccgtgtgtgtgtttgcagcgggagccggcaggaagacagcgagcagtcgagcaccgagcagagtactgtacgggccaagacaacgtgtgacgagttgcttcgctggcagctggtcatcatgctctaggcatttatcaaagccgtgttctgagcgcggctctctcgtcttttttgcctcccttggcaggtccggttcttcgcagggcaacgatctggacgttgactcaagggctagctggctggcccttggcagggccggttcttcgctccgtggctcgcgtgttgtggtccgcagtccgcacctcgcatttcgccttgctcgtcgtgcctgctggctaggtggtggtgtccgcgtctccccctacgacgacgacaacaagcttgcggacaggtccttgtccgttgatcgccgtcggtgactcccaccggggagcttgcttccccgctgccgtgccgtgccgtgccgtttcgtgcgcagctacttgcttcctcgccacgtgccttaatttcccccctctcgtgttttcgcgatccgtaggtgccaaattcttggagaattgtacctctctcaccagtcacgccacgcggcgaacgtgccagcaaggacattctccacgcctgggctctccgctaaagggcggtccaaagtacgagcgggtgcgagtcataattggacttgtactagggggcatgcaataatttgtaacgttttaattgcctcgtttgtggccgaaagcatcgatggatcggggacagcaggacgaaccaggtagctagctcgtcggtcgtcgcagcgaaggtctcttgctcggtcagcttaggacccggcccggcccaggttgcggcgctgctgctgctcgtgtagacccgcggatgcgttcgcgatcgggaagaaccctttcggaatgcgcctgccgtgtgtgtgtgtgtcaaggcgaaatgcaaatccatccggcttgccggacgaggtctttttccaccagcgactttttctttctttcttttcggttgaaaacgatggcaccaaaccaaagcgaacagcatatcgctgcagtgacacgtacgctgatcgagtggataacttctgtcagtgtacaaactttcggtcgttaataagttgccatgcagttaactggaacatgagtacacatgtacagctaacttccatgatactatacttatattatatacgtattcgatagccttgtcctcattcggcggtttccacgatacatactctttttgaactgaacgagtgttgttctcggagccctgctcctgacactgacccatatctacttacattttccatgcttcaagcacaaactttgtcaggcttctttttggttcagctttctcggttagattctctaccaaaaatctctctcgcgcgcacctctccctctcccgacagcgccaccgctccacctcgccgacggccgcgcccgcctcgcatcgccgggcctcctcggtaccccggctcctcgctcgccagtgccggagtgccggccgcgtcttctccagcacctttcgcctctacgactcccaccgccagccacntccgacccgccatcggccacgcacgcccgctgcctacactcacacccgccaccattgtcgatcgtgctcgcgcacgcatgccgctacgtaaatattcttcatcttgtggtgtttcctaagtagtcattttatatataaataaatagtttctatgttaaatattcactaccggaatttggctttttgccgagtatcatattctttgccgagtgttttttttcggcactcggcaagaagctctttgccgagtgccacgcaaaaaaccctcggtaaaagaaaacacttggcgaaaaagctctttgccgagtgttttattttttgacactcggcaaagagtttctttgccgagtgtctttttttgacactcggcaaagggctctttgccaagtgtcacaaatacaacactcggcaaagagctctttgccgagtgtttttttacaacactaggtaaagacaatttaacaatcacattttaaagtggtaaattaattcaaatga

SEQ ID NO: 193 - DNA, 1339 bp, Zea mays
ataaactgctcagtcataacagccttacctccatcggcgatgcatcacaagaacagaggaggctgccatgtcgttattaggacctccggcacggggagccatctgcttgctagttgtgtcgtcgtcgatcgtggtcctcagcacggccggtggtctcggatccgatgccactagtaggtccgccgctgcctatctctcagttgacgacgactacggggaggaggacgagagcggcgactcctccttctccttccccgaccccgagacgagttcagcttcaaccgggctagtgttcgggttctacgacgacaagtgcccggacgccgaggagatggtgtcgtccatggtgcggaagctctaccacgcggaccccaacgtcgcagccgcactcgtccgcctcttcttccacgactgcttcatccacggctgcgacgcctcggtgctgctggaccgcgtcggcggccagagatcggagcgcgacgccggcccgaaccagtcgcttcgcggcctgggcgccgtcgaggccatcaaacggggagtggagaaggcgtgccccgggaccgtctcctgcgcggacatcctggcgctggccgcgcgggacagcctcgtgctggtgggcgggcctacctacccagtgctcacgggccgccgcgacagcgcccagagcttctactacgacgcggacggaggtggcatcccgccgccgaacgccacctacgccatgacgctcgacgcgttcgcgcgccgcgggcagttcacggagcgtgagaccgtcgcgctcctaggttcgccgtcgcctgacgatctgactctctgagtctgagctgcgcaactccctgcatgcagtgacgcaaaaggcagtcttgctctgcgcgcaggagcccacagcatcgggaaggtgcggtgcaggttcatcgcggacaggatctacaacttcgccgggaccggcgcgccggacgactccatcgacccggacatggtcggcgagatgcgcactactacgccgagctgttggagggccggggcatcctgcgcgccgaccagcagctcacggcggggagcaccgtgcggtgggtgcgcgtgtacgcgtccggagcgcgcggcgaggagctgttccgcgacgacttcgcgcacgccatggtgaagctgtcggcgctcgcgccgctcacggggtcggctggccaggtccggatcacctgctccaaccccgtccgtcccaactgaaccgacctaggactagagtttgaagggaaaggaggcttgatgcccttttgatgactcgtcagtgtatgtttgttcaaataaaggcgaggatttggttacaaaaaaaaaaaaaaaa

SEQ ID NO: 194 - DNA, 2291 bp, Zea mays
gcacgaggactgcatggcacgctattaacacaaagtccatgttcactgtctactacaaacctaggacgagcccttcagagttcatcataccatatgatctgggtaccgcgtcgcggaaaagcaattattctattgggatgagattcaggatgaggtttgaaggggaagaggcccccgagcagaggtttactggtacaatagttggctgtgaaaatcttgacccactatggcctgattccagttggagatacttgaaggtgcgctgggatgagccttctactatcccgcggccagataaggtctctccctggaagatagagcctgcttcatcacctcctgttaatcctctccctctttctagaggaaaaagacctagacaaaatgcacctccaccttcccctgaatcatctgttctcacaaaagaaggtgcaaccaagattgatactgattctgctcaaacaccacatcaaaattcggtcttgcaaagtcaagagcagatgagctttaggaacaacctgactgaaagcaccgactctgattccactgttcagaagcagatgatgtggtccccatcacccaatgggaaagttcacactaattttcagccgagacctgctatggataactggatgccattgggaaggcgtgaaactgacttcaaggacacccgttctgccttcaaggatgcccgcaccgcttctcaatcgtttggagatacacaggggttctttatgcaagcttatgatgacagtcgtcaccgtctttctttcaacaatcagtttcaagatcagggttcagctcatcgctttgcagatccatacttctatatgcctcaacaaccttctctgacggttgaatcaggcacaaggacgcaaacagcgaacaatgacttgcgtttttggagtgagcggaattcgatgtatggtaatccaagtgaccaacagcagggtttcagctttgggcaaaacacatcaagttggttgaaccagccacttccccaggttgaacagtcacgagtggtcaggccgcatgcaacggttgctccatttgatttagagaagactagagaaggcagtgggttcaaaatatttggtttccaagttgatacaaccaatccatcacctgtccaattgagctctccattgtctgctatccgagagcatgtggtacaaactcgaccatcggcaccagtgaatgaattgcaacctgtgcaaattgagtgcttgcctgaggtgtccgtaagcacagctggaactgcagctgagaacattcagcaagtccagcaaagttcgaaagatattcaaagcaagtcccagggcgcttcaacaaggagctgtacaaaggttcataagcaaggagttgcgcttggccggtccgtggacctctctaaattcaccgactacggtgagctcaaagcggaactagacaagatgtttgagttcgagggcgaattggtatctgctaaccggaactggcagatcgtttataccgacaacgagggtgatatgatgcttgtcggagatgacccgtgggaggagttctgcaacatagtgcgcaagatctacatctacacgaaggaggaggtccagaagatgaactcgaaatcatccgtgccgaggaaggaggaacccccagcagcaggcgaaggctgcgccgccgccgccgcaaacgagtaggatgtctgcctgcactgcagcaagcagttttagatgactaggtcgtgtggaggaagccgacgatgatgcatgcgtgatgaacccgttccttgtgcaggaggtggtgccagcccgggtcccagggaagtaaaaactcctgagatcttttgcttgtccgttgcagccccatcccccgtccgtttgggttttagttgggaacgtagaaactactgtctccgcctgcttctccgaagctcgctgttggtagcaagttttattgctagtattattgttattgctgatttgctcccctctgcctttgcgatgtaaatatttgtgtacccagccccagccccagccccagccccagcttgtagtgagcagtaacaagcagtagcggtaccttcggtattaaccggcagctagctatttcgcggcattttaatccctgtaagcgtagctctgtggcgtgagatagatgacaaacactgggtatatgtatgtctgatctttctcactgaatgtaccataagagagtttgtagagtacctgacctgtgaccaaccccgttcctgtctgctctctggtctcagcaacacgctgtgtatgccgcataggtcaaaaaaaaaaaaaaaa

SEQ ID NO: 195 - DNA, 1583 bp, Zea mays
  misc_feature (33)..(33): n is a, c, g, or t
  misc_feature (56)..(56): n is a, c, g, or t
  misc_feature (64)..(64): n is a, c, g, or t
  misc_feature (74)..(74): n is a, c, g, or t
  misc_feature (179)..(179): n is a, c, g, or t
  misc_feature (182)..(182): n is a, c, g, or t
  misc_feature (209)..(209): n is a, c, g, or t
  misc_feature (213)..(213): n is a, c, g, or t
tgcggctcgagtggatggagagggatgagcgangcacggtgatctcgggaggctgngttctttntgcacgcttntgattacagccaatcaccgtctttattttaacaatcatacccaatatcatagttcagctcatcgctaaacatttccatacttttttaatggggggggtgccttcnctnacagttcaatcacacacaaagactccnacancgagcaatgacgggcgtgtttggagtgagcagaattcgatgtatggtaatccaagtgaccaacagcagggtttcagctttgggcaaaacacatcaagttggttgaaccagcctcttccccaagttgaacattccccagtgttcaggccgcatgcaacgggtgctccctctgatttagagaagactagagaaggcagtgggttcaaaatatttggtttccaagttgatacaaccaatccatcacctgtccaattgagctctccattgtctgctatccgagagcatgtggtacaaactcgaccatcggcaccagtgaatgaattgcaacctgtgcaaattgagtgcttgcctgaggtgtccgtaagcacagctggaactgcagctgagaacattcagcaagtccagcaaagttcgaaagatattcaaagcaagtcccagggcgcttcaacaaggagctgtacaaaggttcataagcaaggagttgcgcttggccggtccgtggacctctctaaattcaccgactacggtgagctcaaagcggaactagacaagatgtttgagttcgagggcgaattggtatctgctaaccggaactggcagatcgtttataccgacaacgagggtgatatgatgcttgtcggagatgacccgtgggaggagttctgcaacatagtgcgcaagatctacatctacacgaaggaggaggtccagaagatgaactcgaaatcatccgtgccgaggaaggaggaacccccagcagcaggcgaaggctgcgccgccgccgccgcaaacgagtaggatgtctgcctgcactgcagcaagcagttttagatgactaggtcgtgtggaggaagccgacgatgatgcatgcgtgatgaacccgttccttgtgcaggaggtggtgccagcccgggtcccagggaagtaaaaactcctgagatcttttgcttgtccgttgcagccccatcccccgtccgtttgggttttagttgggaacgtagaaactactgtctccgtctgcttctccgaagctcgctgttggtagcaagttttattgctagtattattgttatttgctgatttgctcccctctctgcctttgcgatgtaaatatttatgtacccagccccatccccagctccagcctgtagtgagtagtaacaagcagtagcggtaccttcggtattattaaccggcagctagctatttcgcggcattttaatccctgtaagcgtagctctgtggcgtgagatagatgacaaacactgggtatatgtatgtctgatctttctcactgaatgtaccataagagagtttgtagagtaaaaaaaaaaaaaaaaaaaaaaaaaaaactcgggacttcttgccgcc

SEQ ID NO: 196 - DNA, 5880 bp, Zea mays
  misc_feature (4515)..(4515): n is a, c, g, or t
  misc_feature (4900)..(4900): n is a, c, g, or t
tgcagtgatgggaaaaggaaaaaggggggctcatcttttggttgtccctgctgggctcggtgactaggtcgtgtggaggaagccgacgatgatgcatgcgtgatgaacccgttccttgtgcaggaggtggtgccagcccgggtcccagggaagtaaaaactcctgagatcttttgcttgtccgttgcagccccatcccccgtccgtttgggttttagttgggaacgtagaaactactgtctccgcctgcttctccgaagctcgctgttggtagcaagttttattgctagtattattgttattgctgatttgctcccctctgcctttgcgatgtaaatatttgtgtacccagccccagccccagccccagccccagcttgtagtgagcagtaacaagcagtagcggtaccttcggtattaaccggcagctagctatttcgcggcattttaatccctgtaagcgtagctctgtggcgtgagatagatgacaaacactgggtatatgtatgtctgatctttctcactgaatgtaccataagagagtttgtagagtacctgacctgtgaccaaccccgttcctgtcagctctctggtctcagcaacacgctgtgtgatgccgcatatggtcaatgcaagtccgtgtcgtttacaacgtccgtcttcgtggcgatgacggcgacctaaaggcgcgcactgtctctttttgccgtccattgatccatacgctatgcaagtatgcatgattggggcgagtgtgtggcggggccccttatcgtcttgcctgcctggtgtccgagtgatgcaatgcaaatcaaagcacagcgaaaggcaaaggcgacaggcagctcatgctgtgggcgcgatttcccgtcacatttggtgtgctctgttgatacacggaactgaggaagtggtggtggcgttaagctgtttctgcagtgaaatgaagggaggaaaggtgcccggggcaagcaagcaaccaaccagccaggcgtgtggctgcttgcctccctgatccctcggcaccgcctgctagtgcctcccctgaactccgtggaaaaggcgccatccgtccacttcgttcccccgccccgttgccgccacgagtgtgccgtcgtggttggcccgtccgcctgggctgcactcccggtggcgctcgtgctgccagccagccgtctcccttcctccggtcaacgtggcaggggagaggacagaggagggctcaccgcaccggcgcggtggctggaaactggcaagggaccatggctcgctgcgaggttcgctgcatctgcatggctactagtcctgcatccatgggtccggaccccggtccccggagccggagggatatgcttttgggcggtcggtctggtcggggcgacgacagcaggtcagcagcagccgcggaacgtgccatgccaatcctaaagggcgtcgcagtcgctcactgttgggctgttgtggggtcccgtggctgtcgtcgtcgtcgtcgtagcaaagaaacagtggatccatggtctggcgaacaccccaggacaggctttgaccggaaccggggcgctggtcctttgtcctctctctctctctcttgaaacaatggtcgaaacagttcttgactgggtccggacgtggcggccgatgcttgtacggctccgcgcggttccacgggaagcatcatcatggctttgcacagagcacgtaccctggggatacctctgccgctgctgcctgcgcctgaccctgaccctgaccctgcctagtgtgtcttctgttgcactgggcagtgggcaactgggcactaccacgggctaccgacgtgtagcgtagcagcagcagtagatcatttggcagtatgtgacactgaatccagagtagtagcgccctagtcgagcaggcgatgatggcgctggcacgtggaccctccacgaccctggcccccgccacgcgctcgggaccctcccactccatccgaggcacaccgatgcatgctgtcctgtcctggagtcgcagtgtagtaggtgcagcactagtaattgctgtgcggggtggtggcccggcccggtgctgcgctcgctagacactcactgctgctgtaggcagcgtcgagcccagcagcaagcagcccacggcccaccaccacggagagggggaggcaggcaggcggggccgccagccacccacatcagtcgaaacggcatctaggcaggcgccgcgccagtccaagcgcgtcgcgacaaggccgctgctgccgtccctctctgctcgccctcgcagtagcagcacgggcactgctgctgttgggggtggcccctgcctctgcctcacaggctacgactgccacacgcccagaccaccgtctctgcctcgttttcctcgtggcgacgtcgacgaccagcgacaggcgtacgagtgagtgttcgtacgagtattcgctgtagcagtctagcagggcagcagaaaaagtgtgaagcgtgaaggagtccgctccagctccggccggacgcccgccgcgtggggagaccggcgacggaaacgtacgtacggacagactgagaaacgtccagggagaggaagacgaaacacgcgtcggcacggcaccgcatctctgacgtggttgcgccgcgcgcacgcagacacaggagcagaccgggccggcggccggttgttggctgtcgggaagaagaaacaaaacagcacgacgtcgacacccccgggggggacggcgtgttacatgctgctgcatccatgcctgccggcgtcgccgttgacgggctgtggctgtgggcctcatgcgtgcatcctaggacgcgccatcgatcggtcctcctccctccgtcacgcgcctactacctacgactaattcgtggcgtcgcaggtttcagtcttccaagtgcaaagagagtgaccagcagacttgcgcgttcactcgccaattgtcagctttgatgcaatgcaatgcaactcctctgttgtgggtttagtatcacgtcgctttcattggacgcagagaaataaacagtcagaattagaattctgcaaacgcttctccaccgtcactatcgtcgtcgttagtctggcaattggcgacccattgtcaatcctttctcatgctccatgcaattttaatcatgcttaatattggtcataaactctaggaaaggaaaaggaaccaaagaacatgacaagccatgtttggtttactgtctaacttaccatactttatataacttttctatataagtttagttcttcaattttgacgactaatcttagacaaaatatgatacatttagtcacgaaccaaacaagtcctagagcctctaaccccaggagagaccgaaaacaccaccaaccatttgcccccgctcgtgaaacactaagggcatgtttggattgatgcataacttgcctaacttttcagcctaagattagttatttaattcaagggcatgtttgaattgatgcctaacttttcagcataagattagttattcgaacaactaaccttaggcaaagtgtgacacagttagtcacaaaccaaacatgtcctaaaaccaccaaccaggtgttattctattctatgtaagcatggcaacgtatgtctgataagaatacaaaaaatttccccgccttttaaagtacaatggcgtgctatcctcctttgatcggaagactgaaccatattgatgactcacttgtgtatccttgttgatggcggttacatcatataatttgtattttgtatccttatgccgctcaagatataaccgccaaacgcatccatttgcatgtgtggatgggtgcgcgatgcaaggacctgaattgtacacaaggaagacaagagttcttcaagtacgccccatttgatctgagagactaaagattagtacatctattttagttctatttagtccctaaattaccaaatggtgggactaaaacatgaactaaattgttttagtctctagtccctcaaggtcaaggggtgactaaaagagactaaaccatataaattcctctttttgtcccccttttatttcagttgcgctaatgacggaagaatgataaggggtattttagtcctcttatgattcatttaatgcattttaaatttaggatgcgtttggttgcgggacaactgaggacagggacgtctcctagcggctggcgtcctctctcgtccctccaattttgagggacaaatgaagacaacactgggataatcctgttccaacctctgaccctgaaacaaataaccttatttgagggatcgttctattccatcccgttctgtcattgcaaccaaacgcacccttagtctatacaactaaacgtggtagagactaaactttagtatcctaactaaattttagtcattggattaaaggaaccaaacgggcccttagattccccaatgttcaggtgctgacctggtattcacgtaggcagggttcagagagctgcaatccaatggccctctttgatagctgtaagctgtacatgcactttgcaagangctgcgtgcagatatatatagacatggaaataaggaactgcgacaatcatattttatagaagagcaaacaagaggtaggaagaagcaaaaaaatgacttctctccacaacatatgttaattatctcagccattaaggggatgctctatgttgctttccaggcatttcaacccggaatttagacaattctagcatatgcagtaaaccaataaagaaaatttggttcacaagtggcatgctgtatcaacatcaagatatattatttacctcaggatactgatgatatatagcaaatggagctgaataagacaaaagtggaagcagatcagcaacaagacactctacttcgtggccaggggcagcaacaatcaaactgcatcaacaanaaaccatcatgttaatcagaatatgtgctaataatagaagaataaccttcttctacaacttctgtaacctgctaaagccatgttccttccaatatttcatcttttctggtgatggtgcttttccaggtttaggagattttgaagcatttgaagtagtaccatcactgtctttgccacctgcagattcacatagcatccagagatcaaaacttaacttcactagaccattttcagattcatcaactttttacctaatgaagagttctcatcttgaacatgatgctcatccaaagaaggctctgaggcctccatatcagttggctgatctgttgataactgtgccttatcatctgacactgctgtgcccacttgatgtgccaaagatgcatgggcatcctcatctccagcaggttctatcgtctcccggcccttcagcgctactatctacaacagaaggggaattcccagaactttgcattgaacatggggcactaagtggcaccagaacaatcctgaatggaaagtttatcaaaacattttcagacacggtataacttgaactaaatcatggctgctgaccacttctacaaattgaaccgaattattcatatgagcttgaaataagaacattgaatatttcttacgtgacacatgacagtattgacgaatggtccaaaagaagtgaacgataatattagattggatggtaagcaaatacagtttgaatggctgtattaaagcacgagttttgtcatgcgtcgtgcgtttcccgcgtgccagcgaaatattaaaaaaaaagtgtagttgccgggattcgaatcgaaccatggtctctaggaatagagcactcgtctctaaccactgcaggcctgcggttggaatcagcacaggacattagagttttgtcaggatgagttttggctgctaggaaagctgaagcagcattgttttgtttatgcttctatggaaagaacaattgc

SEQ ID NO: 197 - DNA, 3018 bp, Zea mays
attgggtccctccggccccccgcccgggtctaccctcctctccttcctcgccgcacacacagacacacgcaaaaacatttctcccccctcccgactgctactgccgctgcctcctccccctttccgcccgccttcgctccctcccaacccccttcctcctccgtctagggtttcccgccgccgcctgatccgagtcagatgccgcccgcaacagccatggcgccgccgtcccagcccccgtctaactcaggggatccgctgtacccggagctctggcgcgcctgcgccggcccgctcgtcaccgtcccccgcgtcggcgacctcgtcttctacttcccccaggggcacatcgagcaggtggaggcgtccatgaaccaggtcgccgggaaccagatgcgcctctacgatctgccccccaagctgctctgccgcgtgctcaacgtcgagctcaaggcggagacggacaccgacgaggtctacgcgcagatcatgctcatgccggagcccgagcaaaccgatgtgccggctgagaagccgagttctgcacctgctgcgtcgccgaggccagcagtcaggtccttctgcaagacgctcaccgcctcggacaccagcacacacggtggcttctctgtgctgcgccgacacgctgacgagtgcctccctcccctggatatgacccagtcgcctcccacacaggagctggtggcgaaggatctgcatggcatggagtggcgcttccgccacatctttagagggcagccaaggaggcatctccttcagagtggttggagtgtttttgttagttctaaaaggcttgttgctggtgatgccttcattttcctcagaggagaaaatggtgaacttcgagttggtgttaggcgggcaatgaggcaattgtctaatgtaccttcttcagtcatatctagccaaagcatgcacctcggagtccttgcgactgcatggcacgccattaacacgaagtccatgttcactgtctactacaagcctaggacgagcccttcagagttcatcataccgtacgatcaatatatggagtcggtaaaaaataattattctattggcatgagattcaggatgaggtttgaaggagaagaggcgccagagcagaggtttactggtacaatagttggttgtgaaaatcttgacccactatggcctgattccagttggagatacttgaaggtgcgttgggatgagccttctactatcccgcggccagatagggtctctccttggaagatagagcctgcttcatcgcctcctgttaatccactcgtgcattcttctagagcaaaaagacctagacaaaacgttcctccaccttcacttgaatcatctgttctcacaaaagaaggtgcaaccaaggtcgaaatcgattcagctcaaacacaacaccaaaattcggtcttgcaaggtcaggagcagatgaccttgaggaacaacctgactgaaagcgctgattctgattccactgttcagaagccgatgatgtggtccccatcactcaatgggaaagcccacactcattttcagcagagacctgctatggataattggatgccattgggaaggcgtgaaaatgacttcaaggacacccgttctgccttcaaggatgcccgcaccgcctctcaatcatttggagatacacagggtttttttgtgcaagcttatgatgacaatcatcaccgtctctctttcaaaaatcagggttcaactcatcgcttcgcagatccgtacttctatatgcctcaacaatcgtcagtgacggttgaatcaagcacaaggacacaaacagcaaacaatgacttgtgtttctggggtgaccagaatgctatgtacggcaatccaagtgaccaacaacagggtttcaactttggacaaaacccatcaagttggttgaaccagccatttccccaggttgaacagccacgagtggtcaggcctcatgcaacggttgctccatttgatctggagaagactagagaaggaagtggcttcaagatttttgggttccaagttgatacaaccagtccatctcctgtccaattgagctctccattgcccgctatccaggagcatgtgttacaaactcgaccatcggcaccggtgaatgaattgcaacctgtgcaaattgagtgcttgcctgagggatctgtaagcacagctggaactgcaacggagaacattcagcaagccccgcagagttcaaaagatatccaaagcaagtcccagggtgcttcaacaaggagctgtacaaaggttcataagcaaggagtcgcacttggcaggtcggtggacctctctaaattcaccgactacggcgaactccaagcagagctggacaagatgtttgacttcgagggtgaattggtatctggcagccaaaactggcagatcgtctataccgacgacgagggcgatatgatgcttgtgggagacgacccgtgggaagagttctgcagcatagtgcgcaagatctacatctacacgaaggaggaggtccagaagatgaactcgaaatcagctgcgccaaggaaggaggaatctccggcagcgggcggcggaggaggttgcgccgccgccacaaacgagtagtatggtggtttgctcttggtggcaagttgaggccaaggttttactactgctattgttattgctgatttgctctccccgccttccggtgtaaatatctgtgtgtacccagtcccggccttgtgctagtaagtagcaagcagtgttaccttttggtattttaaccagcagctaagttcgcggcattttagtccctgtaagcggtaagcagctctgtagcgtgagatagatggccaagcgccggtacgtacgtgtagtgtctggtcttctcactgagtgtactataaagagttaatataggagctgaccctgtgaacccgcgtgatggatgcatatgcttagtgcaaaccaacactctatcacaaaaaaaaaaaaaaaaaaactcgagactagttctcctcgtgc

SEQ ID NO: 198 - DNA, 2719 bp, Zea mays
  misc_feature (16)..(16): n is a, c, g, or t
gcacgagaccattacntagaacatcctaatcaaaaaaaaagctatcgcttatcatgctaggctaggcagctttgttgagaaggagcacgggggaagcccggcaagatcactacacgtggcatgtatgtccaaaactccaaatgccgagtagacagtggcggcggtagagagcgctgttaccttgcggggtgacgggggcaccttcttcggcgcggctgcagctgcagcatccgccgccgcgccggacgcggaggccgtgctggcgtaccgctcgggcgccgcgccgcgccgcggaaagccgcgaaggagggcgttgcggagggtgcgtcgccacgcgagtgcggtggaagatgacatcgggaacgcgaggggagaccaggcgcgggaagggcgggaggactgtgaagagcgcgaggagggcagcggcggcggcggcggcgctgatgctgatgctggtgcaggggctgatgagccggattcccgttcggcgtggccgcgtggggagcaagcagaagtgcagaactgcacaaggagagggcccacataaccatttctatgatattgcgcgtgtctcagtgtctcggcccagtttttcatgggctgacccggttatgtggccttgttagttttcgcctaatttcaaataacagcaatttcttagtggcccgtacactctgcagcagtgcggtgcgggcgtgcggcctccctttttttctccagttcctccggcggcggcgtgcttggcggtgcgccaggtgcccagatctccaccatcttagtcgccggcgacgagcatcaccaggttcccgatgaccatggcgcagcgcacgatgtgcctgcttcggcggtccattgggtttacagcgccgcaggcacagagagccctgagtaccactgccgcaccagcggcggagggtgcggccgtggctgaagctacggcgaaggaggcgaagaggaggaggaagaatctgtttgacgtagtgcagttcctgccagagtggggcattggatacaaggttgccaagaccacctggcgtgacgtctcctatcagatcaccaagatcaacctgtacaaggatggtcggcatggaaaggcgtgggggcttcggtacaaggcaggtgtgcaagctgcagacaccccaactaggatcagcggtgttaacaaacgtgggtggaagtacataaaagaatcacagaagaaactacaagaagcccccaaagtagacgtagctgttgctgctgcctagttcgtagttacatgcatgtttgttgtaagatgattcggtaaatctttagatggctgttgccagggtgagaacagggaaccacttttttttggatcgactctatacttttttgtcgatgacgactgaacctctctgcaacatgtccagtttcttttcttttccttatggaacgaacctttaccgtaatgtactgatgcagaagaactgcgttgattgtggcgatctagttttcattcaaacgcaagccttgtttcattctgagccaaaaaaaaaaaaaaaaagccaatgttcctaggtttcggccgttcgtttttccaagttgaactattttgttcctcaccatgttcctaggttttcattctacactgcggaggcgattgactggcattctcagtcagatgacgctggacggagtcatgcctacacgttcgcaacgctgcgctctttatgcctgaagccaaggtgggaacgccatggaggacaagtttggtattcagcccggcgaggaccactgcatgatcgatctgggcctggcgttctggtatggcaggcgttgctgggtgcctgccatcttccacggcagcgaggctgtaggcacgcatctaattttgttttttttttttttttggacaaacaaacataccattgtgtgtcacaaagatgtcgaaaaacaaacttgcttgtatcaaaattagctcttcatgtatactgtaccaaatatacgcaaatgaccccgcagcatagttaattacaagctaaactcataaaaggaaattccttcaacattcccattggcatcctcggtggtcggtgctgaagccgcagggaatggtcttaagtgactgtcgtagtcaagagaggttccaggtattgcttgaacttatcttttgtcattgccccttctcgccggctatctgctacctctcggccattcttgaagaaaatcaaagtcgggagaccatagaccttgtactcttcaatcagctgcggattggcgtcgtgatcgatcttgacgatttttactcgcccgtcatattcctcggaggcccagtcgacgacgggcgcgatgaggcggcacggcccgcaccagtcggcgacgaagtccacgagcacgggcagctccgactccagcacctccgcggggaactcgccctgcccaatgaaccgggccgccgcgccgcaccgaacgcgcgagcgagggcgagcgagccgacctggcgccgcgcggcatccggcctgcccgggctgagcgcgggacaggcggggcgcggccgcaaggcgggccccgcggggggctgaagagaagggcgtgcgcagagagggcgcgagggtgggcgccgtggtgctcggcgcggacgccatgagcggaacggaggcagatagaggaatcttctggaaggtgccaaaggccagcacgccaccagttctcttccgcgggcgagatttgtcggcgcggagcgatctttcttttt

SEQ ID NO: 199 - DNA, 1910 bp, Zea mays
  misc_feature (955)..(955): n is a, c, g, or t
  misc_feature (958)..(960): n is a, c, g, or t
ttccaggtcctgcttttcctccttgctttatgtcgctggttgagggaagcgtggaccttgaagtttcttccatcttcctcttgccatgttgtgccccaagacgcttagcaacaactacaattccttcactgttgaatccgcatcggttgattacagcaccatgctcctttaatctgaaaattcgaggcttgggatttccctcttgaggaagaggtgtcacagagccaacttccacaaagccaaatcccaggcctaagagaccttcaactgcctcagcatttttatcaaagccagcagcaagaccgattgggtttgaaaacttccttccccaaacctcaaccccaagaactgatggatcaggtctcttttctcttggaacaaatccatgggcagccgctttaacagctaaactatgagcaaactctgcatccaacagtgcaaagagtgggttcacaagttctgttgacttgaataaccatccgcaaaactttccttcatctgtagtactcacataagcacctccaccaatggccaacgctatcatggccccagttaaaagccttcccttgcggggtgacgggggcaccttcttcggcgcggctgcagctgcagcatcggcggccgcgccggacgcggaggccgtgctggcgtaccgctcgggcgccgcgccgcgccgcgggaagccgcgaagtagggcgttgcggagggtgcgtcgccacgcgagtgcggtggaagatgacatcgggaacgcgaggggagaccaggcgcgggaagggcgggaggactgtgaagagcgcgaggagggcggcggcggcggcggcgctgatgctgatgctggtgcaggggctgatgagccggattcccgttcggcgtggccgcgtggggagcaagcagaagtgcagaactgcacaaggagagggcccacataaccatttctatgatattgcagcgtgtntcnnngtctcggcccagtttttcatgggctgacccggttatgtggccttgttagttttcgcctaatttcaaataacagcaatttcttagtggcccgtacactctgcagcagtgcggtgcgggcgtgcggcctccctttttttctccagctcctccggcggcggcgtgcttggcggtgcgccaggtgcccagatctccaccatcttagtcgccggcgacgagcatcaccaggttcccgatgaccatggcgcagcgcacgatgtgcctgcttcggcggtccattgggtttacagcgccgcaggcacagagagccctgagtaccactgccgcgccggcggcggagggtgcggccgtggctgaagctacggcgaaggaggcgaagaggaggaggaagaatctgtttgacgtagtgcagttcctgccagagtggggcattggatacaaggttgccaagaccacctggcgtgatgtctcctatcagatcaccaagatcaacctgtacaaggatggtcggcatggaaaggcgtgggggcttcggtacaaggcaggtgtgcaagctgcagacaccccaactaggatcagcggtgttaacaaacgtgggtggaagtacataaaagaatcacagaagaaactacaagaagcccccaaagtagacgtagctgttgctgctgcctagtttgtagttacatgcatgtttgttgtaagatgattcggtaaatctttagatggctgttgccagggtgagaacagggaaccactttttttttggatcgactctatacttttttgtcgatgacgactgaacctctctgcaacatgtccagtttctcttcttttcttttccttatggaacgaacctttaccgtaatgtactgatgcagaagaactgtgttgattgtggcaatctagtttccattcaaatgcaatccttgtttcattcaaaaaaaaaaaaaaaa

SEQ ID NO: 200 - DNA, 2161 bp, Zea mays
gagaagccatcgttgctaagcacacgtgaatgggaggaggaactgatgggtcgggcccggtcaatagccacgagaaggggagggctagcaagcggggtcgagccggcaccgagagagagggagcgcgggcgcgggctggcttgccgcgcggagacaggctagaggtgggttagagagggagagggggcgggtgctggctctgggccgaagttgtcccaggccagggaaaggattttttcttttatccttttcttctctctatatataagattttctaggtacaaaataaattgctagataaaaatagttatgtgaggtgcttctaacaaagatgcgacgtagccgcgtagtgctcagcccaagaaacaggaaaagctcgcgagctgcacgatcgaaccccgacgggtgggggacatcgagaggaggccaagtgcagttccggttcgtctcatcgcaagcacaagcacccagccggcagacagccagagcccagtacgcgtgtaccggttgaggcccaagccgagccggccaacgctgtgtctttgtgatcggcaaattgacatgcggcctcactgaaacgacggcatccaaagacaccgtgcccatcactctgaatgcagcatttattcacatttatccagattttcctactattcgcagtcccgttacacattggcacattgccatactgcactgatgaatgtagcacctactggcatttatccagatttcctaccatcccgatttcttggcgggtggtgatctcatgtggacgttggaattcagattcagattcaaattgcaaaaggaagagggaaaacaagtggtcaaagcaagactcgccacacgatctgatgatggtacaggacaataacaggagccaccaaccaaccgatgatgggttttgtcgagtggcatctcatcgcatcgcacttccctttcttgaagccaccgcaacacccgaacaaatcctcaattacaacgacgcaccaccgtccacccaagcgacgccaccgctttaaaatccccgcagccaccgaacggataaagagccaagagctcccccacctcgcccccccccatccagctccgaccctagggtttccatccggctcttccggaagcttccgaaaatggccaccgacgagctcgcccacgccgtcgcccccgccccggccgggggcgaccactccccggccttctcgttcagcatctggccgccgacgcagcgcacgcgggacgcggtggtgcggcgcctcgtggagacgctcgcgggggacaccatcctctgcaagcgctacggcgcggtgccggccgccgacgccgagcccgcggcgcgcgccatcgaggccgaggccttcgacgccgcggcctccacgggaggcgccgccgccgcctccgtggaggaggggatcgaggcgctgcagttctactccaaggaggtgagccgccgcctcctcgacttcgtcaagtcccgctccgcggacgccaaggccggtgacacgccgtcggaggaggcccgggcccctggcgcgcccgaggccgaggccgcccagcccgcggcgtgagcgccggacagccattcgttccgttttgtatttcctgcagcctgtgtttggcttgggtctgagtttgtatgacttgaacgttagctgtttgcacatctatgcaattcttgttcttccatgaatagccccgttctagtgcgtgttcctgtttttctgggaatccctgcccgatcctgaggttgtcaaaccatcgcagcattgacctctgtctgtgtgcagcttcgagtgatggtcgaattgttccggagaccgaattgacaagcaattaagattcctcccatctttcaagccacatttatatgtataataataatctgaccgttgatttgaaattctaaaaaaagcaaaaaaaaaaaaaaaactttcagaaatcaaatgtctatatcacaatcttatgtgtaactggcccagtaatattcgctgatatgtatgttgcaaaggtatgccagggctttgaaagcgaaatcggtatctgtcggttgctatccgtctgccttccatccaccattcgtttacacggatcaatgccgcacgacggctcatgagttcaaacttcaaagggcatttgctgggacaaagtgtgtgataaacga

SEQ ID NO: 201 - DNA, 5349 bp, Zea mays
  misc_feature (105)..(105): n is a, c, g, or t
  misc_feature (147)..(147): n is a, c, g, or t
tccaaaaatgacattaaaattttttagggtccaaacgtgattttgtttccgaggaagggtcaaaatgcaaaaaaaatcgggctcactgctcgcttgtcgggttgntcaggaacaggttatcgggtagcagattgggtattcgggcancgaacttcttaacccgaattttgctaaaaaaatgtcagataccgaactagctaagaagtatcttattaggtttgtcttgtactaattaaactttaccctaacatggtcgatacctattcaaccatctctagccaatttcttagatactactccctctatcttaaaaaataaggcgcataaaattttagattttgtcataaaaaataaggtgtactactacttttaccctacggtagatcagtagatgcatgtgcccttctccatttttctatcggtgcatacacgtttctttatatggtgacgtatgattatttatcccagcctagtagacggggaaacaagatttttctcatgcacccaatgcgtaatgtctgatactcaattaaagccgaaaataattaccttccattccatgtagcatgtgtggtaccacctgctgatccgttaagccaaaacatagcgacatcagaggaaagataagtactgtaaagagttgcactaatattcatgaaaaaaatccacgccttattttttgggatagagggagtataatctagacatgaggggagctaaaatccctatgttcatcccctagatatgtgcttaaaacgagcaacattagtctacagatggctcaacctacatgaatcctcactgaaacaacaacaataagaaaggcattctccacgcgcagtacacaactcgcaatatctatgaaactatatacctaaatatcctctatcttaaatatagaaaataatttcttcattatagacttcaaaggtgttctctaaaggcttctctaaatatagaggacactcataaatctctacatatatagactcactctcatcttctctgtccatttttatactttagataacatattaagcaaaactcagatatgtaagatatttaatggtatggtaaatatttatatataaaaaactgaagtaaaatatgtctctaatgtagctcttttacttatagacaaatagatatagaggacgttgttgaagatatagataagagaatattttagaaaaatttatagatgacacttagagaaatgatataaagaatactggtgaatactaccatatgtgtcaactaaacacactagtcaacaagccaaacgccatcgaccaacaccactatacgacaatagtggtagcatgaggctggttccaatcaaaggcgttgctaccgcgtatgatcggttggtattgacttgttcgacttcaacgcgggttggttcgaccacctgatcggtgggctgtcaaccggtcatcttgatcgttattgatcagacaatactgatccaaactggtcaataacaacaacttttagtgatgtggtatgtttatattggttcacgtgtgtgcacgtcacatagctattttcaaatatttgaagtccaaaaaaaacaaaaaaaaataattccatttttttaaaaaaatatagaatgtgacctgcaaattagatttttatttacgaatcatgcaatttttatatgtttaagttatataattttatttatgaaattattaattttatgtgttaaattgtgtgacttttaattgtgttcatacttagatgaatctatatttcaataagatatcagatatcgggttttattttagctaaaagttgtaaaagaaaaactgctgaggtgactataagcttcgtagataaaagctaatataaccgatgcagctcgcgagctgtgttgagagaatttcgtgacaggaggcctagtgcagttcgagaaggttcggctcgtagcaagcacccgaccgttggacgggcagaggctgtagtacgcgtgtactgactactgattaatccccaacccaagcagcccaacgctgctgctgctgctgatttgtgatcggcatgcaatttggcgttgccgccttgccggtgctcctgctacgcctacgactaacgaacggaaaggaaatgacggctcagattcgacgccgtgattttacccccaccactccgaatacagcattcactcatatttatgaatttatccagatttcctacctctcaccgggtggaacgttacaaattcgaactcatctgacaatgaggacaaattgtgtggtactacattgacagcctgcactgaatctactggcattttattcggatccgtaccattccgatttcctcgcgggtgatgatcacatctggacgttagaattcaaacaaattcaattgcaaataagagggaaaacaatctgtcaaagaaaacgaacatacaagactcgcaacgacgccacccgatgatttctctttcttgaagctaccgcaacactcgaacagaatgatgctcatgaacaacgacgcaccactgtccaccgaggtgacgccaccgctttaaaatccccgcagcctccgaacggatcgagctcgcccacctagaaatgacactctgactaacgacgagttttatcccatatagaggagtatgttaattgttaatggataagaacgtctacctatccgtaaaatatattcacatataccattataattatttaatagtctatattaactaaaattaaactcttttctagctattatttatatagctatcaagtcatgtaatcatgtgatttgttatatgtgaagttagaaaaaaaacactattttagttttcgtatttagcaattagagactaaaatgatataaaatgtaagagataaaaattagtctatataaatcaaacaccttcttaatattttaaatcttgatatttaaatgattgatatattgtaatttaagacttttctattgttacaagttacgagtaaaattttatgctcgctatcatatacatctaatcgtaaccttgccatacctaccccacctagcccccgccatactccgaccctagggtttccgtcctcttccgtaagcttccaaaaaaatggccaacgaggagccggctcccgtcaccgctcctgccgccgccgccccagccgggggcgaccattctccggccttctcgttcagcatctggccgccgacgcagcgcacgcgggacgcggtggtgcggcgcctcgtggagacgctcgcgggggacaccatcctctgcaagcgctacggcgccgtgccggccgccgacgccgagcccgcggcgcgcgccatcgaggccgaggccttcgacgccgtggccgccgcgggaggcgccgccgcctccgtggaggaggggatcgaggcgctgcagtcctactccaaggaggtgagccgccgcctcctcgactttgtcaagtcccgctccgcggacgccaaggccgacccgccgtcggcggaggccctggcccctgacgcgcccgaggcccagcccgcggcgtgagcgccggacagccagtcgttccgtacctgatcttcctgagatgagattgagtcgcgtctggagtttgtgtggagactgcagcctgtgtgtgtggcaaagtctgggtctgtatgacttgaacgttagctgtttgcacatctatgcagttcttcttccacggatgtctgatttagtgcgtgctcttattttacttcttgcaatgactgcccctgaccaacgattatgttccgtttgctgtgacgctcatgcatcaggcctcgagtgatagataaatccgaaataacaagcagaatcctcccatctttcaagccacatttttatctggtaactgtcatcgttgatttgaaatctgattatgggtcataagttcagtatgaatcctcaatgatcaaatgcctatatcgcaatcttctgtgtactttttgctgctatactgtatgtcagctggctttggaaattggaatcaatacccagccagcatctcgttcaaatgtggccttgctactgaaactgaatgaatcgtctgtctcccatttttctttacgccgaccaattctgcaggcggcctgtttttatcaacaagttcaaagagcatttgctggggtgctggggcgtctggttggtgctaagcctgtctgatgacccggatctactctcggttgaagatgaaaagggatactgagggcctgttgggagccccccttcaatccccttctcctaaacaaagccctaaattgaatagtaaaaatccccttctcccaagccctgaaatgtcggcgttccccgtgtcaagcgagcttcggcatgtatttggccattcctcttacagttcacagactgaatatagccgaggaaccgttactccggttacatcggcgatcaattgggatggcggcttcagtccccagcgactgcattggatagttcaaagcaagccctgtacttgtcgaacaattagtggtaatttctgaattgcacacgttatccaaagtgctttgagttgataaaaatcagacaaacccttcagcgcgtagtgtcattgtgtttgtgttctttcatatgatggtcatcacattgatgtgtgagtggctgagtgtgacgcacaggattggagggaatcagatggaactttattattgttggtgcaaatcacacttgccaccaatatgttccaattcaggaagcttatataactcttggtgggtaaacaaaaaaaaaaatcctcggcagactgaagaaatttccaaacatgatagccatatgtccttttccatatttattagtcgatgcttatatctctccgttcttgaacagtttgatgccgtccctccagagattcgcatgccacaaaattcaaggcctaagaaaataaaagaagaggaggaaggaacaaaacgatctgggacagtggaaatcacttgacgatcgtggacactggcacgcctgaatgcagaagaagtgccaaaagcagcgagctgcacatgcaatgaagaaatccaaaaccaaatgtgaaacatgatggtccagttaaccatgagacaaacaatggcggcaagcgactcccgaagcctgtctacaagaggcaacctgaaaatagagaacgatttcccagctgaaatttctcgtggccccctcgcaaggctatctacaaatgactgagagcgctctcctggcagtttagggccaagcaaggcatgcttcccaaccgagtacaacatcatctacaagaatctgcgcttcatcaccagatagtagccacggctctcttgatttccgttccttcaatgtttcttcttccgcaggtgatgatgagttgcagggagctctgctag

SEQ ID NO: 202 - DNA, 625 bp, Zea mays
cttacaaagtagcagccgtcacacaccggtgaagcgccgccggcggcaggaacacccccgaccccgatctcgacggcagagcgagaaagcgatggcgctgaccaacttcatcgtaacggtggctgtggtcggcgcgggggtgctcctcttcaccaccgacatccgcaggtccggcgccctcttccgccgcaacgcgcgccagctccagcagtggctccaggaggacacggcctccgccgcgtccaagtccacgaaagaagcagctccgaagaaacttgactcaactgtctccaaggagaggccaaaggaagacagtcactgatttgagttgtttatatgagcggtatgacccctgtttaaagccgttcatttttttgtgtgtaagtaacgtgataggaacctgtagctcttaagtagatgcacggccagattatgtttccgtttgaacagaagcactgggcctgtgtggaacagctagattatgttgttgtatttcgcttgtaaaggatctaaagctcttagctaatgtacatgtgccctgctggtagctttgacaaaaaaaaaaaaaaaacagtgggtcagattatgaaatgctatttgatttcttttaaaaaaaaaaaaaaaa

SEQ ID NO: 203 - DNA, 1123 bp, Zea mays
aatatattacactgaggagtgaggagcacaattccttccaggatcccagaagattcgacgttccacgggctccggcggcggcaggaacgcctcccgatttcgacggcagaactagagagcgatggcgctgactaacttcatcgtgacggtggccgtggttggcgcgggggtgcttctctttaccaccgacatccgcaggtctggcgccctcttccgccgcaacgcgcgccagctccggctgtggctcgaggaggacacggcctccgccgcgtccaagtctgcaaaagaagcagctccaaagaaactcgactcgacggtccccaaggagaagccaaaggaagatagccactgattggagctgtttatatgaacggtataacccctatttgaagtcttgcaagtcctgttttctacagttgctgcgatagaaacttgtagctctcaagtaggtgcacggcaagattatgtttccgtttgaacatcggcctctgtggaacagctagctgaatgttggtattatgtcgtgtgcttatatggatccgaagcacttcgctaatctacacgtagctcaaatcttgttggtgtaaaaaaaaaaaaaacgaaggcccctactgttgcgctggctgccggtatttctgcgccctgatcaatctgaagcggttgatttaagcagaccttgaatgaagggaagcatggtgcatttgaatgcaaccgtcgcctaacgtgtgtccgagtgggggttttcttgttttttgagcaggagaggaaaccgtcggcatttgatagaggtgacgcaatctgggacagctgccgggtggaccggctgacggtccgtcgactggtggaggaggagaggtgagcagcgactgtacgagtcggaaggtggtgttgaatgatggctgctccagtgcactgcatgggatcactcgaggttgcattagcaactttcgacgtggcgattgcgcgcctgacaagttggttgttggttcagttaggtttgcaatcatcgtcgtccctcgcagatcaccacaggatggcgaagagatactagacggtgagtctgaggagatcatcatgccttgtcgttcagagccgggctagcacttgactcattggcctgcag

SEQ ID NO: 204 - DNA, 613 bp, Zea mays
aatatattacactgaggagtgaggagcacaattccttccaggatcccagaagattcgacgttccacgggctccggcggcggcaggaacgcctcccgatttcgacggcagaactagagagcgatggcgctgactaacttcatcgtgacggtggccgtggttggcgcgggggtgcttctctttaccaccgacatccgcaggtctggcgccctcttccgccgcaacgcgcgccagctccggctgtggctcgaggaggacacggcctccgccgcgtccaagtctgcaaaagaagcagctccaaagaaactcgactcgacggtccccaaggagaagccaaaggaagatagccactgattggagctgtttatacgaacggtataacccctatttgaagtcgttcaagttctgttttctacagttgctgcgatagaaacttgtagctctcaagtaggtgcacggcaagtcggcaagattatgtttccgtttgaacatcggcctctgtggaacagctagctgaatgttggtattatgtcgtgtgcttatatggatccgaagcacttcgctaatctacacgtagctcaaatcttgttggtgttttgaaaaaaaaaaaaaaaa

SEQ ID NO: 205 - DNA, 1760 bp, Zea mays
aagtaatgggtttagataggatcaaggtgaatttttgctccatactatcccaattcccaacccgaccattgccgtccttacagtcaactgtgttctagacagttgagttcaaaaaggtgaggcggcgagatcgaatcaagcggagcggagcctacacatggcgatggcgctgcgtcggctgctgcttcctctcctcctcctcgtactcttaggtctgcggccgcagagctgcgtcgccagtggcggaggtggaggggagccggcggagttcgagatacctcgggacgggagcgtgctggagcttgacgagagcaacttcgaggcggcggtgcgcgcagccgaattcctcttcgtcgacttctacgctccctggtgcggccactgcaagcgcctcgccccgcagttagatgaggctgctgcagtgctagctggactgagcacgcccgtccttgtggctaaagtaaatgctgacaaatacaagaagctcggctctaaatatggagtagatgggttccctactttgatgttttttgaccatggagtgccctcggagtacacgggttcaaggaaggctgatgtgctagttgagaaccttaagaagcttgttgcacctgatgtttctgtccttgagtcggactcgtcaattaacggctttgttcaagcagctggcatcaattttccattgtttattgggtttggaatggatgagtcattgattgttgaatatggagcgaagtacaagaagaaggcatggttttcaacagcaaaggatttctctgaggatgtgatggttgtgtatgattttgacaaggttccagcgttggtttctgttaacccaaaatataatgagcagagtgtattctatggcccgtttgaaggaacttttctggaagattttataaggcaatccctactgcctgcaactgtgcccatcaatagagagacagtaaagctattgaaagatgatgggaggaaagttgttcttacaatcttggaggatgaatcagatgaaagctctctgcagctaataaaagtgttgaggtctgccgccaatgcaaaccatgatttagtgttcggatatgtgggagtcaaacagtgggaggagttcaccgagacttttgatgtgaaggtttcgcagctgccaaagattgttgtctgggacacaaaagaggagtacgaagtggttgagggttcagagagtttcatagaaggtgactatggatcccaagtcagtcgatttctagagggatatagggaaggaagaacaacaaagaagaaagtgggccgtggttccccaacactgctcggccttaacgcggtatacatcctcgtcctgttggtcgccgttctcgttgttttgatgtatttttccgcgcaaggcgaggaggatcatcagccaagaagagcccatgaggactgacagcaatctgagatggcttagattcaaggcgttgatccggaggctgccgagttatttttgaaggggggtaacatataacatctgatggacaaattttcctgatcttcatttcacgtgccctagggtcgagttttagatatttgttgcagagctatgcatgagctcccctgtgtttctcttgaacccttgaagtttttggacttgttacttgaggaccgggtttcctcaggtttatgtcattgtaattattcggcactttgtaacatagcattcatgtgttatatttgagacccttggagaaacgacttctatagattgaacagcaaaaaaaaaaaaaaaa

SEQ ID NO: 206 - DNA, 4079 bp, Zea mays
gcacgagcccgtcgccccgcgctccctcgccgccacctcgtctcgtcacacactccactcgaacgcactacttgatcggccaaagccaaacgaactgggctccctcccctccacttcctctccccatggcgcagcagctcccctgcgtctcgtcgccgcgcccgctgctcgccgtgcccgcgggccggtggcgcgccggcgtgcggggccggcccaatgtggcgggactggggcgggggcggctgtctctccacgccgccgccgcgcggcccgtggccgaggcggtgcaggcggaggaggacgacgacgacgacgacgaggaggtggccgaggagaggttcgcgctgggcggcgcgtgccgggtgctcgcgggaatgcccgcgccgctcggcgccaccgcgctccgcggcggtgtcaacttcgccgtctactccagcggtgcctccgccgcgtcgctgtgcctcttcgctcccggcgacctcaaggcggatagggtgaccgaggaggtgcccctcgatcccctgctcaaccgaacgggaaacgtgtggcacgtgttcatccacggggaccagctgcacggcatgctctacggatacaggttcgatggcgtgttcgcccctgagcgcggacagtactacgatgtgtccaacgttgtggtggatccatacgctaaggcagtggtaagccgaggtgaatatggtgtgcctgcgcctggtggtagttgttggcctcaaatggctggtatgatccctcttccctataataagtttgattggcaaggtgacctaccccttgggtaccatcagaaggaccttgtcatatatgaaatgcatttgcgtggattcacaaagcacaactcaagcaagacaaaacacccaggaacttacattggtgctgtgtcaaagcttgaccatctaaaggaacttggagtgaactgtatagagctaatgccctgccatgagttcaatgagctagagtacttcagctcctcttcgaagatgaacttctggggatattccacaataaattttttctcaccaatggcaagatattcttcaagtggcataagagactctggatgtggtgccataaatgaatttaaagcttttgtaagggaggcccacaaacggggaattgaggtgatcatggatgttgtcttcaatcatacagctgaaggtaatgagaaaggcccaatattatcctttagggggatagataatagtacatactacatgcttgcacctaagggagagttttataattattctggttgtggaaataccttcaattgtaatcatcctgtagtccgtgaatttatagtggattgcttgagatactgggtaacagaaatgcatgttgatggttttcgttttgaccttgcatctatactgaccagaggatgcagtctatgggatccagttaatgtgtatggaagtccaatggaaggtgacatgattacgacagggacacctcttgttgccccaccacttattgacatgattagcaatgacccaattcttggaaatgtcaagctcattgctgaagcatgggatgcaggaggtctctatcaagttggtcagtttcctcactggaacgtttggtcagagtggaatggaaagtatcgcgataccgtgcgtcagttcatcaaaggcacagatggatttgctggtgcttttgctgaatgcctatgtggaagtccacagttataccaggcaggggggaggaagccttggcacagtatcaactttgtatgtgcacacgatggatttacactggctgatttggtcacatacaatagcaagtacaacttgtcaaatggtgaggacaacagagatggggaaaatcataatcttagctggaattgtggggaggaaggagaatttgcaagtctgtcagtccgaagattaaggaagaggcaaatgcgcaatttctttgtttgtcttatggtttctcagggagttccaatgttctacatgggcgatgaatatggtcacacaaagggagggaacaacaatacgtactgccatgaccattatgtcaattatttccgttgggataagaaggaagaacaatcctctgatttgtacagattctgccgtctcatgaccaaattccgcaaagaatgtgaatctcttggccttgaggacttcccgacttcagaacggttgaaatggcacggtcatcagcccgggaagcctgactggtcagaggcaagccgattcgttgccttcaccatgaaggacgaaaccaaaggcgagatctacgtggccttcaacaccagtcaccttccggtggttgttgggcttccagagcgctctgggttccgatgggagccggtggtggacaccggcaaggaggcaccatatgacttcctcaccgatggcctgccagatcgtgctgtcaccgtctaccagttctctcatttcctcaactccaatctctatcctatgctcagctactcctccatcatccttgtattgcgccctgatgtctgaaagaagcagatacaatagagtatactatagcggttgttctctaggctgtagcatgcagtggaaactggaaaatgttggggttgctctgttgtcggtagtttacatgcgcatgtcggtatgtgtagctaaagctggtggatctcagttctcagatcggactcgagacggggaaaaccattgcccagttggctggttctctgaagttttgtttggtgtaaagaaatggtggtccatcatctactcaaatttttttctcttttttaatgaaataagttgactcaaaatcaactcattcttcaacttaataattagtatatacacaaggaataaattaattctatcaaatttatgaaatgaaatccaacattattcgaaggactgacgactactaacacggcactgctcccggagaaagaggaaaacctggcaaatggattacgggtacgagggtcggctaaagtaaagagtacggacaaaactttcatagcataggctcagagcttacgttgtcattataggcgatactgtcctaccaactccgccgtttgcgctacaaacttcaggtatccttggtcatggtcacataccttcgaaggtatggagcattgtacccacgtaaacaacccagagtatttttaaccaaagtacgttggcaagaacgaagcacagtaccaacacgcttgtcaacagaagaccctttttacctttctacacactccctaggggagatccttgtaagaggcatcttccttgagctgtaaaaggaagggttggtcttctctattcagatgagacacacactccgacccacgcacgcacgtactcacaccagagacttgggaacgcttccctctctcgccagcttgcaacctcgtactacgaataatttggtgttggtagtgtaagccaccgaagactagagtagggatattcggccgaaccaatataattcatgcgtccacatcgcaaaccacccggcctaacgcgcactacaaatttattcgtcggtacttactcgaaacatcgccactaaggccagggttcaagcccaatatctaacgctcccataccattgttaggtgtctaggacattggctctgttgggggccttcctctttcgaaggtcctcaaaagtgcgactaaccatttgttttcagtatgatatagattattacaggaagcttcatctttgggatgaaagttctctcatgataaaggcatgtgatatgaatatacaacccgaaggtgacatggatggacgccgaagctatggctcaaggagcttcagcttggatggaagacgaaactgacctaaggggggaaaagactacttagtcattgataacttgtattataactaagagtaaatgccaggggtatgaatgtaatcttatccgggctgcatcccgtgcctataaataaatgaacagtaacactgtactgtactgttcacgctggattgtaatctctctctcgcgtcatctttgcattctcaccttctggcgaaccgaaggtacaattgtataataaatatcattaatgttaattcttatatgtaaatatgaatataagtgaatggtttag

SEQ ID NO: 207 - DNA, 3009 bp, Zea mays
  misc_feature (2065)..(2065): n is a, c, g, or t
catatttatattgacatttatggcatgtgttctttagacatactactttctgtcactttttgttactgtaacttcggcaattttcaactgataacattttttcaattaacaacgtgaaagttgcattcgtcatcttcacactactttctagcacaagtcattggccactccactaaattacttccttttgtgtagccaaagcttttaatgtgcacttcagacttttagccattttgtattgactaatgtgttacatgtcgtattgcaatgcattagcatatgcctttactttgcgctggtattctttgtgtcatcttgctctaccctgtaacattactgcatcttttgttatcttatgtctactttgtaatgcatggtgtattcatcctttcattgtctcatttcaccatcaagaggcacccaaagtttgtttgcatgatttatttttaacattggtctaaatatgtattttgttaggtgatatttcattttacatgctgatgtttccgttatttcctatagtctttgcacactgtgctatccttattccttgtaccaaattttttgaagcaatgattagttgcagaatgcagatagttatttgttcggttcctgtgttctatctttcttttgcagctcgctataagctaataatttttcttatgcctctgcttctattccatcagatgcagcttttcatgtctgcctgatttttcttttactacgcaaaggttgatgctgtagtatacctggtagatgcatatgataaggagcgatttgctgaatcaaagaaggagctcgatgctctcctgtctgatgattctttggccaatgttccatttctcatccttggcaacaagattgatatcccatatgctgcctctgaagaggagctacggtatcacctaggccttagcaacttcacaaccgggaagggcaaggtcaaccttggcgactccaatgtccgtccacttgaggtcttcatgtgcagtgttgttcgcaagatgggctacggtgatggtttcaagtgggtctcccagtacatcaagtagggccctcgccgaggcgcatgctcagcccggcgaatttttttgccttgttcgttccggttggttcgtgacgagaacgaacgatggtcgctaggaaagtatcatggagggtatgaagaggaaaaacagtgcttaacattgttgaacatgttgagtctttagcgtcaaaacaatttatgtcgaactctattctttcgcttttccatacaacgtttactaagtacttgcgatgcattataaaattattactctttaattgtggtgtaatgttcgtgcattgcaactgagtaggagtcgttgcattatcattgcatgttcttggtttgattatgttttcttaaagcctctatctgtactataaaaagtctagttttcttttgtcaatcacgatcgttagatctattttttattagaatcatagggctgtcgtttattggcaggaacgcagaaactatcaatggaccgggtccttcggcacgacattggtcagtgcatgaccagcattatccgtgagattggatccccgcttgcacgcagcgaggcctatgtgaccgtatcatacgtaagttttctggatatatacaggtgcatataaataacattaggttgcaccggtgttcagtttttaggatgcagcctgattctcatgctggcaaccaaacaacctgtatgtgcgtatatcagtagaccgggtcctttagcatggcattggatcgctgcaaaattatgtgcatctgcctttgcggcctctcacatacatccaatgcaggcccacatgaatagaagaaaaaaaaaccaaggagggcttctatttctgtagtgtggatctgcacgggatggatgtgagaggctacaaaggtgtgcctttgcattcgggatgtacataatttttcccatgccgccactcccccacccccaacccaatcactgcacgcctccttgagacctactcgagtggagcaaggaaaggaatgacacgtatgtgccctcgccttcgttcgtctactgacgtgtanttgtaggccttgtggccataggggaaggatccgggtagcttcgtcaagcgcatgacgcacatgctcagcatctgttgcggccgccatagtttcgacctctagaagagcacctgctcctcttgcggctaccctaccgcctccctacttcctccctctctccgttcgtttgcctctgcctcactgctagatcgagacatttttagtgttaccatgttccgttgtggccgtcccagtttccatctccagaagagcatctgctctcctacgactaccctgctgcccgcatccacaagtgcatgatatgcctccttgcttcctctctctccctctctatctccgtcatttgcctcgctgctagatcgagcaagttttagtgttaccctattatgtttcgccctgattgtaatatgttgcttcgtgacatatctagatggccaaatagtgggatttagtatgttctattgtgaacttaaaactgggtgagattttgaacgttgtcacatatgcagacgtttgttgcttttaactttatgtgtgtgtatatatgcatctgtatattattatgctactgacttatatgtgatttctgctaatgtgttgttgaatttattcctgcatgaaatgatgatggaaacattgctccatgttactaattatacttgattgacaacaatgtttttcaagatgatcctagtgtgccacttgttgattttgtgctactttagaacctttgattcgtttcaagcatattatattgttttgctgttcatgccttgtatgtttgtgcatttccctcatctagagaactcgttgtatgcacttttgtagcatgttcaaccctgattttgtttactaattgatgaaaatgaaagctaccctaattttgtttatgaaggaccgatgagactattagagggggaggggtgaatgggagccacaaaatt

SEQ ID NO: 208 - DNA, 3496 bp, Zea mays
  misc_feature (1856)..(1856): n is a, c, g, or t
  misc_feature (1915)..(1915): n is a, c, g, or t
  misc_feature (1980)..(1980): n is a, c, g, or t
  misc_feature (2481)..(2481): n is a, c, g, or t
caatttttttccaggatggtacgactctgtgtaggaacttattgattgatctgttgatatacgaggggaacacatatcgatttaacattcctataaatatacaagagtatcttgaccatattatggaaaaaaatagattaaatagtcagttgtgcatatgtttgttttatacttattgatctgaatgtctaaactatgacgacctataaaagatcattattgaattttgccattaaattttcttgttaaattttatataatatattaggtgagtgtccgtgtcttgcaacgagaattaactaattttttatcatgaaattgttatttttctttgagtagcgtctctgttttcattcactcgtatcattttagaacaactcgcacatctcatatatgttaagagtgttcttagaatattgttttacattcttttctttctttcctttgcttgcaccatgatcccgtttgttgtccgtctttaacgattttgtctttggataagcagtatactgacctttcttcgatttcttcactctatcacttttctgtaaaaggttcttccatgcttaaaactgaatacaatgatatgtatatgtatgtattttgaagcttacatttctttcaccgtataggaattatacaccaaatatacatatctattcgtatattggctcattaatcatacgtgattcgtgatttagcatcgacacgatggttcaaagcaaaagggtctacatgcagcactcgctcgcttccctccgcctcgaatggtcacgccacccagaccctgcagcagcagttaatcgtcacgcccccatccttccccagcaaacacaacacaagcagacggggagagattcagatccactcgtcacacatccgcgttaccccctctcccttggtttcctctcccaccaccaacccccatcccggttatctccgccgccgcccgctttgggaaggcgcgacgaaggcaggcgagaggctccagccggacgaggaggaaagaggagcagcagggccggaggagagatgttcctgtgggactggttctacggggtgctggcctccctcggcctgtggcagaaggaggcgaagatcctcttcctcggcctcgacaacgccggcaagaccacgctgctccacatgctcaaggacgagcggcggcgccggcccccgcctgcttcccgtatcctagatctgaccgcacccgattggatcctgtccatttctggcttccgtttgcctttctgatccgttcttgtctcgatcgctgcagcggttggtgcagcaccagccgacgcagcacccgacgtcggaggagctcagcatcggcaagatcaagttcaaggccttcgacctcggcggccaccagatcgcgcgccgcgtctggaaggattactacgcaaaggtcgagctcgattcatccgtccttataatacgtgccgtgtggtcagatctatgttcgtcccttgcgcccttgattaaaaacgtgtgtttcgaatttcgatctgtgctaaggttacaattttccttttcaatgacgttcaagggacgccagaaattgttgatttgacgagttcgaatcttggttgggaattctgattgtgccacttagagaaattgatcagtagctcctgtatggaactgttttacatgcatcagcccttgcaaccaaattcctgggtcggtactggttctttcggtactctgaggagacaatgtgaaattgagtataaaaaacatatatacacaggtgtatgttgttgtatatttcttttgtggtcagtcttaaggttctttgaaatgtgtgagctttgggagtcagctgcatctgttgcttcatatactcgttncattttgatacacaaaatataattgcaattctatgtctattaacacttttttctggttntatatcactgttttaaaggcattgcctaggcgtccaggcggtggtccaatgccttgggcgcctancttgcctaggcatctatgcggtggtccaacgccttgtctctccataccgcttttaaaaatcatgttctatacatatctatgttgatatttatgacgtgtttttttagaaatacacatgtttgtatgcgactctatgtctgacactttttgttgcagtaactttcaaaattctcaattgttaacacttttaaattaacaacatgaaagttgcatttttcatcttcacactttctggcacaagtcatggggcacttcataaagtgttcctttggtatagtcaaagcttttaaggtgcacttcagactttagccattttggtattgactaacatgttacctgttgaattgcaacgtattagcatgtcttcatttaatagcttgtattttttgtgtcatcttgctctacattgtaacatactgcatcttttattatcttttgcctactttgcaagcatggtgttttgatccttttattgcttcatttcactgtcaagaggcaccnaaagtttgtttgcatgattttatattgaacattggtctaaatatgtattttgttacgtgatatttcatgttacatgctgatgttaccattatttcctattgtctttgcacattatgctatccttattccttgcaccaaaatttgtgaagcaatgattagttgcggacagttgtggttcgttccctgtgttctatctttgttttgcccctcgccggaggcgctctgcttcggcaagatcaagttcaaggccttcgacctcggcggccaccagatcgcgcgccgcgtctggaaggattactacgcaaaggttgatgctgtagtatacctggtagatgcgtatgataaggagcgatttgctgaatcaaaaaaggagctggacgctctcctgtcagatgattccttggcaaatgttccatttctcatccttggcaacaagattgatatcccgtatgctgcctctgaagaggagctgcggtatcacctaggccttagcaacttcacaaccgggaagggcaaggtcaaccttggcgactccaatgtccggccacttgaggttttcatgtgcagtgttgttcgcaagatgggctacggcgatggtttcaagtgggtctcccaatacatcaagtagggcccttgccggggcgcttgctcagcccagcgatttttttgccttgttatttgttctggttggtatttcgtcacgtgaacgatgatcatcatatcatgacagtatcatggaggggtatgaagaggaaaaaacagtgcttaacattggggaacatgttgaatctttagcgtgaaaacattttgttatgtcagtcaaactcctggaattcttttgcttttccgtaggacctttactaaggacttgcctgcgatgcattataagattattgattgcttaaattatgtgttataaatatggtggtggattggtactgagtatcggtggttgcgttatcaatgcatgtattcatttgtttgcttaaaaaaaagagaaaaaactcgagagagg

SEQ ID NO: 209 - DNA, 1135 bp, Zea mays
cattgggtacctcgaggccggccgtgaacgccccttgtccttcccgagcggcaatcaaagagacggggagattcagatccacacacatccgcatccctctctcctcggtttcctctcccaccaccaacccccagatcgcagcgatctccgccgccgccctctctgggattccgcgcgacaaagtcaggcgtagaggctccaggaggaggagggaggcgcagcagggcgggtgggggagatgttcctctgggactggttctacggggtgctggcctccctcggcctgtggcagaaggaggccaagatcctcttccttggcctcgacaacgccggcaagaccacgctgctccacatgctcaaggacgagcggttggtgcagcaccagccgacgcagcacccgacgtcggaggagctcagcatcggcaagatcaagttcaaggcgttcgacctcggcggccaccagatcgcgcgccgcgtgtggaaggattactacgcaaaggttgatgctgtagtatacctggtagatgcatatgataaggagcgatttgctgaatcaaagaaggagctcgatgctctcctgtctgatgattctttggccaatgttccatttctcatccttggcaacaagattgatatcccatatgctgcctctgaagaggagctacggtatcacctaggccttagcaacttcacaaccgggaagggcaaggtcaaccttggcgactccaatgtccgtccacttgaggtcttcatgtgcagtgttgttcgcaagatgggctacggtgatggtttcaagtgggtctcccagtacatcaagtagggccctcgccgaggcgcatgctcagcccggcgaatttttttgccttgttcgttccggttggttcgtgacgagaacgaacgatggtcgctaggaaagtatcatggagggtatgaagaggaaaaacagtgcttaacattgttgaacatgttgagtctttagcgtcaaaacaatttatgtcgaactctattctttcgcttttccatacaacgtttactaagtacttgcgatgcattataaaattattactctttaattggggggggtgatgttcggaggccgctcgcgttctagaaccggacgctgggtcgaccggga

SEQ ID NO: 210 - DNA, 1452 bp, Zea mays
ccggccgggatttagcatcgacacgatggttcaaagcaaaagggtctacatgcagcactcgctcgcttccctccgcctcgaatggtcacgccacccagaccctgcagcagcagttaatcgtcacgcccccatccttccccagcaaacacaacacaagcagacggggagagattcagatccactcgtcacacatccgcgttaccccctctcccttggtttcctctcccaccaccaacccccatcccggttatctccgccgccgcccgctttgggaaggcgcgacgaaggcaggcgagaggctccagccggacgaggaggaaagaggagcagcagggccggaggagagatgttcctgtgggactggttctacggggtgctggcctccctcggcctgtggcagaaggaggcgaagatcctcttcctcggcctcgacaacgccggcaagaccacgctgctccacatgctcaaggacgagcggttggtgcagcaccagccgacgcagcacccgacgtcggaggagctcagcatcggcaagatcaagttcaaggccttcgacctcggcggccaccagatcgcgcgccgcgtctggaaggattactacgcaaaggttgatgctgtagtatacctggtagatgcgtatgataaggagcgatttgctgaatcaaaaaaggagctggacgctctcctgtcagatgattccttggcaaatgttccatttctcatccttggcaacaagattgatatcccgtatgctgcctctgaagaggagctgcggtatcacctaggccttagcaacttcacaaccgggaagggcaaggtcaaccttggcgactccaatgtccggccacttgaggttttcatgtgcagtgttgttcgcaagatgggctacggcgatggtttcaagtgggtctcccaatacatcaagtagggcccttgccggggcgcttgctcagcccagcgatttttttgccttgttatttgttctggttggtatttcgtcacgtgaacgatgatcatcatatcatgacagtatcatggaggggtatgaagaggaaaaaacagtgcttaacattggggaacatgttgaatctttagcgtgaaaacattttgttatgtcagtcaaactcctggaattcttttgcttttccgtaggacctttactaaggacttgcctgcgatgcattataagattattgattgcttaaattatgtgttatatatatggtggtggattggtactgagtatcggtggttgcgttatcaaaaaaaaaaaaaaaaaaaaaaaaaaaaaaaaaaaaaaaaaaaaaaaaaaaaaaaaaaaaaaaataaaaaaataaataaaaaaaataaataaattaaataattaatttggggcggcccttttatagttcccaagcttactttcccgggtttgcgacgtatttttttttatttgggggcccctaatacaat

SEQ ID NO: 211 - DNA, 1726 bp, Zea mays
ggagattcgccgtctcaccccttccctgcctgctccctcgtctaagaaaagcgggcagagcagagacggcggcggcaggccatcgcggactcccgctcaccctcgtctgccaccgcctcccaggtcctagcacgcaggggccgacggcgacgggtggggaggggcggcagaggtagtccgaggggaggctgtggagcgaagggcggagagaggccacgccgtccggagtctccagttccgtcgccacagcttcctgccgcgccggggccgaggtaaacgagagggatcgaggaagaagtatcccccggagccccttcccccgaacccgaaggctccggaatggcgcactgggttagcgacagtgatggcagtgacaactttgaatgggatagtgatggcaatggggaggagccagcgaacttcaatgctgctggtgccggttcatcagctctgagatcaacgaacactgatgctccaggtccatcaacacgggttgctaatggcaatgggaaggctgggccatctgcctccttggttcagaagtatatggacatgggtttcgcggaagagattgttcggaaggccatgaaggacaatggggataatggagcagattcattagttgaacttcttcttacttactaggaactaggcaatgacctcaaagtggataacggcttcgcttctggttgtgccccccaaactgttgatgatagtgatgatgacgacattctagaaaactgggatgatgaggatgctggtggtgggagaagcaccggggttgctaactctattgatgattctgaagacgaggatttcttaaatgagatgtcacagaaggacaagaaagttgattccttagttaaaatggggtttcctgaagacgaggctgcactggctattactagatgcgggcaggatgcatctatttctgttctggtggattccatatatgcttcacagaccgcaggagatggttactgtggcaatttgtctgactacgagggtaattccaatggagggagaaacaaaggaaggttcatggatgggaacaaaaaaaagagaaaaagatatggaggtcaagcacagggaagtagaggcccattagatggtagctgtgaagaacccatgcctctcccaaatccaatggttggatttaacttgccggaccattggacaagaccagtagacagatcgctgcctacacaagctattggtccaccatacttctactacgagaatgttgctcttgctccaaagggtgtctggactaccatatctagattcttgtacgatattcagccggagtttgtggactccaagtacttctgcgctgctgccaggaaaagaggctacatacacaatctgccacttgagagaaggtcgcctctcctccccatacctccaaagacaatattcgaagcatttcctcgtaccaagaggtggtggccgtcatgggacccaaggcggcagttcaattgcctccagacttgtacgtctagcgcaaaactgttagagaggattcgtgtaacccttgcaaacagttcggatccacctcctccattagttcagaagtttgtgttggaggagtgtaggaaatggaatctggcttgggttggcctaaacaaggttgctcctctagagcctgatgagatggagttcctgcttggctttcccaaggatcacaccagaggtatcagcaggacagagaggtcccgatctcttg

SEQ ID NO: 212 - DNA, 2418 bp, Zea mays
aaaaagcggtcagtgggtggaggcagccaagagtcaccctgtcgccgttgccgtcgccgaggcaggcagagtctccctgtcgccgttgccgtcgccggcctcctcctcctctgccacttcctcccaactcccagccgcaggggccgacggcgacgggagggaagaggcggcagaggtactccgaggggcgcggagagaggctgtgccaggccacgccgtccagtgcctccgggtccgtcgccgcagcttccggccgcgtcggagaggtagcccccggagctcttcgcggaggctcgggaatggtgcactgggttagcgacagtgatggcagtgataacttcgaatgggacagtgatggtaacggggagcagacagtgagcttcaacgctgctggtgctggttcatcagctctggcagcgacgaacactgatgctcctggcccatcgacacgggttgctaatggcaatgggaaggctgggcgatctgcctctttggttcagaagtatgtggacatgggtttctcagaagagattgttctgaaggccatgaaggacaatggggataatggagcagattcattagttgagctccttcttacttaccaggaactaggcaatgacctcaaagtggataatgactttgcttctagttgtgcccccaaaactgctgacgatagtgatgatgatgacacactggaaatctgggatgatgaggatgctggagggagaagcaccagggttgctaactctgttgatgattctgatgacgaggatttcttacatgagatgtcacggaaggacgaaaaagttgattccttagttaaaatggggtttcctgaagacgaggctgcactggctattaccagatgcgggccggatgcatctatttctgttctggtggattcaatctatgcttcacagaccgcaggagatggttactgtggcaatctgtctgactatgaggataattcctatggagggagaagcacagggaacaagaaaaagagaaaaagatatggaggccaagcacagggaagtagaggcccattagatggtagctgtgatgaacccatgcctctcccacatccaatggttggatttaacttgccagaccagtggtcaagacgagtggacagatcgttgcctgcacaagctattggtccgccgtacttctactacgagaacgttgctcttgctccaaaaggtgtctggactaccatatcaagattcttgtatgatattcaaccagagtttgtggactcaaagtacttctgtgctgctgccaggaaaaggggttacatacacaacctgccacttgagaacaggtcacctctcctccccatacccccaaagacgatatcggaagcatttcctcggaccaagaggtggtggccttcatgggacccaagacgacagttcaattgcctccagacttgcgtgtctagtgcaaaattgttagagaggattcgcgtagccctcacaaacagttcagacccacctcctccaagagttcagaagtatgtgttggaggagtgtaggaaatggaacctggcatgggttggcttaaacaaggttgctcctctagagcctgacgagatggagtttctactcggctttccgaaggatcacacgagaggtatcagcaggacagagaggtatcgatctctaggaaattcatttcaggtcgatactgttgcttaccatctctcagttctgaaggatctgttcccacaaggcatgaatgtgctgtctttattctctggtattggaggagcagaggtggctctccacaggcttggcatacggatgaacacggttatttcagtggagaagtccgaggtcaaccggacgattctgaagagttggtgggatcagacgcagacgggtactctgattgagatcactgatgtgcagacactgtcatctgagaggatcgaggcgtatattagaagaattgggggcttcgatcttgtgattggtggaagtccctgtaacaacctcactgggagcaaccgtcaccacagagatggtttggagggcgagcattctgcattgttccatcattattttaggatcttacacgccgtcaagtccatcatggagcgtttgtagttcttagaatatttactgttgttttggttctagtagaatactttgtgaccgaacttgtaaatggtttgcaggttgactggtttagttctcttgccactctaatttaggctagtttttttttattttatcttctttggtgattttggtgcagttctgtggcactgttgggtagtcaaatgcagattgatccgagaggctgccctgatgtttttcctttttaaaatttgaatttgtcaatgagagatcaggtatcctggttaccaaaaaaaaaatggtttgcaggttgactggtttaaaaaaaaaaaaa

SEQ ID NO: 213 - DNA, 2499 bp, Zea mays
cattgggtacctcgaggccggccggggtgcttttccttccgactgcggcccgccacccgccacccgccaccgcctcgagtctctcccgcgggcgcgaggtgcacgctcgagtcaccaccagaagggcgcggaggaggccggctgacaagaggcggccctgtgcgccaagagccccggcgcggggaccagaccagaggcggcggcggcgtacgtgcgcgcgtgtgtacgtggtgcgtatggggtcgaggcggcggagacaccaccaccacggccggtgggttgtgccctccgtggcgccggcggcggcggctttcgcagcggcggggttgctcctcctcgtcgtcgcgttccattgcttcctgtcgctgccgctaagcgacgccagtggcggctcccgtgtcttccggcgccccaacccgccgttcctgttgaacaagccagcggatgtgcgcagaaatgtaatcggtgccgtggatttcgctgttccaagcggtgggagcaagctcggggaggagctctgggagtcgaaggcggcgggcaacttcttcggctgcagcaacgccaccaaacagttcgccgatgccgaggctgtgaccaagtcggaccgttacttgatgatcgcgacgagcggcggactgaatcagcagcgaacagggatcatagatgctgttgttgcagcccgcatactgaatgcaacacttgtcattccaaagctggacgaagaatccttctggaaagatgcgagtgactttgcggagatatttgatgtcgattcattcatatcctcgctttcgaatgatgtaaagatcatacgccaagtacctgacaggaatggcaaaccgccttcgccgtataagatgcgtattcctagaaagtgtacttctaaatgctacgagagccgagtgttgcctgctcttctaaagaagcatgttgttcagttaaccaaatttgactaccgattgtcaaataagctagagactgatcttcaaaagcttaggtgtagagtcaattatcatgcactaaggtttacagacccaatcctccaaatgggtgaaacgcttgtccaaagaatgagggggaaaagtggacgtttcattgctcttcacctaagatttgagcctgacatgcttgctttctctggttgctactacggcggtggagacattgagagaagagaacttggtgagattcgtaagaggtggaagaccctgcatgcaagcaaccctgacagagaacgacggcacggaaagtgccctctaacaccagaggaagtagggctcatgctcagggcattgggatttgggaaggacgtgcacctttatgttgcatcaggagatgtatatggaggcgaggagacactggcacctctgaaggcactcttcccaaactttcactcgaaggaaactctagccaacaaggagttagctccttttttaccatattcatctcgcatggctgctctcgattttatcgtatgtgataggagcgatgtcttcgtgacaaacaacaatggcaacatggccagaatgttggctggtcgaaggagatattttgggcacaggaggaccataaggcccaacactaagaaactttactcattatttctgaatcggaccagcatgagttgggacacatttgcatctaaagtccagacctttcaaaagggattcatgggggagcccaatgagattaaactaggaagaggcgaattccatgagcatcctgtagattgcatttgtgcaaaatcgaagggaaaaagcgtacagagcaggcctcacctagttaaaggcgctggagaagctgtggagaaccattctattgatggggaacttgactggaaggatttggactacggagagcatacacccttgggcaggggggattcatcgaatgaaaccgaatcagacgatgtccgtattggtggatcagacattcctgaattggaggatatgatgtcagactagacacaaatagatagttcattatagttttttcttttatttacaaatggtttggtgataagttattttgaggacagaagatgctacatggtttatttttctcctgtttattcttggagattgcagacacatagaaacaagtttttgccagctcgacaaacaagaaaggcctggaagagctagagcttcctacagaaaagacaggaagcctatagttcggtatgaggtaacaactgtacagtgtatgatggaccctggggaaatggtttctttttcatatagcttgtaccgtagatagaaacaaaagaaacccttcttatgttttactgtgtagcgttataatgagattttgatgggtctatcatcgttcttgattttgtttttttctttctttcataaatgcctgttcccaattttgctggcctcgatttaaatctgtatttataaagaatgtaaaggggtccaagcatacaccccctttcccaaatataggattgtcttacggtttctccttaaaaaaacactgcaccgtttccct

SEQ ID NO: 214 - DNA, 1857 bp, Zea mays
ttatatatattgtttttttcttgagctcgcgacctaaacgatccgagctagctcgttagcttaacaagtaagctcggacgagtcgagcctagcgagtatatctagccctagttgcaaacataaaagacacttttttcgggcattgatggagaatcaagtagctccatgaacttgagattaggcatttagacttggcaaatcttgagaattatggagaaacaagagtgaggtacacagcactgatctgttgttaactgatcgggtgcgggcgtaaaacaagtcggcccaagtcccaacaacggatcggaagcgatccccattccacatccaccaaatggccgacgccgacgctgccgccgtccccgttgatggccccgcccgcaccaccgtgctggactcgctcggcgaggacatcacccgcatcgtctaccccgtctccgcctgcatgctcctcgtcgtgctcctggtctccctcctctcctcgccctcctccccgtcgcccttctccgcctccatcgcggccgccaccggcggcgtctccggaggggacgacatacccacggcgctcatcaccgccctcaccttcgtcgtcgccgtcacggccgccaccttcctgctcgcgctcctcttctacctccgctgcacgccctgcctccgcgcctacctcggcttctccgcgctctccgtcctcctcgtcctcggcggccaggtcgcgctcctcctcctctcccgcctccgcctcccgctcgacgccgtctccttcgcgctcctcctgcccaacgccgcgggggcgctcgcgctcgccgcgctggccccggcctccgtccccatcgcgctccaccaggccgcgctcgtcgccgtcgccgtgctcaccgccttctggttcacgctgctgcccgagtggaccacctgggcgctgctcgtcgccatggccatctacgacctcgcggcagtgctgctccctggtggccccttgagggtgctgctcgagctggccatacagaggaacgaggagatcccggccttggtctacgaggccagaccggtggatccccgccatggccggaattggcgcttgtggagggaagggaggcaacctggcgcggatttggatgccagttccacggttgaggtgattggggaggtacttcagcctgactctggaaacagttcggcatcccaagttcatgaacctgccactcttgctggtgatattagtaattcaaggcccagggtgacattggcggctgctttgagctcctctgattcttctactgtcgcacaagttggggaagtttcagcattgcaggagcatagagttgctgttgctgaaatgacggtacctttgatccagccacgccctcagagatctgaagaagaggtggaagatgaagatggcattgggttaagctcatctggggctattaagcttgggttgggggacttcatattctacagcgttttggtcggcagggcagcgatgtatgactacatgacagtgtatgcctgctaccttgccatcattgcagggcttggcatcactctgctcctgctggcattcttccgcaaggcattgccggccctaccagtgtccattgccctcggcgttctgttttacgtgctcacaagaacactgcttgaggaatttgtcgtgcagtgctccacaaatcttgtgatgttttaatatgcacgcaacattgcttattgctgtaccattgtagttcatgatcggcacctttaccagatgattagctcgtaattttctgcaagtgttaattttactggtccgtgcactgattattatatgaagatatttggaattcctgtcgtattttcccactactaatcttgttctgt

SEQ ID NO: 215 - DNA, 1376 bp, Zea mays
gcccctcgctgtgacgactgacgagcaaccaatccacccaaatcccagaccgagctccaatcctcagcgccgccagtcgcgccgcctccgatggccgcgcggcgcgggccccacgtcatcaagctccacgatcccaacccgcccctcctcggccgggcgccggggaccgcaccggccgccatccccgcgccgtcgcgcgatgagggcatcctcgcgcagcaccctcgcgccgccccctcgagcgcatccgcctcgcacccggccttcgcccttatcgaggagcgcctcgtagcccgggaccaggacatccaggagctcctcgtcgacaaccagcggttcgccgccacgcacgtcgcgcttcagcagcagcttatcgcggcgcagcacgagctccgggcggtctccgtcgctgccaccagggcgcgcgccgagcgggaggtcgaggtgcgagcgctggccgaccaggcggcccacatagaggccgaggcgcgggccgtcgccgctgcgcgcgcggaggtcgaccaggttcacgccgacgtccaggtgctcgtcgcggatacaaagcagtccgggcacgagcgggcggcactcctctccctccctcactcactaagccaaagctgacagcagcatacaagcaccagcagagctcttgccgatggcggtggccaagcccccgcttcagacggccgcggtcctcctcctcctcctcctggtcgtcgcggccgcgtcgtggctccagaccgtcgacgccgcttcagggttctgctcgagcaagtgcagcgtccggtgcgggcgggcggcgagcgcgcgggcgcggggcgcgtgcatgaggtcctgcggcctctgctgcgaggagtgcaactgcgtgcccacgcggccgccgcgcgacgtcaacgagtgcccctgctaccgcgacatgctcaccgccggccccaggaagaggcccaagtgcccctgaggccggctcacacacggcgcaacccaagacacgtgctccatgggactgccactgctttgcctgcaactgcgatccgatccatgctgatgggccaggcaacctgttatgctatccctaccctactactacgtatttgtgtacgtacgtatctttgtatgcatcgcgcgtccgtgtgatctataatatataatctgctaccaggtcccgtcagatgtactgttagtgataagctgagcgactagagaggtactgaatcctcagtagttggtagaacgggctgttcctcgggacagtgtgtgtcatggttaggctgcctgtactaattaatgtacatgaactattgtgctatatatatatattgtcataaaagaaaaaaaaaaagaggacgcggggggaggggggaactcgagcccgg

SEQ ID NO: 216 - DNA, 2638 bp, Zea mays
ccacctatttaagttgattgatttgttcttttaacttacaatatgttactaaattattagtagactatagcattaaagtgggccatttatgttgactattattgaatattaatttgaaccaaacctatattaatccaacattatcgcgtgtatcttgggtgccacggccaacaagttgaatgaagcaataatttatgaaaaggcaacgtcgtttacgccatgtttggtatattcttgccggccgggacatgttgaggatcatatatatatatatatatatatatatatatatatatatatatatatatattgttgttgcagatgaccggtcattacttggagtaaaacagcaatactaatatttttttgctttgaataacatttttgcgccgtgccggccaatgcatgagcgtgcatcagaagtccgctcctattttggaggtacgtagtagtatctcgggtttgatcaagtagggttggttggcaggaaaagatgatgaagacagaatttgtcaaacttggagactagatcaaagatagaagtgtgagactgatcagtttgtttgtcctattctttcttttctcctgagcaaagatacgaagatatatgaagatttttgttgttttttccctaatgcacgtgcacgatcatttagtccatgtatacagtgtaaaatgctacataggttttgcggtgtccatttaattagccgtttagtctatttaagtattattcggttcaaataaatcctcttcgctatggctttagtcctctgatttctgttttttctatagtattttgtctttattaatttcagccgcaacagtacaaacaattttaatcaagctgcagcgaaaacgatatgtgaccgaactcacactcttgactgtatgacgtagccggccggccggccgtcccgatccgtggaagagtaattcaaaatagggtgtaataagagtagttcaaaatactgaaaatatgttgactgattcgctaaaagaaatttctttgccttctccactccaatccatgtacgtgatggtgatggaggagatctcagcaagccttcgagaataagcagtgacaacaataatctagcctgcctgtccttagcgtagtcatgccatggccggcgatgcgctcatcgtcatcgtcactagcttcctcctcgcgctgccgtcagcgacggcaataggcaaggtctgtggcaacgccggcaactacacggccaacggcaggtaccggtccaacctcgactccctcgccgcggcactcccagccagcacgtcctcgtcccctcagctcttcgccaacaccaccgccggcgaggcccccgacgccgtgtacgcgctcgcgctctgccgcggcgacctgaccggcaacctcaccgggtgcagcgcctgcgtgaacggctcgttgcagtacgcgcggagggcgtgcccctacgccaaggccgccagcgtctacgacgacaactgcctcgtcggctactccagcgccaacatcctcgtcccggcctataacgccacccgggacacgagcacgctcttcgactactggaacagcatgaccatcgccggcaacgccaccctggtggccgcccacgtcgacgacctgctgacgcagactgcccagcaggcggcctccagcccgaggaggttcgtcacggcctacatggacggctccagcaacgccgtcatcccgacgctctactccctggcgcagtgcacgcccgacctgtcagccggcgactgcctggcctgcctccagcggatcctcggcttgctcaacgccacgacgtcggtgagccttggagggcgggtcctcctgctgcggtgcaacttcaggttcgagaataacatgttcttcgacggcgcacagatgacgcagatcaggccgtcgtccggcgctccggcgccaccaccaccgtctcccgccgcaaataaaggtatgtgcggtcaagttcgagctattttcatcatgaactaattgttgatgcacccttgtttgtctaggatctggggtgaagccttgggtaattgcggtgtctgtagcacctcctgtggcggtagtagcattctgcttcatcctttacaaccgtaggcaaaggagaaggttcagaagaggtgagttgtcgtttgttaccgacatctctctcactcactcatatggttattttacaattatattatacatttagacctaatttggaaacttaaatcccattcatcattaaagaggattgaagagaaaataaactagttttcccttcgattctctccaattctggaggagaatttgagtttacaaactaaccacagaaaggggaaattaaagggaaaatctcccataaataactaattacagttcgattgtttatcctatactagaaaaagacaggatcctaaggagatttaagttttcaaactagttctcgaagtaatcaaattctcgactattatacaggtagatctaaactacgacaaaagcatcctcgcaacaacttgaaaggagacgaactagattgggaaatggaaacagagctctcagagttttctgtttttgacttccatcagatattggaggctacagataacttctctgaagaaaataaacttggggaaggtgggtttggcc

SEQ ID NO: 217 - DNA, 2059 bp, Zea mays
gagcaggaaagcttcggcgtggtagcagaaaatgaaaccgacttaaagatgaaaagactattcagacctcgatagattactatagaattattatcaaatataaagggcatgaatgtaattttgtatgggctgtgtcccgtgcctataaataggtgaacagtacccccgtactgttcacgctgatttgacattcgcttttgcgtcacgcttgtactttcatctccttcaagctgaaggtacatttgtaattcgatgttatttctgtttctacataataataatgcaaaaataagttaataataatatacaattgtctatgttatccttcatattccttatgattcatccttcgtcactgtatagtgtatttatgaaggtacgcccttcataaccttcgtccgaaaatcattatatcctaagggaaataatgcttcgaaggacgaagggctttaccgattaacattttctgtgttgccttgttcttaactcatagcatttgagaacaagtccccaacattggcgcccacctccggtgaactcacttccactctttgagtttttgaacaccttcggcgatcataaaccttcgctatggcgccgaagaaagcttcagcaactggcactgcagctctgcaaccgctggaccacaatcaggagactgtctcccttcgggaggcccgaagccagaaaaggaaggctgttagcccgacaccgccagaggatgagatagaccaagaaatcagagacatggagatgcttcatcaacaggtgcagaggaagaaggaaaagatggccaggctagctgaactgcaaaggcagatagacgaagcctctgaggaagttcgtcatcttactcaggatgagcaacaccgaaggcctcagcaccaagaccttcatcaggagggtttcctcaatgaagatgactggtatgacaatttccatcatgggaattttgtttttgatgatgcttctcctctgtccgctgagctgcaggctacaccttggcctccgtcctacaagccgcctcagcttcccatatttgatggccactcagacccgaagcagtttttgatgagctacgaagcaacagtatcttcgtatggtggcaatgctgcggtcatggccaaatcttttgttatggctgtcaggagtgttgctcaaacctggtactcctcccttcgaccaggaacgatcacttcgtggcaaaagctgaaggacttgttgttaaccagcttccaagggttccagacgaagccggtcacggctcaagctctattccagtgcacccaggatcacgaagagtaccttcaggcgtacgtccggaggttcttgcgtttgagggcacaggcaccaacagtgcccaacgaaattgtcattgaggccatgatcaaggggcttcggccaggaccttcagctcagtacttcgctaggaagcctcctcaaactttggagaagctgctccagaagatggacgagtacattcgggccgataatgattttcgccaaagaagggaggaggctttcaggttttctgaaatgaccaggggcttcggaggaagattctatccgaggcacgttaggtcaatccataactctgctcaaaatgatgatagggggagccagcagcaaaggccacagtgctcctcacaggcttcggggcaacagcaaggctccttccgaccaccagctccaagaggcagaggcgccaggggcttcggcggaagatttggagatcaaccaagaagaattttttgcttattctgtggtgagaacaagggccataccacaaggatgtgccatgttaccatccagaagcaaaaggaaatagccgaagctgcagcacaacaggctcagccgaagcaggtcatgcacactgcttcgtatcattcgccttacatcccagaatatgtaggcaaccaccctgcagtttctgttgcttcggcgagtcaacctcaagcttcttggcaacagcctccgcctccaccaccgctgcaacaaggacaacagccagaagggagccaatatggcccacaccaaagggacttcagagaacagtccg

SEQ ID NO: 218 - DNA, 3503 bp, Zea mays
tccgcacccaaagctgacacaccaaaaggtgcgccgcgggtgatgccagctcaggctcacaacacgagcaatctcgcgttgatctccagtgatgaaaggggcacgaggctgctggaccagttcgaggacacgctggtgcgcgtcctcgtcgccgccgccgccgtctccttcctcctcgcgctctcctccagcgccggcacactcacgctcgccgccttcgtcgagccgctcgtcatcttcctcatcctcgtcgtcaacgccgccgtcggggtctggcaggaggccaacgcggagcggcgcgtggacgcgctgcgggagatccagtcccaccacgccgccgtcctgcgcgacgcccgatgcgtcccccgcgctccactggcccgggacctcgtcccgggcgacgtcgtccagctccgcgtcggggcaaaggtgcccgccgacatgcgcgtgccagcctcgcgtgcacctcctagctccgcctcgagcagggcttcgctcacgggggagacggcctccgtcaacaagacctcccgcgcgctcccgctcgaggacgccgacatccaggccaaggactgcatggtcttcgccggcaccaccgtcgtcaacggcgccgcgctctgcatcgtcgcgcgcaccgggatggacacggagatcggcgccatccacgcccagatccaccaggcctcgcaggaggacgacgacacgccgctcaagaagaagctcaacgagttcggggaggcgctcaccaagatcatcggcctcatctgcgccctcgtctggctcatcaactgcaagtacttcctcaccttcgacctccagggaggatgggtgcccaggaacatcaccttctccttcgagaagtgcacctactactttgagatcgccgtcgcgctcgccgtcgccgccatacccgagggcctgcccgccgtcatcaccacctgcctcgcgctcgggaccaggaagatggctgccaagaatgcgctcgtcaggaagctgcctagcgtcgagaccctcggctgcaccaccgtcatctgctccgacaagaccggcacgctcacctccaacaagatgtgccgtcgccaagctcgtggccgtcggcgattcctcgcaggaggttaggaccttcaaggtggacggtacgacttacgatccccgggacgggaaaattcacgactggcctgctgggagcattgacgccaaccttgagacgatcgccaaggtcgcagctgtgtgcaatgatgccaatgtggcacattcttcgcatcagtatgttgccactggaatgccgacagaggcagctcttaaggttttggttgagaaaatgggtctgcctggaggaaagaatggtctgtccttggatccgtctgagatactaggctgctgcgcatggtggaacaatgttgccaaaaggattgctaccctcgagtttgatcgcacaaggaaatcaatgggcgtcattgtgaaaacaagttcaggaagcaatgccctgctcgtgaagggagctgttgaaactttgcttgagcgaagtagccacattcagctgaaggatggttccgtggtgccattagatgagaaagcaaagagaactatcctggcaagcctccatgagatgtcgaccaatgctctgcgctgcctcggttttgcatacaaggaggcgctagcagaatttgcaacatatgatggcgagaaccatcctgctcataagctcttgctggatccggccaattatgcagctattgagactgacctaatatttgcgggtcttgtaggcctaagggacccaccccgggaagaggtctatgatgctattgaagattgcagagctgctggcatccgagttatggtgataacaggggacaacaaagaaaccgctgaggcaatatgccgtgaaatcggcgtgttttcacctgacgaggatatcaccttcaagagcttgcaggggaaggagttcatggcgctggaggacaagaagaccgcgcgtctgccagtaaaaggtggtctcctgttctctagggcggaacctaggcagcaaacaaggacgattcgtggaggccttgctgaaggaagaatcgggcaagttgtcgccatgactggagatggagtcaatgtaagcgcgcctgctttgaagctggtcgacatcggtgtagctatgggagtcattactggaactgaggttgccaaagaggcgtctgacatggtgttggctgacgacaattttagcaccatagtttctgcagtcggtgaaggaagatcgatctacaacaacatgaaagctttcataagatacatgatttcgtcaaacattggtgaagtcgcttctatattcctaacttccgccctgggcattcctgagggtttgattcccgtccaacttctatgggtcaatctcgtcaccgacgggccccccgcaactgctctaggtttcaatccgcctgacaaggacatcatgaagaagccacctaggaggagcgacgactcactgatcactccctggatcttgttccgctacctggtgattggcctttacgttgggatggcgaccgttggcatcttcgtcatatggtacacacatgggtctttcatgggcattgacctgaccggagacggccacactctggtcacctactcgcagctttcgaactggggccagtgctcttcctgggacaacttcacggcctcgcctttcaccgccggagccagaacgttcgcgttcgacgacgacccgtgcgactacttccacgcaggcaaggtgaaggcgacgacgctgtccctgtccgtgctggtggccatcgagatgttcaactcgctgaacgccctctccgaggacagcagcctgttggccatgccgccctgggtcaacccgtggctgctcgtcgccatgtcggtctcgttcggcctccacttcctcatcctctacgtgccgctgctcgccacggtgttcggcatcgtcccgctcagcctcaacgagtggctgctggtcctgctggtggctctcccggtggtgctcatcgacgaggctctcaagctcgcgggcaggtgtacgagcccttcttcgggccccaccaggcggtccaggaagaagaagcagaagggcgagtagcgagcgggcgctaacatttgactccgtgctcagttactaaaccattccattaatcatgtaaacaaaagatgaacctcagtcagtcaatcaatcaatacaggagataacccattttcactgtttctctttctactctctctccaccctaacgccaaaacaacagcagcacagtagcttctttgttctcagaacaagttgttaattagttggcaacatatgttatcctgtgaattatgtagcgttgagtcagatcttcagatgatactttccagttttttttttcttttcttttggctgtaaatttctctcttgccagtgcagatggcaacgagagcaaggtcaggccagagggttggtcaaacaaagtttaactgccctcttgtggcccgaatgaatactgcag

SEQ ID NO: 219 - DNA, 2660 bp, Zea mays
tcgcttgttctccctagttccgacccgaagcagggaatgagcttcggcgatctcgacggcggcgggtccaagcgcaagaagccgtacaaccgccacgcgccgcggcagatcgaacagctcgaagcgatgttcaaggaattccaccacccggacgagaagcagcgcgcgcagctgagcaggcagctgggcctggacccgcggcaggtcaagttctggttccagaaccggcgcacgcatttgaagaaccaactggagcggcaggagaacgcgaggctgaaacaggagaacgacaaactgcgcgtcgagaacctgtccatccgggaggccataagggacctggtgtgcagctgctgtggcggtccagcggtgctcggggagctgtcgcccgaagagcaccagctgcgcctcgagaatgcgaggctcagggacgagctcgctcgagtctgcaccgtcacttccaagttcattggcaagcccatgtctcacatggaactgctgctcgcgaaggagccgcatcctattacaggctcgtcactggaacttgcagttgctgttggtgttggttccggcgtgccatcgagcaaaatgcccgtctcgacgatctccgagttggccggcagcacatccagctcaacgggaacagtgaccacgcccatggtgactgcatccttgccgatggttagcattgtcattgacaagtccaagttcgcccagcttgcagtgagtgcgatgaatgagcttgtcaagatggcgcggatgaatgaaccgctgtggattccaaccattccctcacctggctcaccaatcatggagactctaaactttaaagagtacttgaaggcattctcaccatgtgttggagtgaagcctactgggtttgtgtctgaggcctctagggaatccggcattgtcaccattgacagtagcgctgctcttatggaggtcttcatggatgagagacgatggtcagacatattctactgcattgttgccaaggcatcaatcgttgaggagatcttacctggtgttgcaggaagcagaaatggtgcattgctgcttatgcaggcagaactacaaatgctttcacctcgtgtccctataagggaggttacatttctcaggttctgcaaacagcttgctgagggtgcatgggctgtagtggatgtttccattgatggactgcagacggatcagtgcctagatacaaacacgaaatgccggaggctgccttcaggttgcgtgttgcaagatacccccaatggctgcaaggtcacatgggttgagcatgcagaatatcctgaggcgtccgtgcaccagctctaccagcctcttatgcgctctggcctcgcccttggcgcagggcggtggcttgcaacactgcaacgccagtgtgagtgcttggccatcctcatgtcatcgcttgcagcgccagagcatgactcagcagcggtttctctggaaggaaaatggagcctgttgaagctggcacggaggatgatggagaacttctgcgcagggatgggcgcgtcatcttcccgcgaatggagtatgctggatggcttaacaggtagcacggggaaagacgtgcgggtcatggtgcagaacagtgtggatgaacctggggtgccaccgggtgtggtgcttagcgtcgccacagcagtatggctgcctgtgacccctgagcggctcctcaacttccttcgcgacgaggagctccgtgctgagtgggacatcctcagcaatggtggccctatgcagcaggtgctacgcattaccaagggccaactggatggcaactctgtggctctgctgagatccgatcatacagactcccacctgaacagcatcttgattctgcaagagacgtgcactgacagatctggcgcaatggtcgtgtacgccccggtggacttcccggcaatgcagcttgtgcttggtggaggggactcgaagaacgtggcgctcttgccatctggtttcgtcattctgcctgctgggtctagcgccggtggggttgggcacaaggcacgcggatcgctgctcacagtcgcattccagatccttgtgaacagccagcccacagcaaagctgacggtggagtcagtggacaccgtgtacagcctcatctcctgtaccatcgagaagatcaaggcggcacttcactgtgacgtctgttaacttgggaacaggaagcttcaggcatggaggcaaggcaacagccggtgatcagcctgagtcaagaacgaaccgcgcaaaacagtagtgacctttgctaggtggtacgggtccatagggctggcccgtagcacacagcaatggcggtggttcgggtattgactcagcctccaattgttctgggttaaattttgcattttggacctacgcctgggcaatgccatggttggttttggtggttttagggagtctggagtcatctatgctttttgttggctggctcgtggtttttggtatcaggtttgcttttgtaaccatagatgtaggagagccccccttgatgttgatgatacagtcaatatcagacaaatgcagcattgtatcgtgagattcagtctcagatcactgtggatttaccttgtatggaacagtaggaggaggagcggcagtttatgtaaaaaaaaaaaaaaaaaaaaaaaaaaaaa

SEQ ID NO: 220 - DNA, 1738 bp, Zea mays
gtcgcccatcggattgctggattccagggacccgtacgatctccagcagcctcagatcggaccaaggatgatgtacgggaacatagctaaccagcacgaggcgttcctgaggaggaagctggaggaggagcaggcagccgagctgcagcaagccatagagctggaggggcgccgcttcatggggctgcagctcctcgatctcaagagcaggggccaccaccatctcggttcaggcgcgcccatgcctctgcggcaagccaccgatggcaaaggcagcggcatcaacgggaacggcaacgcgtcccatttggaggatgccatctgcatccaagataagaggatgatgagcagccttgcaatgagtgctcctcctgctgctgctgatgcggaaggcgagcacgaggagcagcagggagagggcggtggtggctgtgatggcagcagcagcagcagccccaagcaggcagtcaaccctggggaagaggaggtggtggaatctggtcctgtgacagcgacgcccaacgctgcttgtggattccaagaaagcagctatggcgtggtggaggtggagctcgtcttgcctgacagccccttcgcgccccccaccaaggaggaggcctcatacgctgatgctgtcactgctgcagccgctcggaacggtagcaccagcagcagcagccctcgccatgtggcccttttcgcacccgcgtcttccaccaccctcgagctgcccccctacagctcctcctgcttctttcaggtgcccaggttttctcctgggcatgaagccattgggctgtgatgtgaggtgcacagaacaaaaaatggggagggggccccctccattcctctaatctgggaggactaatggctatgattggccccatcaaccaggcgtagagaagctttgacaaaaaaaggagattgcgtccctcgacggcgggccgggcaacacaacaacaacaaccatctccaacgcagcaagcagacagaaggacaggcaggcagcgagtgcaaccgcgagagcgatcagcgatgggctccttcttctcgaccttagtgacgccccctccgcccgccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaggagctggcctcccgcttcaccgatgccatcttcatcaaggtcgacgtcgacgagctcgcggaggtcgcaaggacatggaaggtagaggcgatgccaacgttcgtgctggtcaaggatgggaaggaggtaggccgtgtgattggggctaagaaggacgagcttgagaggaagatcaggatgttcgtcacgtcatcttcctcgtcctaacttagcagtgcatacactcccaccttcttactggtttctcgactccagtggttcacctgggacggggttgctgaaatggttcccttctctgaatactgaaaaatcaaaaaaagaagtatatgaaaaaatgatggtagacgtgtctgggtcaataagagtttctgaaacttggatttgtatgtgtcagtctctgtgttctgtttccaaggaatggatcatgtgagtttggaatatagctggaaatatgctgtgctgttagtttctgttttcaaaaaaaaaagccccctaatttgcggcc

SEQ ID NO: 221 - DNA, 1513 bp, Zea mays
aggtccgttctcccttcttctccgttgcattgccattgcctgcctgcgcatgcatcgcattctcatcgttctctcttcagtcacaatgcaatgcactgcacgttgcgttgcttgtttgtttcgatagcttcagttgccacctaaaaaagcttctttttttcggttttatcgttttgtctggttgcaggaagctgcagcacgcgcaccatggcggagccgagttcgccggttgtgcgtcgcccatcggattgctggattccagggacccgtacgatctccagcagcctcagatcggaccaaggatgatgtacgggaacatagctaaccagcacgaggcgttcctgaggaggaagctggaggaggagcaggcagccgagctgcagcaagccatagagctggaggggcgccgcttcatggggctgcagctcctcgatctcaagagcaggggccaccaccatctcggttcaggcgcgcccatgcctctgcggcaagccaccgatggcaaaggcagcggcatcaacgggaacggcaacgcgtcccatttggaggatgccatctgcatccaagataagaggatgatgagcagccttgcaatgagtgctcctcctgctgctgctgatgcgtaaggcgagcacgaggagcagcagggagagggcggtggtggctgtgatggcagcagcagcagcagccccaagcaggcagtcaaccctggggaagaggaggtggtggaatctggtcctgtgacagcgacgcccaacgctgcttgtggattccaagaaagcagctatggcgtggtggaggtggagctcgtcttgcctgacagccccttcgcgccccccaccaaggaggaggcctcatacgctgatgctgtcactgctgcagccgctcggaacggtagcaccagcagcagcagccctcgccatgtggcccttttcgcacccgcgtcttccaccaccctcgagctgcccccctacagctcctcctgcttctttcaggtgcccaggttttctcctgggcatgaagccattgggctgtgatgtgaggtgcacagaacaaaaaatggggagggggccccctccattcctctaatctgggaggactaatggctatgattggccccatcaaccaggcgtagagaagctttgacaaagaaaaaagaaatacctttggagaggtgtaatcttcttcagagagtgggaggagggaagggacagtgaagacagcaacagaaggagaaacaagtctaggttgtttttttagctcttaggcctatgataagtatatgatagtaagtgtgagtgagtgagtagtaggcataaataatagtagtagtagtagttaattagtcgtttattagcagctcctatgctcgtttgtggcatggatggatctcactgttgtgatgatacaggtgattaaactaaaccttagtagaatggtgtaagctctgccaattgtagttgcggcgtggctgcatacatcaaaaaaaaaaaaaaaaaaaaaaaaaaaaaaa

SEQ ID NO: 222 - DNA, 1359 bp, Zea mays
ttttttagctcttaggcctatgataagtatatgatagtaagtgagtgagtagtaggcataaataatagtagtagtagttaattagtagtcgtttattagtagctgctgccagtgtcaagaaggtgatgaaaaggcacactccagctctctcctatgctcgtttgtggcatggatggatctctctctgttgctatgatatgttggtttatttacaatatcgtgtgaataaatatttaatgtttttcactttgtttgatttgtagtaccacacataacgatttcatgtgttttccgtggcaacgcacgggcatagatctagtatagataaagagccgtagtcttgactagagcaactaactaaattcacatttatttctgctagcagacgcatttaactttttaaaacaagattaatcacccctatatactcgactcgatcctaaagtcggcgcacatcatgttttagcaaccaccgcttcctcctctggaagtggtaaagatggcctccaagttgttccgtcggggccatccatgagggcgattccaacagcagccaattccttccggatctcgtcggatttttcatactgcttcgccttccttgctgcagtcctctcttcaatcttctgtaccacaagctcctcagtgatggaagctcgtctcagtgctttatcccgcagctgttgcaaagcctcatgataacttgaaggtagcaatcctagaacagagagaactactcttattttctcttctaaggcggaaagcgattccaacctcttgtcctgtttctttcccttgcgagtgtgcagcagatcattcataactttcaatggctcagaaatagcagccaatgccactgaagtgtgaagatcatctgacattgaggtctcaaattcatcatgaagtttctggatgtaatttaaggtattagcaggcaatggatttccagtgttgctttgttgatgctgacagatctcttcacaatcacgcaaggtctgatacgtgtagtacaatctatctgatgcaacattgagttgttctatggtgtagttaattggggacctatagtgtgtgccaagtaagaacattctcaaagccagcgggtggtacatctctataacccgcccggtggtaacaaaattaccaagtgatttagacattttttggctgtttacattcacaaaaccgttgtgtatccagtaatttatggtactgtcacaacatgccgcacgactctgagcaatctcattctcatggtgtggaaagatgagatcctccccaccaccatgtatgtcaaaagaatgacccaaataatgtgcactcatggcactgcattctatgtgccatcctggctcgtgc

SEQ ID NO: 223 - DNA, 1414 bp, Zea mays
tggaccctcgagccgcgccgggtacaggggcagccaggcacacacacacacagtgaccctgccccttttcccggccgtctcgctctccaccgatattccgctcctcctgtccagtcctcctcccccgagccggctcattatatcgtccgtcgcgcagcacaacgcaagtttgctagcggccggatcagcagccacaaaacgaggagagcaaccacgctgcacacagagacgcccgtgtgtgagatatagagcaagctcgatcgaaggaaggagggaagctagagatcgtacgtcgccatggggaggggacgagttgagctcaagcggatcgagaacaagatcaaccgccaggtcaccttctccaagcgccgcaacggcctgctcaagaaggcctacgagctctccgtgctctgcgacgccgaggtcgcgctcatcatcttctccagccgcggcaagctctacgagttcggcagcgccggcataacaaaaactttagaaaggtaccaacattgctgctacaatgctcaagattccaatggcgcactctctgaaactcagagctggtaccaggaaatgtcaaaactgagggcaaaattcgaggccttgcagcgcactcagaggcacttgcttggggaggaacttggcccactgagtgtgaaggagttgcagcagctagagaaacagctcgaatgtgctttgtcacaggcaagacagagaaagacacaacttatgatggagcaagtggaagagctccgcagaaaggagcgacacctgggagaaatgaacaggcaactcaaacacaagcttgaagctgaaggttgtagcaactacagaaccctgcagcatgcagcctggccagctcccggcagcaccatggtggagcatgacggcgccacctatcatgtgcatccaacaactgctcaatcggttgcaatggactgtgaacccactctgcaaatcgggtaccctcctcatcaccagtttctgccttccgaggcagccaataatatcccaaggagcccccctggaggcgagaacaacttcatgctgggatgggttctttgagttgctctgttaatcatccatccatcagatggatgtccaaactaataaaaggcactcagtgctaccatatgcatatccatgcttaagtgcttgatttgccacgacgtgggatatcttttaaatttatcgttctggtgtgtaataactaattaagaacggcaccttcattctatggttgtggtgtggcacttctatctatggtttttgtatttggaccacgaatgttgtaatttgtaaaaaaatttaaagatttatctatgctgccggtgctgcggtgcatagcccggtgcatagaatccaaaattatctgcaccggtgcttattatggccgcctgcatagctggaaaat

SEQ ID NO: 224 - DNA, 1277 bp, Zea mays
ctcgtgcgctgatattccgctcctgtccctgtgtcctccccggatggagctagagccggctctgctcatcattatatcgtcgcgagcacttgtgtccggcggccttgtgttcgtggggggtgtgtggcatattagctagcggataagcggccggccgaagagcaagcgcagtgagaagaagaagctcggatcggaggaggtcggcatggggaggggacgcgtcgagctgaagcggatcgagaacaagatcaaccgccaggtcaccttctccaagcgccgcaacggcctgctcaagaaggcctacgagctctccgtgctctgcgacgccgaggtcgcgctcatcatcttctccggccgcggcaagctctacgagttcggcagcgccggcgtaactaaaactttagaaaggtatcaacatttctgctacaatgctcaagattccaacaatggtgcactctctgaatctcagagctggtaccaggaaatatcaaaactgagggcaaaattcgaggccttgcagcgcactcagagacacttgcttggggaggaccttggcccactgagtactgtgaaggaattgcagcagctagagaaacagctagaatgtgctttgtcacaggcaagacagagaaagacacaacttatgatggagcaagtggaagagcttcgcagaacggagcgtcacctgggagaaatgaacaggcaactcaaacacaagctcgaagctgaaggctgtagcaactacacaaccttgcagcatgccgcctgctggccagctcccggcggcaccatcgtggagcatgacggcgccacctatcaagtgcatccgcctgcccactcagttgctatggactgtgaacccactctgcaaatcgggtaccctcatcaccagtttccgccccctgaggcagccaataatatcccaaggagcgctgccacaggcgagaacaacttcatgctgggatgggttctttgagttcttctgttaatccatccatcagatggatccatgttgaaaccaataaaaggcattcagtgctatatatatcatatgcatatccgtgctcaagtgcttgatttgccacgacgttggattgtatcgttctgtgtgtaatagctaatttagaacggcacatctattctatgtggttgtggtgtggcacttatactgtttattcatttggaccatgaatcggggtagtttgtaaaaacacatctatatatgctgccggtgcatagaattcaaagttatctgcaccgtaattattatatgctcc

SEQ ID NO: 225 - DNA, 973 bp, Zea mays
gcacgaggctgtaatccactataaataggcctcagggaccccccggccgggactcactctattcccattccaagcccccgctctcggattcccgacgacgagctcagagctcctcctctcctcccctgctcggtgttcgacgcaacagctgccgccatgtctgccgccaaccagctcgccgccctcttcagcaacatgtacgccacgggtttgcttgacgatcagttccagcagctccagatgctccagaacgccagtactcctgacttcgtctccgaggtcgtcacgctcttctgccaggacggcgagcggatcatcggagagctggccaaactgctggagaagcccaacgtggattttgacagggttgacgcctttgtgcatcagctcaaaggaagcagtgcaagtattggtgctcagaaggttaagaacacttgcattcagttccgcgaatcctgtcagcagaagagcaaagatgggtgcctcaagacactggagacagtgaagattaacttctatgacctgcgtgacaagtttcagaccatgcttcagctgcagcgtcaggtcaatggctgtccccccagcaagtgaacaagatggtggagtggagcttcatgttgggatgatgcgtgcatctttcaagttccagaacattctgaataagctcctcaattggcttctaggaagtctgtaatagcttagcagcaagattagcgttgacaccaccgtagcagaagtcaatgtcgtcgtttttgtgtcaccgtcttagtcgtaagtgtccgtgctgggtgatggatctcctgcaagcagttgcaagtggtccatttactatgtagtagtggctctgaataatctatatcttagcaatgaatttggcaacatgtgcgtgctgtttgatatgctaaaaaaaaaaaagcaccacaggggagccccggtacccaaaaaaaaagaaaaaaaaaaaaaaaaagcggcc

SEQ ID NO: 226 - DNA, 7107 bp, Zea mays
  misc_feature (259)..(259): n is a, c, g, or t
  misc_feature (1258)..(1258): n is a, c, g, or t
  misc_feature (3900)..(3900): n is a, c, g, or t
  misc_feature (5356)..(5356): n is a, c, g, or t
gaatttgtttcacatgatacatttcttcagaaagttacacatatgcttcttgataatagatgtcatgaacacatagtaactattggaaaaatgaataataatttaattaaacacataatatatagtggccttgaactattaccacttctgtactacaatagtaaacttgaaagctcgcgacaaatacataagtagaaggtaggcaacaattaaaagctctcttgtttgttttaaccaaatatatcaggaaattaatatnatttaacaacaaatagtagaggctctatacaacttttcttatgtgatgaatttattatttgtttatgcatatgcgattattcatggaaattaaatatgccaaggacatgcaatctcaaaagtaaaaggcatccaaggatttccagtatgaagcgacatccaatgaaattatcattacatccctagttaattaaaaatatagatacaaagttagtatcatttgttgaaaactatgaaaataactaaaattcttttgaaaatatgtaaaaggaaaataaataaataatccttagactaagaatttgatatatgaattgttaccttgaataatcaccgttttcatagcatggtgcaaacctaaaagctggcaccaaccatagaagtataatacaagtaaaaattaaaagctctcttatttgtagcaatcaaatatagtagaaactaatttcattttagaaccacttttaaaatttattatagatagaagaatccaaggaaaatatgtgtctattccccacttctaatcactaggcaaaacttagagcaagcgttaatgataacgatctaacaaatctaagcactactttccacaccacatacctaatcactaagcgatttcttaagaacttggatgtctagagctatcggaatggagtctcaactctctagcaatgtttcttagctccgaaatacatcaaatgactggttagggtgctatttttaaacccccaagtcatgaactagccattgaaaaaccatcttagccattcacatgcagtcgagatgggtcatggcctatcgatggaccataccatgtccgacgtctttggattgcacttgcattccgtgtcatactgctaaattctagtcattacggcctaatggctagtttctcgatggtctgatgccctttagtctgagttcgtctagctaagcttcacggtccaacagcctttgtcatactataatctagggcccaatgcatacacctagtcagttngttagtgaatgtttttgtttgacatgatgttgtttttgccgatggtctgacgatcgttggatgtcctattctcaatcagttcattataacgccttcacaatatagtctgatgcctttgtgaggagaacaataccagcgctggtctggcgcttgaaattagggtctgatgctagagtccgtccccctctggtgctactttctgttttttttgtctttacgatcttggtgtccaacttgattttatcttgtgtcttgaatttttgcctagtagtgttgtagatcttcaagaacccttctaacgtgtttcttaccatttcatcatcttgatcaacacttttccttcgtccaattccttgttgcattatttgaattataaataaaaacactagcaaataatattagtccaaataattatattaatcattaaacaccaacacttaactatcaaatatgttccatctatttttattatatatgcaatgtatataatatgtattattgataaagaaggtcatctttgcttgtatactccacatataaatatatttattattcaataaccaacgctcatgtcccaactgtaccttatattggtaacttcagttgaaacttgctagagagactttgttcagatagtaaatttgacgagctaattacctctaatattttatcttgacaatagacagtacaagtgcatgttagcaagaggaaaaatagataatttgcaaaacaaagataaatatttttttggcttgaataatcaccatttctttatgcaacggctagattgaaaattgccaccaaccacacaagtagatggtacgtgacagttaggagttttttgttcgtagtaatcaaatgcagtagaaatcaatagcatccaaaaaaacaactagaaaaaattaaaagaggggagaagaagccaaggatgtactggttccagttcaacctccctgagctgtgatgggaatcgcattccctctataattcctataaataggggccctcccgctcccatcacaatcacccatcactcgctctattcccattccaagtccccgctcttggattcccgacgacgagctcggagcttcttcttccctgctcggtgctcgtcgcaacagctgccgccatgtctgccgcgaaccagctcgccgctctggtcagcaacatgtacgccacggtaagggtctccctccgctgctcgactgccggattcttgtatttcggcgccatgatgcggaattcgggttgtggctgacgggattgctctctgctttggtgctagggtttgcttgacgatcagttccagcagctccagctgctccaggaccccagcgcccctgacttcgtctccgaggtcgtcacgctcttctgtcaggacggcgagcggatcatcgaagagctggccaaactgctgtgcgtctggttcctcactcgtcgttccgtttctgtgatcgggtggttgcgttatggggcgatgaattgaatctgattcctacaattttctgtttctatgcctgtgcagggagaagcccaacgtggattttgacagggttgacgcctttgtgcatcagctcaagggaagcagtgcaaagtgattaccttgcccatacctttttcttgaattgaatgtgtaatgctagtaggaatgtacatgttttgtttccatttcagcgctggaatggggtatgcaatgccattaaaatgaggaggggggatttatatttgtggaatgattgatctagcttgcacaattaattctgtgtgctgatcggaccgaacctgttaaatatcagtttttcacattctgtttgggaactgttgccattagttcagatgttgtgttctgtgatgtggatctgacacatgttaaaaaagaaaaactttaagttgccctgttttaagttgtttttcgaatccatttagggaaggggttgccatatattttgttgttatagtgtcgcatgatgtcaacctgacagacatgctccattcagcacactaatcaaatgactagaagagcatcgccccgtattgttccattttgagttgtgtttcagatccgttttgtgagggtttgtcgctgttaagacataaaatgtggaaaacatgctccccaccacactaatcgaataacacaagtggcactactgaaccctccccattttcagtgctttagtttcatgttgtactaactatggaatccatggccaagacacagcagtagttgcttgtctgcaatcatcgtggtttaggaattaaggcaggggaaatgggggatgatgccttgccttgcctatctcaaaatgattttgttttcatgttatgttgcctgaatcataaatgaatcattttatgcattatatagtttttccttatcatggatccagatctgtttaggatttgtggatgtgaagtacctatgctattgcatttcgaataattgtgtcatgaaaacaaataaaggaaagaatattgaaggcttatcaagggtctcaaatgaaaatattatggatctatctctgtttgtagaattcaaaagtttcagtattagatgggggcttcctagagttcttaacttttactaggcttgtacttggctggcttgttaactcagatatgtatgatcaatttatttnatatgtatttgattagtatgcagtttgatgacatctaaactttggtatcttatctttcttattttattgaattatttttgtggctccttgatttgtatatttgtgcatttcagtattggtgctcagaaggttaagaacacttgcattcagttccgcgaattctgtcagcagaagagcagagatgggttagtacctagttttttatatgttcatgtactgctgttcttttgtcattgtcttattgatatttaggagctcccaaagttattactgtgaaacaaaatttggttgctataagttttttttttgtcatagttatcagctgtgtgttccattcatgagatgccaatgaatattgtctgcacaaatcgctgacctatatccttgccaggtgcctcaaggtactggagacaatgaggattaacttctatgagctgcgtggcaagtttcagaccatgcttcaggtattaccttttgtgattaagttcttctgagagtacctttttctgtccattgagctagactagcctttttttagagaaaaatcttctattctgaatcttgcttgttatacctagtggtctagtggataggatgtatatcatgaggtaacaatgaagaacgtaaaattatgttgatgcagtgagtgcaattagtttcttttagcacatgtaagatagtagatttgaagaagtacatctctagctatcgtaagagaaattaggactccgagaaatccttgtggggaaacatgtctgacagattatttttcatatctacatgttcttatatcaagattctgtgtagaatgtgtagtcctttgttactcctttctatggtcattatatctttatgttgtgatggccggagacaatgaggattaacttctatgagctgcgtggcaagtttcagaccatgcttcagctggagcgtcaggtcaatggctttccccccaacaagtaaaccagatggtggagtggaccttcatgttaggatgatgcttgcacctttcaagtttcagaacattctgaatgagctcctcaattggtttctgggaagtcttgtaatagcttagcagcaagattagcgttgacaccaccgtagcagtagtcattgtcgtcaagtagttgtcctaaatgtctgtgctgggttatggatctcctgcaagcagttgcaggcttgcagctgttctgtttactctagtagtttattttggagtagtcgctctcaataaatctgtcctaggagtctattggtggattattagtcagtcagtttctgggattcctggtggtgaagcaaaacaatgttatggctatcggttaataataatagtttgctgtgtttgcccacatgtgcgtgctgtgctatgtgaaagtgagcctgtcgttggatcatggatgtattttgcagatttttcggtttggtagcgacgtcgggggatggcagccacagntaccaatgagacctgttggtaagtggcctgccgctagcttggaagctaaaataccggagggaaatggagggactaaaattctttcttatttaattttgaataagaaaaggggttttaaccccttcaatcctctccagttaaactagccctaaatggggtctctacacttatagcctgagtggagcttatgtttagtcctttgttggccattatattgatatatgttcaatgttcgtacttcttatgcagcaggagggccagatccagggctttccccctgaccccgaagaagtaatcgagagtggtggaattgatgaagctgcatgtggggatgatgcatacaatacaccttcagactggcgaaattaagggaacatgctcaatgagctcctcacttggctcctagctttctaccatctatgaagtctataatagcttagcagcaagatttgttgtgaacatgctcaatgagctcctcatttggctttttagccttcttctaccttgtaggaagtctgcaatagctgagcaacaagattcgctgttgacactttcgcgtcagccgttgtcctaaggcctagtttggaagcaaggataccggaggggattagagggactaaattccccttctattcaattttaaataagaagaagaatttagctccttcaatccacttcggtattcttcctcccaaactagtcctaagtgtatgtgggggccggtggagaagcaaagaatgttatggtaagagtctgccgtgcttgctctgtgctgcatatgaaagttagcctgctgctgctgctgttcataggtgtattattgcagcgtctcatttcaccgatttcaggttggcggcaggtgaggtggggacggagggaggatggctgtaggtgatgacctgcccaatctccaggtgacttgtgcctgaatctgcagtgctaagcatcccaccatacaggaggtatgcattcagcgtattgatgaattcgtgtgaggatttcttgaaaaaatccagataggcaggcttatcagtggcaagcaggatcctaagtctttacatctgcagtgtcttcggcaataaatcaccgtcctggagatgccagtgaatcaccttccgtcacttggcattgcattgctggctgcactacatgacattggcactgcactacctagtctgcctgtctgctgttagaaaatgagccaatgcatggcctaagattgggggtggggggagctgctagaaaagttgaaccttgttaaacctggagtaccaaccttgttaattggtctatataatccatcacaataacctggagtgccaacctaaggtgtacccactactccctctgtccacatgagtttgtttttctaggtttattgtaagtcaatcgctatcaattttgaccggttataacagatgtttcataagattttacaacataaaagtaaaattactagatttatcatgacttgaactatcataatatgtaattcttttttattttaaaataatttaatcttataaatattgttggtcaaagtttaaatagtttgacttaggattctagacaaactcatgtggacggagggagtactatctactttctgatcttatggttaatataaccatatataagtccatttcttagatgatggaaatacctggcatgaccagggcggagaagcatattttcctagacgaaaaaccgaaaaggtaaagacgaaaaagaatgaagaagcaatgtgtcag

SEQ ID NO: 227 - DNA, 1096 bp, Zea mays
aatagatccaaaaaacactagaaaaaagtcaaagaggggagaagaagccaaggatgtactggttccagttcaacctccctgagctgtgatgggaatcgcattccctctataattcctataaataggggccctcccgctcccatcacaatcacccatcactcgctctattcccattccaagtccccgctcttggattcccgacgacgagctcggagcttcttcttccctgctcggtgctcgtcgcaacagctgccgccatgtctgccgcgaaccagctcgccgctctggtcagcaacatgtacgccacgggtttgcttgacgatcagttccagcagctccagctgctccaggaccccagcgcccctgacttcgtctccgaggtcgtcacgctcttctgtcaggacggcgagcggatcatcgaagagctggccaaactgctggagaagcccaacgtggattttgacagggttgacgcctttgtgcatcagctcaagggaagcagtgcaaatattggtgctcagaaggttaagaacacttgcattcagttccgcgaattctgtcagcagaagagcagagatgggtgcctcaaggtactggagacaatgaggattaacttctatgagctgcgtggcaagtttcagaccatgcttcagctggagcgtcaggtcaatggctttccccccaacaagtaaaccagatggtggagtggaccttcatgttaggatgatgcttgcacctttcaagtttcagaacattctgaatgagctcctcaattggtttctgggaagtcttgtaatagcttagcagcaagattagcgttgacaccaccgtagcagtagtcattgtcgtcaagtagttgtcctaaatgtctgtgctgggttatggatctcctgcaagcagttgcaggcttgcagctgttctgtttactctagtagtttattttggagtagtcgctctcaataaatctgtcctaggagtctattggtggattattagtcagtcagtttctgggattcctggtggtgaagcaaaacaatgttatggctatcggttaataataatagtttgctgtgtttgaccaaaaaaaaaaaaaaaa

SEQ ID NO: 228 - DNA, 1945 bp, Zea mays
cgggcatccgcctaatcccacccgctatatatcggatcgacggtctccccgcatgggcgcagcgagactccgttgcgccgccgccatcgccaccgccacagctgtccccgccgccgcggcgctcccgattcgccgccacccggcctttttccgcgtccccgccgccgttggcctccggttctcgtcgtgccggatcccggtgccgaggagagcggccgcggccatgtcgtcgtcagcggcggcgcaggggacggagcacgaggctgacgcgtggtacgcggtaccgggcctcagcctccgcgaccaccggttcgccgtcccgcttgaccactccagtcccgagcgcggggacaccatcaccgtcttcgcgcgcgaggtcgtcgccgctgggaaagaatacatatctctgccttatttattgtacctacaaggagggcctggatttgagagtccccgtcccacggaagcaggtgggtggttaaagaaagcttgtgaagaccaccgcgttgtcctgctagatcagcggggaacaggattatccacaccgttgactccatcatctctttcgcaaattaaatctcctgcaaatcaggtggagtacctgaagcatttcagggcagataatatagttaaggatgcagaatttattcgtgtacgtcttgtaccagatgctaagccttggacagtcctaggacagagttatggtggattttgtgccgttacatatttgagttttgctccagaaggcctgaaatctgttcttttgactggagggctcccaccactaggagaaccttgcactgcagatacggtgtacagagcttgctttaaacaggtccagcggcaaaacgagaagtactataagaggtacccccaagatatacaggtcgttcatgaggttataagacacttaagtgaatctgaagggggaggggttcttcttccatctggtggccggttaacccctaagatgctgcagtgtcttggattatcaggtctaggttttggtggtggatttgaaaggctgcattatctgcttgagagggtgtgggatcctgtacttgtcgctggagctaaaaagaggataagctattacttcttaaaagagttcgaaatgtggctagattttgatcaaaatcctctttatgccctcttgcacgagtctatctactgtgagggctcttcatcaaaatggtctgctgaaaagattcatggcgaatatgggagtttgtttgaccctattaaagctacagaagaaggccgagctgtgtactttactggagagatggtgttcccttgcatgttcgatgacatccctgctctacgagacctaaaggaggctgcatgtttgttagctgagaaggaagactggcctccgctgtatgatgtcagcgtgttgaacaacaataaggttccggtagcggctgcggtgtactacgaggacatgttcgttaacttcaacatcgccaaggagaccgcctcccagattgctgggatccggctctgggtgaccaacgagtacatgcactcgggcatccgcgacggcggctcgcacgtctttgagtatctcatggctcttctgaacggcaagaagcctttgttttagctgtttcagaagccctgctatctaggttcgagtgtcagttgagctgaacctactatgattgaaacgagcaaataatgaggtccgtttggtttcatgaacaaacgaataatgtttaccttgtagaaatttcacggataatgtataacgttttgaaatttggtccgcagctacatcatagaaatggaattggtctgctcgcaagacacgttccgagcagtacttaaaaaaaaaaaaaaaacttcgtagacatttgtgtccaaagtccaaacagatccagaagccagaggtgccattagtaccatttgttcaaacaggccctgatcctttttttttaaaatt

SEQ ID NO: 229 - DNA, 2211 bp, Zea mays
attggtttgtatcccgtatccgtccttcgctcctagtgaatgtggtgcacgacggtggaaactgagtcacgtaatccctactgttgtttctccgattctccttacgacccgccggcgttgggcaaaagcggccggtgctggtcctctcctcttgcagaaggcaaccggcggcgatccccatctacagcaaaaaaacgaccggcggggagcctcttccccggaaaataatttgacgagtgtatagaaaatgtcaaggttggagctagtgttcaaaagaccacatatacaatgaagagagacatgctcaccgctcacggagagaaggtcattcttcgtgcccttgaaattgagaaatcccggctgccacactcaaagggtatttgagtacctgtggatcttctgtatccataaaggatcagatcccaaaacccattggtcaaactactgaatgcagtaaacagggcatatcttatatctgagattatagatccaagatgcagatcagcggctttgtcacccctattggtcctttatctgaagaaaatcacacgatcgacaagaatttgttgccgctggagtgtgaagggacaatggaatgccacacacgagacaacgatgctgttgggttggatgcaagagcggaaggtgttgtctgtgagctcacagaccttcagaataacatacaagtttatgatatcgagttgactgttctaggaaactacacaggtcacggcttgccccttgatttccttgagagtaaaacgactggtggacccatcaagggctaccctgttgttgtggatgttttagaggattgttcttcagtgagtattcatgatcacctcccagtggctaggagagttgggaagaagaggcagagacgcagacatgatggaaggtggacgaagaggaccccgctacgttttccggctgcgtccacggctgtgcgtgccatttccaccaccgtgcagacaaaaaagaactcaaacaaggacccggtactcgaggaatgctccctgctattggctctagctgcgaaagcctccctgctgcatacatgaagacccctaggtgacgcagttgactccagcggcatagaagtgtatcatgtttcatgtgagaacgactgctgatttctttctggttcgtgtggctcacctttgccccttacacctgacgcgaggtcgaccaggagcagcaaggactgcaatgctgcacttctttgtaatttatgttctgcctcccctctgtgtgctcctgtgcgcttggtttagtgcagtcgtgaggataagttggggctagttatggttggaagaacatgaaagatcgaattttatttaaaacccagctgttttgcaggatatacagctgttaatggctagtttggtaactctattttttcaagatttttcttggaaaaatagaaatctcttgaaaaaaatgaggttgctaaattagccctaagatcttttctgttggaaattagggttgtacagtgttgttgactttgttaaaaacccagccttagagccgacttaagagattacacatatgatatgttattcagtgcccttttggttcatgcctcaattttaaaatctcattctacaatcccattagccaaatagtttcttatttttactagattttgtgccagaatcataccaagctgacaatatagttttgtcgacaggccccaaatttattgtgaagataaaataatgttctcatacaatacgacttcatatgacccatgaaacatcaatagccacttggccatgatcactggatcattttcgttacactaccaaaaaaaaattagagcattcacatgggattgcccctagcattttggacattttaaaaaaataggtttaagcaaagaccaccattatgaaaaccaactgaaattagaacaagaatgcatcagttaagcaatcaactaatggtgtataagtgtatcaactaacatggacacctaaaaagacattactgaaaaaatggaggttgcaaagttaaggaaggtattaagagtgcccagggaactagattccagataacctctccatgtacgatgcaagcttgcaggtgcttgtcactacagctgacggcggcctcctttagatgttcatactgctgcatcgactttataaatagattcgaatagccaagagattctccagttcgtgaaaggcactgcgctgcttcttg

SEQ ID NO: 230 - DNA, 4845 bp, Zea mays
tcccaggatgggcctgcttctgtgaaagtttcatttgtaccctacactctcaccaaccctcgtaccttgtagtccattcgtcatgtcttgctctatttgtcgtacaagggtcgtgggctctaatgttgtcccagattaaaagaagcatagtgtttgaccggagaaaagggcacgatcctaccattgtcatgttgtgccgaacggagagatagtggggatagatatggggtgataacatgattaccccgcacatgcttgatccggccccgtgagattttatctgattcggtcaaccctcttcttccgtcctcgtctcgttcgaccctcgagatcggcccgaggttcgcctctctgtgcagagcagcaaactaagttgctagcaatagtgccatgcttcggggcctctatgtgctgcaaaatacattatatgtccaatgaagaaaaaaaacattccgcgacaaagaccgtgtgacagagaagtggagatgaagattagatccttttgggcagtagtctcactccattattttttatttgtcatggtttacttaaaaaaataaataaactagcggacgataaatattcgaaatcggagctttgatagcgagtttgtaaaccggacaatgacgttttttctataggcggatttttagagaagatactaaaaacatttttaaactagcacgagaagagtagtaaggctccttgtacgggcgcaagcgcaacggcgcatgtgtgtctgccatgaaagaatagccaaatcgaccaacatcaggaaacaaaggagctactctcgattcgcccctggagacgctatttggcgatccccggtcttgggcgctggcatgtatcgatcatcggatccacaggcggttaccgaagagcatctcctctgtgatggaccatgtacggacgcgagcgtttccgtgtcccctttccgtcgtaaaagataagtacagtagactggaaggatgcttttatccggctgtcgtttgcctccggaacgatcctggagacgtggacgaccgtggcgctgtctttcgcccgggcaaggaccgacaaggagatgggtacattccaacgagagatagagagagaaaacggagaagaagctaccggtcgggatcaaacaccagggcaaaaaaaaaaaaaaaacgtgaaacagcttctgctttgttgaataatttcgacttgtgtcccaacaggcaacaagtcctcctgaatcggtgaaaggctagtagtttcttgtaacataactatccggatgtgtcggcagcggtgactgatgagctgcctgtgagagagtaggcgacaggcaggcatgctgtagctagcgtcgaacgcgagcggcctaaatggtaggcgcgtggcgcgtcgcacggtgcagcctgcaaggcacactggcagtcaaaaggttgcagcgcggcgcggcgcggatgcgtgcgtacgtgtgcaggccgcagctgctggcgaagaggcgacgaccgtccacaagtcagcgatcagactgctgcacgcgtttatgtatcggcttcagcgcttccaagtctcgtaccctcctccatttttttttgggtaggattataaactccagtacctggattatagattcttggcataagtatagccatgtgctttatttgtttcttgttttcttttttctaaagaaaaaaaaacaagaacaaacggggtggtgtgcgcctgttgggttgacaggaaagctgatttacgccggtgacagactggcacacagcgtcgctgcggacctccggtgagtgtgactgagttggccttggcccgcgccgggcagacaggcgcatcgtgggccggtggcaacaacatccgggatcgagagggccgcagcgaggcagtagttccgtggaggggaggcgggcccgtgagaaagctcctacgctaatggcgtcggcggtgcgtgcgccgtggttggtggtggtggtggcgtcccggtcccggtcccggatggtggccgctgccgcgcgcgtttacgtcgtggcctgctgcatgctgccggccagccccgaaacgaaacgtgcaggatctgatctgatctgatctgatccgccactatctcctctcctctgcggaccatcgtctccgccctccggcgaccgcccgtcggcctcatttgcgcgaaaataacccgccaccccggcacaaaccgtacactgcttgtcctactgatgatggctttgactttgattgcttccatccaacgagacaacattgccgcattggtcagtttagatgtccggacgtcctttgaggtttttgagccgtgaacgacagcggggccgttttaatctggcagatgtgtaaacgggctgttccgcagggcccaactaggtctaggccaggcagccttcgtttctgaacatcagcctagacacctacggattgatttccaggccaggctggacactggactgatctgcggagcacgacacataaacaaacatggcgaaccgagtgtcgccgttcgcgtcggaaagaagggagggagagggtagcatcgcagcaggggaggaccggaggagggagctgaggcatggcatgcgagaacgtcacaggctcgtcggaggatggcccttctttctttctgtgccataaattgtttataaaaaaactggtgcgtcgtgttcattggagtactactagttcgttcggacatcatatctgtttcctgcctagcctaaccaaaagtccaaaacacagctcgcgcctagcgtgacctgcacacaacttacgcagattccagtttttttttttgttttccgagtccgagaggggaaaaaaagtaaagagaaaaaacataagaagccgcagacagaaaaaatcaactctcgcgcggccatttctcatccatcgcgctgcgcatttgcaactcccagtcccacctccggcgcggctgccagccagtagtcagtaggcttgatcatgtcgtcgcggaagcatcacgagctgccggagggaggagcaggaggcagcggcgccggccgcacggcggtgtgggacaccgggagctccctgtacgactcgtacgagctggccgccgtgcgccggctcctcgacaagcgcctcctcgccctccgcgacgacgctgaagagacgaggggcaaggagggcaggcaattggtggtcgtgccggtcgtcagcagcaggaggggggtccaccacaggaggaaggccacgctgagggcgctcttcagggcggtggtggccacctgggcggcccggccgaggcaggcgccgccgctcgcctgtgcctgcgctgctggcatggtccgtgatgaccaccagggtggttccgcggtcgagccggaggatctgccgtcccacggtcaactttgatgatcatccatccctgtgtttaggccatctgttcttgcattgcattggcgcaagttgttttttttttcttttgtgtttatcgattgctgtgtttttttacgctgtcatgttcatgcgatggttggtcattgagcaaccaaattctgcgtgaagagtaactgagcccaccggatctgtatatgtgaatctgcgtgaagcatacgaaagcttttggcggtgaatgatctctctggaccttagtaaccaggttcccggatcgatgggatcgaggaacgggaacgcggtacgctactaaaactaggatttaacactactggatcgagattgttcccacgttcccggaacgaaacgaggaacgtggccaagttccccgttcctggttactaggcgctggacactattttttttttctgtttgctcgagaacgcgtcacatgtggtgtttctgaattttcttcagcgacgacaccgctgctaaatgcaatgctaggaatgcagcgacattaattacataagagctactgaaaatatatgatgcgtatgtcgtgatgaaagcaaacggactggctcagtggctcataagagtccatacgcagtgctgaagacaagtagctctgggcagtatctgcactgcagcaccttgccgttggactggcttacgatcacgaaccgcgcgcggcgtcttcaactggctgacggcgccgccgatcgaggctgaaggttcgccttccggaggacccggagctcgagcgcgccggggcggatttacgaccggggctgcctgggctgcagccccggtcgcggcccagtaacgtgtcacaggcaaggtggaggaagctgatatgcagttgtctgaggatgagaaggatacggctcgtgtgcaagacatgacggagaagatggctgcgtcggtgtccctggaggagcagaagactatcaagcgcatgcggaggcccaacgtgcgtgtgtgcggcccagagtggcaggtgtaacgctcctgcgtgagcgctgtgcggcccatggggcggtgtgtgagttcctgcgtgaactctggtgcgtgcgtggacacgggaaataaatatcccagccgaacaggagtctatatgcaagtttagaaccttcagaaatacaaatcctcctttgtccctgccctatctccttcttccttattgccccttctctatgtatctactctctcttacatttggtatcagatagccaccgatctctcgggactggcgtcaatctggatcaacctccgacccacggctacgacaccagatttcaacgccgacaaagcaggatggatcagtcttccaaactgctgctggatgaaattgagaagaagttcacggctctggatctcaagtgggaacagcgcttcgtcgacttcaaccgtaccaaggaggaacgcctggtcgcccttaagcaatcgagcgcggagctaggcaagtggcgcccccaagattgaggcaac

SEQ ID NO: 231 - DNA, 5169 bp, Zea mays
ggtgggacttagatgtttgtgtttctgatatgttttatttttagaacagcttgttgtttgtgtgtgtgacctgaatcaggtcagtttctgtgatgtatctcttctatgtttagcctctagtgcttatctagatgtggataaaacagttgtatttctgttatgaaagtaatataaatggagtgatctccattcggggggaaaacagccatcagtccgtgagaatttgagaattcccaattccagttgcagttccagcacgatctcacccgcctgctgtcgagtagtatatacgtacaatacatgtggacgacgtccatggttgcctcccttccccctcctcctcttcctcccagctgagctgcccttcttctttctccagcaagcaagcagcagcagcagcccaattgcattgcattgcagtgatggtgatgtgatttctgcggcgcgagacaagcacacccaccctcccagctcaacttacggtgacgccgtgacggtgaggttaggagctgggtgactgacgggggaggcccaccggacgtacgtgatcggcagccaagccaaggcgatgcctgcagccgcggctccagctccacacaccaggaccaggaccaggtccagcggcagccccagcgcagccatcggccccccgcttccttactggggcggcgccgctgttggcgcagaggagcagaggtggcgcatcggcatggactccgccgccgctgccctcctcgactccgcctccgcgtccgcctcttccgccaacgccgcaggcaaggagatgcccaccgcccgccacatcgcccaccgcaccgcccacaacatgtcctcctcctcgctccgcaagaagtccgacctcgcgctcctccgcaaggtcccctgcgccccgctccgacgcctcctcgacaacctccaggaggttttgctcgccaccaagctcgccctcctcttccccgccgttctactcgcgatcgccgcgcgaatcttccacttcggccaggcaactcctctccctcctcctcctcctactgtcatcgcatcttttttcccctttaatttcttaattcgatcggaatttaggcatattcttcgattgttatatatcctctgcatcattcaacgcgcacatattttttttctctcttatacgtacatatagaaaaaaaaaaaaagagcattttgatcgcaccagcggccagctaggcccaggaggcaagattgcatcacttcatgtgccgcctcaattctcaccgctctgcatctcacctccctcttaccaatctatgcctgcctgcctacctgccactttccaaacacattggccttgtccctaacaacaataagcaaaccctgcagccatgcgtaacgttccgttgcataaactacccatcaaagtcaaagaaaatacaccaccacaacgcatgaacagggaagcatactcgcgctctgatgatcgctagaatttcagagtacatgcatgtgatgtgaccatgtgggctagatagcctgttgctgccaaattctgttcggcctgacagatggaatcatggaatgaaatagcaccacaactaaactaatcggccaagcacatgcatcagcaagcttcctctacatcctatctaacagcttgtcggccctgctctactgcccatctactcaccagaacctggtgtattattcttcatctgtcacccaatactctccttccttctaccccttcagttttgacttttgaccgcactatgaccaccaacagacgacacagttggcagcacgacaggttggcttcaggttttagttccatctcagcagattgatttaggctctcgctaggaacaacagtgggaagtgatttgtaattcctcccatgagatatcaatgatatgtaattcctgccacgagatatgaatttttgcagcaggacaagcttctacttcgtctttcactgtggtgtggtcctgctgggcatgtgaacatgcttgcacgcgtacaatgttcttctctgtccctatccaaacacatagtacacgacatgcaaacaaaagggcatattggattgccacaaacatgaccttgctagacactgaatgagtgtcgcttcttttgttccactgccacctcgccatcgttttcttaacttcaacaagatacaactatatatatgactccatctcagtattgcattccgaggaaactaaaactgatcgaaacatgtgatgctttgtacccagtgtatgatgatgcccatatctccccttcctgtttcttaacacatgctttctcttgaaactcgacaggaatgggtctttgtgcttagcttgatcggtctcgttcctcttgctgagcgacttagctttctgactgagtgagtttgttctgcttgttatcataccgtgttcttgatacctcctgttgattgatatctttctaatatatgtaatatatgttaatgttgcaggcaggttgcgttttacatagggcctactggtaaaagaaataaatactgtcagattcagtttttttatccaggccacaacctttacattgtttcctaacctgcccgggtaaattgcagtgggtggactgttgaatgcaacatttggaaacgtaacagaggtcatcattgcgatctttgcactctatcaaggcaaggtagtggtggtgaaatgctccctgctaggctcagtcttgtccaacctgttgcttgtccttggaacctcccttttctttggtggcctggctaaccttggaactgagcagctatacgacaaagtaaccaactcagctatttctcacctattgttaagctgtccttggaagcaccaaaagaaattttgtcttttactaaaatgagtatacggttttattgtgtgcagatgcaagtagatgtcagcacaggacttctgattcttggtgtgctatgccactctctgccactgatgctgagatatgctgtgagctccggggagcacgcagaatcctcttgggattcaggactggagctgtcccgagcatgcagcattgtcatgctccttgcctatgtagccctcctgttcttcctcctgaaaacccaccgccaactatttgaaccccaaccccaagaggtgtgtattgtaatttgttgctgatcagtaaccagcaggaactgctaacatagaaccagcttgctaatttgggtatgtggtccaaccaaatgattttgtaggttgaagatgatggtgatgattcggtctctcaagacgaggcagtactgggattttccagcgcaatgatttggctgggagtcatgaccctgatgacagcactcctatcagagttcgttgtgagcacaattgaggtatgcaccactgagtacaatgccatgtttatgttacccatttcagtcagcacatacactgtagtaagttgtagtacagctaatggttttatgacagaatcttgttaacacttaacaggcagcatcggaatcttgggagctatctgtcagtttcattagcgtcatcttgattccaatagttggtaatgcagcagagcatgctggtgcagtgatatttgcgtttaaaaacaatctggtagggaaatcgaggaggtcttacacactcatcacgatgttatggtagcagatactaacataacattgttggctgaaacaggacatcaccctcggagtatctttggggtccgctacgcagatttccatgtttgtggtgtgtattaacttaaatgtagagatagttccatgtgctttttttgcatcggtaaactttaatggtggaagcgaaatgtgctaggtgccattgagtgtccttgtagcatggatcatgggagtcccgatggatcttgatttcaacttgcttgagactggttgtttgtttcttgcaatattagtaacggccttcacgctccaggtattcttttgcaccctcctcgatccggcttgaacataatcgataacacgcatggatttttcattgacagaacatccatgaatcttgagtggttagttgtatgtgctgattttgtttattaagaaaagaaatgtccacttgtgcggttcggctgtgtccttgtttctaaggatgcggggccataggagttctgtcaatatcgtggttttagcggtaaagagtgactgttctatgcgtttttgcaggatggatcatcacattatctgaagggactgctgcttgtgttttgctacattgtcatctccttatgctttttcgttttgagacagcatggaagtatggatttctagtcttaacaaccttcattcaaaaaaaaacctatagatgcattattggttgacattttctaaataatctcaataacatgttactgatgctagatggaagcaacgatgatcagctgggtgtagcaagcaagccatggaggatttagggcgcctgagctggcagtagtttctcaacaagtagcgtggactttggtttgcacgattttgcatggaacactggaggggagacccgtgaagtttgactaaagtatgtagactgcgggaagatgctgttcagctgatgtgtgaatgtaagtacatacaaagactatagatgaaaactgatgttgcgtgagagactatttgtgtgtgtttttcttgttctttccaccaagcaatggctagaattcggttgagctgttgaaattgtctcctgtataaatcagtgacatgtcatactattttccaactggacttaacagagcctttatccttctaattggttacccgcatggtcataatctggatcatcatcgtgcgttaactttgtctaaatgtttgtttggttgcctgcaagtggagggcatggactgtatgaactaatgcaaaataagttattttgagactatttatgtgcatccacacgtaccccaaaacggtagtatcctggcgcgtaggctagcgtgaggtgagcctcgtcacgcgcgtgcttcgaaccaataagcggtatatgaatctgtctgtatttccagtgcctcaataacacatggaaagaaagaaaagaagtgaaacgaacgacaggtgtcttatataatctagcttatggattatataatctagatatctagagggtaaataatcaaggccttatttgtgatacatcagcttacaattctaagttttccttttgaaagttcatcagcaaagtcacg

SEQ ID NO: 232 - DNA, 1932 bp, Zea mays
  misc_feature (1903)..(1903): n is a, c, g, or t
  misc_feature (1931)..(1931): n is a, c, g, or t
gcacgagaccattacctagtacgtcccaaccggccgggctccacacaccaggaccaggaccaggtccagcggcagcccccagcgcagccatcggccccccgcttccttactggggcggcgccgctgttggcgcagaggagcagaggtggcgcatcggcatggactccgccgccgctgccctcctcgactccgcctccgcgtccgcctcttccgccaacgccgcaggcaaggagatgcccaccgcccgccacatcgcccaccgcaccgcccacaacatgtcctcctcctcgctccgcaagaagtccgacctcgcgctcctccgcaaggtcccctgcgccccgctccgacgcctcctcgacaacctccaggaggttttgctcgccaccaagctcgccctcctcttccccgccgttctactcgcgatcgccgcgcgaatcttccacttcggccaggaatgggtctttgtgcttagcttgatcggtctcgttcctcttgctgagcgacttagctttctgactgagcaggttgcgttttacatagggcctactgtgggtggactgttgaatgcaacatttggaaacgtaacagaggtcatcattgcgatctttgcactctatcaaggcaaggtagtggtggtgaaatgctccctgctaggctcagtcttgtccaacctgttgcttgtccttggaacctcccttttctttggtggcctggctaaccttggaactgagcagctatacgacaaaatgcaagtagatgtcagcacaggacttctgattcttggtgtgctatgccactctctgccactgatgctgagatatgctgtgagctccggggagcacgcagaatcctcttgggattcaggactggagctgtcccgagcatgcagcattgtcatgctccttgcctatgtagcctaccttttcttccaactgaaaacccaccgccaactatttgaaccccaaccccaagaggttgaagatggtgatgattcggtctctcaagacgaggcagtactgggattttccagtgcaatgatttggctgggagtcatgaccctgatgacagcactcctatcagagtttgttgtgagcacaattgaggcagcatcggaatcttgggagctatctgtcagtttcattagcgtcatcttgattccaatagttggtaatgcagcagagcatgctggtgcagtgatatttgcgtttaaaaacaatctggacatcaccctcggagtatctttggggtccgctacgcagatttccatgtttgtggtgccattgagtgtccttgtagcatggatcatgggagtcccgatggatcttgatttcaacttgcttgagactggttgtttgtttcttgcaatattagtaacggccttcacgctccaggatggatcatcacattatctgaagggactgctgcttgtgttttgctacattgtcatctccttatgctttttcgttttgagacagcatggaaatggaagcaacgatgatcagctgggtgtagcaagcaagccatggaggatttagggcgcctgagctggcagtagtttctcaacaagtagcgtggactttggtttgcacgattttgcatggaacactggaggggagacccgtgaagtttgactaaagtatgtagactgcgggaagatgctgttcagctgatgtgtgaatgtaagtacatacaaagactatagatgaaaactgatgttgcgtgagagactatttgtgtgtgtttttcttgttctttccaccaagcaatggctagaattcggttgagctgttgaaattgtctcctgtataaatcagtgacatgtcatactattttccaactggacttaacagagcctttatccttctaattggttaaccgcatggtcatgatctggatcaaaaanaaaaaaaaaaaaagaaaaaaaaaaaatna

SEQ ID NO: 233 - DNA, 2655 bp, Zea mays
gccggtatagagtccagagatactatatatttttggaagtgagtttcatatgaaaaatgcatatagcttgtttggtcatgaatttataatcctttatagctttttattgcagtagaacttattgaggaaccccatgagcaaaatcctaaagatgatgacattatgctaaccggaaacagtaagatactacaaagtattttattgatgactacattgtgtaccttattattagcaaaaagattttgaaaacgtctaacaatgagacgctaggaactcacatggttcttttggaccagatctgcatgatactgtcatatggtcttaagcattttcggttgctcatgtcgctgtgttctgttctgaataaagaaagctaagaaatgaataggttgtccactggcagacaatcactgtgacccggcaacaccgaaaataaaaatcaatacttaaatctgtggatggcatgtggtttcactttatagactggacgacactaacgtcccatggatctgctaaaaatatcttttcacagcttttcaacagaaaataaaataaatacagctaccctcactaaattactggaaacatcattctcttcctctgttcatatcattactagcagcagatgaacaatttactgaccgaacagtgaaaccaaataatatgtgcagtgaacaagttatagcataacccagcaatcgtaatgaccaattaactaaaccttttggcaattgtaccaagatgccagggccccagcccaccatcacctctgctttccctccccatgtttctgtcaccacccactgctttccgttccaccactatgatttgcattgatctttttttttctctccgtctctcagaaaactcaccgcatctccatctatacattgggccccctccggcccggccggtcccttttcccctcctccctcgctaaggttcctgtgcagcagccctgttgcatgccatcttcctagcttagctagcaagaatctcttgccctccttgcttcctgatcctgcgcccttggatcaccttccatgtgttcttggccttgttctctcgtgcatctgaccatcagttcttaagagtatatttccattggaagcaaattttagggtttcctgggagagactctgccaacctttttttttgccctggtgcatctgcatcaacttgttcgtttctctctcgtaaaaaaaaagctcactgtcgtaaacgttttcgccaattgatccatgatagactaacgtcgtgtagatgtcacaaatcctctccgaggtgagtcaccgctgcagatttatgatcaactcgacgctccggcgaggcacccatcttgttctctctttctccgttgtgttcctctattggttctatgtgttctcagtaagatcctaaccaccaatacaacatactagtatcatatccttggaaattataagcctctacatacaacaacttaattagtcagaggaaagctttcaagtctagatataaccccaagtatcttttgaggatgaccctgtccggtggggcctcgtctgggtctagtcatgggacccgtagcttggggtcagagggtgacatggtgcaccggatggagctcatgcgcaagagaaggatggagtcaaaccgggagtccgcgaagcgatcgaggcagcggaagcagcaacatctcgacgacctcaactcgcaggtggacaagttgaggacgacgaaccagcgcttaccgctggctctcttcctgcccgcctgtttgatctgaacatattttaatcgaaatggtgaatttgctgctgtgctctgtatatatataggccacttttgctttttatgtattgaagcttgcactcatgtgcaggtgaatttgacacaaagcaaaagtcagatgaaaaaaacgagacttgtgcttcaggatatgctgaagcaagcaaactccgataatgcgcggtgccccttaatttctcagggtccaccacccaataaaattgattcaaagtaggccattccaacctaagcaaagaacgatgcacgacgtgccaccgtcgaaatctttctcaaaaaaagggaaaaaagggaaaaaaattccacaccaattcattggctgtctcggcaaaatcaacacggttcatatatatatcaatcattttttttcttcttcttctacccgacgtcgcgtttatatcggaataattgaatcgtcttctgtataaaataaaacaaaacaaaacaaacaggtggacaagttgaggacgacgaaacagcaactcatggtagcactgaacatgaccagccagaactacgcggcagcagcagctcagaactcggtgctgcgcacccagatgatggagctgcagagcaggctctgcgcactgcgtgagatcatatgccatatgtacgcaacaacaacgaatgtccatccagcaactgtcatgggcggtgctgctacctaccatacttttggcgaaactgcgtggaactctggcagctgcagcatgcaaatggtcgaccacttgttgcaccagtgcttctaggctctagctacgtacaaggaggtagaggccaagacaaacaaaggcatgcatatatatgtattccatgttttgtaagtagtgtgtacgtcatttgatttaatgtataaaagggtttgtg

SEQ ID NO: 234 - DNA, 1858 bp, Zea mays
ggctggcggttgcctctcctcctctcccctgccctcgcaaacgcacgcaccacagcatcgtccttcgttccattcccatccataccccctcgatcggccgggatgctgggtgtggggatggccgcggcggtgctgctcggggccgtggcgttggtgctcgcggacgccgctgcgaggagagcgcactggtggtacagggaggcggctgaggcggtgctggtcggcgccgtggctttggtggtggtggacgccgcggcgcggagggcgcacgggtggtacagggaagcggcgctgggcgcggcgcggcgggcgcggctgccgccgggggagatggggtggcccttggtcggcggcatgtgggccttcctccgcgccttcaagtccggcaagcccgacgccttcatcgcctccttcgtccggcggttcggtcgcacgggcgtgtaccgaagcttcatgttcagcagcccgactgtgctggtgacgacggcggaggggtgcaagcaggtgctgatggacgacgacgcgttcgtgacggggtggcccaaggcgacggttgcgctggtcgggccgcggtcgttcgtggcgatgccgtacgacgagcaccggcgcatccgcaagctgactgccgcgcccatcaacggcttcgacgcgctgacggggtacctgcccttcatcgaccgcaccgtcacgtcgtcgctgcgcgcgtgggcggaccacggcggcagcgtcgagttcctgacggagctgcggcgcatgacgttcaagatcatcgtgcagatcttcctgggcggcgcggaccaggccaccacgcgcgcgctggagcgcagctacacggagctcaactacggcatgcgcgccatggccatcaacctgcccggcttcgcgtaccgcggggcgctgcgcgcgcgccgccgcctcgtggccgtgctgcagggcgtgctggacgagcgccgcgccgccagggccaagggggtctcgggcggaggagtggacatgatggaccggctgatcgaggcccaggacgagcgcgggcggcgcctggacgacgacgagatcatcgacgtgctcgtcatgtacctcaacgccggccacgagtcgtccggccacatcaccatgtgggccaccgtgttcctgcaggagaatccggacatgttcgcgagagcaaaggcggagcaggaggcgatcatgaggagtatcccgtcgtcgcagcaggggctgacgctcagggacttcaggaagatggagtacctgtcgcaggtgatcgacgagacgctgcggctcgtcaacatctccttcgtctccttccgtcaggccaccagagacgtcttcgtgaacggatacctcatccccaagggctggaaggttcagctctggtaccggagcgtgcacatggacccacaggtgtaccctgaccccaccaagttcgacccgtcgaggtgggagggccactcgccgagagccggcacgttcctggcgttcgggctgggcgccaggctctgccccggcaacgacctcgccaagctggagatttccgtcttcctccaccacttcctcctcggctacaagctggcgaggacgaaccctaggtgccgggtgaggtacctgccgcacccgaggccggtggacaactgcttggccaagatcaccagagtcggtagctagctgctagattgtgatggaagtacgaatgaaaaaaaagcccagcagaaactctagcggctgggccggctggaaattatgggccgggccattgtggttgcccccccctgtctgtgcaaaaataaaacaagcagaaaggaataaaaaaaaggaaaagtattacttcgaacgctgaaaaaaaaaaaaaaaaaaaaaaaaa

SEQ ID NO: 235 - DNA, 1371 bp, Zea mays
gcgcgcccgtggcccgtaaaagacaccaacccacttctcgaatcgaatccaggtccagggacgccgctacccgccgtccttcacccccgccatgccaacgctcggcatctcgccgctgctggacgcctacttccggcgccgcttcgccgcagcgggcctcgtggaggcctccgtcccgctggacggcggcgccaccacggtccactgctggcgcttcccgccggggtccgccgacggcgaggacgacgcccgtcccgtcctggtgctcctgcacggcttcgggcccccggcaacgtggcagtggaggcgccaggtgggccctctctcgcgccggttccgcctcgtcgtcccggacctgctcttcttcggcggctcgtccacgtcggcggcggcgcccggcgccgggcgggtgtccgaggcgcggcaggcggaggcggtggcgaagctcgtggcggccctggtggcgccgccggcgcgcgtgtcggtggccggcaccagctacggcgggttcgtggcgtaccacctggcgcggctgctgggccccggcgcggtggaccgggtggtgatcgccagctccgacctcctcaaggccgacgccgacgaccgcgccctgctccgccgcggcgccgccgagcgcgtcgaggacgtcatgctgccccgctcccccgagcggatgcggcgcctgatgcagctcgcctaccaccgcccgcgccgcttcacgccgggcttcgtgctccgggatctcgcccagtatctgtacagcgacaaagtagaagagaagaaggagctaatcaaggggataacgctgggcaacaaagacaagttccagcttacacctctcccccaggaagtccttgtgttgtggggagagcacgaccagatattcccagtcgagaaggcatttcaagtggcaaggaaacttggagcgaatgctaggctggaggtcctcaaggacaccggccacatgcctcaagaagaggatccaaagcggttcaacgaggcaatcctcaacttcttgcttccagctccaaagtcgtccttgtaacgcgatatatatcccatagttattcacttattattattcaaaaaaaagagttcatccgatttccatatgcacattctgcccgatcagtgcagtctttgtcgctttggtatcacctcaccttcaagattgatcatggaggaattggaaagtatgttatggaaactattgctatttatctgccaatatatatctgttggatcttttatgggcttgacctatttattgaataaactatagggtgtgtaatggtggagaataccaatagtaccacattggaagtccaagtatcttttgcattgacttatatggtgtgatttattccactt

SEQ ID NO: 236 - DNA, 1661 bp, Zea mays
cattgggtacctcccggccggccttgggaaaacgcaacagcgcactcgcccccctcgcttaaaagctgtagctcacacgagccgtgccactgcgagggaaggagggagagaaaaaggggagcccgatccaatcccaatcccctcccgccgcgtcacatcgccgccgtcctcgtgccccgttacctctaaaaccctagcggggagccgccgagccggggatgaagatccagtgcaacgcgtgcggggccgcggaggcgcgggtgctgtgctgcgcggacgaggccgcgctctgcgtcgcctgcgacgaggaggtgcacgccgccaacaagctcgccgggaagcaccagcgggtgccgctcctgacggacgccgccgccgctgccgccgcagcggcgccggccgtgcccaagtgcgacatctgtcaggaggcttctggatacttcttctgcctagaggaccgtgcactactttgtagagactgtgatgttgctatacacacagtgaattcctttgtttcagtacatcagagattcctgctaactggagttcaggtgggtcttgatcctgctgatccagttccacctattgctgaaaagcatgttaatgctgctggtggatcagtaaatcaaccagtgagacatcagccaaggagaagcccgacagttcaattttcagttgaagggagtgcttctgttcctaccaaaaatgtaacaaatggagattgttcaaggcagaattttgtcccaacagccaggggagaagtggttgattggactatgaataatagtacaattcggtcagtagaatctccgcctaagtacatttcagaggaaagccccacacttctgcaatctagccagaccacaacagtcttctccaaccaaattaatggcaacagtgatggggcctaccacttgtcattctcaggtggtaatgtgacagacagcctaccagattggcccgtggatgagttcttcagtaactcagaatatggtccaaactttggcttctccgagaatggttcttctaagggtgataacgctaagctggggggcgctggtggatctccacaatgccgtttggctgaaggctcagttgctgaggaactattagggcaggtgcctggattgatcaccgatgaatatatgagccgagtacctgagaattcatggacagtgcctgaggttccctctccaccaacagcctcggggctcaactggcacgggaatttgtgtttccctgcgtatgacagcaccatgttgttcctgaaattacctcccttcagaactccgaaagtcacttcaccgtaccttccagtttcaagcgccggagaagagagtactgagaggcgacaagaagatcactagacaccactgtccggtctaggctatcttgagaaaggcttcttggtgggctaaatgacgaaagaaaatatccaggactgggtggtcattcaaacatcaactgagctatccagtagccaggttttaagtgtgttgtaatgcttcaatgtgtttcattttccaaagacctgagcttcgcttgtgatttgttccgagctgtacggtgtcgattttgtgtatataatataatataacgaaataaagggtacccagtatgagtatgatcattccgaaataaaaaaaagacagagtatgagg

SEQ ID NO: 237 - DNA, 1363 bp, Zea mays
  misc_feature (1307)..(1308): n is a, c, g, or t
  misc_feature (1346)..(1346): n is a, c, g, or t
cccacgcccagaaagacacggccgagtcgtctttcccgacgcaaaagtcgacgacgcgtgcgccttgctcgctcgctcgccgtctgccgtcgttctaggtttagagccaggtcaccagcgctaggagggcgcgaagtcgagtagacggccgggcctctcccgttctccacggacggctagcgctactggaggcgacgcctggacggcgaccccgcacactcacagccacaccctccacctgtgtgactattcaagggcttaggccgagccgcccggccaatcgccgtccgccggaccgctgaggaatttttctttctcgtcaaaagttactgcattcattttacagtaatggctatggggttgattaatgctaatcctataatccatgagaaaaaagagaggcgtgccagacaggcaccagagaccacagatgaaaatgcagcagagcccatagatcagctggaaatatttgatcacattagagatataaaggatccagagcacccgtactcactggaacagctgaatgtggtgactgaagattcaattgaactcaatgatgaaagtaattatgtcagggttacattcaccccaacagtggagcactgcagtatggcaactattattggcctttgcatacgcgtgaaacttgtacggagtctccctcctcgttacaaggtggacataagggttgcccctggatcacatgcaactgaagctgctgtgaataagcaactgaacgacaaagaacgtgttgcggctgcattggagaacccaaacctactggacatggtcgaagagtgcttatcaccaacatttgattgaggcctgaatatcaatatatcggtgtgacatggtgttgatgttcaggagccacacatgctcattgccaatggagttcactcctgtctttcgagaaccaaaatgccttgggtgttaagtgacgtgttgcatgatttttttcctccgccccgttcagttattatatatgctactatggcgctaccctttttggacgtttttggtgcttgtgacctcactgatcaatgcgagatgtaatcagctcttgtgctgtagctttcagagtgctgtcgctgtcactgtcagtgccacgccattttgtggctgtgtacccccacacgatcaacttggtaggagaatcctagaatcctctagcacgggttgtttctgttaccataccggaagtgttttattctgagtttctagcatgtttttttatcgtataacaggcccttagtttgcataagaaaatcgttatttctattaaagtttggcttcttggctcnnctgatgaagccagcgctctcgctaaaaaacccgcccgntgtgttttaatgtaaaa

SEQ ID NO: 238 - DNA, 1342 bp, Zea mays
  misc_feature (1316)..(1317): n is a, c, g, or t
ggttttcgctgtctcgctgccgtcctaggtttggagccaggtcaccggcgctaggagggcgtgaaatcgagtcgacggtcggcactcggcactcacgcgttctccacctactgctggcgctcctgtgaggcgacgccggaccggccaccccgcatgcgaacagcgcacggaccggccaccggtgtgacccctccatccaaggcttcagctccagaccgagccgccccgccaatcgccgtccgccgaaccgcctaggtccttgctggagacaggcacgagcgtggcctaggaggtgaggaccgagaggtgtcaaacctacaagtgctggcacaacagcacacatggttgtctcctcctttcaaagaaacggaatttgttttcctcatctaaagttactgcattgtattccatagaaatggctatggggttgattaatgctaatcctataatccatgagaaaaaagaaagacgcatccgacaggcaccagagaccacagatgaaaatgcggcagagtccatagaccagctggaaatatttgatcacattagagatataaaggatccagagcacccatactcactggaacagctgaatgtggtgactgaagactcaattgaactcaatgatgaaagcaatcatgtcagggttattttcaccccaacagtggagcactgcagtatggcaactattattggcctttgcatacgggtgaaacttgtacggagtctccctccttattacaaggtggacataagggttgcccctggatcacacgcaactgaagctgctgtgaataagcaactgaatgacaaagaacgtgttgcggctgcattggaaaacccaaacctactggacatggttgaagagtgcttatcaccaacattcgattgaggtctcagttgttgcacatctgggagccatggtgtttcatgttcagaagccacacaagcttattgccataggaattcactcctgaatattatatttgagggccatggtgtttcatgtgcatgattttttttgtcctccgtccctttgagttaatacaattgttatctttttggacatttgttggtgcttgtgacctccctgggcaaagggacatgtaatcagatcttgtgtagtagctttcagagcgtttccagtgccacgccattttgtggctgtgtacccccagtcaactgaacttggtaggcgaatcctagaatcctcaagcacgagttgtttatgtctctataggcaggaaatgttttatcttctcagctcaaccgatcatgctaattatttggctgggcggccgcccgtttttcccganngaaaaaaaaaaaaaaaaaagcggcc

SEQ ID NO: 239 - DNA, 1183 bp, Zea mays
agaaagatagacacgtccgccgtctccgctccggttttcgctctctcgctgccgtcctaggtttggagccaggtcaccggcgctaggagggcgtgaaatcgagtcgacggtcggcactcggcactcacgcgttctccacctactgctggcgctcctgtgaggcgacgccggaccggccaccccgcatgcgaacagcgcacggaccggccaccggtgtgacccctccatccaaggcttcagctccagaccgagccgccccgccaatcgccgtccgccgaaccgcctaggaatttgttttcctcatctaaagttactgcattgtattccatagaaatggctatggggttgattaatgctaatcctataatccatgagaaaaaagaaagacgcatccgacaggcaccagagaccacagatgaaaatgcggcagagtccatagaccagctggaaatatttgatcacattagagatataaaggatccagagcacccatactcactggaacagcttaatgtggtgactgaagactcaattgaactcaatgatgaaagcaatcatgtcagggttattttcaccccaacagtggagcactgcagtatggcaactattattggcctttgcatacgtgtgaaacttgtacggagtctccctccttattacaaggtggacataagggttgcccctggatcacacgcaactgaagctgctgtgaataagcaactgaatgacaaagaacgtgttgcggctgcattggaaaacccaaacctactggacatggttgaagagtgcttatcaccaacattcgattgaggtctcagttattgcacatctgggagccatggtgtttcatgttcagaagccacacaagcttattgccataggaattcactcctgaatattatatttgagggccatggtgtttcatgcgcatgatttttttttgtcctccgtccctttgagttaatccaattgttatctttttggccatttgttggtgcttgtgacctccctgggcaaagggacatgtaatcagatcttgtgtagtagctttcagagcgtttccagtgccacgccattttgtggctgtgtacccccactcccctgaccttgggtgctgttcggttcaaaaaatgtaatcacaaatggtaatggtaagggttccgcctcgattactggcggtacc

SEQ ID NO: 240 - DNA, 3222 bp, Zea mays
attcaaacaacccctcggcacccgtctccggtctcccttccgtcattgcgcgtcccaccttccgtccccacaatttccgctcccctcacgagcatttcccccgcctacccgtcgccgacggccatggcccacctccagctcacggcgctcgccggcggcgccgacgacgagatggaggaggtcgcgctgctgggatcctacgacgaggaggccggggtggggccggaggcggagggggaccgggcggaggccggcatgcggcgggtgcaggtgcgcgtaaccggcatgacgtgctccgcgtgcacgggagccgtggaggccgcgctctccgcccgccgcggcgtgcgccgcgccgccgtgtcgctgctccagaaccgcgcccacgtcgttttcgaccccgcgctcgccaaggaagacgacattgtagaagcaatagaagatgctggcttcgaagcagaaattcttcctgactctactgtttctcagccaaaaccgcagaagactttgtcaggccaatttaggataggggggatgacttgtgctgcatgtgtgaactcggttgaggggatcttaaaaaaattgccaggtgtaaaaggtgcagttgttgcattagcgacctcattgggtgaagttgaatatgatccttctgccattagcaaagatgaaattgttcaggccatcgaggatgctggttttgacgctgcactgttgcaaagtagtgaccaagacaaggtcctattaaatgtccaggggttacatttcgaggaagatgtagatgtattgcatgatatcctgaagaaaatggaaggcttgcgtcagttcggtgtaaattttgcaaactcagaagttgacattgtatttgaccctgaagtagttggtttgagacagattgtagatactatcgagacggagagcaacaataggctgaaagctcatgtacagaatccatatatacgggctgcatcaaatgatgcgcaagaggcctctaagacgcttcatcttcttcgctttagtttattcctaagtattcctgtatttttcatccgcatggtatgccctcgcatacctctgattagttcattcctacttatgcactttgggccatttcgtataggagatctgctgaggtggattctggtgaccatggtacagtttattgttggcaaacgattctatgttgcagcgtatagggccctaagacatggctctacaaatatggatgtcttagttgttattggcactactgcttcatatgtctactctgtttgtgcacttctttatggggcattcactggatttcatcctccaatatattttgagacgagcgcaatgataattacatttgtgctatttgggaagtatcttgaagtgctcgcgaaaggaaagacatcagatgctatcaagaagcttgtagagcttgctcctgctacagctattctacttctgaaggacaaagagggaaaatattcaggagagaaggagattgatgcgtcgttagtacaacctggcgatgcgttaaaagtgcttcctggttcaaaggttcctgccgatggtatcgtcatttggggtacaagtcatgtcaatgagagtatggtaactggtgaatctgtaccaatctccaaggaagtatccagtctagtcattggaggcacaatgaacttgcatggtgttcttcatatacaagcgacgaaagtaggatctggaacagttttgagccagataatttctctcgtggaaaccgcccagatgtctaaggcccctattcagaagtttgctgattatgtagccagcatttttgttcctattgtcatcaccctgtccttcttgacattccttgcatggtttctatgtggatggttgggagcatatccaaactcatggtctgctgaaagtagcaattggctttgttttctccctcatgttctccatatctgttgtggtgattgcttgtccatgtgctcttggtctggcaacaccaactgctgttatggtagcaacgggagtcggggctagtcatggagtacttgtaaagggcggagatgccctggagagagctcagaatgtgaagaatggatctgggggactttctcacgttggtagcgtcagcagaggcaagcagtgagcatccactggcaaaagctatcttggattatgccttccatttccatttcttcggcaatcttccctcaggaaaagacagcatcaagagaagaaaagaagagatactttctcagtggcttctggaagtcgtggactttgctgccttgcctggcaaagggattcaatgctggatcaatgggaagaaaattttggtagggaatcgtgctttgataactgaaaatggggtaaacattcctgaagaagctgaacgtttcctgatagacatggagctgaatgcaaagactggtattctcgtagcgtatgatggtgacttcattggcttggttgggataaccgatcctttgaaaagggaggctgctgtggtcatacaaggtctaaaaaagatgggtgttcatccagttatggtcactggggataactggaggactgcacgagcagttgcaaaggaggttggcatagatgatgtcagagccgaggttatgccggccggaaaagccgatgtaatccactccctgcaaaaggatggcagtgttgtcgcaatggtcggagatggcatcaacgactcgcccgcccttgctgccgccgatgtcggcatggccatcggcgcaggcactgacatcgctatcgaggcggctgactatgtgctcgtccggaacaacctggaggatgtgatcacggctattgacctctcacggaagacgttcatccggatccggtggaactacttctttgccatggcctacaacgtgatcgccatccccgtagctgctggcgcgttgtttcccttcaccggggtccagatgccgccttggttagccggcgcgtgcatggcgttctcgtccgtcagcgtggtgtcgtcgtcgctgctgctgaggaggtataggaaacccaggctcaccaccgtgcttcagataacagtggaataagttcctttttttttggcaatctgttgtatctcactttatcggagagaaatagatacaaacgtgaatgctggtgtggtgcagtattgagggtcaaacacttgtacatatcgaacagtttgcaattgcaaccgagttatacatgcaaaaaaaaaaaaaaaaaagcttatcgataccg

SEQ ID NO: 241 - DNA, 1465 bp, Zea mays
cctgccgggactgagcagagtaactctcttccccctcgcctccttcatcagtcatcacacacgcctgcggcctgcctgcctgcctgcctgagtcctgacaccatactatacctccacctccccggccctgtcctactagccgtcagaggtttgccgcctcctcgctcctcgtcttcatcaccccctctctctctcttccttcgtcctcgacctgtggccacctgtggcgtcacgctttataagagcacgcggccggcaaccatctcccttgccacccacaagtagagaagaatcttttgttgctgacgcctgagacgctggcactgccgccgcgccgtctggagagaaagagcagagggacactgaagcagaggagccgaggggtagcgacgagagacgagcgagagcggccgacggagatggaagcaggaggagcaggagcggagggggtgatgagggtgctgctggtggacgactcccccgtcgaccgccgcgtggcgcagctgctcctcagcagcaactcctgcgccggctcattccacgtcatcgccgtcgacagcgccaagaaggcgatggagttcctcggcctcaaggacggcggcaaggagcaggccatcgacatggtgctcacggactactgcatgccagagatgaccggctacgacctgctcaaggccatcaaggcgctgaacccgctgaagccgatccctgtcatcgtcatgtcgtcagaagacgagccccagaggatcagccgatgcctgaacgccggcgccgaggacttcatcgtgaagcccctgcagagcaaggacgtgcagcgcctccggaactgctccacggccgcgagacccagcaacaagggcggcgccacgttgccgtgcgaggagaacgccgtggccaagtggagtaacaacaagctgccgccctccgccggcgccacgtcgccgtcgggacggcgggcgaacctcgccggagtcgccatgcgccaggtgctgcactcgtcgagcgtggagatctcgcagtacctgccgctcctgctcaagctcgtcgtgctggcgtacgccgcgctgtgcctgggcgagctcctgcacagatggtcgtcgggtggcagctgctcgctctccccgtggtgcgcctgatcaggaaggagcaagcagcgcaaaaagccagcaacggtgcaagagcccccctgggcaccgacgacaggagactgctgatgcaccaagcattatttcagaggctccaatagccctagtcttttaatttaggtagatgagattgtctgctctgagatcctaaccggggtttcgaccgatgatgagtccccccgtggcttttgttcgttgatttgaggggccggggccgtagacgtaggaaggagaggaacggaacgaaccccttgtatcctctgctctgtatagaatgaatgaatgaacgaatgaatcagaatgcaaaaaaaaaaaaaaaa

SEQ ID NO: 242 - DNA, 1094 bp, Zea mays
tctggttggcgagaaagagcagagggacaccgaaacagagaggagcagaggggagcgacgacaggtcagcggagatggaagcagcggcaggaggagtggaggcggagggggtgatgagggtgctggtggtggacgactcccccgtcgaccgccgggtggcgcagctgcttctcagcagcgactcctgcgccggctcattccacgtcatcgccgtcgacagcgcgaggaaggcgatggagttcctcggcctcaaggacggcggcgaggagcaggccgtcgacatggtgctcacggactactgcatgcccgagatgaccggctacgacctcctcaaggccatcaaggcactgaaccccctggagccgatcccggtcgtcgtcatgtcgtcagaagacgagccccagaggatcagccgatgcctgagcgccggcgccgaggacttcatcgtgaagcccctgcagagcaaggacgtgcagcgcctgcggaactgctccgccgccgcgaggcccagcaagggcgcgacgcagtgcgaggccgccgtcgtggccaagaggaatcataagccgcatcctgccgctgccggcgccggcgccgcgtcgccgtctggacggcgagcgagcctcgccggagtcgccatggtgctgcactcgtcgggcgtggagtacctgccgctcctgctcaagctcgtcgtgctggcgtacgcggcgctgtgcctgggcgagctcctgcacaggtgggcgtcgtcggacggccgctgctcgcttctccccgtggtgcgcctgagcagcggtgcgtgtcctgggcaccagcaggagactggtgatgcaaatgcagagtttttcagctgctgaaccaaaaaaaaaaacctccaacagccgtggaggtctagcttagcctttaatttaggcactgtagaagattgactgctttgggattgggtacgctcgcgtctgccgtctgcgtggcgtttgtttcttgatttgagggagacgtatgtatgtacgtacgatacgaggccacggggggtacgctcccctgtatcctctcctctgtatagaatccactgaatcagaatgcaacgcgtgacccgagcc

SEQ ID NO: 243 - DNA, 1158 bp, Zea mays
atacatactatcaggctagaccggtagagtatattaattctaaacagctcgtgtgatgtttcacccagtcatcgccgtcgacagcgcgaggaaggcgatggagttcctcggcctcaaggacggcggcgaggagcaggccgtcgacatggtgctcacggactactgcatgcccgagatgaccggctacgacctcctcaaggccatcaaggcactgaaccccctggagccgatcccggtcgtcgtcatgtcgtcagaagacgagccccagaggatcagccggtgagccagccggctctgttctttcctctttttgagcaccgtttcctttggtccctatcccgtcccctgtgaatgcatgctgaatcatcccgtgagatagaatagcagacggcgccaaaagccctggcccgtgtgtactgacggggtaacatttattcattcatccactcgacccgtgtgtactgacggcctcgttattctccggagcagatgcctgagcgccggcgccgaggacttcatcgtgaagcccctgcagagcaaggacgtgcagcgcctccggaactgctccgccgccgcgaggcccagcaagggcgccgcgccgtgcgaggccgccgtcgtggccaagaggaatcataagccgccgcatcctgccggcgccgcgtcgccgtctggacggcgagcgagcctcgccggagtcgccatggtgctgcactcgtcgggcgtggagtacctgccgctcctgctcaagctcgtcgtgctggcgtacgccgcgctgtgcctgggcgagctcctgcacaggtgggcgtcgtcggacggccgctgctcgctctccccgtggtgcgcctgagcagcggtgcgtgtcctgggcaccagcaggagactggtgatgcaaatgcagagtttttcagctgctgaaccaaaaaaaaaaacctccaacagccgtggaggtctagcttagcctttaatttaggcactgtagaagattgactgctttgggattgggtacgctcgcgtctgccgtctgcgtggcgtttgtttcttgatttgagggagacgtatgtatgtacgtacgatacgaggccacggggggtacgctcccctgtatcctctcctctgtatagaatccactgaatcagaatgcaacgcgtgacccgagcc

SEQ ID NO: 244 - DNA, 1698 bp, Zea mays
cggggctgagatttatcttgatcggctagagaagatcgagggcgacgcccggcggcggaagccatcacaccaaagatcatccatggctagttctctacttcagcagctgctgtctctctgctgctgctcctgctgccctctcctcttcgtctccgggagcatctatcaggaaaccatgctgtcagcgccaacaacttccaccccatctttctggtagctgggatgagctgcagcgacctggaggcacgtctcaccgaggagtaccggccgtcggtgccgcattgcggcgccatgaagggcaagcggtggttcggtctgtggaagaacagttcggagctgctgtctcgtgactacatgcagtgcttcgaggagcagatgagcctcgtctacgaccctgacatcaacgagtaccggaacctcgccggcgtcgagacacgagtgcccaacttcggctccacaagagccttcagctacaagaaccctctcaagtcagactggtgcctcggaaagctgagagccgcactggaagacatgggataccgagacggagacaccatgttcggagccccctacgacttccgctacgcgccgccgtcccccggccagacgtccgaggtgtactcccgctacttcaaggagctgatggagctggtcgaggccgcgagcgagaggacccggaagaaggccgtcatcctcggccacagcttcggcggcatggtcgcgctcgagttcgtccggaacactccgccggcgtggcggcgcgagcacatcgagcgcctcgtcctggtcgcgccgacgctccccggcgggttcctggagccggtgcgcaacttcgcgtccgggacggacatcctctacgtgccagcgacgacgccgctggccacgcgagccacgtggaggagcttcgagagcgccatcgtgaacttcccgtcgcccggccgtgttcgggcgcctgcaggcgccgctcgtggtcaccagggagcggaactactccgcgtccgcgcaagacatggagcgcttcctcgccgccgtcggctccggcgaggccgcggagcccttcaggagacgggccgtccccaagatgagcagcttcgcggcgccgatggtgcccatgacgtacatcagcggggtcggcaacaggacgccgctgcggctggtgttctggggcgacgacttcgacgcggccccggaggcggtggcgtacggggacggagatggcaagatcaattcgatcagcggcttggcgttcgagaaggagatgcgtcggcagccggagcagaagaagcagttcaaatccatcccggccgggaaggcccagcattctacgatcgtcacggatgattttgccctgcacagggtcattcaagaaatcgttgaggccaataatcagaagattccatcctaaattcttcatgtcatgcttgcattaccgagctgttggggccaatagtgggttgggaagtgatggttcagacatcggtttcgtgcttaaaacggccaataatcagaatttgttaacgtcaattgcttgcctcatgagcggccgccgataaggaaagaccagtcatcgaacttatcacactgtcacttcccaaacttagaaaatctagaaaaacaagtcatataacttgatcggtcgatacaaaatcgtccaaaaccaagtttgctcaaactagatgccaatatgatgtgccattc

SEQ ID NO: 245 - DNA, 2791 bp, Zea mays
tttgaggactcatcaaaccaaatcagccacgcatcaaactaaatcccgcctaaacacagtactccatgcgtgcctgagaaatccacggctacgttcccatgcacacattatctgaatttcggcacaatttcgtgaaccatgcgtgcccgagaaatcctacccctagctagaacagagtagtgcacaatttcaatctcaaaacaaacagaaccttagatagagaatataccctttccaaaggttgagagtaggaattaaaaaaaaatatgataaaagaaaactctagattgaactagaggaactatttaacttttatagatctcgaaaggcgtgcttgttcttgttctcgccgagaggagagatagattagagagagctgtaagccggtgcctgcagcatgtctgcaatgtgccccgcatcgcacgtcccaggggcgtcgggcttgggtgccacctccgacggacgccgacgcttttgcagctactcattgctactacacaggacagtactggggcgtataggaggatagggatgaactgcgtggcgtgatgaactgctcgtgctccagaagaagacgtgcctcgcgtgcccctggaatagccgtgaacagtgacgtttccaagtgcattccatctgcccaactcgcagcaagccgccgccaggtcgtcaagaagctgctggtcgtcggggtcccagaatgctccataattccaattgagggtgccaggtaattagagctgtaaattaactaagatctaagttgcaaaatagtgttttgtaagacgatatgcaagatctaaatacgaccatatgcataatctggtatatacagtttaatatggtgttacgcggtgcttaaggtttgtttcttttcttccatgtgaaatggagtgggtttagtgagattgaagtggccaatagtttattttcatcgccaattcgtatgtattttaagatggtatggattttgtccaaagcctcagcctgtctattatcgacagtgtccctttggccctgtctcgcgtctatatatgacaacccggcggctctaaaactaagcgatgagatttatcttgggatcggctagagaagatcgagtgagaagttgcgcgtgtgaagccatcacaccaattaaagatcgagatcatccatggctagttctctacttcagcagctgctgtctctgctgctgctcctgctgccctctcctcttcgtctccgggagcatctatcaggaaaccatgctgtcagcgccaacaacttccaccccatctttctggtagctggggtgagctgcagcgacctggaggcacgcctcaccgaggagtaccggccgtcggtgccgcactgcggcgccatgaaggggaaggggtggttcggtctgtggaagaacagttcggagctgctgtctcgtgactacgcgcagtgcttcgaggagcagatgagcctcgtctacgaccctgccatcaacgagtaccggaacctcgccggcgtcgagacgcgagtgcccaacttcggctccacaagagccttcagccacaagaaccccctcaagtcgtgagtcgtcgtcctcctcagagatcaatgtgtgtgtgtcggtgatctccatgtttgacaaactaactgcttgttctctttccgttgtccacagagactggtgcctcggaaagctgagagccgcactggaagacatgggataccgagacggagacaccatgttcggagccccctacgacttccgctacgcgccgccgtcccccggccagacgtccgaggtgtactcccgctacttcaaggagctgatggagctggtcgaggccgcgagcgagaggacccggaagaaggccgtcatcctcggccacagcttcggcggcatggtcgcgctcgagttcgtccggaacactccgccggcgtggcggcgcgagcacatcgagcgcctcgtcctggtcgcgccgacgctccccggcgggttcctggagccggtgcgcaacttcgcgtccgggacggacatcctctacgtgccagcgacgacgccgctggccacgcgagccatgtggaggagcttcgagagcgccatcgtgaacttcccgtcgccggccgtgttcgggcgcctgcaggcgccgctcgtggtcaccagggagcggaactactccgcgtccgcgcacgacatggagcgcttcctcgccgccgtcggctccggcgaggccgcggagcccttcaggagacgggccgtccccaagatgggcagcttcgcggcgccgatggtgcccatgacgtacatcagcggggtcggcaacaggacgccgctgcggctggtgttctggggcgacgacttcgacgcggccccggaggtggcggcgtacggggacggagatggcaagatcaatttgatcagcgtcttggcgtttgagaaggagatgcgtcggcagccggagcagaagaagcagttcaaatccatcaagatcaataaggcccagcattctacgatcgtcacggatgattttgccctgcacagggtcattcaagaaattgttgaggccaataatcagaagattccatcctaaattcttcatgtcatgtatgcattaccgagctgtgggggccaatagtgggttgggagttgggacatcggttccgtgcttaaaacggtcgtggtgtggtctcaattcaatcgaattagttatttgttaacgtcaattgcttgcctcatgaacttgctgtgataaggaaagaccacaattattctccgctaaaaaaaaaaaaaaagaaaaaaaaaaaaaaaaaagcggcc

SEQ ID NO: 246 - DNA, 1766 bp, Zea mays
aggccggccgggattatcgacagtgtccctttggccctgtctcgcgtctatatatgaattggctccctcgaggccggccggggatgagatttatcttgggatcggctagagaagatcgagtgagaagttgcgcgtgtgaagccatcacaccaattaaagatcgagatcatccatggctagttctctacttcagcagctgctgtctctgctgctgctcctgctgccctctcctcttcgtctccgggagcatctatcaggaaaccatgctgtcagcgccaacaacttccaccccatctttctggtagctggggtgagctgcagcgacctggaggcacgcctcaccgaggagtaccggccgtcggtgccgcactgcggcgccatgaaggggaaggggtggttcggtctgtggaagaacagttcggagctgctgtctcatgactacgcgcagtgcttcgaggagcagatgagcctcgtctacgaccctgccatcaacgagtaccggaacctcgccggcgtcgagacgcgagtgcccaacttcggctccacaagagccttcagccacaagaaccctctcaagtcagactggtgcctcggaaagctgagagccgcactggaagacatgggataccgagacggagacaccatgttcggagccccctacgacttccgctacgcgccgccgtcccccggccagacgtccgaggtgtactcccgctacttcaaggagctgatggagctggtcgaggccgcaagcgagaggacccggaagaaggccgtcatcctcggccacagcttcggcggcatggtcgcgctcgagttcgtccggaacactccgccggcgtggcggcgcgagcacatcgagcgcctcgtcctggtcgcgccgacgctccccggcgggttcctggagccggtgcgcaacttcgcgtccgggacggacatcctctacgtgccagcgacgacgccgctggccacgcgagccatgtggaggagcttcgagagcgccatcgtgaacttcccgtcgccggccgtgttcgggcgcctgcaggcgccgctcgtggtcaccagggagcggaactactccgcgtccgcgcacgacatggagcgcttcctcgccgccgtcggctccggcgaggccgcggagcccttcaggagacgggccgtccccaagatgggcagcttcgcggcgccgatggtgcccatgacgtacatcagcggggtcggcaacaggacgccgctgcggctggtgttctggggcgaagacttcgacgcggccccggaggtggcggcgtacggggacggagatggcaagatcaatttgatcagcgtcttggcgtttgagaaggagatgcgtcggcagccggagcagaagaagcagttcaaatccatcaagatcaataaggcccagcattctacgatcgtcacggatgattttgccctgcacagggtcattcaagaaattgttgaggccaataatcagaagattccatcctaaattattcatgtcatgtatgcattaccgagctgtgggggccaatagtgggttgggaagtgatggtttagacatcggtcgtggtgtggtcgcaattcaatcgattagttatttgttaacgtcaattgcttgcctcatgaacttgctgtgataaggaaagaccacaattattttccgcttgtcgtgtgcgttgtaccgtataatgttaataaaaacaagagtaaaatatagtagcagtcatcaaatttaaaaaaaaaaagaaaaaaaaaaaaaaaaa

SEQ ID NO: 247 - DNA, 1425 bp, Zea mays
  misc_feature (84)..(84): n is a, c, g, or t
cacaaaatttgcaaaatcattaaagcaggcttctgaagatgcaaagagaattgttgaagaagaaagtgctaatgctcatacagnaaatagaaactgctaagggtgctgtccaaagagttcagcaagcagttcaggagcatgagaagatgtcccaaaatactgggaagcaaaagcaagacatggaagaactaaagaaagaagttagggaagctcggaggatcaaaatgttgcatcagccaagcaaggcaatggatctggaaaatgaaatacgaattttacgtaacacatttgctgagaagtctaaggattgtgttagtcttttgaaagagttggaaacgcataaaaggttaaaagaaaatggtaccatcccttcattcgatctggagggtctccaatgcttaggatcaatgctacgtatagttggtctgagtggtactcacatggatctgtcaaatatttcaatccagtggttccgtatacatccaaaagaaagcaacaaagagattatttcaggtgccacaagaccagtatatgctctagagccacatgacgtaggacgctatttgcaagctgaaatcgacgtaggcggcgaaatcgcagtagcaaagactgctgggccagtagaccctgatgctgggttggttgattatgtggagacgctcgtaaggaaacctgaaactgaattcaatgttgttgtgcttcaatccaatggcgtcgatcagccaaaagagtcggttcatgtactaaatgtcgggaggctgcggatgaggcttactaaagggaagtcggtagtcgccaaggaattctattcctcatcgatgcagttatgtggtgtgagaggcggaggcgaagcagcctcgcaggcgatgttttggcgacccagaaacgacctcagcttggtgctagccttcgagagcactcgagaacgcaacgcagccatcatgctcgctcggcgtttcgctgtagattgcaacgtatgcgccttcgccgagcgctacatcatccttgctgggccaggcgacaaaactccctggtgaacgaagatggcacctgtgctctgccgataccagataccacccagcacccaccactcctgactgtcctgctcttcctcgcgtcgtaggttcctgaaagaaggcgccgtccgcaccattttaaccgcctgggcgccgcctttctatgtcactgtgctatgttttcccagtccgcgagggttgtaatctgttgttgctgggagatgcgacagcaatgtaagctacaagtctaactgtgtttgacatatgtttaggcctcgttcggttggcctggaacggccctattccatccggatatatttggtcaggattgaaaccggaaacaactaataatggttgttcggttatgtctaactcataataaaaccagattgaaaacaggtcatttcaa

SEQ ID NO: 248 - DNA, 578 bp, Zea mays
ctggggcccccgcggccggaaacaaaaaattatcagtaatcttcacaagcacctgctatagttgtgtggtgcaaacaccaaaatgttgcctgccaaagtgtcatttgttttcctgatagtgtactgcgcagtaacattttcgctaggtcagatagctgttggcgaggcatgcacagtggatcagagggacaagatcacaacggactgcagagagttcatcaagctgaaaggccccgtcacagccccgtcgtacaccgacgactgctgcgtcgccataagagcggtgcccaatctcgacatggagtgcatcattcgcctgctctccaataaacagaagaagaagtacgacgtggacaagatccggcggctcggcagcgtcctctgcaatccacatccggtgatgacgtaaaatggggtgtggcagtagtttctgatggagtgcatcgcgtcaacaatatggagcttgaactatacaaaccctactgataatgtgtcaccatttcatatgtatatgtactccattcattaacaaaaaaaagtgtcttatatatcataaaaaaaaaaaaaaaagaccggcc

SEQ ID NO: 249 - DNA, 1570 bp, Zea mays
tgtgctttgcccatgcatccccttcctcgctttgtgtaaaggtcgaggcctctggccatagacgaattgtctggctgagtcagtcggaacgtcttcatgaacacgggaccctccgcgcgagctggtaagattacaaacttatgatatcttttgaattgttaacttgatatatacagagtcaatagtttattagcaaatgaagtttacgaatctcttggagttattctaattgattttagcgtccatttttttttttttttttttagttctaaacccatacacagtttggttataagatcgagaccgccatccatggaccagtacacgattagcgagcaatataatcacacacttcatcaaacccatacacacgaaccgtaagtacactacacactccctgtccctgggagtcagagagacatggcgcggcagcatattgcaccgtcgcggcaacggctgcacggtgctccggcccctacctacgccgtcgtccgttcagttccccggcgccggcttgccgccgaatcccttcttgcgctcctcgatgaagctggaggagcgctcgttgatgttggacggcacccttggcgcctgcggcatccgcggccggagcccgctccgcctcggcacccgggcgccgctctgctcctccgctccggcgaccgacgacgcctgccgcttccggaacagcgacttcttcctctccaacgaggcgccgccgctgccctcctgcgcaggacggtcctccttgatcgtcaccgtcctcctcgtcaccttcgtctcctccgccttcgccaccgctggcgccgcggcctccgcttccaccgggccgtcggccgcagcagctccgtcctgcttccgctcaggatcaggaacgcccctcgccgtcgtcgcggcgctctcttccaagacggtcgtcgcgacgccgctggggcccccatcgccatggccgccgagctgctggaagtcgaactcggccctctcgatgggtatggcgaactcgtcttcttctatgccaccgtcgcctcctcctccctccgtcggcggcggagggtggccgccggcgccgttgctccttggcccctcggcgatgctcttcatcctgctcaccgacaggttcttggccaggaacgtcaggaaccggtcgcacatgccgccggccgccctcgtcgctggctccacgtcgccgccgccgctgcctttctccgccattaccgcgcgcttgttgtacttgtacctggcagcgtagtggcgcgaagcagcaaagaatccatgtacactttatagatgcatcaacatgggcgtgccgtgtcgtgtcgtgtgtgatgtgttcgtgtgttgggattgggacaaggagcaacaaaattaaagtacctggcagcgtagtggcgcgaagcagcaaagaatccatgtcttctccttgggtactgaaagacacagcaagcaagcgattccagatgccattagacggcaacccgttcggaatattgcaggccaaagcgattccaagagtctaacagaagcagcaaggtattccctttggccactggaataagagacaagcaatcta

SEQ ID NO: 250 - DNA, 998 bp, Zea mays
acggccgaccttatgtgacagttcgggcaccgacgtccgtctccgtacttccggctgtgtgcgaaactgcgaacgcgtgatatctccgcgtacgcaaacgcgacgcgaaggtcagcacggacaactctacccctccgcctcgaccctgaccccccacctcgtcggcgatgagttcctcttccaacggcgggaagaagccggctcccggcggcggccgcaggggtcccgccatccgcacgctcgctgacataagccgtgggcccaccggcttcccaggtgccggaggcggcgacagcggcagcgacgacgacgagccacaggaatactacaccggtggcgagaagagtggaatgcttgttcaagatccaacaagaagaaatgatgtggatgcgatatttgaacaagccagacaagcgggtatcaaaggaatgcctcctcctcttgatggcgagtcttccagctctaggagctttacagggactggccgacttcttacaggggagacaatatcatctgctgcacctcaggaaccagtaccaattcgagtacgccacaatatacatttgtggaacaatggctttagtgtggatgatggtccactgagatactacgacgatcctgaaaatgcagagttccttgagagccttaagatgtcaaagtgccccaaggagctggtgcctactgatggagaacatgttgatgcgtctgttattagaaggatggaagattacagggaacctgtaaggcctcgatcagctttccagggtgttggaagaacccttggtggtggaccttccccagatgagagcgcaacagctgctcctgcatcagcggcccctgctgcttcgaggtccgctggcgttgtcgtggatgactcccagccatttacgtccatacagctgaggctggctgacggcactcgcatggtcgcccggttcaacatgcaccacaccgtgggagacatcaggtcctttatagacgcagctcggccgggagct

SEQ ID NO: 251 - DNA, 1455 bp, Zea mays
cgaccctcgcgccttcgcgagtctctctctttctctcgagtctcgacacaccacagcggaagcggctcgactcgctgagtgacaagacgcgacgcgacgccaagccaagaccaaattaccaaaccctaccccttcgccgcgaccgcgatcccccacatcgttggcgatgagctcctcctccaacagcgggaagaagccggcgcccgccggcggccgcggggggcccaccatccgcacgctcgccgacataaaccgtggccctgccggtttcccaggtgccggaggcggcagcagcgatgacgacgagccccaggagtactacaccggcggcgagaagagtggaatgcttgttcaagatccaacaagaagaaatgacgtggatgcaatatttgaacaagcaagacaggcgggcgctatccatggaatgcccccttttcttggtggcgagtcttccagctctaggagctttactgggactggccgacttcttacaggggagacagtaccatctgctgcacctcaggaaccagtaccaattcgaatacgccacaatatacatttgtggaacaatggctttactgtggatgatggtccactgagatactacgatgatcctgaaaatgaagagttccttgagagccttaagatgtcaaagtgccccaaggagctggtgcctactgatggagaacatgttgatgtgtctgttattaaaaggatggaagattaccgggaacctgtaaggcctcaatcagctttccagggtgttggaagaacccttggtggtggaccttccccagatgagagtgcaacacctgctcctgcaccagcggcccctgctgcttcgaggtccgctggcatagtcgtggatgactcccagccatttacatccatacagctgaggctggctgacggcactcgcatggtcgcccggttcaacatgcaccacaccgtgggagacatcaggtccttcatcgacgcatctcggcctggaaccgcaaggccgtatcagctgcagacaggtttcccacccaagcagctggctgacccaacgcagaccgtggtgcaagctgggctggcaaactcggttatcatgcagaagatgtaatgtttcgacaacatgggtaactaggatgcatcgtactgcatcttttgagaactgtcttattgtggttgacatactgctctggtgcgtcattcatggtcttaatagtttatagttcatctatgaactgaattatgctttctgatttacagcagatactgaagtgtcgatttaacgtttatgcatgtctggatataatcaaccgttgttgcttgcatccccgtgtctagttctctcgctccgcgggcattatatttcgtgttgccatgaccgttttcattgcaagttgaagcgcgaccctgcagtcgcaagataactaccctgtttctgcagtaattcgggtacaaaactca

SEQ ID NO: 252 - DNA, 1441 bp, Zea mays
  misc_feature (12)..(12): n is a, c, g, or t
  misc_feature (26)..(26): n is a, c, g, or t
  misc_feature (56)..(56): n is a, c, g, or t
  misc_feature (1197)..(1197): n is a, c, g, or t
ggtaccctccgnggtctcggccgggnaaacccgaaaaaacagcaggcggggcaggngaaaccagagtaccataccaccgccccgataccgcgacgacccgacacctcgtccacctctccttccgagttccgactcatactggctatccaccgcctgtctctcaggcgatcaagtcgaccagagccggcaaccgatggtggtggtggcggtgggagggggcggcggcggcggtggctgggggacgtgggaggagctggtgctgggcggcgctgccccccggcccgccggcgccgcgtgggccaccgtcgccgacgagcttcggacccgctctccgtgcaccttctcgcccgaggaatgtgaagcaaaatttgcagagatacagttgcggtactctgcgtgcaatgcttggtatgaagagcttcgtaagcagagagttgctgaactgaaaagggaattggagaggtcagaaaattctattggatccctccaatctgtgattcaaagcctcagcaatagcaaacacgttgatgggagttctgaatgccgcaccagtcatactgaatcatgtccacattctgaaaatacagcagatactaattcctcaggtaaagaaacgtccagggatagatcatcagctgctagtttcacagaggaagcaagcaacagtcagaaatctcagaaagtgcagcagtgtgatactgattcaattcaagttatcaatccatcaccagacgagtcatatccccaggcccaagttgaaaaggtcggtcccaaagatggcttgctttggggttctagaaaacaaagagtaatgagagctagaaggacacttctgaaagctggtgatagtagtggggatggtgagcctacatctacagcatgcatacagggggagggtttgtccaaaggctgcatgaagaacttcaaaactcaaaacttagaatcagttgttgtgaagaagggtgtgaaaactccaaaggtagaatctgatgtgatgaataaggatttgaaaaccctaaatgtaggatctggtataatgaagaagggcttgaaagctcccaaaacagaatctgatatgatgaagaagggcgtgagaacttctaaagcagagtctgatggtatgaagaaggggatgaaaataccgaaagtagaaccctgatgttatggactggaaaactcccaaagcaggatctgatnttacgaagaagggcttgagatctccaaaggcagaatgttgccagcctgtgattgagagcgttaaactaaagctggcagagattttgaatactatatcaactcaagatgactgcaaaatgttgcaacaccaacttgatacccaggtatgataggttcaccgagtttcatcaattttgtttttgcagtgcctcagtgatggtctaaattatctctctctctcttctctctctctctctctctctct

SEQ ID NO: 253 - DNA, 3262 bp, Zea mays
aatgactccttaggtcatttgagagatgggatacttcatgtgggtgctaataattttaagactactattaaaactgttccactttttttcctgctagttactcagctaagatttttgtggggttttaatgatggttattttctcactagctggctatagttgattgttttacttttcaagttaattgttccatcaaatcattctcaaggtctgtgaaatagcgtgaacacttatggtctgaatttcatctgactccttaccattcgtctatatatacagaggaaaagagctagatataagaagatgattcgccggcatatggacttccgaatgcttcactctaagatcaagagtggcgcaatctctggcaccaaggagcttttgagagatatacttattttcatcaataatggaataaccttctatccgaagactacattagagcacatggctgcggttgagcttcgtaactttgcatgcaaaactgtgaagcagagtgcaagcttgttcttgaaaagccatcgagagaccagaacagctggtgcccctgtaataaagaagaatgctcgagccctgcatttttcaagaacaagcttgcactctggggatgcaagggcaagcaaggtttcttcaagggatgctgctgccaaggaaggggatggcaagagaccttgcagtgatgagctggctaatcaaaagactacaaagagaaatgagccagccaagaagaggggtgtgggtcggcctccaaagagtgggcagaggattgctggggcacaggaaaatagccccatcaaaggcaggaaaagtagcgctggggcacaggtagatagccccagcaaaggcaggaagaggagtgcggaagcacatgatgatagctccagcaaagggggcaagaggagccggcggtgaagctaccatcagctcaatgccggtgaaactgtgtacagcttaaccatatatcataggctgttcccttccggtttgcttacctgacaaaaaaaagttattgtcccagtattcaaactgatgtaacaggaagggttagttgtttctgatgttgttttgtaaggagtaaggacaattagaagggaaccctcatttttatattgagactatccgagttaggctatacatatctgaccatgtaatgcttatagtagttttaagttgttataccatgtcaaaaaaaaaaaaaaaaccctcgtggccgggccccagtctgtcacactgaaccagataagagcaacgtcagggatgggctgatggcgatccgctcgtgggccgtgcgtcaccgtctagcacacgcgccagcgcagcgcagcgacgatgaaccaataaaccgagcggaaaacccggtcgcggaggaggccgcgtggggcgcgcgcgcgagcgagctgtgagcatcgccgttcctctcgcgctctcggctgtctcgctccttcccgcggtcgcctccgcccgtgcccgtgcccgtgccccgtcccaactcccacccaacatttcccaatccctccgggctccggcaccgcgagatgtttcgttagccattcccacgacacaatcagcaccaccggtgccctcgctgccaaggcgcccgctcgtgtgacgagtggcgctccaccaccgcccattgcgcgctcagctccgaggcctcccgctcgccgcggcatcatctccggctcctcccgccgccgtggtaattcgttttgttctcctcactcaatccgattgttcagatatccgtgtgctactgcacctggtatatcatggattggttctgatcgtgccttgggacttgggtgctcttacctgtctgtaattgggatttgggaaacgatctcttggggttggggcgccctcgttatcccgaggtgcccccagacctgtaaactggagaaggttgggttcatacagtcatacttcatagagcgtagcgtaattcggtctcggcaggcgcgtcagtgttcccgccccatttgggcctcggcatcgatgcgcgcgtcacatccctttgccgtcaatttgcttcgagggggcactgctgcactccgaacaaacaaaagcgagatcatgcatgatgcttgcgccagacgttcatctatctattcgttcgagatttcgcccccttgtcaacttcctctccttttccgtttcaccagcaaaatttggagaaagcgatgctaaagtatttttcttatctgatgtgtgtgtgcgcgcgcgcctggaacctgttgatttcaggttgtttgactgtgtgatcaatgtgtcctgtgtgaggtgttttggtccttttgcaaagttcggctgggacaggtctctggaactaaaaaagtgtatttttaatattttttcttgaatatataggagagctatgtatctttatattaagaagaagaaaagtccgttacatgatagtctcctatcccggacaaaataggagaccgtagacaaaaccactaaaactctaaagcttacaaaagacatggtaagacctgactaacaaacagcccaacatattttaagtgcctaacacggattgtgtactaacaaatctgactaacacggatggtgtactacctcttctaggcctggccgcctggctccatcaaatacaatggtgttccatgttatatgttaagaaatttctcctttgttctgtgtggtatgcctgaacttgagcaacacgccaaatctttacttagaacatatttcgggaccacccagaatgaaacgtgatgagccattttttccattataaaaataatggcattattcattgtgctgtttttttatgacctgccatcctgcaagcagggcgtcatgaaatgaacctgacttgcttgagttgcttcttgacaccataagaaggcgatccatctgtttccagttgcacacagaaagctagtgccttgaaagataaggtgagtttgcttgtgttcttttgatgattacttactagtgacatctacattttctgaacccttaaagggttggttgagtgcgaggtcatgatactatattgctacctacttttgatcgtacagaatggtaaggggggcggtaggtgtcctaagatgaaactgcggttgcatctgttggtcctgtgcgtgatcatcatattcctggtgtacaacatggctagctttcaacataagcagacatcggtaacaaccagtatcccctggtttattgaaacagggttctgtgaacgtaaatatacctaaaagattaatctgatgtgattatgcaactttacagt

SEQ ID NO: 254 - DNA, 2754 bp, Zea mays
ttttcatcaataatgtaataaccttctatccgaagactacattagagcacatggctgcggttgagcttcgtgactttgcactctggggatgcaagggcaagcaaggtttcttcaagggatgctgctgccaaggaaggggatggcaagagaccttgcagtgatgagctggctaatcaaaagactacaaagagaaatgagccagccaagaagaggggtgtgggtcggcctccaaagagtgggcagaggattgctggggcacaggaaaatagccccatcaaaggcaggaaaagtagcgctggggcacaggtagatagccccagcaaaggcaggaagaggagtgtggaagcacatgatgatagctccagcaaagggggcaagaggagccggcggtgaagctaccatcagctcaatgccggtgaaactgtgtacagcttaaccatatatcataggctgttcccttccggtttgtttacctgacaaaaaaaagttattgtcccagtattcaaactgatgtaccaggaagggttagttgtttctgatgttgttttgtaaggagtaaggccaattagaagggaaccctcatttttatattgagattatccgagttaggctatacatatctgaccatgtaatgcttatagtagtttaagttgttataccatgtgaactgatgcttgaacaccgaaaaaaaaaaaaaaaaaaaggcggccgccttttttttttttttttgtcatataatagttttttatatataatataatataaagtaaagctgagaataataaactactactacatggtagttacatgctagcagtggccaataagcctagtcactggcattgggccccacgcacgccttagcctctgggctccacagccactgcaccaagaatttcctccccttcctcccattcacattccagctcctcccctgcgcgtccaccgacaccttcccggcgtacccgccgccgccgcccgtaccgtacaccccctcgcacaggtcggcgatctcggtgggcgccgtggggtcctccccggcgtaccacgcgttgacgagcgggttcgtggcgagctcggccagctcgtgcgcgatgacgctgaccatgccgtcgacgcccgcgtcgccgttgggcggccgcagcgccgccatgccgcttcgggccatgtacgacggcagcgcgaacgggtacgcgcagacgtcagcgcagcgcccgccgctgtgcccgacccacgcgtagggcagcgtgtggcccacgagcgacgggaaggtgaagtagtggaagccgcatacggcgcggcagaagtcctggacgccgacgccgggcgccgtgagaacaaggtaggcgccgccgcgggtgtcggcagggagccggcccgcggcgaccgcagaggcgagcacgcgctggatgtcgagccgggagagcgagcggcccagcgaggccgactcgtcggcggcttccccggccaggtcgacgcggcgggtgacgttggcgagggtctggtcggcgtagagcgcggcggtggcccaccagtcggcgacggaggggcgcggcagggacgtgtcggagagggagaggaggaagtcgcggacgggggcctggtgcgcggggtcccagcggccgtaccagagcacgtagaggcggagcggcgcggcggagaggacggggcccatgtggtagcggaggtccaccaggttggagctgccctcgtacttcttggacgcgcccacgagagcgtcgccgccgcggccgtgagggtacggcgtggccgccatcgccgtgaggagaaggccaggaagcaggaagacgacgacgatggcggcggcgagcgccatttcgaactgtttgagcgcgcgcgtgtttaccgcgtgtgcgtggtcgtgcttgtgtgattcagtgattgtgacggtgaacgctcattccgaccgtgagtcccgcgaggccgaggggctaggtaatggtctcgtgcggtgggcgagtgaggcagcatggcatggcagtggcagggttgttggcttccaactggcaccaatgggatgcggcctgcgtgtgggaggctgggagctggagccagctgcatgcatgatgcatgcagtgcaacggtgctgttgctgaacgaggcgttggctgaggcatggccgcatggggccgccgatttgaaaaaacccggagccaaaattcgaaaagttcaaacatttttcggctggttggctgggtgtgatacacggtgctagcccgaccggatgttccgtcccaattccaattcggcaattaccaaacggcgatggccggccgccggaaggttcactgggcaactgaagaatgcgccttgttttgtgaaccgggtccagctggacggcgcactgtacacatgcctagcctacaggtttttttttgccactcactgtatggagagcgacgaaaagaaagaaggggcgtgacggcgacgcggcgtgcccttgagtctgatccagagaccagaggtgtgggacagcgcccggtagggcaccccatggaatggtggttggctgtgttcattgctgagtacgacagtgttagtaggctacactgcactcactgcgcgtctgcaatgattccttcgtgtcgcgcagaggggccacatcgcatgcatagagtctatgcaggagaagagtgtttgctgaattgatgagcatcagtacatatataaattacaataacagattggatcctatttctatggagccgtagcgcgaaatgagccgcaagtgtg

SEQ ID NO: 255 - DNA, 1959 bp, Zea mays
gcacgagaccattacctagaacatcctaatcgaaaaactctcacgcacacactccacagtgccactcgtctcgctcgctcgcgccagctggtccggcagcagacagcatgggttcgtcggcggcgcttcagccgaagcagctgtaccagctcgtggtgaacaacttcgtcgccgtgctcgctgcgccgctggccgtggcggccgtcgtcaatgcggcgcgcgtcgggccggacgagctgctcggcaggctgcaggcgctccgggcggtgcacgtatttctggccgtgttcgtcgcggccgccacggcgatactgtacgtcctgctgcggccccgggccgtgtacctggtggactacgcctgcttccgcacgcggcccaactgccgcgtccccttcgccaccttcctggagcacgcgaagctggtgacgttcgtggagggggcctccatcgacgagcgcagcgtccggttcatgacgcggctgctggagcggtccggcctcggcgaggagacctgcctgcccccggcccaccactacatcccgccgtaccggaacatggaggcctcgcgcgcggaggtggagctcgtcatcttctcggccatcgacgacctgctcgcgaagacgggcatcagccccagcgccatcgacatcctggtggtgaactgcagcctcttcgcgcccgtcccgtccttcacggacatggtgatcaacaggtacgggatgcggccggacgtccgcaatgtgcacctgtccgggatggggtgcagcgccgggctcatctccgtggggctggcgcgcaacctgctgcaggtggcgggccggggcgcgcacgcgctggtggtgtcgacggagaccatcacccccaactactacgtgggcaaggagcgcgccatgctcctgcccaactgcctcttccgcatcggcggcgccgccgtgctgctgtccacgtcccggtccagggcccggttccgcctggcccgcgtggtgcgcacgctgacgggcgcccaggacagcgcgtaccggtgcgtgttccaggaggaggacggcgagggccaccgcgggatcaacctgtccaaggacctgatgaccatcgcgggcgacgcgctcaaggccaacatcaccgccatcgggccgctggtgctgccggcctcggagcagctgctgttcgcgctgtccttcatcgcgcggcgcgtgctgaaccggcgcgtgaagccgtacctcccggacttccgcacggcgttcgagcacttctgcatccacgcggggggccgcgcggtgatcgacgagctgcagcgcagcctgggcctgtcggacgaggacgtggaggcgtcgcgcatggcgctgcaccggttcggcaacacgtcgagcagctcggtgtggtacgagctggcgtacatcgaggccaagggccggatgcgccgcggcgaccgcgtgtggatgatcggattcggctccgggttcaagtgcaacagcgcggcctgggagtgcatcgcgccggcgcgcaccgccgaggggccctgggcggagagcgtcagccgctaccccgtggacatccccgaggtgctcaagcactagccgctatcccgtggacatcaggccgggcatgcatgtgaccggccgacgacgtgacagcgtgttttggacttgcttgtggtgctggccgggccggacgcgttgaatgccgagcctgacgcgtccatgtgtgcggtgcgctccagcccggacaggtggttgcgagagggtacaccgtgttaaatccgggccatttacacacgtatagtactcgtgctcctctagatcgtgtaccccttccttctcttcttgttcttcttctttttaccttccttttcaacatttgttttcccactaataatttacttgtgtccattttaaaaacaagccaaaatgtaccgcgagttggatcgattacattacatatgttactatagcaagcattatt

SEQ ID NO: 256 - DNA, 1206 bp, Zea mays
actatatatacagacaccatgcatgtcatcgtctctcgatctattcgatcgacaagccgtgtgttgagtcatttcaaaacaaccagagaaacacatggccaacatccccaagtatcgctggacccaaaaccccttaatccttctatcttgcgctggtgcggtgctggcagtttctactctgatgctgccagtgcctgctgcatcccaaactataaatttcaagaatctttgcattggtgtccataagatcctagacgcatgtgtgggtgccaatgccgaactacgccaagtgtctatggccgccggtgcgaggaacgctagggcgctcctgcttaacagtcagggtatatctgggccacttcccacgggtttgggcgccttctccaacttgagttacgtcgccctcgccaacaacaagctcaccgggccaatcccaccatcagtcgggcacctgcaccactccctccgcgagattgtcctcctcaacaaccagctctccggctgcctccccggcgagctagggatgctcagcaaggcggtcgtcatcgacgccggcatgaatcagctcaccggcccaatccctccgctcttttcctgcctcagcagagtcgagcagctcaacctggccgggaaccgcctctatggccatgttcccgacgctctctgcaggctcgcggggccggctggccgcctttccaatctaaccttgtctggcaactactttgtcgccgtcgggccggcatgcgcagcgctgatcaaagacggcgtcctggacgtgaagaacaactgcatttcgggctttgccaaccagaggccagcggcggagtgtgcggttttccagagccatccaaagacgtgcccggaggaggcaagcactcaggtgtcatgccctgccgcagctaccatgcacatgaacgctgcgccgccgagggatcagcggaagaccaccagggactactacagctacgtgacgtacgctagcctgcgttagtgaggcgccacgtacggccatgcaatgacgcgccaccagtgcctatagctggaacttggctatatatgttatctttttgtatcattattaattattttgtaccatgcatgtgttggtgtgctgcttgtgattgttgtttgttcgtttgtatcacgtgctactggcatatcttatatattacacgccacttgttagtgtaaaaaaaaaaaaaaaat

SEQ ID NO: 257 - DNA, 1191 bp, Zea mays
cccacgcgtccgcggacgcgtgggaacctggtaagattcaagtgttctatatgatccaagtgatgccccccgcccgcgtgggcgcgggcgcgggcgacaagccgtgtgttgagtcgtttcaaaacaaccagagaaacacatggccaacatccccaagtatcgttggacccaaaaccccttaatccttctatcttacgctgctgtagtgctggcagtactttctactctgacgctgccactgcttgcttcatcagattcagatgctgtaaatttcgacacattctgccctggtttcaaaaacttatatttatgtgtgggtgccaagaagtcccccggactacgcaacaatgtcctcctagcatctatggccggtgcgaggaacgctagggcgctcctgcttaacagtgagggtatatctgggccacttcccacgggtttgggcgccttctccaacttgagttacgtcgccctcgccaacaacaagctcaccgggccaatcccaccatcagtcgggcacctccacgactccctccgcgagattgtcctcctcaacaaccagctctccggctgcctccccggcgagctagggatgctcagcaaggcggtcgtcattgacgccggcatgaatcagctcaccggcccaatccctccgctcttttcctgcctcagcagagtcgagcagctcaacctggccggggaccgcctctatggccatgttcccgacgctctctgcaggctggcggggccggctggccgcctttccaatctaaccttgtctggcaactactttgtcgccgtcggacccggcatgcgcagcgctgatcaaagacggcggcgtgctggacgtgaagcacaactgcatttcgggctttcccaaccaaaggccagcggcggagtgtgcagcgttccagagccagcgaaagacgtgcccggaggaggcgagcactcaggtgtcatgcccagccgcagctaccatgcacatgaacgctgcgccgccgagggatcagcggaagaccaccagggactactacagctacgtgacgtacgctagcctgcgttagtgaggcgccacgtacggccatgcaatgacgcgccaccagtacctatagctggaacttggctatatatgttatcttcttgtatcatcattatttttttttttggaaacgacattattaattattttgtact

SEQ ID NO: 258 - DNA, 2595 bp, Zea mays
ggaaagctgacacaccgccggccgggctgcgagcccgcggcctccgggcctgcgactgctcccgctccacaatttcaacctccagatctggccactcccactctcacacgcccagtcttctcaatcctcacatcctattggccacggcaactgccatcgccatggccgggaggcgtccggcaccggcggccctcctcctcctcgccgtagccttcgctcccatctcctccgccgttcgcccagtctccgatgcgcacagatccgctgccgaggagctcttcgccccctccgccgacggatcctttggcgatttggagagtacgtatgaggcagtgaaaacattccagatactcgggctggagaaatataatagtttatctgggaaggcgtgcaagtttgccgcggagaacctggcttccaccgattccaccgcgaaagatctgttccacgcagtccggatcagtggcgcgctgggatgtggcgttgatgccggcgtgtatgatggtgttgtggcgagactcaaggcagtgattaaggataccaattccctgttggaattctactattctgtgggaggtttgcttagcatcaaggaacaaggccataatgttgttctgcctgatgcagaaagtacatttcatgccattaaggcacttagccaaagtgacgggagatggcgttatgacactaacagcgctgaatctagcacatttgctgctggtatcgcactagaagcattggcgggcgttgtttcactggcagatgcagaggttgatccatccatgatggtagtggttagaaatgacatcgttaagctgtttgacaccatcaagagttacgatgatgggaccttctactttgatgaaaagcatgttgatgctaccgaatacaagggtcctataatgacttctgcttcggtggtacgtggtgtcacctcttttgcagctgttgcttctggaaaattggatatccctggtgacaagatacttggcttggcaaaattcttccttggtattgggctcccaggtagctcaaaggattgctttaatcagattgactctttgtcagtcctggaggacaatagggtcttcgttcctttgatactctcacttcctaccaaagtattctcattgacttcgaaagatcagcttaaggttgaagttaccacagtgtttggatctgcagcacctttactcaaagtgaatcttgtgcaagtgttgggaactgactctaaagtcatcaccaatgggaacagggagcttcaatatgaccttgacaaaaatgtccattacttggacattgctccattggaaatagatgttgggaaatactcggtagtttttgagatttcacttcaggaacaagagcgtgagactgtttatgctactggagggaggaacactgaaagtgtatttgtcacaggactgatcaaagttgataaggcagaaataggaatatccgacaatgatgctgggaccgtggagtctgtccaaaagttagatcttctgaaagatacaaaggtgtctctttctgcaaaccacctacagaagctgcgtttatcttttcaattaactactccgcttgggctcacatttaaacctcaccaggtgttcttgaagttgaagcatgagagtaaggttgaacacttatttgtggtacctggctctgcaaggcaattcaaaattgttctcgacttcctagggttggtggagaaattttactacctctctggaagatatgaccttgagcttgccgttggtgatgctgcaatggaaaattcatttctacgacctcttggccatttggagttggacctaccagaggccccagaaaaagccccacgtcctcctgcacaagctgttgacccattctcaaaatttgggccgaaggcagagatattgcatatattccgtgccccagagaagaggccacccaaggaactctcgctcgcattcacgggtctcacgcttctgccttttatcggattcttgattgggctcgtgcgtcttggagtgaacgtgaagaacttcccgtccttgccgggaccggccgcatttgcctcagttttccatgctggaataggagcagtcttgctgctctacgttctcttctggctcaagttggaccttttcacaactctgaagtaccttggcttcctcggcatcttcctcgtgtttgtgggccataggaccctgtcctacctttcctcggcgtcagcaaaacagaagacggcatgagtggacagtgcaagcagagctttcccgatcatcaattcgttttttgaggtggccattccaggccactgggtgtctttgcttggtactctgaccgcaccctagtttttctttagctaacatgcattttgagggaggactcggtttatttcagttggctttgacgaatactgatactaggacaagtaacaggacctcacatcacagtttctgaatagaatggatgtttaatcatagcatttatatgatcattcgatatacatcatccttaatcgaactgaaacgttatatgtacacagaaatgatgcaaagttaaagaatttttgagcgtgtttggatgcacgccgcgcccggacggcac

SEQ ID NO: 259 - DNA, 2007 bp, Zea mays
  misc_feature (21)..(21): n is a, c, g, or t
ggccactcccacatgccccangtctcctaaaccctacacatctatctcggccacggtaattgccatcgccatggccgggaggcgcccggcaccggcggccatcctccttctcctcgccgcggcattcgcccccatctcctccgccgttcgcccagtctccgacgcgcacagatccgctgccgtggagcttttcgccccctccgctgacggatccttcggcgatttggagagtgcgggggagggggtgccgcctggccggccgcgcgggctggagaactataagagtctgtctgggaaggcgtgcaagtttgccgcggagaacctggcttcccccggttccaccacgaaagatctgttccatgcagtccggatcagtggcgcgcttggatgcgctgttgatgccggcgtgtacgatggtgttgtggcgaggctcaaggcagtgattcaggatactaattccctgttggaattatactattctgtgggaggtttgcttggcatcaaggaacaaggccataatgttgttctgtctgatgcagaaggtacattccatgccattaaggcacttagccaaagtgacgggagatggcgttatgacactgacagtgctgagtctagcacatttgctgctggtattgcactagaagcattagcaggtattgtttcactggcagatgcagaggttgacccatccatgatgggagtggttaaaaatgatgtcgtgaagctgtttgacaccatcaagagctacaatgatgggaccttctactttgatgaaaagcatgttgatgctactgaatacaagggccctataatcacatctgcttcagtggtgcggggtgtcacctcttttgcagctgttgtttctggaaaattgaatatccctgccgagaaaatacttggcctggcaaaattcttccttggtattgggctcccaggtagcgcaaaggattgctttaatcagattgagtctttgtcattcttggagaacaatagggtcttcgttccgttgatactatcactttcttccaaagtattttcattgacttcgaaagatcagctcaaggttgaagttacatcagtttttggatctgctgcaccttcactcaaagtgaatcttgtgcaagtgttgggatctgactctaaagtcatcaccagtgagaacaaggaacttcaatacgaccttgacaacaatgtccattacttggacattgctccattgaaaattgatgttgggaaatactcgatagtttttgagatttcacttcaggaaccagagcaggagactgtttatgctactggagggagaaacactgaaagtgtaattgtcacaggactgatcaaagttgacaaggcagaaataggaatctctgacaatgatgctggggccgtggagtctgtccaaaagttagatcttctgaaagatacaaaagtgtctctttctgcaaaccatctgcagaaactgcgtttatcttttcaactaaccacaccgcttgggcacacatttaaacctcaccaggtgttcttgaaattgaggcatgagagtaaggttgaacacttattcgtggtacctggctctgcaaggcagttcaaaattgttcttgacttcctaggtttggtggagaaattttactacctttctggaagatatgaccttgagcttaccgttggtgatgctgtaatggaaaattcatttctacgacctcttggccatttggagttggacctgccagatgccccagaaaaagccccacgtcctcctgcacaagctgttgacccattctcaaaatttgggccaaaggcagagatatcacatatattccgcgcaccagagaagaggccacccaaggagctctcgctagcgttcacgggtctcacgcttctgccgtttattggattcttgatagggctcgttcgtcttggagtgaacttgaagaacttcccgtccttgccaggaccggccgcatttgcctcacttttccatgctgggataggagcagtcctgat

SEQ ID NO: 260 - DNA, 1357 bp, Zea mays
  misc_feature (1018)..(1018): n is a, c, g, or t
  misc_feature (1045)..(1045): n is a, c, g, or t
  misc_feature (1048)..(1048): n is a, c, g, or t
  misc_feature (1065)..(1066): n is a, c, g, or t
  misc_feature (1069)..(1069): n is a, c, g, or t
  misc_feature (1075)..(1075): n is a, c, g, or t
  misc_feature (1094)..(1094): n is a, c, g, or t
  misc_feature (1099)..(1099): n is a, c, g, or t
  misc_feature (1105)..(1105): n is a, c, g, or t
  misc_feature (1107)..(1107): n is a, c, g, or t
  misc_feature (1109)..(1109): n is a, c, g, or t
  misc_feature (1111)..(1111): n is a, c, g, or t
  misc_feature (1114)..(1115): n is a, c, g, or t
  misc_feature (1127)..(1127): n is a, c, g, or t
  misc_feature (1131)..(1131): n is a, c, g, or t
  misc_feature (1136)..(1136): n is a, c, g, or t
  misc_feature (1145)..(1145): n is a, c, g, or t
  misc_feature (1161)..(1161): n is a, c, g, or t
  misc_feature (1163)..(1163): n is a, c, g, or t
  misc_feature (1168)..(1168): n is a, c, g, or t
  misc_feature (1171)..(1171): n is a, c, g, or t
  misc_feature (1173)..(1174): n is a, c, g, or t
  misc_feature (1178)..(1178): n is a, c, g, or t
  misc_feature (1182)..(1182): n is a, c, g, or t
  misc_feature (1185)..(1185): n is a, c, g, or t
  misc_feature (1187)..(1188): n is a, c, g, or t
  misc_feature (1192)..(1192): n is a, c, g, or t
  misc_feature (1194)..(1194): n is a, c, g, or t
  misc_feature (1196)..(1196): n is a, c, g, or t
  misc_feature (1198)..(1200): n is a, c, g, or t
  misc_feature (1202)..(1202): n is a, c, g, or t
  misc_feature (1206)..(1207): n is a, c, g, or t
  misc_feature (1211)..(1211): n is a, c, g, or t
  misc_feature (1216)..(1216): n is a, c, g, or t
  misc_feature (1224)..(1225): n is a, c, g, or t
  misc_feature (1235)..(1236): n is a, c, g, or t
  misc_feature (1251)..(1252): n is a, c, g, or t
  misc_feature (1255)..(1255): n is a, c, g, or t
  misc_feature (1257)..(1257): n is a, c, g, or t
  misc_feature (1264)..(1264): n is a, c, g, or t
  misc_feature (1267)..(1268): n is a, c, g, or t
  misc_feature (1270)..(1271): n is a, c, g, or t
  misc_feature (1273)..(1274): n is a, c, g, or t
  misc_feature (1278)..(1279): n is a, c, g, or t
  misc_feature (1282)..(1282): n is a, c, g, or t
  misc_feature (1288)..(1289): n is a, c, g, or t
  misc_feature (1303)..(1303): n is a, c, g, or t
  misc_feature (1310)..(1310): n is a, c, g, or t
  misc_feature (1315)..(1315): n is a, c, g, or t
  misc_feature (1318)..(1318): n is a, c, g, or t
  misc_feature (1324)..(1325): n is a, c, g, or t
  misc_feature (1328)..(1328): n is a, c, g, or t
  misc_feature (1330)..(1331): n is a, c, g, or t
  misc_feature (1340)..(1341): n is a, c, g, or t
  misc_feature (1344)..(1344): n is a, c, g, or t
  misc_feature (1346)..(1346): n is a, c, g, or t
  misc_feature (1351)..(1351): n is a, c, g, or t
ctggccgggaaaaaaaaaaaaaatttattggcgcccccgacccggcgggagatctggccactcccacatgccccagtctcctaaaccctacacatctatctcggccacggtaattgccatcgccatggccgggaggcgcccggcaccggcggccatcctccttctcctcgccgcggcattcgcccccatctcctccgccgttcgcccagtctccgacgcgcacagatccgctgccgtggagcttttcgccccctccgctgacggatccttcggcgatttggagagtacgtatgaggcggtgaggactttccagatactcgggctggagaactataagagtctgtctgggaaggcgtgcaagtttgccgcggagaacctggcttcccccggttccaccacgaaagatctgttccatgcagtccggatcagtggcgcgcttggatgcgctgttgatgccggcgtgtacgatggtgttgtggcgaggctcaaggcagtgattcaggatactaattccctgttggaattatactattctgtgggaggtttgcttggcatcaaggaacaaggccataatgttgttctgtctgatgcagaaggtacattccatgccattaaggcacttagccaaagtgacgggagatggcgttatgacactgacagtgctgagtctagcacatttgctgctggtattgcactagaagcattagcaggtattgtttcactggcagatgcagaggttgacccatccatgatgggagtggttaaaaatgatgtcgtgaagctgtttgacaccatcaagagctacaatgatgggaccttctactttgatgaaaagcatgttgatgctactgaatacaagggccctataatcacatctgcttcagtggtgcggggtgtcacctcttttgcagctgttgtttctggaaaattgaatatccctgccgagaaaatacttggcctggcaaaattcttccttggtattgggctcccaggtagcgcaaaggattgctttaatcanattgagtctttgccattcttggagaanaanagggtcttcgctccgannganactatnacttttctttcccccctanttttnttggcntncnancannatctagcttcangggntgatncctccttcnccctattttaccactncntgccnccntnntttntacnccnanntttnantncnnntncacnntttntcccncccatttnntttcctatcnncccccctttcccttnntancntaccccncgnntnngnncccnnttnttattnnccccccctcgctanccccctnatttnctnttcatnnccncnncccctcctnnttntntcccntcgcga

SEQ ID NO: 261 - DNA, 616 bp, Zea mays
gtcaaaatcttctccaatcccttccaatccccctcaatccctatggttttgggatcaaacgaacatggcctattgggatgaccctttcccctgcactcgcatccaaacactgcataatctaggattgtccctagacacatccttaatgaagctcgccaagtcagaaaatcatacatttgtacaaaatgcaaaacttatatcaagatttaacccgcctgcatgaacgaaagaaaaagagcaatgagaatggaactcctttacagtaagaaaacaataagcataaagtgtattgtcaatgatgaaaggtggggtgtattaatagaagtgagatcagattgagcatactccaaatcatttgcaggaaaaggaacaggcactgcactaaaagtaatcaacgggaccctagttatttggtaaattggaaaataactgttactattcgtaatgtcactaaactcaactctaagccatgtttagtctggggagaagggaaaattacagttcctaagtgttctatggacgtcttgacctcttttgctgttaagattttcttgttcataccaagcccagaaaaaaagaactacaatggtgggattagtgataaccgacagcaacg

SEQ ID NO: 262 - DNA, 884 bp, Zea mays
  misc_feature (864)..(864): n is a, c, g, or t
cgggagaatatcgcatcgccggcgccccctcgcccggccggcccccccgcgcgcgcctcgggctctgacacatctctctaatctctcctaggaccgggtgcccttacatccacgccgcaacgcaaatcgccgtccgagtcctcgcggtctctcgtctccccgtgcgagaggacgccggcagcagcggcgtgccagtgcggtggcttggtgggggaagaccggaggcggcggcagagctcgcgcccagaggtgcacggcaggcctgttctcggcgtcggctgggggaaggcgagtagccgcgggaaggacgagtgaataatcatgagctcgctctgccctttcgcgggagccaccactggtggtggtgtatgccctgtgaaatctgataagatcaacactggggtgtgccctgcaaaatctgacaagagcgtcagcggtgtatgccctgtcactggcaaggatcatggtagcaagctcaaggaaagtggtgattctggtgaagaaaagggcaccgatcctcgtgtcgtaccagcaaaatgcccattcggctatgactccaacactttcaagctgggtccgcttagctgcattgtctgccaggcactactccatgaaagtagcaaatgcaagccgtgtgcccataaattctgcaaggcatgtatatcacgctttaaagactgcccactatgtggtgctgatatagagggtattgagcctgatgcggaacttcaagctcttgttgaccgcttcattgatggtcatgccagaatcaagcgatcacatgctgcagggggatgtggaagcagcagatggcaagaacaaagtcattatatgagggatgtttccatgggagagagggggctntttctggtgcagcagcctat

SEQ ID NO: 263 - DNA, 1988 bp, Zea mays
cggcgtgccgccccgcaaaaaataaaaagaaaaaaaataaaaaaaagagaggaaaaggggacaaaccaccaacaacaaccagaatatcgcatcgccgtcgcgtcgtcgtcgatctccccgccccgccccgcccgcgccgcggaatctgacacatctccctaatctctcctaggaccgggtgcccttacatccacgccgcaacgcaaatcgccgtccgagccctcgcggtctctcgtctccccgtgcgagaggacgccggcagcagcggcgtgccagtgcggtggcttggtgggggaagaccggaggcggcggcagagctcgcgcccagaggtgcacggcaggcctgttctcggcgtcggctgggggaaggcgagtagccccgggaaggacgagtgaataatcatgagctcgatctgccctttcgcgggagccaccactggtggtggtgtatgccctgtgaaatctgataagagcaacactggggtgtgccctgcaaaatctgacaagagcatcagtggtgtatgccctgtcactggcaaggatcatggtagcaagctcaaggaaagtggtgatcatggtgaagaaaagggcaccgatcctcgtgtcgtaccagcaaaatgcccattcggctatgactccaacactttcaagctgggtccgcttagctgcattgtctgccaggcactactccatgaaagtagcaaatgcaagccgtgtgcccataaattttgcaaggcatgtatatcacgctttaaagactgcccactatgtggtgctgatatagagggtattgagcctgatgcggaacttcaagctcttgttgaccgcttcattgatggtcatgccagaatcaagcgatcacatgctgcaggggatgtggaagcagcagatggcaagaacaaagtcatatatgaggatgtttccatggagagaggggcttttctggtgcagcaagctatgagggcttttcgtgcccgaaacattgaaagtgcaaagtcaaggctcactatgtgtgcagacgacatcagggaggagttaaaatcttcagaagataacttagacctatgttcacagcttggagctgtgttaggaatgcttggggactgctgtcggaccttgggagatgttcctgcagcaatcacctactatgaagaaagtgctgagttcctctcaaagccccctgcaaaagatcttgagctggttcatactctctctgtttcactaaataaaatcggtgaccttcgctactatgatggcgacctccaatctgcaagaaactattatgcccgttcattggatgttcgcagaaatgcagtaaaagaacactctgctgtggcttcccaggtcattgatctagcaacttctcttgcaaaagttgcggatgtggatagaaatcttggtaacgaaagtaccgcagttgagggttttgaggaagcaattcgatgccttgagaagttgaagctggattctgaacaaactaccctcgaacagcggcgcctctcggttctcgacttcctgcacaaccagttggccgataagtaagacatagtcttctcctaagaatgcaccaccagcagatgtctcctcatggtaatgttcaactctactacataaggttccctttggaaggagttggtctagaagcagcgatgagtgtgtgtttaccatcgtttgaaactttgtcacggcacaaaataagagctcctgcactgtaaatgtaatcatatatatgctcatcgagtattcttgatgattgccgatatggtttagtagtctaagcactctggtttgtcaatgtcatagcctggagcagcgcataagatgttagttaacttgtggcaagttccatctcgctttgaagtgtcatgtgtgaagacctatcctgttgtatatttgacaataagacagggaggtagtaatcaaaaccgtggccgtcgtttctcaaaaaaaaaaaaaaaaaaaaaaaacaccctagtctctcctcgtgc

SEQ ID NO: 264 - DNA, 849 bp, Zea mays
cattgggtacctcgaggcccgccgggacctcgaggccggccgggaaaaataaaaagaaagaaaaaaagaagaaaaaaaaagagaggaaaaggggacaaaccaccaacaacaaccagaatatcgcatcgccgtcgcgtcgtcgtcgatctccccgccccgcccgcgccgcggaatctgacacatctctctaatctctcctaggaccgggtgcccttacatccacgccgcaacgcaaatcgccgtccgagtcctcgcggtctctcgtctccccgtgcgagaggacgccggcagcagcggcgtgccagtgcggtggcttggtgggggaagaccggaggcggcggcagagctcgcgcccagaggtgcacggcaggcctgttctcggcgtcggctgggggaaggcgagtagccgcgggaaggacgagtgaataatcatgagctcgctctgccctttcgcgggagccaccactggtggtggtgtatgccctgtgaaatctgataagatcaacactggggtgtgccctgcaaaatctgacaagagcgtcagcggtgtatgccctgtcactggcaaggatcatggtagcaagctcaaggaaagtggtgattctggtgaagaaaagggcaccgatcctcgtgtcgtaccagcaaaatgcccattcggctatgactccaacactttcaagctgggtccgcttagctgcattgtctgccaggcactactccatgaaagtagcaaatgcaagccgtgtgcccataaattctgcaaggcatgtatatcacgctttaaagactgccccactatgtggtgctgatatagagggtattgagcctgatgcggaacttccagctctt

SEQ ID NO: 265 - DNA, 1589 bp, Zea mays
  misc_feature (1)..(1): n is a, c, g, or t
ngacatcctaatcgaaaaaaggtttttttttgcaagatgttcaccagcagctgagcgagcgttggcaggccacgggggctgtgctgtgctgaaggtcgtccgtagcgtgatctgctagcgctcgcaattctcctctccaccacgccggcgacggcagccggtgaccagtacctacatgtccagcctgaggtcgctagccagcgcactgatcggggacgccgcgaggcttcactcggccactggctctgccggggaggagcctgacagggtctacggcgccgtgctctgccgggcggactccgctggtgctaactacaggcgccgccggggtgcccttggcgccatcgacggcgacggccactcaccttgcgcgctccacagcgacgtgaccgtctactccgagctgtaccatctccgtttctctgacaggaacttcctcgccaacttcaagaacgcgccgaaatgggccgacgtcaaattatggtttctctcagactgctaatggtacatagcagatttacaagggagtatttactgatggacaagaggtagcaataaaaagactgtctgctcacaacaagacgggtgtttgttatggcttaaaattagattctaaccgtcagaatccgattcttgtagccaaaggcttcacttcttagcttgtttctatgagaatcgtttccatgaaaatcactcaaataatccgcaaataatccgtcaagttttgtcacgatgagaaaaattcgttgctttctagatcctaaactctataaactattctagcttcctctatagtctgcaagtaatcccgcgatatttagattatcttgacaactagactatacaagaatccagattctcagaaaagctctttagaaaaaagctataccaaacatacccctttagatatcgcgatattcaggttttagcaaaacttaagcacaaaatccttgttagactccttggtcgttgcatccatgaagagaagatgctgatatacgaataactgacgaaccaaagcttggaccacttcatttttgatccaatcatgcatgcatcacttaaatagaagagaggagtcaaaatagctgatggtatagcccagggactcctgtaccttcacaacctctcctgaatacgcatcgtccatagggtcttgaaagcaagtaaaatcctgttagatttctgatctaaaccctaagatttctgatgttgggatggcaaggatatttccatcggatgccactcaagcaacagccagcagacttgtgggcacatagtaagggtattgttatactagttctgttacttactaatatttctatctaaggaattgtattctgactagccccattctcttcttttctagtggatacatggctaatgaattgcatctgatggccttctctcgatcaagtcagatgttttcagtttagtattaatggtgtatctgtatggtgttctacattatttccttccataaagtattgaactcaaagtacagggggtttcctgtacctccctgttttaaaaaaaaaaaaaaaaaagcttatcgatcgtgccgacctcgaggggggggcccggtaccc

SEQ ID NO: 266 - DNA, 2457 bp, Zea mays
ggcatgacaaggtcaatgatcattaaatttgtttcctcacttgatgaaaggtttcagatactaagttacttggttaagttctgggctaaggtacatgatctgaataccccaagacaactaactatgagctccatgtcaattatttcactagttgctttccatttgcaggtaccatgggttaattattattttggtttggttattaaattgcaagtaactgtcccattaccttttgtgttgattaattgacctactaaccaatctgcatttgaagacacaaactttggattcatttgtatagaaaataagacgatacttattggggaaattatgaattatcttctttactatcgacaaattctggatatgctttatgccagttcagaaaacatgatagatacccttcttctacacttcctcagtctaaattcctacacttcatgctattgcattctatgtaccagaaaaaatggattttactccattttccttaatggtagtgtttgagtagcaactcattagatgcatggctaagaagataagcatcaatgtgcagtgcagacccggcatcctccaatattgcctgcgttctctgacttgttaaaagatgggttagattgcgaaagcattgagaggaatgctttacggtttagggattttgggagtagaaataaagaatctgtcgctgaactgtttgtatcattgataagtaaactattgtcagcagagagtttatgggagcatgggctgtgcgcaagcaattttgaagcgtcatggatctcaaagacctggaagaaaggagtaggcaatttaagtgttgaagatttcttggaccggtcgcaaaattttgcaaggtcagtgggaaaggtgcagatgcagaagatttgcaaatgccttagagaatgtgctttgaatttgttagatttcatgagagggaaaatggacacaacgaagctgaagacccttttatttgggcggcttagcccagacgaattagtcagcaaacctcgtctgaagcatgtcaagagaaaaaggaattgggaacggaccccgcaagggggaagatgtgtgctccagaagagtgcaaagcatgctggtagtgctactggcagtgattcattacccactcctaacaaggtcttgcatcatgcactccattatcgagttgctggccatcagtctagcattcatcagtttgtgcccattattcgatggccacgaatcattccttctggttttggctatggattatcgcttgggattccatcagttgctcctcaccttggcaagggaatactgggcaagccaccaatcattccttctggttttggctacggattgtcgcttgagattccatcagttgctcctcaccttggtaacggaatactgggcaagccaccaagtaatataacacccttagatcaacggagctcaactcaactagtgcacgtacggaatccacaccagcatacatgtcagcaatcatgtggcggagctatggagccgagcagctccggcgtggcttaatgataaggtccggtgatgagcagctctagtagcggttaggagtttgaggttagatttagggtgtgtttggtttgacttttggctttggcttttgccccctaaaagttaaaagccaaccaaagggctggatacaggaagcagcttttttctaaaagccgactttctcgtagtgtaaatctgaaagcacccctgaacctgcttttagtggcttttcggatggaactatgaaaacatatatcgaagaatttttaacgacttttagtggtttccctaaacgtttttagattttttaacagcttacaacctacaacagcttttacacagctcacagcctacaacaacttttttccatagccacagcccaaccaaacagacccttgatgtggagctccctcttgtgttgaggcacttttcattgctcttgttagttcaagttttagttttttttcttctttcattgaagggatcatgaatgacgtataatgtcttatagatttttaactttaaaatcaatcacttttaaaatctacttattaaaaccaatgcaatatgctacctggatatgcactatgattttttgttaagcattgctatctaacataaaaagagtttagcaccctatagctttgaattatgtcaaccaacctagtaaattagactttagaagcttctcttgttaatatatgtacaaacacttttggaggttctttgtacaagaaaatgtattatttggcaaagaattgtaattgaatgtgaacagattttgtaaatatttttgaatgctttgtaatgctgctttaccatttattcaactgttgtctgctttgctgtggacgaaaccaatgctcgcagctttttgagtcgaaggagaaaacaccttcccttattttcattcacatcgaagcacatttggaccaaaatcaaagaatg

SEQ ID NO: 267 - DNA, 1248 bp, Zea mays
  misc_feature (49)..(50): n is a, c, g, or t
  misc_feature (1233)..(1233): n is a, c, g, or t
acccacgctttttagactggccgttggtaccctccatggggggtaggtnngtcaccaaccattggaggtttctccttcatctgactttgtccagataccagctgatgcagctgatgtttgggaagtcgatctcaggcttctcaaatttgaacaaaaattagcgtctggatcatttggtgatctataccggggggacgtgctgtagtcaagatgtagctatcaaagtactcaagcctgagcgggttagcgttgatatgctacgtgagtttgcacaggaagtttatataatgtttaaggttcgtcacaaaaatgttgtgcaatttattggtgcatgcacgagacctcctgttttgtgtattattacagaattcatgcatggaggcagtatttttgacttcctttacaatagacgaggaaattttcaactcccggatgtgattagaattgcatctgatgtgtccaagggaatgaattacttgcatcagattaatattgttcatagggatttgaagactgcaaatcttcttatggatgatcaggttgtcaaggttgcagactttggggttgcaagggttaaagaccagtcaggagttatgactgcagaaacaggaacctacagatggatggcccctgaggtcattgagcatttgccgtatgatcatagagcagatgttttcagttttgggatagttctttgggagctgctgaccggaaagcttccatatgaagacatgacacctcttcaggcagcagttgctgttgttcaaaaggatctgaggcctactattgctgttgatactcatcctatgctcgctgagctactccagagatgctggcagaaagatcctgctctaagaccaacatttgcagagattgtggatatattgaactctataaaggaggcggttcggagttctgtgcatcacaagaggcattcaggtcgatctcactccgggagaagacgaggctgttgatgtgccagttttatgtggtgccgcacgcccttttcattttatttttgtagtcgagcgataacttcagaatacggccagaagagcttactgtgttcattccgagaggttttggtaactttattttttttaatttggacttatgcttcaaggattttcatcgttaaaaagcttagaggtgcatatccacgtttacatttggcatgtatctgtatctcgtactcgttttcttaagtttggcaggcaaccaagattttaatgnaaatctttaaccatt

SEQ ID NO: 268 - DNA, 4342 bp, Zea mays
  misc_feature (1791)..(1791): n is a, c, g, or t
tagttgggggcagttagagttttgaccttttgtatgtgcagttgtgcatgagcttaggctcaaaggaacatttttagttgctgttagtaattagttattttgttatcctctgcacaatatagatgaaaatagatggtggtaggtagatcctggtttgttgccaaaacaaaatcatctttccacttcagcaggactcactcttctgccaaacactcatcttgacggtcctccattcctatttcattgaaaccattcagtgttgtttcttgatgaactaatctcagaattctttgcagaaattgaatgttttacaaattttagggtggtgatcatttccaaaatattgatttgaagatggatgattttagacagctgtttccagatccatccaactaccagaaatcactggaccccacacaaaagtggggaccagtatggatggtagatgctggaaacgagtatgctggtcatctaaagcccacatagtcatcctaatgctgagctcaagttttgtcactgtaagaaagtttcagagttgtagcaaactttgtaactgcagtggcggcttgaatttgaaaatgtatatatgtttgtaattttttatgtttgttcacttctatttcatcctcctttttcaacaatgtccaggctgacattctccaaagtgcattgagggaaggcgttgataaaataaaggtaagatgtgacagactaatatgctttaactggagtataatcaagctcttcagatttatatttctatcatatgacaagtctcgtgttagttgcttttgtacaacagaattagtgtattgtaggtataacttcctgtttacagttccttacttttgtgtctcttaccattttgatgcttatattgtccttaaaaagtagtggttgcactttttagtatcagtaaacagtatgaattgtttctgtcaaaattaacaagaagtggtaaactttggtgcgatttaccttgaagagcagctcgaataagacagcatcagcaccagctcatgtcatttatcacccgaagactttctgtgcactatgatcaccttcttagtccttttttttaaatgctaatgcagtacagagcatggccgttggtaccgtcgatgtctgctaggatggatcaccaaccattggaggtttctccttcatctgactttgtccagataccagctgatgcagttgatgtttgggaagtcgatctcaggcttctcaaatttgaacaaaaattagcgtctggatcatttggtgatctgtatgttcaagaagcaacttgaagtagtaactcttatttatatgtaactgacttatttgatgtgccatcagataccatgggacgtactgtagtcaagatatagctatcaaagtactcaagcctgagcgggttagcgttgatatgctacgtgagtttgcacaggaagtttatataatgaagtgagtgatgaactttacttatgcttggactgagaaaatggtgtaacagtcacttcacaatacaacattttaggatgatgttccatcatttatttatgactgcccaggcaaactgaatttgctgtaatgacttctcctatgggaagtaacatgatgctagtttaagatttcttgtttcatatttctgcaatttgagttttactgaccatgggtttaaggaatgatttatcgtttgacattgtgttcgattacaacttaataacatagtttatcaaaaacccagaatagcattagcctgttatttttagtcttgatgatcagacacttactgaacttgggacnatcattacgctccagctctctttccaaatttgatttggcatgcatatttgacatgctgctactcttattgatatatccagtcactttctccaaccatgtttaatcctaattttacagaaaggttcgtcacaaaaatgttgtgcaatttattggtgcatgcacgagacctcctgttttgtgtattattacaggtatacagtcatttcctatttccacagtgccacttagattctcttgcatttgtactttggaacatcgcttgtattagctctttattccttttctttttgttattgccagaattcatgcatggaggcagtatttttgacttcctttacaatagacgaggaaattttcaactcccggatgtgattagaattgcatctgatgtgtccaagggaatgaattacttgcatcagattaatattgttcatagggatttgaagactgcaaatcttcttatggatgatcaggtacttaactgcacagtgtagtattaaccttggttacaatatctatctcaggaaatagaactctactaccatactcacttctcaggatagtggaatcttagctttggatacaaaggttactttggtcctgaactcctgacatcctgatatcttgaagataattctgcactagcttagaccgctgtgaaattgaatagaaatatggtcaacctctatggccgtaattgcatatggtaacacaaatcaacagcttcactagaatcatgcctataataaattgttctgaagccacctgctccaccctccagacgtccttttttttgtgcacatctgtctgtctacttatattgcaattgcttcaaaatacgatcaatacataggtgtgcatgcatcatcagtcactcagtcttttgtcaaaccaatcaatggacccgttgtattgtatctgtgaactatgatgacatttgtttttgggaatgaatcatgatctggttatgtttgcttgcccttgggtactatatacgtttcaaataaataagcacatgtttactcagattactgtgccatttgaatgatataatatcgtaggttgtcaaggttgcagactttggggttgcaagggttaaagaccagtcaggagttatgactgcagaaacaggaacctacagatggatggcccctgaggttgattttgccaaattgcttgttattaaacattgagaaactcttacattaaaagcagcgtatgtgaaattcgttttagtgcttaaaaatgtggtttcatatcaagcggattacatattagttgtgcagtctgcagacagaatgcccaaaatgtgagaatttattccccctagaccaccttgatagttcgcatgaagcagcaaatttgttggggttgggggcctcagtgttatacctaaaagtttacttagttcctaatgtcacttttcaaaaaaccaagattaatttttttgagcagcttgcgatgcctcggctattgcaacatgactattttttttattctgtgtgatctacatcaatgctgcttcaccaagccaacaattctagcatcgaatatgattcgtttacttggtctgcagtgggtgttactgttcctgtattgagctataaagtaccgggaaaaatcatttttatctgaaagtactttggaaaaaaataatccaagaaccttttgtgggatcaaatcgctatctcagctttagagtaaattagtgagctgtcaaactgaaggtagtccagcaaatgtttatcatttatttttagtttgccttcagtaatgcataacatataatttattggtatgctgggggtcaatgagctccttagctgtgatatgaatgtgccatcttcacaatgccatcagccttgtaccacatagaagtcaaaactagcttttgtttatgcatcacctcgttctactaaatggactggcccctgcaggtcattgagcatttgcccgtatgatcatagagcagatgttttcagttttgggatagttctttgggagctgctgaccggaaagcttccatatgaagacatgacacctcttcaggcagcagttgctgttgttcaaaaggatctgaggcctactattgctgttgatactcatcctatgctcgctgagctactccagagatgctggcagaaagatcctgctctaagaccaacatttgcagagattgtggatatattgaactctataaaggaggcggttcggagttctgtgcatcacaaaaggcattcatgtcgatctcactccgggagaagacgaggctgttgatgtgccagttttatgtggtgccgcacgcccttttcattttatttttgtagtcgagcgataacttcagaatacggccagaagagcttactgtgttcattccgagaggttttggtaactttattttttttaatttggacttatgcttcaaggattttcatcgttaaaaagcttagaggtgcatatccacgtttacatttggcatgtatctgtatctcgtactcgttttcttaagtttcgcaggcaaccaagattttaatgaaaatctttaaccatt

SEQ ID NO: 269 - DNA, 939 bp, Zea mays
cggccgggccgggctccgcacccgccttcctcagctccgttgcgcaccgccaccgccggccggccagccgccggagcaccgaaagacccccgttctttcctgtaaaaaaaaacccgccgcctttagctagctaaccggtcgtcctcttcaccccctagctttgctagctctagctaggaacgaaagaaattaaaggataactgagattgctgattggtggtccgggtacggtgttcttgagtcgtgaagcgacagtacagtggctagggtcgtgccgcccctgcagtctccggggttgcgtgcaggatggtcgtcagggatcgggagtgaggaggcatcagctctcgcggtcgtggagcctaaatgtaccgcaacaacgactcggcactctcctgcttctacctcttcctcctctggttcttcttcttgaagtagacaccaccagttcgccaggtagttagcagcccagttgcgactggggatcggtggcgggctgccgcttgcgagttgtaagcttggaggggaggggagcaggagcaggagatgcagctggatctgaacgtggccgaggcgccgccgccggtggagatggaggcgagcgactcggggtcgtcggtgctgaacgcgtcggaagcggcgtcggcgggcggcgcgcccgcgccggcggaggagggatctagctcaacgccggccgtgctggagttcagcatcctcatccggagcgatagcgacgcggccggcgcggacgaggacgaggacgccacgccatcgcctcctcctcgccaccgccaccagcaccagcagcagctcgtgacccgcgagctggtcccggccggcgccggtccgccgggccccgacgccgcggcattgggccgagctcggcttcttccgcgccgacctgcagcagcaacaggcgccgggccccaggatcgtgccgca

SEQ ID NO: 270 - DNA, 2022 bp, Zea mays
tcttccccgcaaggaaggaaggcaagagttctcggcttctcgcaagtcgcgacagagaaagaggcggagttgcggagaagatgcagagcagcagcatgaagagggagatcagcgaggcccacaacaccattcgcttcggcatcaacgccggcgtcaaagcggacctcgccccgccgcacccgctccagtctaccatccaatcggtaaggattcgtcgctctccttcgtttcgtggttcacgcgtggtgtcgcatcgggcggctcgacgaggcggacaaagccggtggccagtgcgtccaccacctaggggcgcgaccgactcgtcttccccaccggtctggtgctccatggaggtggctgtctccattggtaccacgcagggccaggcttgttccactggctgcagcgtggacaatgacgtgaagccgaagctctagacggcgatcaaagcagaggaggaacaccagctgagactactctacacccgagtgtcacagtggtggcccatgaatacgcaggctggagctgcgatctcgtcgcagaccatgggtgcaatgggtgcagagacttaggtggatggttctaaatgttcacggcaaaaaaatgtgtggcgcatgggtttctatcctgagggtgcgcagatcggtcgccattagaaagatgcagcttcaactactttggaccaggtgcaaactcatggcagttctgatagggcaccctacacaaatctggagtttgaacacacgacaggtgatatgcttatcttttgtggatggactgttcgcttggcttttgctgattgaattggagctgcacttgtagtttggtaacgtttatatacataactatgcggattgcgttagctagaatatgtcttccagtaccagggtgagtgggtgacaatgggctctaaattttacactaaaatttaagaatccgatcgggttatgatcaggttatatttatatttattattgaactaaaattaatttagggctctaacaaattgtggagaaacattttgaatcgtgatccattatcacccctaccagtaccacatacatacctcccgttgtggtgtttaaccctacgtgcagaccttgtcaccttattttggatcgattccctgttgtatgtggcttgtgctaaaacaagaaacacttgcaactttactagaaattatggtcagactctctttctctgtgttcgtttgattgttgctctggctgtctcctgctaaccaattttgtgggaaattcaacctttgaagcatcaatgtggtgaataatttctcaaaccctcagtatgttttccctaatgctggataaggcgctctcaaaaaggtcagttcctatttgatggtgcattcattatttggttgtgcatggttaatggtgccatctttcttgtatgaatgcctgggactcggccacgacctctgggtgcacctcttcaccaccagcgaggctgtggtcagcgccttcgcctccatgacgccgatgctcatcggctccgtcgtgctggactccacgcagggggtactctgcggcgtcgccaggggctgcaggtggcagcacctggcggcgtggaccaacctggtggccttctatgtcatcggcttgccgctcgccatccttttcggattcacgctcgccttccaaaccaaggggctgtggatggggcagatatgcagcctcctctgccagaactacgtcctcttttttatcaccctgtgaaccaactggcaggagttagacctgaccatgttcaacaaggacaacgattttgtgtgctaggaatctagaaagagtttttattttcttttttgccatgtgctgttgctgaaacattgaaccatcagcatcaggcttcgacagagctgtctggtgtttgctcatcaattcatcatcagtgtaatactacagattataacatttggaatctcgaagataggaattaaaaatgttctgatacgccaaaaaaaaaaaaaaaaaaggcccctagggccaaaaaaaaaaaaaa

SEQ ID NO: 271 - DNA, 2152 bp, Zea mays
acactccgacctaaccgaactagcctgaaactgatggcggacaggaccgaacatagccagcggcacccaagataaaagtcgtataatcgcagtcgcagataccaaagcatagctccgaacaccgcctcggttcatctgcctggtagaggtagcacgccagatcaccagcgatccgcacgtcgcagcagagcaaagatatcgcggggagcaagagtagtcaacgcacgaatggtgggcacggtgtcgctagcggcgggctacggctccgatggcgtgtaccgctcgccgcgcctggtggctgccatcgcctccgacccgggcctctccgtcacggacctcgtccttcgccgcgccgcggcgtgcccctccgcacccgcgctcgtggacgccgcgacgggccgcgccctcaccttcggggccctccgatccgcggtgctcgtcgcggccgccgcgctctcctcccgcgcgggcgtccgccgcggcgacgccgtgctgctcctcgcgcccaactgcgtgctctacccggtctgctttctcgccgtcaccgcgctcggcgccgtcgcgaccacggctaacccgctctacaccccgcgggagatcgccaagcaggccgccgacgcccgcgccaggctcgtcgtcaccgtctccgatctcctgcccaagatctccggtctccgcctccctatcgtcctcctcgacggcgacggcgcccccgtgccttcgggctgccccagcagtaacgtcactctctactcggacctcgtcgccggggtgcaggaggcggagtaccgccacacgccgatcgggcagggcgacacagcggcgctgttctactcgtcgggcacgactggggagagcaagggcgtcgtgctcacgcaccgcaacttcatcgcggcagcgacgatggtgacgtcggaccaggacgagctgggggaaggccacaacgtgttcctctgcttcctgcccatgttccacatcttcggcatgtccgtgatcaccctcggccagctgcagcgcggcaacgccgtcgtcgtgatggcccggttcgacgtcgacgccgtgctggccgccatcgagcggcaccgcgtcacgtacctcttctgcgccccgccggcgatgatcgcgctcgccaagcacagcaggggcggcaggtacgacctcagctcgctcagatgcatcggctctggcgccgcgccgctcggcaaggacgtcatggtggctatggctgacaggttccccggtgtcgacattatccagggttatggtatgactgaaacctgcgggataatatccctggagtacgtacagaagggttgtgcccgtcagtttggttcgactggagcacttgtcacaggagttgaagcaaagatcgttaatgcaaagacaatgaagcatcttcctccgagccaactaggagaaatctgtgttcgaggaccgaacataatggaaggctatttcaacaatgtgcaagcgactgagtctacaatcaagaatggatggttgcataccggtgatcttggatacttcgatgaaagaggccagcttcatgttgtcgatagacttaaagaactgattaagtacaaaggcttccagattgctcctgctgagcttgaaggactgcttttgtctcatccagaaatccttgatgccgctgttatcccgtatcctgatgctgaagcgggggaagttcctatcgcctacgttgtactatcaccgaagagttcactggccgaagctgatgtccagaaatttatcgagaaacaggtcgcgcactacaagaggctgaggaaggtaacgttcgtgggcagcgtaccgaaatctgctgcggggaagattttgaggagagagctcatcgcccaagtcagactgtccaagctgtagcagatttaatctcgatttcactgcagcccttgtcgtctgggttctgctggacacagaagtgcagaatctctgctgagcactgtacaagatttgtctatcaagtcactgtcaggaaccacacatttcagtctagacatgccagacactgatttcttttttttgttaaggaataaagcattctggcctctagtatccacggatgaatgatgtatcctatattgcttggattcttcaagaaagttaaagtaatatataatactacatccgtctc

SEQ ID NO: 272 - DNA, 3398 bp, Zea mays
tcggccacaatattgatgtatttggaaaaaaaatctttcctttgaataacaacggatcatccatgttggtccattcttgtggtgttgtagttgtaccgtcagccatcttgaactttatagtagttacttgtggatcagaagagtattcggtccacaatgtaccaattagctagaaggttggggccgaaatattatggatggtcgctccttcatcccactgtgacaacacatttgtagctcaattgagtttgcccggccgataatctactagtaaatcatacctgaataacttgttcatccatgcatgttgtggaataatagatatacactaattaaggatgaacttgaggctgtagtggtcggttcttactgtgaaggcgcgccccaagagatagggacgctagtgacgcactgccttgacgagcccaatcaactccctctcgtaagccggaagcttcttggggtaaggtgccactgctcggctgaagaccttggtgaagcacgacaccgaagcatgtaccgatgtgtcataatctatgataaggcgcttggagaaatccggcatttgtagtagaggtgtggtcatcagggccttgcttgaatcggtcaaatgcaagcttggtctcattcgtccacgcgaaggcctccggcttcaagagcaccataacaggtgagccacctccctataacctacaatgaacttgcggtagtatccagtgagcccgaggaagccccacaatgcccgcaatgattgagggtcaggttccttcgtcaatcgctctggcgtgagactctatagggtaccgaaggaatctcctctctaagagatttttatttgttcgatgttctgcctattacatcctacgacagtacgacacatatatagagatatgcatctctgactcaatcagaaagccaactaaccaattcaaacaaactagaaaaccacaaactgattcacaataggaagcagcaaaccgattcttaacaaactatttaagtatatctctgtttctaaacttatctgattgccatcttagcaatttttatttctattttttcttgtttttgctgtcctgtctcgatgcgccttctctggtattgggagccatagaaagagtcgataatactgcgccgggtctgtccttcaacaatgcaccaacatctacaacataaatttagtgtcactaaattttaaatgaaatatgtttttatactgtatttatttgaacttgtacatgttttttaacagattggttgaaactagatttatttgacttaaagacaggcagtaattcttttatgaactagtaagattgtattactattatccgaaactgtaacataaaaggtactctaggatccaaaaactaccgactgggttattgtgttgttgcttaactgtcattcgaatatatttgcatttgcattactggatgtgtcactttgccacttttaaatacgtttcataaagcttagcacatgatgtcatttagactgaatattgcagatgttccatttgacattcttgcttagatacacggctaactgatccttttttttctccctcgtagctgcgggttgagcatgacttcccagcaaatcccaagtattttgacataagcaactaagaactccttgcacactcgtgaagctgcagataaaatttgtacataccatttcgtcactaatcaatctttactgcttattaccatcgatgtacagactaaccttgcaatgaaattatttacttcatgtatctatatatatatatattttttatttataaggtagtgcttgtggcttccactagctggtagtagaggtttggttatatcggattgtgagactatggaagctgattggtcgcgggctgtttggataccaggctagaagcctagaatctactaggatcattcttcatatcttctctcgacttgaacccatgctttgtttgcaatgagatgagccaacgtgcggccgcccgggccggtactttctttttttctgttgagcgatgaccttctgttgacctctattgtatatgctttaaatgggctacacgatagaatcagccatcataattcttttgaggacaatggtaacaatcaattttttttgacaatgcaagaaaaaaaaacataagaacgaacaatataaacaattggtattctcgaagtgaacatttcatggttcaaatgtgggtatttctgcatcgggaccatgaagtgcttggtagagaagcctgggcagtatacttctgtaggggtcctcctccctcttctccttcagatagttgatgcagccctccacctcagatttgacttgcaaatagaggcgctgcgccgcctccttgtctcgtagttctttctctctgcctcttgtttcgataggcttcccaaagacgaagtaaaaccgccctggcaccttgggcgcgagcagtagggggtgcattctttggtcttttacctctcccatggaatcagtccttagcctcagcccatcgcggttcaaggcctcgtcgagcatgccatagaagggaaccttctgaaggtcgttgtagtctaacaacaaatggcatatgtcatcctctcccaccactccgaatggtacgatcgtcgccccgaacctggacgccatcctgacgaactcaggctgctccggccagaacaacttgtactcctctccctgaaaacaacagctgtataacaacatacacagtagaagaaacaaaaccacgtacaccgtacacgtactgcaaaaccacaccaccaccaccaccttcctgtgaagcgcttcccgcgcaccccccggatacagcagcacgaactccttgtccgcgaggagcctgtagaagttggcgcccgtcaccggcacagcccccatgacgcggtgcaggtcgaagtgcgccgagtcgggcatgagccgctcggtggccccgtcgaacatgaaggggtgcgccaggccccggacgtggacaccggtgccgctcaggatgcccgtcaccatcggccccagctcgaaccccaggagcatgtggtaccccaccagcacggcgggcccctccctcggcagccccgccaggcccctcactaccctcccgtcgcccagcgtcgacagcatcaccgggtcggtgacaagctttaggaccctgaaagttcagtagcgtagcgtctcagcagagaccgttcttcgtggtcgatagcttgctgcagctcgtctggggtaggaggtatgtagtctgcaacgaagtctgtcctcctggtgcggcggtagtacccggctcccttgatggtcgtggcgaggtcgaagccggcctccttttaggagttgtgagatcggtgaccaaagcatcagacagacagacagacagacagacagacagacagagagagaac

SEQ ID NO: 273 - DNA, 5996 bp, Zea mays
tagatgagagggggcatggagatagagatagaatatagaggggaaagctcgtaggtggagagcgttagcgaccaaccaatggggttggttaaagcttatgtaggcttagatgacgatagtctttgataaatttaaagatctagaaattaaaattcaaaagttttatagttaaacgacactccaagtaaaggtttggtacttgaaaatctgttttgagggtcgccaagggacctggataacacaacaagatagatacatggataacataggaagataagtttaagtaccttttttccgtgtttcactctctggaattcctttttgatcgggccaaagcccatgtagcggtagcactgttccaagtcaatgccccagcgttcgtcgctgactcgctaattcgctatcatcgcggagtgcttatctattgtaaccttaacgttttgtcaggatcgcgtcttgtgcaagccattgaatccttcctctccattgctatccccataccgtgacaacgatcaatgatgtccattattaaataaagcatcaccagctaccaccactaacaaaataggctcacagtttacctggctccactgccgacgggcaagacaaacagccgtggacaagctccgctgctgccggtgacgcggtcgtcgcacgcgcaccgcacacacagggaggcctgctactgtctcactcgtgaaccgtgcagagcagagtgcaggtctcgggcctcgcggtctagactgtgcagcgcgcctgccgaaatcgacgacttgctcaggggaggcccgaggggacccaactgcaacggcgcgccgaggcgcagtcgagggaggtctggcgccgcaagacccgttagaaatcgatgggttctggagtgtccaccccatcatcccaaggtcgcctcgccctcgccgccgacgtcgtcgcggcgccagtcacgggacaagctttcggcgagcgcggccgggtgggtggttgctgcttttgcacgcctcgttctttgtgttcgggcgagcggcgactgcgactgcgatacgctaaactggacgcagtttctggttcgtacgcatttaggttcacgtggctgactgaattgccggccggcgcgctcgctgccacccaccgcggcggcgataagaacgctaggcgtttgaaactttcgcgtccgtggcggcgcgacgcgacaaggagctacgtgccagcgcgtccccccgtctccgtctccgtccctcggggcgttgttgtttattccccagccccccctgttattgaacgcatcgttgacaaaagatgtgacgctgcctgcaactgcaatcagtccccgttccgttttcactttcaccggaacaaaggaaaaagaaaagtgtgtgtgtgtgtgttattgcattattggctcctgcacctactaccgccacgaagcgaccccgacccgttcctcgtcgtcgtcctcttcggatcttcgcttcatccacacaacgtaagctctccgcccttcccagttcggcagttcctcttctcagtcatgctcttcgaccggttgtcgccggtgaccaggcggtgcggtcgatctcttatccaccgtcgttccgctagtatctccctgcttgaagccacgcaagccctgacgacgccgatgattctgcctgccatgtgcagatcgcatccctttttttctctctcaggggaggggcggcgcgtagaggcacgccgccgagcttcgggcatcccatctgacgcgaccggtcttcgggcacgccgccgatcgagctatggacgcgtcgagctccctgtccctcctcgcactggtgaccatgctcagcctcctccactccgccacgaccgacgccgccgcgggtctgccggcggcgcggacgagccaccggaggctactgctgctacaccagcaggacaccaacctcgccgcgctgcctccgcctgcacgcgtgcacgtcgtcccagtcgacgtccacgtcccttctcatggaaccggctcttttccggcagcgtctcccggtccacacgggggcaagaacggtccgagtgaggcagcgccagcgacgccggcgacggcggcggcctatctgtcgagatccatgaggtggctgtacatggttgcggttccggcggtcgccctgctggcgctcgctggactggcgtgctggcttctgtgtcgcaagagcgccgttgccaccattgggccttggaagaccgggctcagtggccagttgcagaaagcgttcgttacaggtactagcactatagtatagtatagtatacgagtactatatatcaaattttctctctggatttgttctcacgtgcttgatctgtcgatcatcaggagtaccgaagctgcagcggtcacagctggaacgtgcctgcgaggacttcagcaacatcgtggtgagctacccgcactacaccgtctacaagggaactctatcgaccggcgtcgagatcgccgtggtgtccaccatgatcacgtcgagcaaggagtggacagagcattcagagagctgcttccggagaaaggtcaccatcagaattgtggacaaaacagcccacccatttgggaatttgtgtgtcgcaaattagcttatttgagttgttgctttgatgaatacaagcaggtagacgccctgtcgcgaataaaccacaagaacttcgtcaacctgctcggcttctgcgaggaggaagaaccgttcaccaggatgatggtgctcgagtacgcgccgaacgggacgctccacgagagccttcatggtaggcacaacagaagctcttcttgctaatacaaccacaccatgcattaattgagcttgagccgcagcagtagcagtgcgtgtcgtcgtagtagctctcaaaaacacttgcgcacgagtgatggactaacagctttgcgggggggaaacaaaacacgttgcagccgaggatttcgagcgcatcgcttggcgaggtaggatgaggatcgtcatgggactagcgtactgcgtccagcacatgcacgagctcagccctcccgtggcgcaccctgacatgcagtcgagctccgtactgctatctgaagacggcgctgcgaaggtacatactcctgtcctgtccagcactccagctctccatgtgtttagctagctactagcctacagcttggtgttccaacctctgagttcccccctgcctgcagatagcggacatgagcgtttggcacgaagtgatttctcaaggcaaaacgacgacaaatggtgacgaacaagcgtcgtccgctggcctgctggcggggaatgtgtacagcttcggtgctctgctgcttgagatcatctccgggaagcttccgactccataccccgcacacgagcgctccctgcagatgacctcggtaacgagctatcgacggaacaccgttatgtttctaacaaccagaagaagaacaccaaatggtgacgttatgtttcttcttcttcttcttcttcttcttcttcttcttcttcctaggctctggtggagcgcgtaaccaacgacgaccggagcgtagcctcgttgcttgatccaacgctgggtggagaccacagggaagacgagctagcggtcatcggcgaggtgatccgggcctgcatgcagagcgacccgaggcgaaggccgagcatgagggaggtcgccgccaggctgagggaggccgtgggtatctcgccggtcgctgcgacgccgaggctgtctccgctctggtgggccgagctggaggtcctttccgccgcggaagcaagctaataatagtgggcgagaggacagggcaggaacaggaacagggcaggatgatgtcgcgcaatctgaccagtttgttctcaagaaaagaaagccttgcagccctttgtgcatgctgtaaatgtgaatgtgaagctgcagggaaggaatagtaatccgtgaatgtaaatctgaaactctgaaggtgctagatgtacgtagctagtgtcttggcaaaggtatcagtaattcagtataaagtcagagcagcactctccctgccttgtcccagcccaggacaggcacgccgctcgccatggccggcaacccgccatggcgccatacaaaacctcaattattgataccggaatgcaggaagttagaaacctgatctcgggggcactactaactagcagacaacactagcaagctatccacattgtctctctctccccagctccaactattcgaatcgaggatgaggccgccgagaaggctctcctgtttaaagctgggtgaacagtgtgcaaaatatctgctgctctgcagccgtgcagccatccagatgggataacccaaaacttttctttgcctcacacggcacaaacttctatgctccagctgctgctgcgcgctcgtctgtcaccaaacctcatgaaacagctgactactgggaccaaccaaaccgtgcgtcgctacacaccacacccattggcacgtccgggccacatgtcacccctccgcccggcgtgacggcgtcgccgtccagaaccaaacggccagtgctctgggcacacacggccccctgcatgcgcgccacctcatacgcccgcagccgtccgttcgcctccgctccacgcgtggccgcctgcatgaccggccgcaccctataaagtccaccgcccacgcgtggtcgtcgttgacacacctcccgagccccgcccgccgcgcgccccccctgcaccggtgcgcggtgcgccctgctgcccgattcgtcggggggcgcgggaatggagctggagctggaggcggcggcccggcgcttccacctctggttccgcgggctgcgctcgctgcgccgggacctggcgtcggcccggtggtcggacgacccgacggcccagctccccgcgcaggtgggccgcttcgtggcccacctggagtcgtactgcgccgcgcgcgccgggctggacccggtgtggacgctgtcggcgccgtgggccacccccgcggagcgcggcgccgcgtactggctcgccgggtggcgccccaccacgctggtccacctgctgtacaccgagtccgggcgccgcctcgaggcgcagctgccggacctcctcctcggcgtgcggtcggggaaccttggcgacctcacccccgcgcagctggcgcaggtcgacgacctgcagcgccgcacggtggccgaggaggacgcgctggcaagggagatggcgctcgtgcaggagggccacggcgtcgtcgtgctgccggcggcgccggacgggtccggcggactcgacgtggccggcctcgtgcgcagggccagggcggtgctggacagggccgacgcgctgcggctgcgcaccgtgaagcgggcggtggagatactggagccggcacaggcggccgagctgctcgtcgccgccgccgacctggagatcgggttccgggagttcgggctcaagcacgggtcgggacgaatgacatgactgccccagtttttttcgagctcccctgcacttcccgccattttatttttctttctttttttttctcctcacgattttgccgagttgtacccggctgggccgtcgtgacagggcacggaaacacgaataaaaaatgcacgagattgacttatgagaaaaaaaaaaaaaccaagccaaatcgacctcccctacggacttcgaaaattaacagttcatggttgaggaaagagactggctaacagttatggaaattttaaaatatatttagttaaaataactgttaattatagatgtgttgttatggtaacatggtggtaaattatggtaacatgggaaaatccggaaaatctatagtagaagatgattttgaattgagttagagatttattgatattttattttattttacagcaaatctgatttaaaaaataaatcaaacgcactcttagacctagtttagcaatttttggaaatgggagagattaaaggatggggttggaaatatatttgatagaagatttttgacctttttacaaaattattaac

SEQ ID NO: 274 - DNA, 2017 bp, Zea mays
gggtacctcgaggccggccggacgaagcgaccccgacccgttcctcgtcgtcgtcctcttcggatcttcgcttcatccacacaccatcgcatcccttttttctctctctcaggggaggggcggcgcgtagaggcacgccgccgagcttcgggcatcccatctgacgcgaccggtcttcgggcacgccgccgatcgagctatggacgcgtcgagctccctgtccctcctagcactggtgaccatactcagcctcctccactccgccacgaccgacgcagccgcgggtctgccggcggcgcggccgagccaccggaggctactgctgctacaccagccggacaccaacctcgccgcgctgcctccacctgcacgcgtgcacgtcgtcccagtcgacgtccacgtcccttctcatggaaccggctcttttccggcagcgtctcccggtccacacgggggcaagaacggtccgagtgaggcagcgccagcgacgccggcgacggcggcctatctgtcgagatccatgaggtggctgtacatggttgcggttccggcggtcgccctgctggcgctcgctggactggcgtgctggcttctgtgtcgcaagagcgccgttgccaccattgggccttggaagaccgggctcagtggccagttgcagaaagcgttcgttacaggagtaccgaagctgcagcggtcagagctggaacgtgcctgcgaggacttcagcaacatcgtggtgagctacccgcactacaccgtctacaagggaactctatcgaccggcgtcgagatcgccgtggtgtccaccatgatcacgtcgagcaaggagtggacagagcattcagagagctgcttccggagaaaggtagacgccctgtcgcgaataaaccacaagaacttcgtcaacctgctcggcttctgcgaggaggaagaaccgttcaccaggatgatggtgctcgagtacgcgccgaacgggacgctccacgagagccttcatgccgaggatttcgagcgcatcgcttggcgaggtaggatgaggatcgtcatgggactagcgtactgcgtccagcacatgcacgagctcagccctcccgtggcgcaccctgacatgcagtcgagctccgtactgctatctgaagacggcgctgcgaagatagcggacatgagcgtttggcacgaagtgatttctcaaggcaaaacgacgacaaatggtgacgaacaagcgtcgtccgctggcctgctggcggggaatgtgtacagcttcggtgctctgctgcttgagatcatctccgggaagcttccgactccataccccgcacacgagcgctccctgcagatgacctcggtaacgagctatcgacggaacaccgttatgtttctaacaaccagaagaagaacaccaaatggtgacgttatgtttcttcttcttcttcttcttcttcttcttcttcttcttcctcccgcacacgcgcgctccctgcaggctctggtggagcgcgtaaccaacgacgaccggagcgtagcctcgttgcttgatccaacgctgggtggagaccacagggaagacgagctagcggtcatcggcgaggtgatccgggcctgcatgcagagcgacccgaggcgaaggccgagcatgagggaggtcgccgccaggctgagggaggccgtgggtatctcgccggtcgctgcgacgccgaggctgtctccgctctggtgggccgagctggaggtcctttccgccgcggaagcaagctaataatagtgggcgagaggacagggcaggaacaggaacagggcaggatgatgtcgcgcaatctgaccagtttgttctcaagaaaaaaaagccttgcagccctttgtgcatgctgtaaatgtgaatgtgaagctgtagggaaggaatagtaatccgtgaatgtaaatctgaaactctgaaggtgctagatgtacgtagctagtgtcttggcaaaggtatcaatcagtaattcaagcccccacccaaaaaaaaaaaaggccccta

SEQ ID NO: 275 - DNA, 1705 bp, Zea mays
gcacgagaccattacctagaacatcctaatcgaaaaactcgggttggttagaagaacccaatgcaagtgtgagtgagctgacggcacggcggacgcgctcgcctctcctctcctctcctctcctctcctcttcttccggctctccctctccgcatgccattccaacgcattaccggtatttttagccgccggaggagacgggtagctgcgtagccactagcgagagagagagggaggggagaaaccatagctcctggccgttctgcctgcccatccaccgcggcgccggccgtccgtctcccgtccacatccctcctcctctcctgcaaggttcctgtgcggtatggtatgctagctcggctccctgtggattcccccctcatccggaatgtgatggcgcggtggatggtgttttgatctgtgttcgcttttggcggatctggtcgcgcgcagtagcgcagaggggtcggagtcggagtcggagtcggagaagatgatgggcgggttcctctccagggtcctcctgttggcttttggctatgcctatcctgcctacgaatgctacaagactgttgaactgaacaaaccagagattgcgcagctcatattttggtgtcagtattggattttagttgccctgttgacagttttggagagattcggagatttcacaatatcatggctaccgttctactcggaagcaaagctgatgttctttgtatacttgtggtaccctaagacaaagggaactacgtatgtttatggaactttctttaaaccatatatttctcagcatgagaatgaaatcgaccggaatctccttgagctgagagctcgagccaccgacacggttgtactttattttcagaaggctgcttcggcaggacaaagtactttctttgacgttttaaaatatgttgctgcccagtcaccttctcagaaatcaaggcaacgccttcatcaggaatcacagcagccgccacaacaacagcaaccacaagtgcaggtgcagcaggcgcaaccacaaaaacaagcagcacctgttatgcgcagagcatcatctattgctgctcggcaagcagcaatggcacagcaatctcaggagactaaacccgtttcatcttcgcccaagatcaagcgtcaaacatcagcgagatctggttcagtggcatccacaaagcctccggtagctgcatccgcgctaaaacctggtggtagcccaaagaaaggcgaggtcaaacctgctgccgacccagttcaaactccaaccacaggtgccgattcaccgaaacccgagcctagcgccccatcactccctggagccgaaggggtggacaagatggccatcgacgaggccagtggtgacgccccagagggcgcagaagagcttgaccctgcgctcgaagaggagacgccgatggaggagacgatccgtgtgacgcgcgccaagctaaggaggcgcacggccaccgaagatcctgctgggaattagctgtaggccattgtttttcctttccctgcacattgtgttgatctttttttgggttttaggctgtcatgttgtttggtggaatggagatgtgttgttgaattggttctttgtgacacagttgattatcttgtttctgtgcttttttggtgcccttttcttgttatttaagttgtaagtaacactttctctccgcaaataaaaaaaaaaaaaaaa

SEQ ID NO: 276 - DNA, 1651 bp, Zea mays
  misc_feature (7)..(8): n is a, c, g, or t
  misc_feature (12)..(12): n is a, c, g, or t
  misc_feature (15)..(16): n is a, c, g, or t
  misc_feature (18)..(19): n is a, c, g, or t
gcacgannccantanntnnaacatcctaatcaaaaaactcgggttggttagaagaacccaatgcaagtgtgagtgagctgacggcacggcggacgcgctcgcctctcctctcctctcctctcctctcctcttcttccggctctccctctccgcatgccattccaacgcattaccggtatttttagccgccggaggagacgggtagctgcgtagccactagcgagagagagagggaggggagaaaccatagctcctggccgttctgcctgcccatccaccgcggcgccggccgtccgtctcccgtccacatccctcctcctctcctgcaaggttcctgtgcggtatgtagcgcagaggggtcggagtcggagtcggagtcggagaagatgatgggcgggttcctctccagggtcctcctgttggcttttggctatgcctatcctgcctacgaatgctacaagactgttgaactgaacaaaccagagattgcgcagctcatattttggtgtcagtattggattttagttgccctgttgacagttttggagagattcggagatttcacaatatcatggctaccgttctactcggaagcaaagctgatgttctttgtatacttgtggtaccctaagacaaagggaactacgtatgtttatggaactttctttaaaccatatatttctcagcatgagaatgaaatcgaccggaatctccttgagctgagagctcgagccaccgacacggttgtactttattttcagaaggctgcttcggcaggacaaagtactttctttgacgttttaaaatatgttgctgcccagtcaccttctcagaaatcaaggcaacgccttcatcaggattcacagcagccgccacaacaacaacaaccacaagtgcaggtgcagcaggcgcaaccacaaaaacaagcagcacctgttatgcgcagagcatcatctattgctgctcggcaagcagcaatggcacagcaatctcaggagactaaacccgtttcatcttcgcccaagatcaagcgtcaaacatcagcgagatctggttcagtggcatccacaaagcctccggtagctgcatccgcgctaaaacctggtggtagcccaaagaaaggcgaggtcaaacctgctgccgacccagttcaaactccaaccacaggtgccgattcaccgaaacccgagcctagcgccccatcactccctggagccgaaggggtggacaagatggccatcgacgaggccagtggtgacgccccagagggcgcagaagagcttgaccctgcgctcgaagaggagacgccgatggaggagacgatccgtgtgacgcgcgccaagctaaggaggcgcacggccaccgaagatcctgctgggaattagctgtaggccattgtttttcctttccctgcacattgtgttgatctttttttgggttttaggctgtcatgttgtttggtggaatggagatgtgttgttgaattggttctttgtgacacagttgattatcttgtttctgtgcttttttggtgcccttttcttgttatttaagttgtaagtaacactttctctccgcatgtgaatacaggttagcggcacgagcaaagaacgcatgcgattgcaacaaaaaaaaaaaaaaaaaactcgag

SEQ ID NO: 277 - DNA, 1853 bp, Zea mays
aattcggcacgagggtcgctcgctggtacacccatgcggccatgcgccatggttcagcttgaacaggggaggagaggagcagagcgagagggcagtcgggttggttagaagaacccaatgcaagtgtgagtgagctgacggcacggcggacgcgctcgcctctcctctcttctcctctcctcttcttccggctctccctctccgcatgccattccaacgcattaccggtatttttagccaccggaggagacgggtagctgcgtagccacactagcgagagagagagagagagagagagagagagagggagggaggggaaaccatagctcctggccgttccgcgctcctcacggccggcctcagtcccttctgcctgcccatccaccgcggcgccggccggccgtctcccgtccacatccctcctcctctcctgcaaggttcctgtgcggtatggtatgctagctcggctccctgtggtttcccccctcatccggaatgtgatggcgcggtggatggtgttttgatctgtgttcgcttttggcggatctggtcgcgcgcagtagcgcagaggggtcggagtcggagtcggagtcggagaagatgatgggcgggttcctctccagggtcctcctgttggcttttggctatgcctatcctgcctacgaatgctacaagactgttgaactgaacaaaccagagattgcgcagctcatattttggtgtcagtattggattttagttgccctattgacagttttggagagattcggagatttcacaatatcatggctaccgttttactcggaagcaaagctgatgttctttgtatacttggggtaccctaagacaaagggaactacgtatgtttatggaactttctttaaaccatatatttctcagcatgagaatgaaatcgaccggaatctccttgagctgagagctcgagccaccgacacagttgtactttattttcagaaggctgctttggcaggacaaagtactttctttgacgttttaaaatatgttgttgcccagtcaccttctcagaaatcaaggcaacgccttcatcaggaatcacagcagccgccacaacaacagcaaccacaagtgcaggtgcagcaggcgcaaccacaaaaacaagcggcacctgttatgcgcagagcatcatctattgctgctcggcaagcagcaatggcacaacaatctcaggagactaaacccgtttcatcttcgcccaagatcaagcgtcaaacatcagcgagatctggttcagtggcatccacaaagcctccggtagctgcatccgcgctaaaacctggtggtagcccaaagaaaggcgaggtcaaacctgctgccgacccagttcaaactccaaccacaggtgccgattcaccgaaacccgagcctagcgtcccatcactccctggagccgaaggggtggacaagatggccatcgacgaggccagtggtgacgccccagagggcgcagaagagcttgaccctgcgctcgaagaggagacgccgatggaggagacgatccgtgtgacgcgtgccaagctaaggaggcgcacgaccaccgaagatcctgctgggaattagctgcaggccatcgtttttcctttccctgcacattgtgttgatcttttattttttttggggggggggggtttaggctgtcatgttgtttggtggaatggagatgtgatgttgaattggttctttgtgacacagttgattatcctgtttctgtgctttcttggtgcccttttcttgttatttaagttgtaagtaacactttccctccgcatgtgaatacaagttagtggcacgggcaacgaacgcctgcgattgca

SEQ ID NO: 278 - DNA, 1813 bp, Zea mays
aagaatgttgctggtacacccatggttgaacttgaactggagaggcagtagccagagtgtgagctgacggcggacgtgctcgcctctcctctcctcacatttccggctcccctctccgcattccatggcaccgcattaccggtatttttagccgccggaggagacgggttgcgtagagagaggggaaaccagagctcctgactgttcctctctccctcctcacgggcgggctccgtctgttccgtccatccaccgccccggtcgtctcccggccagatccctctcctgcaaggtttctttgcgagtggccggagaagatgatgggcgggttcctctccagggtcctcctgctggcttttggctatgcctatcctgcctatgaatgctacaagaccgttgaactgaacaaaccacagattgagcagctcatattttggtgtcagtattggattttagttgccctgttgacagttttggagagatttggagattttacaatatcatggctaccgttttactcagaagcaaaggtgttgttctttgtatatttgtggtaccctaagacaaagggaactacgtatgtttatggaactttctttaagccatatatttctcagcatgagaatgaaatcgaccgaaatcttcttgagctcagagctcgagccaccgatatggttgtcctttacttccataaggctgcttcggtagggcaaaatactttctttgacgttttaaaatatgttgctgcccagtccccttctcggaaatcaaggctgcaccctcatcaggaaccacagcagcagcaaccacaagtgcaggtggagctgcagcagccgcaaccacaaaaacaagcagcacctgttatgcgcagaggagcatctattgctgctcggcaagcagcaatggcacagcaatctctggagactatacccgttccatcttcacccaagatcaagcgtcaaacatcagggagacctggttcggtggcatccacaaagcctgcagcagctgcatccacaccaaaacctggcggtagcccaaagaaaggtgaggtcaaacctgctgtcgacccagttcaaactccagccacaagtgcagattcaccaaaatccgagcctagtgccccaccactttctgagaccgaagaagtagacaacatggcaatcgatgaggtcagtggtgatgctgcagagggcgcggaagagcttgaccctgcgctcgaggagacgccgatggaggagacgatccgtgtgacgcgcgccaagctaaggaggcgcaccgccaccgaggattctgctgggaattagctgcatgccgttgttttccctgcacattgtattgatctttttccgagttttaggctcacatgttgtttgctggaatggagatatgttgttgttcacttggttcttgtgacacagagttaattatcttatttccgtgctttcttagtacctttttgtgtgatttaagttgtaaataacagttcccctccgcatttgtatatagtttagcggcatgggcaacgaatgcctgtaattgcaacattacacgcttcaatctggtcactccttgggtatcttctcaagatgtgtcattcaacagttctcattcgctggggcctggggcaaacaagcgcagcgggttctcctgtcattttccatgtaccagtacttcaatacttgtttgtatcacttccctggtacacgctacggtcacggtgtgtaggggtgggtttggataggggtccatctgggtttctcagttctttctaatcattggaaggtgctctctaaaatacagtttttatatt

SEQ ID NO: 279 - DNA, 1971 bp, Zea mays
ctgcaggtgatccaatatgatttgtgtttgcctttgattttgctgattccagtttcatttgcttttacttttctgatagtatcattacctggcatcatagcaaggtgctgtttaatataaattggttcatcacttcattgccgtcgagtattctaaagcaataatttctcagtgagacaattgcatgtccaatttaatatgaaaatcggtttctctttatgtttggttggattttgccttgtcaacttaatttgtaccttctcgtggagatgcatattgattccttttgtattcatttctaaataaatgcttgcaaactttgtttgttggttatcatcttagaatttcgtgttccttattattatgctgtttagtgttcacgtgcgttgtcttgttttacaggaataggtattcaagttttgtatcaccaagatggtgcagtacaattttaagaagatcacggttgtccctcctgggaaggacttcattgacataatcctgtcccgcacccaaaggcagacaccgacagttgtccacaagggatatgctatctcccgcattcgtcagttttatatgcgcaaggttaggtattcccagcagaacttctatgaaaagctctcgaccatcatagatgagtttcctcgactggatgacatccaccctttctatggtgatctcctccatgtgctctacaacaaggatcactacaagcttgccctgggtcagattaacacagctaggaacatcattgcaaagatatccaaggactacttgaggttgctcaagtatggagactctctttaccggtgcaagtgtctgaaggtggctgcactaggtcgcatgtgcactgtcgttaagaggatcagtcctagtttggcttacttagagcagatccgacagcacatggctaggcttccatccatagacccaaacacccgtactgtgctgatttgtggatatccaaatgtggggaagagttcgttcatgaacaaggttacaagggcagatgtggatgtccagccatatgcctttacaacaaaatccctgtttgttggccacacagattacaagtacctgcgctaccaagtgattgacacaccaggtatacttgaccggccttttgaagataggaacatcatagaaatgtgtagcatcactgcgctggcacacttgagggctgcagtgttgttctttctggacatttctggatcttgtgggtacagtatcgctcagcaagctgcactcttccacagtataaagtctctgtttatgaataagcctttggtcattgtgtgcaacaagactgacttgcagccacttgaagggctttctgaggatgacatgaagttagtcatggagatgaaggcagaggctatgaagactataactcaagctgttggtcctaatgaagagggcggtttgttgactatgagcactttaacagatgatggtgttatggctgtgaaaaatgctgcgtgcgagaggcttcttgaacagagggtggatgtgaagatgaaatcaaagaagatgatggattgcttgaataggtttcatgttgctgttccaaagcctcgtgacaacaaggaacggcctgtttgcatccctccggctgttctggaagctagggcaaatgctgctgctaaggaaaagaagaagcttgagaaggacattgagaatgagaatggaggtgctggggtatattctgcgggtctcaagaaacattatatattggctaatgatgaatggaaggaagatattcttccagagatactggatggtcacaacgttgcagattttctggatccggatatcctagtaaggtgtgaagagttggaaagggaggcggcgcctcccctggaagaacatgctgcagaagatgctttctagattgatggccatgaactatctcatgaacagatggagattctggctcagattaggatgaataaggcattacttatccaagaacat

SEQ ID NO: 280 - DNA, 899 bp, Zea mays
  misc_feature (858)..(858): n is a, c, g, or t
ctggggtcccccgggccggccgggcttttcccgtccgccgccagagcggggaacacctgcaccgccttcaccagcacttgccggagaggacgtgacctctcccgccgacaaatcggtcctcttcgtccgggcgtttatcaaggaataggtattcaagttttgtatcaccaagatggtgcagtacaattttaagaagatcacggttgtccctcctgggaaggacttcattgacataatcctgtcccgcacccaaaggcagacaccgacagttgtccacaagggatatgctatctcccgcattcgtcagttttatatgcgcaaggttaggtattcccagcagaacttctatgaaaagctctcgaccatcatagatgagtttcctcgactggatgacatccaccctttctatggtgatctcctccatgtgctctacaacaaggatcactacaagcttgccctgggtcagattaacacagctaggaacatcattgcaaagatatccaaggactacttgaggttgctcaagtatggagactctctttaccggtgcaagtgtctgaaggtggctgcactaggtcgcatgtgcactgtcgttaagaggatcagtcctagtttggcttacttagagcagatccgacagcacatggctaggcttccatccatagacccaaacacccgtactgtgctgatttgtggatatccaaatgtgggggaagagttctttcatgaacaaggttacaagggcagatgtggatgtccagccgtatgcctttacaacgaaatccctgtttgttggtcatacagattacaagtacctgcgctaccaagtgattgacacaccgggtatacttgatcggnctttttgaagatagaacatcatagaaatgtgcagcatcact

SEQ ID NO: 281 - DNA, 834 bp, Zea mays
  misc_feature (9)..(9): n is a, c, g, or t
ggtaccctncgcggcccgggccggcggaaccctcattaccccgtccgccgccagagcgggagaacacccgcgccgcctccagcagcacttggcggagagggcgcgacctctcttgccgacaaatcggtcctcttcctccgagcgcctaacgaggaataggtattcaagttttgtatcaccaagatggtgcaatacaatttcaagaagatcactgttgtccctcctgggaaggacttcattgacataatcctgtcccgcactcaacggcagacaccgactgttgtccacaagggatatgctatctcccgcattcgccagttttacatgcgcaaggttaggtattcccagcagaacttctatgaaaagctctccaccatcattgatgagtttcctcgactggatgacatccaccctttctatggtgatctcctccacgtgctctacaacaaggatcactacaagcttgcgctgggtcaaatcaacacagctaggaacatcattgcaaagatatccaaggactacttgaggctgctcaagtatggagactccctttaccggtgcaagtgtttgaaggtggctgcactaggtcgcatgtgcactgtcgtgaagaggatcagtcctagtttggcttacttggagcagatcaggcagcatatggccaggcttccatccatagacccgaacacccgtactgtgctgatttgtggatatccaaatgtggggaagagttcgttcatgaacaaggttacaagggcagatgtggatgtccagccatatgcctttacaacaaaatcccctgtttgttgggcacacagaatacaagtacctgcgcta

SEQ ID NO: 282 - DNA, 1101 bp, Zea mays
  misc_feature (14)..(14): n is a, c, g, or t
gaggccggccgggnagttacttccattggggacaagacgtctcccacccaagggcacataggctctgggctctggcgctaatgttcgagcaaggcgctgctcctgttgctgtagaagggattttttgaccaaccctccaaccggtgcggcttcgatctttcctctcctatcacctgaatccctcgagtattcatcgccggcgcagcgcggtctcttcccttcgctggagaagggggaaggggacacgaacggagcagaaggccatggacacgatgcggggcgcgctggagcgggccaagatgctggtgggcatggaggtcgacgaggagtccgcgttgccaccgcccgaggagcagtccttcttcgacgacatcaatcggcactgcaccctcaacaccactcagaggctctatggtttcgcgatatgcttggctgccggactgacgtgcacattcttgtcaatgcttgtcttcttcaatccagtgaaatttggggtagcattcacccttggcaatttgatggcccttggaagtacagcatttctcataggccccaaaagacagtttgatatgatgcttgattctgtgcgaatatatgccactgctatatatattgcaagcatcataattgctctattctgtgctatctacgttcgcagcaagctgctgactctagtggccatcattttggaatttggtgcccttatttggtacagccttagctacatacctttcgcaaggtcgattgtgtcgaaggtgatgacatcgtgcttcgacactgatttctagaccaatcttcattgcctatgtctttcactgtggggcgagtagatattgtaatctagtgacaagtgaagaggaagtggcagtgaccttaaattacccctccaacaggctcttgttgtaatcatcgtgaatcgagctgtgcattttatgctaagactagaagatcgtgttgatattgcaaaaaaaaaaaaaaaacctacacttgcaatccacgcttcgctttccatctgcgaggagtgcccagcacagcgcagcacatgcatagaacaacaatattgttctgccatttgctgaatattgatgtagattccatggt

SEQ ID NO: 283 - DNA, 1920 bp, Zea mays
cattgggtacctcgaggccgaacgaatcagctctggtccacggccccatcgcatatgcacccttcgaccccggccgtagacacatgcgatgcacctgcaggcaggcggcgccgcgcacctccacctccagtatttcatgccccagcaccaaccgcaggaaccagccaccgacctagaggcgcaggagtcgtcggccgtgtgcaggcgcagctcgtccacttcgccgccggcgcctactaccatgtgggagtatcaccaggcggcgcatgcggcggccttgcagacgacctcgtcgccggcgtcttctttcccttcctggagcccttacgccgggactacggcggcgctcctcggcgccagctcggcctttatttccaccgacgccgccggcgccgactcgtcgtcgcccggcatgcgccttctgccagcgggggagcacggcggcggccatgcatacggcgaacaaagcaacatcgcatgctacaaggagaacttcctcgacctgctcgcgtcgaagaacgtgacacaggagatgttcgacgacgtccccgccggtcactacaccgcgcaggcgctgctgtcaggaaggttcgcggcaggctctgatgttgcaccgccggtcaagtacgaggtcaccggcggctcgccgctgttcttcgggagtgctgcagcagctgcaggtggtatgcaccagcaggggatggacatggcgggttgcacgacgccgcggtacacctacggcgccgaccaccaccagatgaaggaaggcggtgaccagcagcaagagcttgcgtccccggccatggcttcctttcttcagcagctgagttcaaacgctggtggtggtggtggtgttggcatgcatgctgctagcatggactactcaggcacaggaggaggactcgacaggatttgccatgagagtcgggcattggaagctggacctttcggcatgaggagcttgccggatctcagctcttttggtggctacagcagatcaacgaccgcagaatcgacatcgtcggcgcagccatacctgcagagatccagcagtctcgctgaaagcagtaggcaacaagagccggatattgtgtcggcaaggagcagcagcagtggcagtggagcagcgagcgagcagcgaaagaagcgggcgtccgaggaaaggacgagcaccgtgaagaagtccaagcaagagggctctaaaccatctcctcccaagcagcaacaggtgcctaaagtgaagatcggagagaagatcacagcattgcaacagatcgtttcgccatttgggaagactgatacagcgtcagtgctgtttgaaacgatcaagtacatcaagttcctgcatgaacaagtacagctactcagcgagccgtacacgaactcgagcaggagcaagggtaataaccacttcccatggggagatcatcgtgctgctgcagagacgagcaagcagggagatgaggcagagcacgacctgagtgacagagggctctgcctggtccctgtctcgtggaccccgcaagtctaccgggacgggactgccatggactactggacgccggcgtacaggggctgcctgtaccgatgagatgacaactccctcgtctgactagttgctcaaacattccttactgtcagtgactggtctgcacaggacggcagcgcagttgatctccttaactatgttgcatgtggtccctagctagtttgtagtgctggtttgtattattgtttaatttgcagtgtcgtgtttgctgatttgtgctagctaatgagtactgaagggattatctggataaaaccacctttagcctctcatatctgtaacgtacgagatgctgcaccacagcataagaatgtgtttgcctgtttaaatgagctgctagtgattattacagaacaaaaaaaaaaaaaaaa

SEQ ID NO: 284 - DNA, 1008 bp, Zea mays
agcttgccggatctcagctcttttggtggctacagcagatcaacgaccgtagaatcgacatcgtcggcgcagccatacctgcagagatccagcagtctcgctgaaagcagtaggcaacaagagccggatattgtgtcggcaaggagcagcagcagtggcagtggagcagcgagcgagcagcgaaagaagcgggcgtccgaggaaaggacgagcaccgtgaagaagtccaagcaagagggctctaaaccatctcctcccaagcagcaacaagtgcctaaagtgaagatcggagagaagatcacagcattgcaacagatcgtttcgccatttgggaagactgatacagcgtcagtgctgtttgaaacgatcaagtacatcaagttcctgcatgaacaagtacagctactcagcgagccgtacacgaactcgagcaggagcaagggtaataaccacttcccatggggagatcatcgtgctgctgcagagacgagcaagcagggagatgaggcagagcacgacctgagtgacagaggactctgcctggtccctgtctcgtggaccccgcaagtctaccgggacgggactgccatggactactggacgccggcgtacaggggctgcctgtaccgatgagatgacaactccctcgtctgactagttgctcaaacattccttactgtcagtgtctggtctgcctctgcctccaagttgcacaggacggcagcgcagttgatctgcttaactatgttgcatgtggtccctagctagtttgtagtgctggtttgtattattgtttcatttgcagtgtcgtgtttgctgatttgtgctagctaatgagtactgaaggaattatcttgataaaaccacctttagcctctcatatctgtaacgtacgagatgctgcaccacagcataagaatgtgtttgcctgtttaaatgagctgctagtgattattacagaacttatatggtgtcggtcatctggactaatatatacgtttgtgcatg

SEQ ID NO: 285 - DNA, 903 bp, Zea mays
ctcgaggggccggcactcgacacacacacccggacgcacggcactcagcaccaattcgctggaggcgaggaggaaccgtacgcgcctcattacgcccatccacgtgctcgcctctccccatcgcataattttcctcggcggcgtcgccatctcaccggcggcgggcctgcggccggcaaccggaggcgatggcgagctcgtctgtggcggcggacatggagctggaccgccccaacctggaggactacctcccgcccgactcgctcccgcaggaggcgcccaggaatctccatctgcgcgatctgcttgacatctcgccggtgctaaccgaggcagcgggtgccatagtcgatgattcattcacccgttgctttaagtcgaattctccagaaccatggaactggaacatatatttgttccctttatggtgcttcggtgtagtaattcgatatggattactcttcccactgaggtccttaacgcttgcaataggatggttagcattttttgctgccttttttcccgtgcatttcctattgaaaggtcaagacaagttgagaagtaaaattgagaggaagttggttgaaatgatgtgcagtgtttttgttgcttcatggactggagtgatcaagtaccatggaccacgcccaagcacacgacctcatcaggtatttgttgcaaaccatacatcaatgatagatttcattattctggagcaaatgacagcatttgctgtcatcatgcagaagcatcctgggatgggttggatttattcagaagactatcttggaaagtgtgggttgcatctggtttaaccgtaatgatctccgggatcgtgaaagtacggcacggaagttgcgtgaccatgttcaacagccagacaaaaaccctctcttgattttc

SEQ ID NO: 286 - DNA, 2741 bp, Zea mays
taatatgatcccagtccatattaacaacagcaagcctgtgagtttccttgtcaatcataggtgtatcatcatgccttcccattaagtaatgagcaatgtcactgccaacagagcactattggaaaaataaaaaacaagaattagccataaaaaattggcatgttgtagcatagcatattatgttcttccaggcaaagaactatatagaactttaaaaaatatcctctaagcatcagaaaattggaagtaacaagactggtaaaaacaaaataataaaacatgcaataggatagagcatagaaacacaggaaactgaatttgcaataaaaatattgtatcaacaaaattctgaaaatattacccctattcccacccccacccaaaaaaaaacaaaggaaaatttgatttttgtggctccacatgtgcaccatagtacgagtagattttcacacttacagaagatgaggtgcattatgaagaatagaagcactcccaatgttttcctgggtgcaggcttcagcagttgtttggttgtgtaagtctataatcgcaagcatatatcttggacaattacagatataagcatactacttcacttaaaacagggattgaagcaatgttactgagatgtccataatcaagtgtgctatgttgaaatgcaatacagaaatacatatatctatatgactcagtccagaattgagccgtgagtcctgaggtctgcatgaaaaatagatcctagagactagaatacaataacttgcgctgcaataaaactagcgcattagtccacgtgagataaaattaagaaactaatagttaaacataaccaatcgggctattgtaaacaggaaggtctccaatgctcattgttctcaagaatctaaagtatattatcaacagttgaaaacaagggcatgaagccagtatgaccgtgctggtttaagataggtgcaatagttggcgcaagagctaaagagcatagaccttgcactaacataggacgacagaaaatggaagaaagctgcaaaacttatagaaagtaactcccggcctcggccagagcaaatcaagctgaatgtaagctaaatcatcaaaaggactggaagaaaagcgtcacctcttcgtcgtcgtcatccaaatcttcatcttcgtcgtcatcgctgctagagctctcttcttcctcctgttcctctagttcctcttcatcttcctcctcttcttgaacaagcactggtttcttttttttttctttttccttccccttcccatcatcctccaagtcctcttggttgagatagtaatgcagcatggggttctcgcgtttcttgcggcgcctcccgcgcttgtccacgggcgccgccgacgaggcgaacctcgggtccgtcatcatgctgctgaacctcgagtccagcgccaccttggattccttcctccgcatcggccggaaccgcgggtcagtccgcgccgccgcgaaccgctcgtcctccatcgcacgcctcatcttctcgtccctccccacggccgcctcggcttcctctccctttccctcggacttgcgctccttcttggacttctggccgtcccgcttctcctcgcgcccgtccctgtgcttacgcttcttgcgctcggcggcgtcgggtatcggggcgtcctctgcggcggcgcgcgccttatttgttttcttgtgcttcttctcttctatatcgatcttggatttcctggccttcttgtggcgtgcggtctcgtcggtgctggccggcggcgccatggcggctggctgctacaaaggcgagggcgcggcgccgggggagggatgctcacctcgagggctggttcaactcaaggaagatcaccctctcccttaagcgatccttttgggccaggcccggccgcaaagattgcctttgagccaaccgagccagcccatggaccttctgcaagttggggcccgctagtttatgagccgcatctactcgttggtgcgatttccactcgactcacacccggccgcacggcactcagcaccaattcgctggaggagaggaggaaccgtacgcgcctcattacgcccatccacgtgctcgcctctccccatcggcccatcgcataattttcctcggcggcgtcgccatctcaccggcggcgggcctgcggccggcaaccggaggcgatggcgagctcgtctgtggcggcggacatggagctggaccgccccaacctggaggactacctcccgcccgactcgctcccgcaggaggcgcccaggaatctccatctgtaattgccctaggcctgtcgatcctcaattttccgttccttaaccctagtgcttcggttttacgagacttatgaggttttctgcgcttttcttctgatgtgcaggcgcgatctgcttgacatctcgccggtgctaaccgaggcagcgggtgccatagtcgatgtgagtgtttcagatttttaatcttctgctgatgatggtgtattttgagttaggagtttacatcctgggcttgtggcagaggataggcttatgatctgtcaagtttaactagttaggagagctgttacgatataagctgaaaaaggggtaaagaacttggtgccatggagctcatggaggagttcatcacttcatcgaccacagggatggggaaggggaacttgtctttggatgtcttctcatttagagcgcggtagtcaatgcagaacctcgaggaaccctccaccttcttgactag

SEQ ID NO: 287 - DNA, 2073 bp, Zea mays
agaacatcctgatccatccaggcatccacacacgcggccgagccaattccgctggagaggagtacacgcctcattacgcccatccacgtgctcgcctcgccccatcgcggacctttcctcggcggcgtcgccatctcatcggcggcgggcgtgcggccggtggccggagcccttaggcgatggcgacctcgtctgtggcggcggacatggagctggaccggccaaacctggaggactacctcccgcccgactcgctcccgcaggaggcgccccggaatctccatctgcgcgatctgctggacatctcgccggtgctcaccgaggcagcgggtgccattgtcgatgactccttcacacggtgctttaagtcaaattctccagagccatggaattggaacatatatctgttccccttatggtgctttggtgtagtaataagatatggaatactcttcccactgaggtccttaacgcttgcaataggatggttagcattttttgctgccttttttcctgtccatttcctattgaaagggcaagacaagttgagaagtaaaattgagaggaagttggttgaaatgatgtgcagtgtttttgttgcttcatggactggagttatcaagtatcatggaccacgcccaagcacacgacctcatcaggtattcgttgcaaaccatacatcgatgatagatttcattattctggagcaaatgacagcatttgctgtcatcatgcagaagcatcctggatgggttggatttattcagaagactatcttggaaagtgtcggttgcatctggtttaatcgtaatgatctccgggaccgtgaagttacggcacggaagttacgtgatcatgttcaacaaccagacaacaatcctctgttgatttttccggaaggaacttgtgtgaacaaccagtacacggtcatgttcaagaagggtgcctttgagcttggctgcgctgtatgtccaatagctatcaagtacaataaaatatttgttgatgccttttggaacagtaagaagcaatcttttacaatgcacttggtccggctgatgacatcatgggctgttgtgtgtgatgtttggtacttacctcctcaatatctgagggagggagagacggcaattgcatttgctgagagagtaagggacatgatagctgctagagctggactaaagaaggttccttgggatggctatctgaaacacaaccgtcctagtcccaaacacactgaagagaaacaacgcatatttgccgaatctgtcttgatgagactggaggagaaatgaagggacgtcaagccgtacaagtgcacttcgttagggttttacatgcagctaccttgtaattcggttggcttccagaaaaaaaaaagtgagcctgggacacgtcaagtgaccacctcagttttgttgtaaatttgttactagtttgataggattattagtatgtacttatcaggaaaagaattctcagtatgtgttttggctgcccattcaatgataggtcagtgattaacaccgaagcatggtgctctcgtgagatgctgtgttggtcttaatggattgacggtactgtaccatggtttaaatgtgattattgaagcaatgtgaatggattagctggctaaaaaaaaaaaaaaaaaaaacgggcggccgcaccgattttttttttttttttttaaagtacaaccattgacttcattattatccaatatagtctgtttttctttgaagaaacagccaaagataaccaagggatgtcatcaaaacacagcagtctgtaattctatatcaaaagcataagagatgaatgaatatgagggtgtgtttggtttggcttttgccccctaaaagccaaaccaaagggaacgatccaggaagcagattttttttcaaaagccagctttctcacagcgtaaacttgaaagcacccccgaacctgcttttagcgactttccgatagaactggataaactgaaccaattcaatgtaaaaatgaacttcttcaaggccttcaagctctggcattagtgaggactttgtcaaatgaagaattcgcggccgc

SEQ ID NO: 288 - DNA, 618 bp, Zea mays
gccttgtgtcggacccgggattcggccttatggccgcccaggcaatcgccgggagcacagagctagctagccagccagccagcagccagcttgctcgccgcgcccgtccttcttcctcgcctccgttccattccgtcccgccctccaccgccgccgccgcattcagggatggagatgaagaagatcgcctgcgccgtcctcgtcgccgcctcggcggccaccgtggcgctcgccgcggaggctccggctccggcccccaccagcggctcctccgccgtcgcgcccgccgtcggcgccgccctcggggccgccgtcgcctccttcttcgcctactacattcagtgagccggccggggcgcccggaggccgaggaagagacgaaggggagagagagtgacatggctgcgcgcattccgatgcgtgggcatgttttttgattcgacacaccttttgtcctctttttctttgttccctctttctccttaatttaacgaattgatgcatgccgctgatgttcttcccctgagagagggattaacacttgtatcatttcatcgcttgccatttgtttgaatccattcaacaattcattcaaaaaaaacaaaaaaaaaagcggcc

SEQ ID NO: 289 - DNA, 1464 bp, Zea mays
ggcgcccgcccggcccacccgtccgcccgcgcggcaccgacgggagcacagagctagctagccagccagccagcagccagcttgctcgccgcgcccgtccttcttcctcgcctccgttccgttccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagtgagccggccgcggccggtcgcccggaggccgaggaagagacgaagcgggagagagagtgacatggctgcgcgcattccgatgcgtgggcatgtttttgattcgacacaccttttgtcctctttttctttgttccctctttctccttaatttaacgaattgatgcatgccgctgatgttcttccccctgagagagggattaacacttgtatcatcgcttgccatttgtttgaatccattcaacaattcgatttaatcaatcatcgcgtatatatatgcccaagaaaaatgcaacactttgtgcgatatttctaagtttcacttcagacaaaactgaacgcggcaaggagtaaaatttacatgtcatttcaggcatccatgccgggtttaccagccggaaacgaacaaaacagaacacatccacccagcacacgaaggaaaagatcaatctgtacatgagaaagattgcataccccggtctgcacatcggacagacatcaggctgagaagggccggccggcacggagcccaaaacgagccactctacgggaccggccgccacacctctcgagcttgcagcaactgcaccttggccttgcaaggtcaaggatgctacggtcaataacataagggtttccccaccctggtgcagggagaagaacgcggcaatgtctgcataaactagcagcgccaaacacaggttgaaggacatgaaccacatgctagctgtgccgaactactgctggcgtggttcaggactgcatcctaacttccttgagtgaaactcagtggactctgaaggtggttgagacttgagagtgattcgagtcatccttgcgttgcaggcacccatttataacggagaaaaagagtaccaataattggtaactagtatacagtttctgggataaatggataattttatctagcggctagtgcctatctactggtgactgatggcaatgctgccggtgaatctgcattgtccaaaagcatcgagacaagctaagctattaaacagcgtgcgctccagaagaaacatatgggccacgtacctagcagtttagcacggtgcgaatggctagtgtgcaattgtgcatatcctgtgcaaaaactagagttgattttca

SEQ ID NO: 290 - DNA, 2099 bp, Zea mays
cgagctggccgcgatagccggcgccgcgccgccgccgaagctggaggacttcctcggcggaggcgtcgccaccggtggtccggaggcggtggcgcccgcggagatgtacgactcggacctcaagttcatagccgccgccgggttccttggcggctcggcggcggcggcggcgacgtcgccgctgtcctccctcgaccaggccggttccaagctggccttgcctgcggcggcggctgctccggcgccggagcagaggaaggccgtcgactcctttgggcagcgcacgtccatctaccgcggcgtcacacggcaccggtggactggcaggtacgaggcacatctgtgggacaacagctgccgacgcgaagggcagagccgcaagggccgccaagtatatttgggtggctatgataaggaggagaaggctgccagggcgtatgatcttgcagctttgaagtactggggttctagcaccaccaccaactttccggttgctgagtatgagaaggaggtcgaggagatgaagaacatgacgcgacaagagtttgttgcttcccttcgaaggaagagcagtggattctctcggggtgcttccatctaccgaggtgtaaccagacatcaccagcatggacggtggcaggcgaggatcggaagggtggccggtaacaaggacctctaccttgggacgttcagcaccgaggaggaagctgcagaggcctacgacatagcggccatcaagttcagaggcctgaacgccgtcacaaacttcgagatcagccggtacaacgtggagaccataatgagcagcaaccttccagtcgcgagcatgtcgtcgtcggcggcggcggcggcgggtggccggagcagcaaggcgctggagtcccctccgtccggctcgcttgacggcggcggcggcatgccagtcgtcgaagccagcacggcaccgccgctgttcattccggtgaagtacgaccagcagcagcaggagtacctgtcgatgctcgcgttgcagcagcaccaccagcagcaacaagcagggaacctgttgcaggggccgctagtagggttcggcggcctctactcctccggggtgaacctggatttcgccaactcccacggcacggcggctccgtcgtcgatggcccaccactgctacgccaatggcaccgcctccgcctcgcatgagcaccagcaccagcaccagatgcagcagggcggcgagaacgagacgcagccgcagccgcagcagagctccagcagctgctcctccctgccattcgccaccccggtcgctttcaatgggtcctatgaaagctccatcacggcggcaggcccctttggatactcctacccaaatgtggcagcctttcagacgccgatctatggaatggaatgattcgggccgcccggtcgtggctgctggtcggcctccgctcgccgctggcgtctcgcatgtgcgaaaagggtggggagaagccatgagaacacgagactgacatgggcgctctcgcacaaaagacataaagcggggggactgaaagatcagaggtaccagtagacagtagtagtatgatggaagagacagtaagcagcgagtagtgtgctgcaggatacactgaccatcgatctgctaacaacaaaatgatcgttgcagctagctatagcatatttgcctttgcccttttgtagctttggtctggtctctctctctctctctctcttttttcagctttgttgctccccagcgtcctgcactgcatgccagctgctttgaagctttctctttctactgacatggttctgcaagtgccatcatagctttagtcagccctgtacaatggatgcaggaacgtcgtctttgaattggatctctgtagctcatctctccccctagctcccccactttgttttcttttttgtgctttcctttctgctgcctctgctagcgttatgtgtactgaacaagttcatcaaacagatatagcacccttgcaactaagaatcaatgtcggtcttattcggtcgcggggttatttaaattaaaaaaatatttttatcttttttttaattaattaatttttttttattttatttttttt

SEQ ID NO: 291 - DNA, 1436 bp, Zea mays
gcacgagaccattacctagaacatcctaatcaaaaaagtgctcaagggtgattatcaagattatagaatgacatattgccttgagcatccagcaaggaagatgctcttgatgcctgtcgagccttttgaacctagtaaatcatgttatgtctgctctgagaccccacttgttctggaggttaatactaagacaacaaagctccaggaagtcattgaaaaggttataaaaggtaagcttggaatgaacctacctttgataatggttggcgccacacttgtttttgaggatggtgaagatctggagaaggatgagattgcaaattatgctttaaaccttgaaaaggtgctgtgatactaaccatatacttgtcaagttattttttctgttaagatgagtcatttgtatgcactgtggcatatattctaaaattcttgtttcttaataaattgcagccctttgttgtgttcttggccagcttagttgatttgtagttaagcttcttcacccttagttgtgtttatgctctgcttagttgatccattactgcaggtcttggctgaacttccagctccagttctaaatggtacaatgcttacagtcgaagatttgcatcaggaactaaaatgcagtatcaacatcaaacacagggatgagttcgatgaagaaaaggagcctgacagaatggttcttgttgggtggtctggcccagttgataagcaaaccactaataatggtgagactaaatcagttccatcttcatccaatacagaagatgtggatggtactgccgaggacatatcagcaacttctggaatgaagcgtaagctgaacgaaatattagagacaaaggagaactttgatgctctcgaaaatctttcgggtgttgattccagcagcgctcaagttgttgaagatgacaatgacgatgaccttgttatgtttgatgaggacccaaggcaaagtaagaagaagagattgcagtagcatcctgctgcggcgataacagctcttgactcccggcatcgtggctaacacattgttcgatcgtaacatctttgataacttatttatgcggttatgtaccaggttgatgttgaaacattagtaacaatgcccagggcaccttttggcctcagatagtcagataccctgtagggttgtaatttgtaggatttaggaacaagagcaactaatgctcagctgacagcctgctgcgagatagaatttgtatctcaagagccaaggtactgttttggttatgtttttgttcagttgaggggtgaccgggtgaaccaagctctgtcttgttagctgccattcacagggtctggaaatatgtactcatcctgtattcttgctaaggttatggatcagatggtgtatatatccgtgcaaaatactaatttatagttttgcactaatctacactgtaaaa

SEQ ID NO: 292 - DNA, 1450 bp, Zea mays
tagcgtggtcgcggccgaggtacgcggggagtcttgctgacaattcaagagtgttcttggaggctttaaaattattttttgagaaaagagagaaggaaatagggagccttatttttgacaaggacgaccagttggctgttgagtttgttaccgctgcagcaaatatcagagcttcctcttttggaataccactgcatagtctttttgaagctaaaggtgttgctggaaatatagttcatgctgtggcaactaccaatgctataattgctggtctaatcgtcatcgaggcaattaaagtgctcaagggtgattatcaagattatagaatgacatattgccttgagcatccagcaaggaagatgctcttgatgcctgtcgagccttttgaacctagtaaatcatgttatgtctgctctgagaccccacttgttctggaggttaatactaagacaacaaagctccgggaagtcattgaaaaggttataaaaggtaagcttggaatgaacctacctttgataatggttggcgccacacttgtttttgaggatggtgaagatctggaggaggatgagattgcaaattatgctttaaaccttgaaaaggtcttggctgaacttccagctccagttctaaatggtacaatggttacagtcgaggatttgcatcaggaactaaaatgcagtatcaacatcaaacacagggatgagttcgatgaagaaaaggagcctgacagaatggttcttgttgggtggtctggcccagttgataagcaaaccactagtaatggtgagactaaatcagttccatcttcatccaatacagaagatgtggatggtactgccgaggacatatcagcaacttctggaatgaagcgtaagctgaacgaaatattagagacaaaggagaattttgatgctctcgaaaatctttcgggtgttgattccagcagcgctcaagttgttgaagatgacaatgacgatggccttcttatgtttgatgaggacccaaggcaaagtaagaagaagagattgcagtagcatcctgctgcggcgataacagctcttgactcccggcatcgtggctaacacattgttcgatcgtaacatctttgataacttatttatgcggttatgtaccaggttgatgttgaaacattagtaacaatgcccagggcaccttttggcctcagatagtcagataccctgtagggttgtaatttgtaggatttaggaacaagagcaactaatgctcagctgacagcctgctgcgagatagaatttgtatctcaagagccaaggtcctgttttggttatgttttttgttcagttgaggggtgaccgggtgaaccaagctctgtcttgatgggtgccaatcacagggtctggaaatatgtactcatcaaggattcttgctaaggttatggatcagatgggtaaaaaaaaaaaaaaaa

SEQ ID NO: 293 - DNA, 2325 bp, Zea mays
  misc_feature (1255)..(1255): n is a, c, g, or t
aaaagcccccggccggggccccctcattgcccggcgcttcggccgcccgcgccgtcccatcgtctccctctcctcaaaatccccacaaaccgctctctccctctcgcctcccgcccctaattcccatcccccacctccaaatcccacatcactcaaaaccctcgccgcgcccctgctgcgcgcccccccgatggcagccgtcgcgtcctcggaggaggccgtcaaggcggcgaaggtgctgatggtcggagcgggtggcatcggctgtgagctgctcaagacgctcgctctctccggattcagcgacatacacatcattgatttggatacaattgaagttagcaatctgaatagacagtttttgtttcgacagagccatgttgggcaatcaaaagctaaagttgctcgggatgccgtgttgaaatttaggccaaatatcaatataacaccataccatgcgaacgtgaaggattctcatttcaatgttgattttttcaagcagtttaatgttgttctgaatggtcttgataacttggatgctagacgccatgttaatcgcctttgccttgctgctgaagttcctttggttgaaagtggtactactggttttttgggacaggttactgttcatgtcaagggtaaaactgagtgctatgagtgtcaaccaaagccggtccctaaatcatatcctgtctgcacaattacaagcacaccatcaaagtttgttcattgcattgtttgggcgaaagatctgctttttgcaaaattatttggtgataaaaaacaggataatgatcttaatgtgcactccaaagatgataccagttcaaaaacagatgtttttgaaaggagtgtagatgaagatcttgagcaatacacccagagaatatatgaccacgtatttggttacaacattgaagttgcattggataataaggaaacttggaagaatcggagaaagccaaaccctatttacattagagatgcattgcctgaagacgctgttcaacaaaatggtcgctctcaggatcacgtgaatgaggagcaggatccttctgctatggtatccctaggccttagaaatacacaagagatatggagtcttgctgacaattcaagagtgttcttggaggctttaaaattattttttgacaaaagagagaaggttcttgggcgccctttttgacatcttaaagtttttctctgtatagaaattaatccaggcttgattttctctttcaggaaatagggagcnttatttttgacaaggacgaccagttggctgttgagtttgttaccgctgcagcaaatatcagagcttcctcttttggaataccactgcatagtctttttgaagctaaaggtgttgctggaaatatagttcatgctgtggcaactaccaatgctataattgctggtctaatcgtcatcgaggcaattaaagtgctcaagggtgattatcaagattataggtaaccacattcgaaacctgtcacattgtattccttgtaccagaggtttctacacgccctccgtcctagtatataaggcgtaaccacgttttattctagtcctattgttggaactaggtttatggaggtagtacgagtggtaggtttgaggtctaggacccgggccccggcgcttgggcgccgtcgggctgttggctggagaaggtgcggtactgttcaaggttttgaagtcgataagtcgagtcgacaaggtaccgacttggtgactagtcgatactcgataagtcagtcgtctagtcgtcgacttgccaatatagtggctgttttgcccatataatggcttcgtatagataatatagcatttatatatgaactcataagtcataacagccatatatagacatatagttcaaattgaaaatcaaatagcatctcccgtctccctagagcttgctgtgagggcgacgcaggttgctgtgagggcgtgcagaggaggggcggcggcatgcagaggaggggccggaggcggccagaggtgttggaggtagggtttatgttgtataatgggcctttgggctgcttgggctgaactgggacacaagtcggccgacttgccagaccaagtcgacgactagtcgactgagaatttccagtcgtttccaagtcgcccgacttgcctgaaaagtcgagccaacctcaccagtcgagatcccagggccgacccgaccactagtctccgacttgaaaacaggggtactgttcatgagacggacaatgcacatgttgaacattagcgatggatgaacaatgcgtgatgaacagtaaacgggatgggggaagcaccaggtaagaa

SEQ ID NO: 294 - DNA, 1634 bp, Zea mays
aattcggcacgaggcccaaaccgctctccctctcgccccaacttcccatccgcacccccaaagcccacctcactcaaaaccctcaccgtgcctctactgcgcccccccccccccgatgtccgccgccgcgtcctcggaggaggccgtcaaggcagcgaaggtgctgatggtcggggcgggaggcatcggctgcgagctgctcaagacgctcgcgctctccggattcagcgacatacacatcattgacttggatacaattgaagttagcaatctgaatagacagtttttgtttcggcagagtcatgttggtcagtcaaaagctaatgttgctcgggatgctgtgttgaaatttaggccaaatatcaatataaacccataccatgcaaacgtgaaggattctcatttcaatgttgatttcttcaagccagtttaatgttgttctgaatggtcttgataacttggatgctagacgccatgttaatcgcctttgccttgctgctgaagttcctttggttgaaagtggtactactggttttttgggacaggttactgttcatgtcaagggtaaaactgagtgctatgagtgtcaaccaaagccggtccctaaatcatatcctgtctgcacaattacaagcacaccatcaaagtttgttcattgcatcgtttgggcgaaagacctactttttgcaaagctatttggtgataaaaaccaggataatgatcttaatgtgcactccaaagatgataccagttcaaaaacagatgtttttgaaaggagtgtagatgaagatcttgggcaatacgcccagagaatatatgaccatgtatttggttacaacattgaagttgccttggataataaggaaacttggaagaatcgaagaaagccaaacccaatatacatcagagatgcattgcctgaagacgctgttcagcaaaatggccgctctctggatcacatacatgaggagcatgatccgtctgctatggtatccctaggccttagaaattcgcaagagacatggagtcttgctgacaattcaagagtgttcttggaggctttaaaattattttttgagaaaagagagaaggaaatagggagtcttatttttgacaaagatgaccaattggctgtcgagtttgttactgctgcagcaaatatcagagcttcctcttttggaataccatcgcatagcctttttgaagctaaaggtgttgctggaaatatagttcatgctgtggcaactaccaatgctataatagctggtctaatcgccatcgaggcaatcaaagtgctcaagggtgaccatcaagattatagaatgacatattgtcttgagcatccatcaaggaagatgctcttgatgcctgtcgagccttttgaacctagtaaatcatgctacgcctgctctgagaccccccttgttctggaggttaatactaagccaacaaagctccgggaagtcattgaaaaagttataaaaagcaaacttggaatgaacctccctttgataatggttggtgccacgctagtttttgaggatggtgaggatttggaagaggatgagattgcaaattatgctttaaacctcgaaaaggtcttggctgaacttccagctccagttctaaatggt

SEQ ID NO: 295 - DNA, 3365 bp, Zea mays
ctcagatagggactgaacagaccaggagcacttgagtgaagtgaagaatatgctgcaagctgcatctggaccacaaactgcttgtgcatttcaacgaagaatacaaacaattgaccaattacatgtccttgattctacctcaaagtttcagggaaacttgaatttacacactagacatatttacaaacatcttcaacatactctcgagggggggggggggtgtttcatgtgcaacatcatagaattccaatgctatggttgtgaagaggaccttctcctagcccatcgcaaacactaccaccgaaataaatggctcacaagactacaaacaatacaataatgtacatgttctaaggtgactggagttttatgccgtcggagatactggttttgtgtgcccaggtttgcctacaatggctttcttcacttttgcgagttggtgttttaccttcgatcccacgccagacaataggctatattttttacgtgtcttctgggctgctcctggtgcttcagtttttattgctgcttcatcagttaaattcttagttccctctatgtcctttatcttctcgtcataaatcttctcttctgcatcagcctttggactttgttcttcatctgtgctgaattctggcttggttacgtccacaaagttttcttcagcctcagaagcttctctgggtgaaactacattgagatcacgttcctggacctttgaatcaaacagttcctggtcttcattggatgttatgctcactgtttgctgaggactttcaactgcttgctgaggtctttcaactgtctcatgcacatccatttcttgggtcagaatctctttcttggccacaagttgctggtctccttcatcagtctctttaggagacttttgctcagtaccattgtcctggtgttcctgaaaattagattcccctaatttttctggcttcatttcagtttcgatgtcagcagcttcatcttgcttatcttggttgatctgcatgtttggaccatcagcctgaatttcgactgctgttggaaagttttcttcagatatttccttttcatgggccaaaattgcctgactgtcacaaactggttcggtaatttgagtttctagctcattagatttttcttcggaccttgttattttctgcagatttatatgtgaactttctacattctctttagaaacttcatctttggttgtgtttgcatgctggtcctcttctttcttatctacttcttcattctccagttgaatatcagtagaatatgtggcctcaactctggcagattcagtgggttttgtagacacagggttttgagcacttgtagtatcgctagataagtcattcgcgtcagtcattcctgattctgtcaacaaaggtgcttgctcagacactacatcaacacttttgtcttcaggtaaaggttcaagcacgagccttgattgtccttctcctagagtatcgtcttggggagccattgtgtttgttgagtcattcaggctgctcctcaagcttccattttcattttttgttgatacctccattttttcctgacacacagtaccaactgttctgttgtccagcacaacactcgaaatatcaatatctctagttaccatttttgtagaaacaccagctgcttcttctgtctgcaattcaccagaaattccatcctggggattgtcttggtatgctggtatttctaaagcacgagtgttctttttgatatcctcatcaatttcaattgatctttctgtgtgcagctgatcatcactttgttcttcgaccatttcctgtgtttcttcagagcatttaacttcatgtttttcttgttcaacaaaggtgggattgtcatccaccttattttctgtaggaagtgaccccagactttcttcttgttcagaaatgaacgtgcagctgtcatcttctgtcgcttcaccttgcttccttgcagcctcagattctgaatcttcatttgcatcactgctctcttttcccaatattagattcatcagaaaatgggagacaggtaattcttgttgaacttctttcttagcctctccaaattctgtatcttgcatgtcatcttcatccttttcttttagagtttgattctcatctcgtatgtccttttcatcctgttcattgggaatttgattctctcctggttcagtttgaaggagcttctctgatgaaggcatctctctttctctttcctctaagctgagcaccttttcagcggtgttgccatcctgtgcctgatgtccaggaaggtcaagattgaggttttccatagtgtcgttcacactttcttcctttgatgttgtaattaccaatggaacatcaatatcccttccagtgtcagtaaaggtcttgagacttccgttagacggtgctccatcagctccgctaacctacacgggaaaatgaaaattactttagtaatatataactcccaaaatatttaagaactgctgacatactgaccttgtcagtaatatcttcattgaacgttactgcttcagtggctgctgtactagtctctgtttcctcatttgaagcagtctcttcaatcttgtcaaatgaatttccttctgtttcaagttgcagaacatcatctgcagtaatttcttcttgacattgttctgtttggtttatatccgcgccagattcatcatttatttcttgcatagcttcagtatctacatcatttttctcagacattgaaagcttttcatcttcaacctgattgcagaaaaaaatggaatagaattttaccaagaacagacttgatcagaaaaactggtaacatgaatttcgaggcttataagagcgttacttcttgaagggtattaggactgaccttgtgatgactgcttgagtcttcaacattgttctgtatggatgattctacagaaggttcagaagtgaagtctggtcctttgttttctcctatctcttcaatttctctaggatttatacttgtattgtcatggattatttcttcgcatagagatgttgtatcatcaattttagcatccacattgtatggttcattggaatgcggttgaggtgactcttccttttcagaatttgtctgtaatttatcatgacaaatagcattgtcttcatgtatttctttactttcttctatttcatctgcgatctctttctctgatgcttgaatgatgtgaacaggatcctgcacaacaaatataacagctatagctcattgctcagattattatgatgttattttaacagagaactgctagcaatgaatgcttctggaacttctgatgcataatgatctaatttaagagtcaggccgttggaaactgcaggcatgcaagc

SEQ ID NO: 296 - DNA, 571 bp, Zea mays
agacaaaagctagatagacagacaaatagactatggactgcatatatatattggccacgccggccagctttcaataataacacattgttactattagactctagttcatcaccaatggcgaagttcttcaactacaccatcgtccaaggactcttaatgctttccatggtacttctggcatcatgtgtcattcatgcacacataataagtggggaaattgaagatgttagcaacactgggagcccgacaatgatgggggcaaatcgaaagataattggagataataaaaatttgttgtgctatctaaaggctctagagtattgctgtgaaaggaccaaacagtgctatgatgacataaagaagtgcttggagcactgccatagttgaaaggtgtaataaaacgatatgctttctttggatcttagttggtgattagaaaaatgttctaccaattcatgcatgtaccaaaggataatataagctgctcaaaaaatcatggttaattaaagtttttttgttgcaaaaaaaaaaaaaaaaaaaaaaagaaaaaaaaaaaaaaaaaaggccccta

SEQ ID NO: 297 - DNA, 613 bp, Zea mays
  misc_feature (5)..(5): n is a, c, g, or t
ttgtnggaactcgcgtggtcgcggccggggtccggggggaacacattgttagtattagacactttctagttcatcacccatggcaaagttcttcaactacaccatcatccaaggactcttgatgctttccatggtacttctggcatcatgtgctattcatgcacacataataagtggggaaactgaagaggttagcaacacagggagcccgacagtgatggtcacgatgggggcaaaccgaaagataattgaagataataaaaatttattgtgctatctaagggctctagagtattgttgtgcaaggaccagacaatgctatgatgacataaagaagtgcttggagcattgccgtggttgaaaggtgtaataaaggatatgctttctttggatcttagttggtgatcagaaaaatgttctaccaattcatgcatgtaccaaaggataatataagctgctcaaaaaatcgtggttaattagagttttttgttggaaaaatgataacttccttacaaacatataccaaattaaagagaccctcttaatgcatgatctatcttttaataaagaacatattccatagtaaaaaaaaaaaaaaaaagaccctttttaa

SEQ ID NO: 298 - DNA, 1454 bp, Zea mays
gggtacccccaggccccccgccgttgcacttgcaccgcagccagagtccgggagcgcagagatcgctggggagatggcgagagaagcagcgagcgaagccaccgcaagccgcgaaagcggggcggaggcggcaggggagtgctggagcgaagcgctcaagtcgttcctggaccacatccccgtctcctccgtcccgggcgcgctccaacccactgcctccccagcggtggaggtcaagctccacggctccgtcctgggcgccctcgacgccatgtacagcagcaacgccgcgggcgcggtgatcatcgacgtggtgcacagcagtctaggcaagtacgtcgatcgcgatattggcttcgtcgagttctcgagcctagtcctgtgggcacttgaggaacttggcaaagtggaaagtgaaccaacagacagtacttctgatttcctctctactctgaaacagcatcatcagattgcagaaacgaagatcgcctggttagcgaagttgttcctgtgggagccattcttccctgttcggacccatgacacgctgttccacgcaatgcttctcttttcgaaacaccacaggctcaacgtggcaccggttgttgagtcaatgaactcgagtgttattggatttgtcacacaggatgcagtgatggagctgcttctccagtcaagtggccttgagtggcttgataaaattgcagacaagcagctttcggaatttaggtttgcaaatgtgaggcagcctgttttggtgtactcagatcaaactctagctgatgggctgcatattctctcaaaggaaaaaacgggggttgcagtcattgacaggaaaaccagccgtctaattggatcattacagtgcagtgatctctacctgtttctagatgacagcacccttttcagcaagcgaacgacaactactctggaagaattaatcagcctgaataacaagaccgacaggaaatgcagcaccgctgaaaattcatgtgcgcctggccgaaacatcctcgcgctcaggagcaggcagtcaggcatggtgggcctaccagccaccaacctggaatccgacaccctaaagcaagcgatggagaagctgacaactttaaggagcagctgcagcttcatcgtcgacgagcacgggcgcgtccaaggagtggtgaccacaagggacatcatctccgtgttctccccgctgtgcatggactcgaggattgacggggccacgttcttctcggctgcgctcgagcaggctggctgccgcgttgagaacgggcagatgtttcagaattagtttcagacaaaactggaatgcagggaggctttagtttgttgcagtgaggaagatgtacatggcacttaccggctatgttgccctgatacgagggatatggatacgggatacgtcgatactctgatacgctatttatcaaaaaatactctgatacgct

SEQ ID NO: 299 - DNA, 1123 bp, Zea mays
ttttttttttttttttagaaagtcaaagacttccagccgtgttgtttagttgcacaaatatgaacaattatgatcaagctaactacatgaaatattcaagatgctgattaaaggattcttcgaggtctcctaccaaaggcgtgccgatctagagtagttcttaatctagagcggaaggaattttttgagaaaacaagtcctcactggtaggagaccgcaaaggaggggtaagctcacggagtcacggttcgcgtcgccatatctgcatattgggcggccgtccagaggcgagaagttgaggggcgtgaaaaaaaaggctctcaatgggtttctcagcgctatacatccaatctagggcggcaactagtccagctggacctggtaccactccacggaaccaacgtctccgtcgatctcgagcacgcacacggacctgacgaggtacgagacggcctcgtcgaccgtgccgaacctggcaaggtctgggggcagggtgtccctgggccagttcttgagccagcccttgagcctctcctccagctcctccctggacacgaacgcctcatccatgccgggttccatcagcacgtacgtgtccgactggatgtccgcccgtctcctccgcgttgcacaaacctgttctccgtggcctcgcattctcggcgatcgcttcagcgaggccgtgcaaaagctcgcggcaccacccaccacgaacgccgtcttctgcgagcgccggcggggcagcagcagtgacgcccttctgctgcctgaaggtctgggagacggcagccatgggggacggccgccggagaggttcctcttgccggatggcgcgagagacgctgcaggccaggcgacggcgagggcgcacgccatcatggctgcccacctgcggtgtggaatcactgcagaacgagacggaattgggagacacgaggcggcggtgggtgaacaccgcgcaaagagctgcttggcctccgatgtaccgcaccggatgtgaaccggacggagctctctagtccactaacgcaacatcagatgtctggctggccccgccggccttcgggcacccaagtattatgtgtgtgttctactttcgtgcacatgaacgactccaccccgg

SEQ ID NO: 300 - DNA, 636 bp, Zea mays
  misc_feature (541)..(541): n is a, c, g, or t
tgcagacctccgcttttttcttcctcgcccggtcgtccccctttcccccgcggccccgccccccatgcccctcgcgtacgcgcccataccgtaccgctcccgaaacactagggcgcggcacgcaccctcctcgtgagcgcggggtcgggcgcaggcggcatggcgccgcaggccgcggggtcgacccctgcggtggcggcgctcgggttcctcctccctacctgctgggagatcgaggtcacgtgcgccgccgcgatgatcctcgtcgcgctctacgctgcgtacgagctcctcaacccgcgccccttccaggctgcagcggcgggcgacgccgacgagctcctcgtgcgggggctagacggcaccaacaaggggggtgcgagcggccgttctgcgtatgtactgaagctagaattgttggctgctaggaatttgatggcggcgaacttaaatgggacatctgacccgtatgcattgatcacttgtggtgcagggaagcgtttcagctccatggttcctggctcaagaaacccaatgtggnggagaggaattcaattttttttgttgatagtcttcctgtaaagataaatgtcacgatatatgactgggacattgtatggaaaagcacaatccttg

SEQ ID NO: 301 - DNA, 2811 bp, Zea mays
gcacgagaccattacctagaacatcctaaaaaaaaaccaccaccccaccaggccaccattccttcctcccctggtcgcccccgcctccatggccctcgcgtgcgcgcccataccgctcccgagtccctaggacgcggcacgcacccttctcgcgggcgcgggcgcgggcgcggggcgcgggagcaggcatggcgtcgcaggtcgctgggtcaaccccggcggtggcggcgcttgggttccttctcccgaccttctgggagatcgaggtcacgtgcgccgccgcgatgatcctcgtggcgctttacgttgcctacgagctcctcaacccgcgctcctcgcaggcggcagcggcgggcgacgccgacgagctcctcgtgcgggggctggacggcgccgacaagttcaaggggggtgtgagcggcccctctgcctatgtagtgaagctcgaattgttggctgcaaaaaatttgatggcggcgaacttaaatgggacatctgacccatatgcattgatcacttgtggtgcagagaagcgtttcagctccatggtccctggctcaagaaacccaatgtggggagaggaattcaatttttttgttgatagtcttcctgtaaagataaatgtcacgatatatgactgggacattgtatggaaaagcacaatccttggctcttttactgttactgttgaatctgaggtaccgagtggaccaatttggcatacacttgacagcacatcaggccaggtgtgtcttcatattaaagtaatcaaggttcatgaaagttcctccagggcaataaatagctcagctgaggctggtgctcgtagaaggatttccttggataagcaaggtcctactgtagttcatcaaaagccaggtcctttgcagacaatttttgaactgcctccagatgaggttgttgaccacagttattcatgtgcacttgaaaggtcatttctgtaccatggacgcatgtatgtctcttcatggcatatttgctttcattcaaatgtcttttcaaagcaaatcaaggttgtgattcctttgagagatattgatgagataaggagaagtcagcatgcagttattaatccagctattacaatttttcttcgaatgggagctggaggatttggtgttcctccgttaggatgtccagatggaagagtcaggtacaaatttgcatcgttttggaacagaaaccatacatttagagcattgcatcgagctatgaagaacttcgtaatgatgatagacgctgagaaacaggaacgtgctcagtctgcattacgtgcacacagtagttcaagaaaaaatagcaagaaggagataaatgtaccagaagattgtgctgcattaacagggaagttacaaccttttgtcaaagaagaagttttggtccctgtattcaatggaacttttccctgtactgcagaacagttcttcagtattcttttaagtgatgattcaaattacataacagagtatcgaacggatcggaaggataaagatataaatctgggccaatggcacgttgcagatgagtatgatggccaggtgagggaacttaattgtaaatcaatatgccatagtccaatgtgtcctccttattcagcaatgacagagtggcagcatatagttctttcagctgacaaaatggatctggtatttgagacagtacagcaagtacatgatgttccatttggttccttctttgaggtgcactgtaggtggtgtgtgaaaactatcagttctaactcgtgcagtctcaacataagtgctggtgcgcatttcaagaaatggtgcatcatgcaatctaagataaagagtggtgctgtggatgagctgaagaaagaagtgaaggtgatgttagactttgcgcaggggtatatgctcaaagttagctctcctgaccaagagaacagtaatctcgcgcagcaagacaacacggcgccggatgcgccttctgatacagggtgacagccgccatcacatgacaacgaatcatgccattacgatgttatacacagaagggcaggtggaccagtaactagtagtccacatgaaccacatctaacatgttaagctgacttccaaaagaatgggtggaccgtgtgtagcgtgttaagttcgtttcctgccattgctctatccgtttttggcagtttggctgatgtatatatatagctgtaaacacacgcaaatataaagtggtggctgtggcaggccagtgtgttgtttgagtataaaaacaaagaaagaaacggaagagagaaatatttgccacagaaccaacgcttctcgagtcacagactcacaggggggcatatgttgtgcaaataaaagcttgatgtcctagaaacaactttgcaactgtcagtttgttcaggccttgtttccatgcgcggccgtttttgaggaagcactagccaactaattattagtaacgggcatcctgtctcaactgtcgctttcctatcttgattggggacacttcgatcaatttgcaagtttctgaagatatatgagaggaatgcgcataaattggatgacagttgggacccgctattgacatgttagcagcatccagcttcggcaccgtgatctacgataaaatgaaccccaagtgtaaggataagattagtttctcaaagatcctaacataattcatttagaaaggaataattaaaataaaagaatcagggcaccggactggttgtccgggcgcttggctatccattggtcaggtccagagcttagcgctgggctgggccaggtcaatgaatgcaaacctgcaggtcgactctag

SEQ ID NO: 302 - DNA, 3006 bp, Zea mays
  misc_feature (728)..(728): n is a, c, g, or t
  misc_feature (2618)..(2618): n is a, c, g, or t
catgatcacatacagatacagttgatcatctaaaaaagaatgatctaccctcttaccatagctccattgcatgagattgtcagctattcacttaaaagtcatctgcaacttcgttggtgagattgccagctagaacagcatgagcaagcatgtttagagcagtcccaaccctccacgtcaaccggtttccataacattaaatagactgccacataggcaaaatgatgatgtggcaagagcgttaatgaaagaaaggaaaaaaaatgaagacactgggtctcatgcaggaaaccatgtcggctcaatctccaataagctaggacaccgccccaaatgcgttggagagcaagacaccacttctaccacatgttttatgagaccgtagtaaagcctcggataccatgcacgcagcttgtgacccctcggcatgtgtgagtttcgccgtttgggttggaagatgtagtttctacaactcatgtcttgatgatgtggcaccatagactctacttatgagcttcatgggttgggactgctcttatcctcgaaatatactaggctacgcaaaaccaaacatcatttgccccccacgctattctatgtagcttttgctggcttgcaagttttgtagtacatatcggcagaagtattgcaggagagtgcaagctacgagtctgtgttttttaaatttccacatgccataacttctaggaactatatagaactcttgnatctcaatgttcattttgttatgaatttgtgcagttgaagaaagaagtcaaggaaatgttagactttgcacaggggtatattctcaaagttaggtctccggaccaagagaacagtaatctcgcccaacaagacaacatggcaccggatgcagtgtctggcgatcaatgattatttcaggttgtgcctcctgatttagggtggggtgacagctgccatgacaacgaattatgatgttatacacagaagggcaggtggacctgtaactagtccacatgaaccacatctaacatgttaagctgacttccaaaagatggttggaccgtgtattgtgtgtgtaaacttctttttcctgtcattccgctatccattctggcagtttggctgatgtatatagttgtaaaaacaagtatagtgttgactgcggacggttcagtggtgcgttgttcgaagataaacaaagaaagaaacaaaagagaaatatttgcaccagaaccatcagaacttgtgcagtgtacatttttgtagccagagggaactgttgctttttctgcatctgggccaatggcacgtcgcagatgagtatgatggccaggtgaggccatgttcggtaggtatggattcaatctccaagtggaattaatccagacgtggattgaatggatcccttgttgtcactctttccctaggtggtttaattccatattcatcaattccctgtcattttttcttgttcggttagcacataaccaacaactctttgctgcttctttttctgaaacagatcgttgttgctttttcttaaacagaaacaacaaaggtatgtctgccctaagtagtactaaagcagtttgacatggtattataggcacttgtcaaaacagggccaatgcaattctgatgcaatcaaaacagctcaatcttgttgagtctttcctcgtcaaaactaaagcagggtgagttgataaagaaaaaaaatattttctttggtttaatttttctttttgcttgcttgcataaagaccactaggcttgacatctgcacaaataactagaacacaaacaactgtatattcgtaagaaagaaccactacgaatcgaaatagtaaatctggttacagtttgacatgcagagtattagccgttaaaaggcaacaatatattcctactccatctggtgtcctattagttgtcgttttgatcaagacatgaatcaaacttataaattttgactacaaataactattttattatgtagttttgaaacacaatgtttatatacaccgatttgttataataagtacttttataaaagtataaatgttgagagtttatttgtattttaacaaaaaatattgatgaaagttatattttggagaccgtgtcgctgttctaaatgacaactaatagtacatcagatggagtaggttctaacatttcatcatctaaacatcaacaatatggttgtccaactagtccagaccttagctctttcagcaactctagccacatctagccatcatcttaccatccgatcatgccgccgatagggacagtcgctggagcaccgaccgacggcagcacgccctcccaaggggacaaatagcagagatagtcggccggagtaagcaaagaaatggggaggcgaggtgaattttagagagacaaagaaataaggttggtgctcgcatcagaggtattcagagtttcagaccaatctgtccatcgtagactaagctgttagaactataagcgcttgccacgaaaaaggaaggttattactccagtctgcgatatttgtacgtagaacaaaatctccaaatctatgcttcttttacgcacaaaccaaatacttgtaagattagcatatcagcaggcccatgagaagtaangtaacaagcaaatagcaaatgaaaatgtctaatgcttatcacttccagagaaacacatgcagtttcctaatgatggacaagtatcaaaattggataactaatagatttactcatcgttttcatctgtgataccagacatatatttatctttttcctattctagatgctttgggtccgatgcacatgttgggtcctatttaatctagttaacaattgtatgtttgttacttatggaatctagtttcatttcaactgctagcaacctttttagaaattcagtttcatggcactcaattcacttaccaagacttgtgaattgacgagagttgccatagattgtggttttgcatttgccataatacctggcatttgtcttcagtccctcgtt

SEQ ID NO: 303 - DNA, 2618 bp, Zea mays
cgacggcctgaccgctcccaccttctccgccgcgtcgtccgacgttcctgctgcataactaccacctgcagacctcctatcgtttcttcctcgcccggtcgtccccctttcccccgcggccccgcccccatgtccctcgcgtacgcgcccataccgtaccgctcccgaaacactagggcgcggcacgcaccctcctcgtgagcgcggggtcgggcgcagggccgcgggcggcatggcgccgcaggccgcggggtcgacccctgcggtggcggcgctcgggttcctcctcccgacctgctgggagatcgaggtcacgtgcgccgccgcgatgatcctcgtcgcgctctacgctgcgtacgagctcctcaacccgcgccccttccaggctgcagcggcgggcgacgccgacgagctcctcgtgcgggggctagacggcaccaacaaggggggtgcgagcggccgttctgcgtatgtagtgaagctagaattgttggctgctaggaatttgatggcggcgaacttaaatgggacatctgacccgtatgcattgatcacttgtggtgcagagaagcgtttcagctccatggttcctggctcaagaaacccaatgtggggagaggaattcaatttttttgttgatagtcttcctgtaaagataaatgtcacgatatatgactgggacattgtatggaaaagcacaatccttggttctgttactgttcctattgagtctgagataccgagtgggccagtttggcatacacttgacagcacatcgggccaggtttgtcttcatattaaagtaatcaaggttcatgaaagttcctccagggctctcaatagctcagctgaggctggcgctcgtagaaggatttccttggataagcaaggtcctactgtagttcatcaaaagccaggtcctttgcagacagtttttgaactacctccagatgaggttgttgaccacagttattcatgtgcacttgagaggtcatttctgtatcatggacgcatgtatgtctcttcatggcatatttgctttcattcaaatgtcttctcaaagcaaatcaaggttgtgattcctttgagagatattgacgagataaggagaagtcagcatgcagttattaatccagctattacaatatttcttcgaatgggagctggaggatttggtgttcctccattaggatgtccagatggaagagtcaggtacatgtttgcatcattttggaacagaaaccatacatttagagcattgcagcgagctgtgaagaacttccaaatgatgatagaggctgagaaacaggaacgtgctcagtctgcattacgtgcacatagtagttcaagagaagatagcaagatggagataaatatcccagaagattgtgctgcattaacaggacagttacaaccttttgtcaaagaagaagttttggtccctgtattcaatggaacttttccatctactgcacagcacttctttagtattcttttaagtgatgactcgaactacataacacagtatcgaacatttcggaaggataaagatataaatctgggccaatggcacattgcacatgagtatgatggccaggcgagggaacttaattgtaaatcaatatgccatagtccaatgtgccctccttattcagcgatgacagagtggcagcatatagttctttcagctgacaaaatggatctggtatgtttctactgtacaacagaatgttccattatgacagataatagttcttggtaatttgcttgatctcataagtaatatggatctgggtcatgttgttttttctttgtaaaaggtgtgtctatttttggctaagggtatgagtaggtggatgtgcgttgtttgggctcctgccattttttcttcttaatataatgatgcgtagctctcctgtggattcaagaaaaaaaaaatattgacagctgacaaaatggatctggtatttgagacagtacagcaagtacatgatgttccatttggttccttctttgaggtgcattgtaggtggtctgtgaaaaccatcagttctagcctgtgcagtcttaacataagtgctggtgcacatttcaagaaatggtgcataatgcagtctaagataaagagcggtgctgtggatgagttgaagaaagaagtcaaggaaatgttagactttgcacaggggtatatgctcaaagttaggtctccggaccaagagaacagtaatctcgcccaacaagacaacgtggcaccggatgcagtgtctggcgatcaatgattatttcaggttgtgcctcctgatttagggtggggtgacagctgccatgacaacgaattatgatgttatacacagaagggcaggtggacctgtaactagtccacatgaaccacatctaacatgttaagctgacttccaaaagatgggtggaccgtgtattgtgtgtgtaaacttcttttcctttcattccgctatccattctggcagtttggctgatgtatatagttgtaaaaacaagtatagtgctgactgcggacagttcagcggtgcgttgtttcaagataaacaaagaaagaaacaaaagagaaatattcgcaccagaaccatcagcacttggca

SEQ ID NO: 304 - DNA, 1268 bp, Zea mays
atctatggtgccatttgttgtggcacaggaaatgcctgtctctgtgctatcaagtgtttctagcgctgagcagaaacggcacttaatctctgatgccaaaagcttgaaatccgaactttggaaaggtgtttgtttgcaaactcttattacaggagatacagttgaccctgatgcttcttcaagattaaataacccagattcttctaaaatggacaccaattttttgaaagaggcctacccattacacacaccaaatccatccagtgtgattgaaactgtgtatgaaccgatggcgttggtgacaatctctcccccttttatatgttcagatggtttgtctttcgcacccgaaaatagatctaagccaggagaaatgtcagactgtgaagcagagatggtcacatgctcaaacaatttttttggtaatgccgagcaatctgctaaacttgccagcagtgatgacaggccagaggctttcacaatgactgagagcactacaaactgtgggggtgaacaattgacagatgtcaaagaacctgtggccagtacagcaaaagaacagttatcgaaagacatcgagactatgccagataaaaagaagggtgagggggctctattctatgaacctcctcgattccctggtttggatgtcccgtttatcagttgcgatcttgtaacttctgctgatctgcaagaatttagtccccttggaattaggcagtggatgcggtcgaccatgaatgtcccaactcctttaagattatggggctctccaacacatgatgaaagcccagatgcactaaaaactgctgctgaaagcttcccatgcacaagttcaataatgaaaaaaagacagagaagtctattgtcccctactccagatgaaagaattgagaagaaatctgggattgcaaagggggtgacggacatctcctatatgataacggccacatgttccatgaatgcaaccaatgatgaagacattgttactgaatcagctgtgtgtgctaagcaaccttctttgaaacatctagacaagaagcttgagttctctgacattaacaaggaaaaactctgatggagcatctgaacaggccaaagatgcacaaaacgcacaactcgtggatgagcaacattcctcaccaaatgttgtgaatcctaacactgatctacaagacaatatactacctgcgtttaaataaattatttggtgatacttagccagttggtagtaaccatgctcctataaacgaaaatagtgtggacat

SEQ ID NO: 305 - DNA, 872 bp, Zea mays
cagttggccccccgcgggcccgccggggaggtcaccaccactcttggcgaagcgaaatccaccgtacaccgctgcctccctctccctgtctcgtctcgtcgaaccagccgaggaagccaacgcagacccagcgatcctcgtcgcgcgtcctccctcctcccccacggagggaaggatggcggagcccaaagcggcggcggcggcgaggaagacgcgggtgggcccgtacgaggtcggcaagaccatcggcgagggcagcttcgccaaggtcaagcacgcgcgcgactcccgcaccggcgccgtccgcgccatcaaggtgctcgaccgcaaccacgtcctccgccacaggatggtcgagcagatcaagcgggagatttcgactatgaagctgatcaaacatcccaatgtggtacagctgcatgaggttatggcgagcaaaacgaagatatacatggttcttgaatttgttgatggaggcgagctattcgataagatcgtcaattctggaaggctaggagaggatgaagctaggatatactttcatcaacttataaatgcagttgattattgccatagccgaggagtgtaccatagagacctgaagccagagaatttgcttctggattcaaatggagctcttaaagtttcagacttcggcctaagtgcatttgcaccacaaacaaatgaggatgggcttctgcatactacctgtggaactccaaactatgtagcacctgaggtgcttgctgataaaggctatgatggtatggctgcagatgtatgggtcctgtggcataatcttatttgggtctatggctggatacttacccccttgatgatgccaatctgatgagactgtacaaactgatctg

SEQ ID NO: 306 - DNA, 685 bp, Zea mays
  misc_feature (612)..(612): n is a, c, g, or t
cccagcgtccgcggcgagataaaattcactgctccctgcccgtcgaaccagccgagcaagccaacgcaaacccagcgagccgcggcacctcgtcgcgcgcgccttgcctgtccgcttcttcgtccgatcgtccgccggtccgagccgagccccccgaagtatggcggagcccgcggcggcggggaggaagacgcgggtggggccgtacgaggtcggcaagaccatcggggagggcagcttcgccaaggtgaagcacgcccacgactcccgcacgggcgccgtccgcgctatcaaggtgctcgaccgcagccacgttctccgccacaagatggtcgagcagatcaaacgggagatttcgactttgaagctaatcaaacatcccaacgtggttcagctgcatgaggttatggcgagtaggacgaagatatacatggttcttgaatttgttgatggaggcgagttattcgataagatcgtcaattctggaaggctaggagaggatgaagctaggatatactttcatcaacttataaatgcggttgattattgtcatagccgaggagtgtaccatagagatctgaagccagagaatctacttctggactcacatgnaacccttaaagtttcagactttggcctaagtgcatttgcaccacaaacaaaagaggatgggcttctgcatact

SEQ ID NO: 307 - DNA, 2033 bp, Zea mays
cgtgaatctccttcaactttgattcgagatcaacaaaatccacaggaatatatctatcttctccgccggagcctgggaggtcgcaacaatatggaagcaaccgacgaggagaacgctctgcttcttcgtctccatcccactccgcaggtcgtagcttcggagtacgcaagtgatggttcagttgatatcaacaaacaacctgctctcaagcacagaacgggtaactggagggcatgctaccccgtcttaggtgttggattccgggatgcccgggtcgtccctcccgtcccgacgattttagtgacgtatctcaccactgtgctccacgagagcaaggtggatgcagcgagaaatatctccgcctggtccggagtgtgcttcctcacgccacttcttggggctttcgttgcggacagttacttgggaaggtactggaccattgttgtggtcctcccggtctacatcgtggcaatgctcgtcctgatagcttcagcttctctcccggtgttgttccagagcgacgtgcaccctgcagtggtttaccttggtctctaccttgccgccattgccagcggtggcgtgaagccctgcatttctgccttcggggctgatcaatttgacagcagtgacccggcggagctggtgaagaagggctccttcttcaactggtacttcttcctgacgaccaccagctccctgctgtctggcaccgtgattgtttggctgcaggacaatgttgggtgggcagtcagctacgtgatcccgaccgtgctcatgctcatctgtttccccgcatttttagctggctccagggtgtacaggtttagggaaatgggagtaagcccccttgcgagcttacttcaagtggttgttgcagctgtcaggaagtggaacgccaaactgccggacgatagctcgctgctatatgagcaggccagttcaccttgtacgactgaagcaagtcataagaacaagcataccaatcagttcaggttaccaatcagttcaggttctttgacacggccgccattgtcccaccaggcaacgaatccacggtgcagacgagtccatggaggctctgcacagtgacacaggtcgaggagctaaagatgctgctcttgacgctgcctacctgggcgtcgttcgtgattttctacgcagtcacgtctcagatgcagtcgacgatgattgagcaaggcatgctcatggacaaccacgttggctcgtttgccatcccgccggcatccatgccgatcattggtgtgctcagcttcctcatctgggtcgccgcctatgaaaccgtcctagcgccattggcgcggcgcttcaccgggaacgagaagggcttctcccagtggcagcgcctcgccatcggccaagccctgtccattctgacaatggcgcttgctgcgctggtggagacaaggaggctggcgatcgcggaagccagcgggctgaggcatcgggaggtgccggtgcccatgagcatcctgtggcagggcccagttttctttgtgcatggtgcggccgaggtcttcggtgccatcggcatgacagagttcttctacgaccaagccccggcgaccatgaagagcctgtgcgccgcgttcgggcagctcgcggtggcttccgggtcgtacctcaacacggccgtgctcagcgtcgttgcgttggccacaacgcgcggcggcgcaaccggatggatttcggacaacctcaatgaaggccatcttgactatttcttctggatgatggccgctcttagcttgctgaacctagctctgtttgtgcgctactcaatgcggcatacagacaggcaacgtaagcaagaccttggtttatcataatttcaggaaaaatatgtgaacaaagcagactagaagctatatggacagactactcatgaatagtaacattgtatgaaacagctaaatgcatgtaacaacttattcaatatagggtctctcgaggggtatctttagaagcttatttaagaaaaaaatagacgagctcttagcgaatagcttatctct

SEQ ID NO: 308 - DNA, 2318 bp, Zea mays
ctggcgccggagcccaccatgcatcgggtgggtcggggtgtggcctggagttggaaggccgaagggaaggcgagggccgaccggccgagcaggtttgaagtgcggtcgccgggaggcgttgacagatcagcagcctggttgggattgggctgatgggctccgctagaatggcccatgtggcccacatccgtgagtagttggatttggactctcggacaggacggttcgaaaggtcagatcggatccccatacttgctaatgctaggccacggctgacgtctgcgccgcttccgcgtcggcggcggacagctcggagccgctaggtctccgctctctgccgcattccgtggcatatcctataacaatttccccaacccacatggccaacgccgacgctggcgacggcgacgaggtcatcctcgacgctcccggcttcatacgagtgtacaggagcggccgcgtcgagcgctttctgccggtcgacttcgccccgccctccactgacgccgccaccggcgtttcttcaaaggacgtcgccatcctcccagacgcctgcctattggttcgcatttacctcccagcgcccccctcttccggaagttacagcggcaagctccccgtcctggtgttcttccacggcggcgggttctgcctcggttcggcgtttgatgcggcggtgcactcccacgccaaccggttagccgcggctgccggcgcaatcatcgtgtcggtggaataccgcctcgcgccagagcatccggtccccgctctctaccgggacgcgtggacggcgctccagtgggtggccgcgcactccgtgggccgggggcaggaaccctggctgactgcccacgcggacctcgggcgcgtccacgtcggtggagagagcgcgggcgcgaacattgcccaccacgccgcgatgcgcgctggcagagaggagctgggccacggcgtgaagctcagctcgctcgtgatgatccatccctacttcctgggaggcgagagctccgagacagacgacatgggcgtagcgttgctccgcgagctcgtccggctgtggccggtggtatgcccgggcacgagcgggtgcgatgacgacccgttgatcaatccgatggcagagggtgcccccaatctcgctagcttggggtgccgacgcgtagtggtgtgcgtcgggggaaaggacccgatgagaggcagaggaaggctgtattgtgagaagctgaagagaagtgggtggcgcggggaggtggatgactgggaggcggacggccagggacacggtttccatctctcgtgccccatgagcgcagaggcggaggcgcaagtccgggtcatcgctgagtttctgacctacggatgacatatctgttttcccactccttcacgcggccatggtgcattgttctcgaatctgatatacattttttgtttcgagttttggttgaggacttgcatgtttatattttatatttttatctactatttcataagcttaataaatgtttggctatgggttccagattctcaattttcatcagaagaaggggttactgagctgtattagacttacctttgggttaatatctattggtgcaagacccagattggctatacctttgtaatcgtatttgctttgcctggctaaagtttatgacaaaattgtcgcattgctgacattctctctaaaaaaaaaaaaaaaaccttgtcgcataacatgagcagtcatttagtatacatgagtgatgagtcgtgaggcttctcataatagagcagtgttcctgcacaaatgggagaaagggctggtagtctcacatgcaaagagtccaggagcagccacctatgatggatcataacccaacagttgtaaaagaaatcaatatggggagaatttctcttggaccaacttatttgatgatatctcttgctttgatatccaccttcaggcatcctaggtgtgttttgtttgtcctacaaggcatgcattatgtcttggtcaatcttttacttccattgctgcatcatggggctttgagaaatactgcttccttgacttgtccttttgctttcattgaccaaacacactttcctttatcatcttgcaaaaggcatgctgtttgagcaagacataagttatacacataaattttatgatatgcgtggactgaaggctaaaaggctttttaaagctaccccaacttgcttgggataaaaggcttttgttgttgttgttgttgcatgaactgaaggatcttggtagaatttacagagaaatgctgtagcgatttgatctgttgcaatatcaatgattgagttag

SEQ ID NO: 309 - DNA, 904 bp, Zea mays
  misc_feature (760)..(760): n is a, c, g, or t
ccggccgggatattggctagctttcggctcgccggccaacgacctgcagccaaccatctaccagcgactcagcgagcgagagcagcacacacacgcagctagctaggagcagcagcagcggcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtgctactcttcattacataattttgatgctatatatatataccccatccctccctaaaaaaaaaaaaaaaaaaggggcccacgttaattcaaaaaaaattcgtaaaagatggtgaagctaattaagtgaaatataanatatgtgacatacatacatacgtacgcacgtgcatacatactcctccggttacaaattcaaccaaatgatgatcagctcctccttaggtcttggttaggagcaatggtacgaagggaaatttaatagtaaaatatattctagcc

SEQ ID NO: 310 - DNA, 690 bp, Zea mays
accggcagccaaccatctaccagcgactcagcgagcgagagcagcacacacgcagctagctaggagcagcagcagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagccaccatggatgatgctcaaccttcgtcatgtaacaataatcagtgctactcttcattacataattttgatgctatatatatatatatacaccctccctgaaggccccccgggggggggggggaaaaaaaaaaaaaaaaaaaaaagggcggccg

SEQ ID NO: 311 - DNA, 3254 bp, Zea mays
  misc_feature (2347)..(2347): n is a, c, g, or t
cccccaccgagtgtggagaggctgctttgaatccacgacctagtgagtcagcgagacagttctcggcactgcaccatgcctgcccttctcgttagatatattagttcataggtaatatgatcgtctaaattctcaaatggtatagactgcctagtggatcttgtatttatcttccattttttttactaaaatctggtctgcggcttagctcgcaatttcagaagaactattgtgatcttctggattcaactggcttgttgcatttttggatccttgcctcggttattcggttccttccccagactccactcatttgggagccgccagtacttctttcttataaatgccaacaagtggtaatcttagaagataaaataggtatacagaaaaagatgattataaccaaaagcacaaaaccagagtatgggagtacttctgtaactatggatttttatagtactatattctgctactgcttgtgtttcatttgttttgcttatcttatctatagaaggttagcagcatgtttaaaactcattttctatcaggaatcgtttagatgattgtatcctaggtcagctacattttatgcaatctggtatagttttatttttagcacacatgatctgtgaacaggatcgtgtatgctttggtaaaaccactacaagactaattggctgtgatgaagtgatgataatctgtatagttttgtattgctgtctctgttagcggttctgatgataatgaaatcggtgctggtcgcggggcgcattcctactcgttggtgctccaaagtgttcacccaaagtatcaactattacctctgcacactctgatgggggagataagtaaacccttgctgttggattggtccatctcggtggagtttttgtatgtgtgaagtaccggttgtttcatgctggatattgcgctacttgtggccatagtatgtcattgaagctagatgcgcctcacttgagagttttgttgcaaacctattccaattgtggtctgatgacccctggcaaagagcttttgcaagctgacgttgaaacggtggcttggtgaccgctaataaattttccatcttgtgaacttgttctcagaatgttttgcgccttacatgagtaatatgcttttacacattgcacgacccgtttctggggctattgcctaagggcctgttcgcttctttcagaacgacgggtcggaataatttcctgttgaaactattcactaatttatatagtttttgataagccggaacagtttcatgtgcattccaaactaaccgaatggaccctaagcctgttattgttgttgcacactagcccttgtttcactttgttcgctacatctgaatgcttctgagttgtctcctcttgagttagggatgcatttcattgctactccatccttgtcctctttgagtttatattcgcgggttgggttgataaaactgtgcgggcctatacctgttgctaactctatttgcatttttttttgagacgagtaaaaaaaaagaggggactaaatacttgttctcagtcagaccatccccaactatcctcacatttttctctgatgcataaggtaaaaacgacaattagagttgattgcattaattgtggagggttaaatcggttgtagtccctcatctatctaaatggaggaggtctagacccgttataagtaagttctcgagttaattttgctagaaatttgaaaccataattgatgttgcgcgtgcgaaccgtcggcgccgtcatcgcggattctccacactgctcgtttttaggctcaacatatgcctccttggcttttggtggaggttgatgaaccaaaagcatatgtactgtcagcaatcttcagaaaacaatagatctcacaaatcatcttgttcccgagtaagaactaagtctaatgcaagtcactagtttttcaattcaatatgatgatcattcaatagagctccaatgcacaaaggtcgtttcagattgcatcattctcggccatgaccatctgatcaaaggatcaaaaggtatagaatgaaagtgcccccagcctgagtgggttatcacctgaggaataggcgatgcttggtgtgtcgccttttgggctattttattcgatcgttttgatttagcgggtgctcgtggcttctttgttggcagatcgcgtagaacgaccttcttgctaatgtatctggagagcaatcgatcaaaagtagggtcgactttataatatcctggccccggggatggcgatatctgcttaataaaattaatagagtacttatattaacaaggtatatttttttggaagcctatctcgaaagaacctttangttaagcgtgcttggcttggagcaatttgagatgagtgaccgatagagaagttttctcaggtgcgcgtgagtgagaacaaagtgcatataaaagactcgtgttggtctgtgaggataatatgtgatcctagaaagctaccaggagtaagtatcgttggttcgggagtggacgtggtgttacaagctttaaccactcgaccatgtgtgttatgtgtgttttgcccctgtgtctcccttttcgcttgtgtggaagacgacgcctctgaccatgggcggactgttcggctgagtcagccggaccatctatttgagcgtcggatcgtccgcgtgcatgtgccggaccgtccatgatgcatgagtcagggagcttcgctcggctgctcgattgagcctgcccccccggtgcctccggacttgttagtctttctattcggaactttccgagtaatctctccttatgatatattcgacgtgcgaggatcaccaatgagctgagctactaaaaaagatctaagtgtcatccaatgttttaagtagtatagaaacccattaaaaactagtcctgctagctgtttgtccgcgacgtggatttggaagcatcggtctagtgttctggaacctttggatatagtcattaactgattccatgttccccagtcggactaaagctagatcagctagttctaactcatgttgtcctgagaaaaagtgttcatggaatttctgctctaattcttcccataaattgatagagttgggtgacagagctgtgtaccatgtaaatgtgataccggtaagggacaatgagaataaacggacacgctaggcttccctaccagccaattctgctaggtgtgctaagagttggcttacgtgctcgtgcctgcttttcccgctttcaccccgg

SEQ ID NO: 312 - DNA, 914 bp, Zea mays
  misc_feature (843)..(843): n is a, c, g, or t
cattgggcaccgcgagggtatttcgcacgaatcgtccccgtccagagcgcgagcaacccacgccgccccgctgtctccgccggtccgcccccgtccctcccctcccccgaatcgcgtcgtcccgtctcctgctgccgcggaaccctcgccatggcggaggcgcccgagaccgccgcccccacccagccgcctcccgcgccggcggcttcgtccccgcctcccaagtcggggatcccgccgcggtacgacctggacgccaagtgggacgcgtgcctcgacctctccatccgccgcgtcgcctactcctccctcggcggcgccttcgcgggcctcctcctcttccgtagccctactactcgctgggcatcagttgcccttggagctggtgtggggataggggctgcatacactgaatgctcatacttattcaatggtgctccaaagtgttcacccaaagtctcaactattacctctgcacactctgatgggggagataagtaaacccttgctgttggattggtccatctcggtggagtttttgtatgtgtgaagtaccggttgtttcatgctggatattgcgctacttgtggccatagtatgtcattgaagctagatgcgcctcacttgagagttttgttgcaaacctattccaattgtggtctgatgacccctggcaaagagcttttgcaagctgacgttgaaacggtggcttggtgaccgctaataaattttccatcatgtgaacttgttctcaaaaaaaaaaaaaccttacatgagtaatatggcttttacacattgcacgaccccgtttctggggctattgcctaagggcctggtcgcttncttcagaacgacgggtcggaataaattcctgggtgaactattcactaatttatataggttttgataagccg

SEQ ID NO: 313 - DNA, 826 bp, Zea mays
cggcctcgagcccaatcggctcgagcaagccgcaagcatccgcacacgcactccgcctccgctccgctgtctccaccggtccgcccctcctcccctcctttgcgcctccccgaatcgcatcagcctttctcctcgtgtcgcgactcgcgagcgaaaccctcgccatggcggaggcgaccgacaccgccgcagccacgccgccgccagcgccagcgatggcgactttgtccccgcctcctaagtcggggatcccgccgcggtacaacctggacgccaagtgggacgcgtgcctcgacctctccatccgtcgagttgcctactcctccctcgccggcgccttagcgggcctcctcctcttccgtagccctactactcgctgggcatcagttacccttggggctggtgtggggataggggctgcatacactgaatgctcatacttgttcagtggtggtcctccaaattggtcacccaaagtatcaacaattccttctgcacactctgaaggagaagacaagtaaacccttgcccgttggatggtggagttgtggtgtgtgtgaagtactggctgtttgtgctggatattgcactgcctgtggccataccatagcatgcattgagttttctggcaaacccattgaattccccaattgtggtctagcgaggaagtgcctttgcttggtaacttgttcgcgccatacttctggggctgtatcatcgccaaaccatgcgacgcttacttatttcatttggttctctgcaaaaaaaaaaaaaaaaaaacggcccgcccccctacgacccaaccaaaaaaaaagcccctagggcc

SEQ ID NO: 314 - DNA, 1336 bp, Zea mays
  misc_feature (28)..(28): n is a, c, g, or t
cgtgatgcatggacatttggggcagttngatccgacagcgggacagcatccttgcttgagctagctcaacggttgtctgagctgcaaaagaagggctggagacctcgacggaccatcatcttgtgcaactgggatgccgaagagtatggattgacagcccacgcgtccggggtcgaggagaacagggcaatgctaacttcaagaactgttgcttacctaaatgttgattctgcagtggctggtcatggattttatgcgtctgcaactcctcaacttgatgaattgcttaaagaagctagtaagcaggtccgaaatccagacaatgggacacagagtctctatgatttgtggatgtcttctaacagttctcctttgattggaagattaggaggtggaagttcggattattctgcatttgttcaacacattggtattccatcagtggacatggcgattgggtcagactatccggtctatcatagcttgtatgatgacttcatatggatggaaaagtttggagatcccttgttccagaggcatgttgcagctgcaagcatgtgggggcttgttgctcttaggctctcagatgaggagatcctacccttcaactacagcaattatgccacagagcttgagaatggagcattgggcataagtgaaagagtacagggaatgcctgtcagcttatcacccctgcacaagtcaatcaaagagttcagaaaggcagttgcaaaagtggattctgaattgaaggctctacagacatggaaaatttggtccccatggagaaacaaccccttaaaggtcagagacatcaatgatcggttgatgatgaccgaacgggcattcacagaccgggaaggactgtctggacggccatggtacaaacacctgatttacgcaccttcgctgcacaacgattacggggctgaagtgtatccaggcattggtgacgccattgagagggtgaagaaaacaaatacttctgaatccttgcaatctatacaacatgagatttacagggtctctcgagtcataaaccaggcagcgcttgttttaagtggagggctcacgtgagtattatttcaccttgctatagctggagttcgtgaatgcagtagctggactgatacagtattgcataggatggtgatattaaggggaaaaaaataaatttcactggcagtcattacatttgtgccgagttcttattttgattctggtacctataaattgcatattactcttttccaaacttattccggttcctatttataattcgtatttctctaaaaaaaaaaaaaaaaaagggcgggcgcctctaaaaaggatccca

SEQ ID NO: 315 - DNA, 1451 bp, Zea mays
tctttatcgcgggcggccgctcgcgatctagctcaacttgatgaattgcttaaagaagctagtaagcaggtatgtcaatatgaaggaaatgtagcagaattttagagttaacaaagagaatttaacttaccatgtgaccagaaattgtacaagtggcttaattgtatggatcctgtagttatgcaaaggatacagtccaaaaattagtacaatcagaggaacgaaatcctcttttgattttgcatgtgctgttatttcaagtataaattattgactattagcagtttggtttgtgatgtatttttttttatatacaattgatgttagttcgtgcatctgctgactatgactaaagtcaaatggtgacttctcttaccagtcaactattctgtctctaaacattttctgttttcgttattggtgaggaaggtccgaaatccagacaatgggacacagagtctctatgatttgtggatgtcttctaacagttctcctttgattggaagattaggaggtggaagttcggattattctgcatttgttcaacacattggtattccatcagtggacatggcgattgggtcagactatccggtctatcatagcttgtatgatgacttcatatggatggaaaagtttggagatcccttggtccagaggcatgttgcagctgcaagcatgtgggggcttgttgctcttaggctctcagatgaggagatcctacccttcaactacagcaattatgccacagagcttgagaatggagcattgggcataagtgaaagagtacagggaatgcctgtcagcttatcacccctgcacaagtcaatcaaagagttcagaaaggcagttgcaaaagtggattctgaattgaaggctctacagacatggaaaatttggtccccatggagaaacaaccccttaaaggtcagagacatcaatgatcggttgatgatgaccgaacgggcattcacagaccgggaaggactgtctggacggccatggtacaaacacctgatttacgcaccttcgctgcacaacgattacggggctgaagtgtatccaggcattggtgacgccattgagagggtgaagaaaacaaatacttctgaatccttgcaatctatacaacatgagatttacagggtctctcgagtcataaaccaggcagcgcttgttttaagtggagggctcacgtgaatgcagtagctggactgatacagtattgcatagtatggtgatattaaggggaaaaataaatttcactggcagtcattacatttgtgccgagttcttattttgattctggtacctataaattgcatattactctttccaaacttatccggttcctattttaaatcgtattctcaaaatttgtcatgggttcttatttcaaatttcaataaacactcggctccataactttttgttaaaaaaaaaaaaaaaaa

SEQ ID NO: 316 - DNA, 2549 bp, Zea mays
gtatccgtcccgaatataaaaaatacccgtatccgtatccgaaaaatggtcccgaatcagtacccgtatccggtacccgtttcgggtaccctacccgttttcacccctaggagcaaggcaccgttgttgccttgcctgtgccctgcccgagcgtatatggcgtgagccggaggcggaggggcacccaccacctccaccaccccgcttcctcctcctccttccgtctaggcccggttgagtctccctcacgccactgcaactgcgaccctcccacactccactctcctcgccttccttcctcctcgtcgccgtctcctactataaatcgatccccgtcgtctccctcctcctcccccctcgaccacgcacgcaaatgaaagcgctcccctcgattgggcggcacgtaacccaccaccaccaatacccggacccatcaagcaagcgctgcgtcgtcccctgcaaagaccgcgcattccgtgcgtgccgtgtccacgcgcgcgcgcgcgcggtggcgttaagttgtcgagcgccagaggaggagcgccactagtcgtcggtcgatttgacccaggcgaggaggcgtaggcgtaggcgtaggcgcgtaggggagtctagctagctactggtgttgggtcgctagcttccgacgatggaggtgaagaaggagggcgcgaaggcgacgctgccgccggggttcaggttccggccgacggacgaggagctgatcgtgcactacctgcggcggcgcgcgctggcctcgccgctgccggccgccgtcgacatcccggacgtccgcatcctggcgcacgacccgtccgacctgctgcccccaggtgagtgagtgagggatccatccaatcatctcggactggggctggggctgattggttttgttgctggactttgtggattgggggcggcggtggtggcactgtggcagggttcggcgagcaggagcgctacttcttcacgtgcaaggaggccaagtacgtgaagggccggcgcgcgaaccgcgccacgggggccgggtactggaaggcgacgggcaaggagaagccggtggccgtggcggtccggggcgtgcaggggcagggccagggccagggcgtgctggtgggcatgaagcgctcgctggtgttctaccgcgggaagccgccgacggggagcaagacggagtgggtgatgcacgagtaccggctggcgggcgccgggctcgcgccgtgccgccgccgccacgccgacgccgacggagacggcgtggcgcgggcgccggccgagggctgggtgctgtgccgcgtgttccggaagaagggctccgccgccgtcgcgaggcggcccggcgaccgcagcgacggcgagggcgacgagagcgcgtgcggcggcggaggaggcggcgggcgcgggttcatcgacttcttcgcgcgcgcggacgccgccgggcgaaggcgccgcgctccgtcgcccgccgtgtcgagccggtggcttgcggacgcgtcgccccagccggagcaggaggccaccagcagaggcccgtgacgagacaagggccggccggctggctggcgtgaagcgatcaagcaaggtagagagagagagagagagggaagcttttgttgcattggcagtacctaatgaggggagggtccagtacagtaggtaggagcaaagtgaattcgttttagcaacgtgagagagagaggcccgatagtcagtgcagtatcagttgttgagcgtagatggtgaaactaatgtagcagctcagttgtactcctcccaaccacctgatgaatcctacacaattgtagagtgtggctgcagcaaatcccggccatggcaccggagctcctccaggaacgcaagtccaccagctgctgctgctgcttgccatggcggtggcggattgctagtgctaatgttccacaggctgttgattgctgagaagcaagtggcgggggtggtggcgggcagcagacggaagatggcgggtgtctgatactggtggtggtggtagtagtcgtgcgtaatctgttgcctggacttggacttggtttctttaatgcaattatgatgatgaagtgaatgccttctgcgtgctggtgttggaacgccgggcaagaaaccaaccaggaatcaactagtctttcttgtccccgggtagacgcaacgcaagtggatggtttttgttgcgtgcgcgagacggttgaagaagaagtcagccggcggatggcggtcaaacgtcacatatgggcccgcgccgatggatggctgtctgtccctcgtcccggtcaggaatattttgtgcagatctcgtgtttgaccgaggcgaaagcaacggaacccaactcattggctgctcgacggtgcccaactcacgcacgccacctcctcatgctccttattccttaatagtaaaaaaaaactagcggttgcgtgcaccagcgaggcgcacttgccgattgcgttgcgcaccctagtatggaaacggatataggaggtgtttggttagagggactaaagattagtctctagtttttagtcttttttttgcc

SEQ ID NO: 317 - DNA, 2422 bp, Zea mays
ctgcagccgcaggccgcagcaagcaagcagacgcaggcagaattcgggcacagctacacaaggaaaggcctgtacctactcagaaggggaaaaacttgaaggaagagggagcaaggcaccgttgttgccttgcctgtgccctgcccgagcgtgtatatggcgtgagccggaggcggaggggcacccaccaccaccaccaccaccccgcgtcctcctcctcctccgtctaggcccggttgagtctccctcacgccactgcaactgcgaccctcccacactccactctcctctcctcgccttccttcctcctcctcgtcgccgtctcctactataaatcgatccccgtcgtctccctcctcctcccccctcgaccacgcacgcaaatgaaagcgctcccctcgattgggcggcacgtaacccatcaccaccaccaccaacccggacccgtcaagcgctgcgtcgtcccgtgcaaagaccgcgcattccgtgcgtgccgtgtccacgcgcgcgcgcgcggtggcgttaagttgtcgagcgccagaggagcgccactagtcgtcgatcgatttgacccaggcgaggaggcgtaggcgcgtaggggagtgagtctagctagctactggtgttgggtccattattcgctagcttccgacgatggaggtgaagaaggaggccacgaaggcgacgctgccgccggggttcaggttccggccgacggacgaggagctgatcgtgcactacctgcggcggcgcgcgctggcctcgccgctgccggccgccgtcgacatcccggacgtccgcatcctggcgcacgacccgtccgacctgctgcccccagggttcggcgagcaggagcgctacttcttcacgtgcaaggaggccaagtacgtgaagggccggcgcgcgaaccgcgccacgggggccgggtactgggaggcgacgggcaaggagaagccggtggccgtggcggtccaccggggcgtgcagggccagagccagggccaggccgtgctggtgggcatgaagcgctcgctggtgttctaccgcgggaagccgccgacggggagcaagacggagtgggtgatgcacgagtaccggctggcgggcgccgggctcgcgccgtgccgccgccgccacgccgacgccgatgccgacgccgacgccgtggcgcgggcgccggccgagggctgggtgctgtgccgcgtgttccggaagaagggctccgccgccgccgccgccgttgcgaggcggcccggcgaccgcagcgacggcgagggcgacgagagcgcgggcggcggcggcgggcgcgggttcatcgacttcttcgcgcgcgcggacgccgccgggcgaaggcgccgcgcgccgtcgcccgccgtgtcgagccggtggcttgcggacgcgtcgccccagccggagcaggaggccaccagcagaggcccgtgacgagtcaagggccggccggctggctggcgtgaagcgatcaagcaaggtaaggtagagagagagagggaagcttttgctgcattggcagtggccaaggagggtccagtacagtaggtgcaggtaggagcaaagtgaattcgttttagcaacgcgagagagagagaggcccgatagtcagtcagtcagtcaaccagtgcagtatcagttgttgagcgtagatggtgaaactaatgtagcagctcagttgtactcctcccgaccacctgatgaatcctacacaattgtagagtggctgcagcaaaatcacggccatggcaccggagctcctccaaggaacgcaagtccaccagctgctgctgctgctggccatggcggtcgcgcggattgctagtgctaatgttccacaggctgttgattgctgagaagcaagtagcggtggtggtggcgggcagcagacggaagatggcgggtgtctgatactggtggtggtggtagtagtcgtgcgtaatctgttgcctggacttggacttggtttctttaatgcaattatgatgatgaagtgaatgcattctgcgtgctggtgttggaacgccgggcaagaaaccaaccaggaatcaactactaatctttcttgtcttgtccccgggtagacgcaacgcaacgcaagcggatggtttttgttgcgtgcgcgagacggatggaagaagaagaagtcagccggcggatggcggtcaaacgtcacatatgggcccgccccaacggatggatggctgtctgtccctcgtcccggtcaggaatattttgtgcagatctcgtgttgaccgaggcgaaagcaacggaacccaactcattggctgctcgacggtgcccaactcacgcacgccacctgctcatactccttaatagtaaaaaaaactagcggttgcgtgcaccaacgagctgctgcacttgccgattgcgttgcgtgggctaatatgga

SEQ ID NO: 318 - DNA, 5017 bp, Zea mays
tgaggtaatctcataggcaatttatcgaacatagtgaggcaacgtgggagcatagatacacactaacgcgatgaggatggcccaaaacatagacaccacggacgagagtgtgacgagtgacgtgtttccgacatataggttgtggttaacgcgcgacgctcaaccttgcccgacgacgattgaccaacagtgatttctttaactgaaatcagacatggtcacaactgttgcctcgtcgcgctattgaatgtgaatgagggagaggcggttcagttccgatgacagatgaacttccgatgaaccggatcgaaagggcactcacacgaagatacatgcggcctccgctggccagagtgtaccgagcgaggcgaagccatcaactccactcgtcgagtccaccgtcctgagctacatggggaacgattcgcctatggcttctgaactaaaccagtgaggaggggtggactagagtgaccaggtaggaaaaaataggaagggtggggaggacctcgttggaaattgctcccaactcatgagatctttgttggatcagtatcgagtatcgatcgctctccacttgcacaattgaacgagatggggcgtttgcactggttacactgccccatattaaatacgattgtatatgtccgaactatttccatagttggatacgaacaccctataccactaggtaacagaaaacaatggaaagttcttaatatgagaggtttatttgtgatgcatcagagagaaaaatataggactttttagttatatgttcattcagcaaaaaaaaagtgagaagggaaaaatatgcattagaactatcaataaatttcttgctacatttctccatattgtgcatgtaatctagcatttgacaatatagtacgcagcatgttatgtacgttcaccttttgtttttgccaatgtagaagtaaaaaatagatgataccgtcataaaaaaactaccacaaagtcgtcaactcgtcatcaacttttaaatcgaatgcaaacttaaataaaaaggacccctatgacctatcaatgtaaaacgactcctgcacccttgtcccagtgcgcgcattgaatccatgattcgattcgcagcacgcagtacaattcagaagtacatcgagtaacacaagcttatgcttttttttcgatttgacctgagagagtccagtccagcagcagtaaatcatatttttcgcacaggccatctaatcctccgttgaaacccaacaaaaaaatcacgtgcgatcctcatcgatcccaacgaagcatttcccttttactttcgccaggaccaggagcactcccaatttcttttccacctcttctctttgtatttcgcccttttgcgatgtgtatgggagtactggtgtgggcccatcgccgatggctccctgtcctgcccctgcctccccaattgctcgctttccaccccttgcctctgcaacctccaccaaggaattctttgcccaatgcgctcatcgtccccgtcacacctctgcccacgcaccatcgccgatcctattgcccactacaatttccccatttctctcacgtaagtaggccacaccatcgcgtcatctctgctccgcctccttcccgccggcttcccgccgtcctttcgctgccgctgccattaccgccactgccgcaccggctggccgcgctaaaacagcagccgcgcccgcgctacgctgaccggcgacggcggccggcaagactgcccgttcgtccggtcccttcactccaccttcgcgcaacggcacaaggcggcaagggaccggacggggccggcctcgtgctttttgtgcgtggttggagtggttgagcgagccgatggcgacgatcccgggcggcgtggcgccatgacggcagccatttcaatacgcgcccccccagcagctgaaacctgacaagctaaccagattttaggtggttacccgtgccgtgtcgcctgcctcgcacacccctcgcccttcgcctcttttccaccctggacccaggatatagttcccgctctcgtcgcttgcgcttgtatcttcctcgtctcaggcctccccgccgcgcctttcggttcgggttcagcgaattcagccacgaagcgagcgggcggccggagggttcctggtaacggaactcgctcgctttccagtttccaggtcaggccaggcgacgaccgccgcctcggcagttttctattccagcgtcgcggttccgggtcagaaattggttgcaggctcgcagccagccagtagcccggcgagatcgtcttgtgacagcggcaagtccacggcggttagcaggttgagcgaaccagtggcctggctacttaccagcttgccgtgccatgtgcaactgcggttcttcctgctgatctcgggagctgcaagcccggctctcggccaccgttcgtgggcgtcatggcggcggaccacggggagggcgtcgggcggtgcatactggtggggctgcacatggacgccgtcggcagggacctgctccagtgggcgctccaccaggaggtcaggcggggcgaccgcatcgtcgccgtgcacatttaccgcaagtccggttggtgtctgcctagaactataactggtctgggaatcattagcttccttttcttttcttgacatattcttgcttctcgttgcagacaagacgaacacactgaagctgatcaggacgctggacgactacctggcggaatacgaggctctctgcaaccagaaacaggtgagctaggatgggcagcggacaggtggcgactgctacggagttttttttttttttttttgccatgctgctgctgattcaattgacatgccaccattgaatgattttgtgtcaggtggttctcgtcggccgggtgacgccgggaagctcgatccagaaggagctggtgaaggaggccaagctctgcgccgccatggtcgtggtgcttggcgccaataagaagtactccttcgggtaagtacgctggcagcaacctttgtatgatctagctaactgctggttccgtcaccatcccttagcaaaccttctccttttttccccccattttggttgcggttgcgcagagggtcgtcctgcctggccaagtactgcgccaagaagctgccgccgacaaccaccgtcgtcgccatccaggacggcaaggccgtcttcgtccgggaggcgcccaggccgccacttggtaataaagtgcccattaattaattgtggttatcagttgtggagattttggttagcgagtcgctaatcgttgggtggcgagctggtgcgcaggagcagagccaaagccggtgctccgcacggtgctgcacccgagcgtggggctggagcccaaggtgatcatcccgaacccgaaccggcgcgcgcggtccatgtccatggacttggacgccccatgctgcggtcacggcgccgcggacgcgccggcaagcaggtgcttggacgacgccaccaaaggcgacggcggcgtggcgcccgagcagaggctcgggtggccgctgctccgccgcgcgcacgccgccgccgccgcctcagctgcccctgtacagacgcccggcggcaagaatcatgagccgcggaagcagtcggtggtgcactgggtgatgagcctgccccggcggtccgcgccgtcggagtccgccgagccgcatgccggggcggggctcgagtcggagctcaaggcaatgcttggcggcagtggcgcgcggtgccggtggttccgctacgaggagctctacgactccaccaaccacttctccgcagagaacctgatcgggaacggagggaacagcagggtgtacaggggcagcctcgcgtgcggccggcaggtggcgatcaagttgtgcaaggcgtcggtggaggcgtccaaggacttcctgcgtgaggtggacatcatcaccaagctgcagcaccaccggatcgtccccttgatcggcgtctgcgtggaaggccgcaacctcatctccgtttaccgctacctccccaggggcagcctcgaggacaacctacacggggaaaggtcaaagccggcgctgtcgtgggagaaccggtacaaggctgcgctggggatcgcggaggctctgagctacctgcactccggcagctcgcggccggtgatccacagggacgtcaagtcgtccaacatcctccttacagaagagttcgagcctcagctatccgatttcgggctggccatctgggcgccgacgaatccgacgtccctgacgcacagcgacgtcgtcggcacattcgggtacctggcgccggagtacttcatgtacgggaaggtgaccgacagggtggacgtgtacgcgttgggcgtcgtcctgctggagctcctgtccggccggaagtccatcagcagcgacgggtcgtcacccaagggccaggagagtctcgtcatgtgggcaactccggtgcttagcagcggcaacatctgtgacctgctggacccgaggctggacgtgaagcacgacgaggtggaggtcaggcggatggcctctgccgcgtcgctctgcctccggaggtcggctcgactcaggccgccgatatcgcagatactgagcatactacgaggagaaagcgcggcgagcatcgccgaccagggcgcgacggagccggactgcgtggacgacgaggcctaccccgccgcgaacgtgaggtcgcacctgggcctcgcgcttctcgacgtggaggactcggagtccatctccagcacggagcacagcagcggcctcagcccgttggaggagtacctgcgagaacgttggagccgatcgtccagcttcgactgatgattcatgcccgcgctgcgattttgtttgtgggcatgtgttttcgttttttttcccctctccgccggtaattcacatgtttattgtatggtttggttaccggggccgtgtgtacagtggacagtcaaaaatcaccagagccacatcttcggcgacaacaaaaaaaaaaaaaaagctccaaaaagatttttaaa

SEQ ID NO: 319 - DNA, 1446 bp, Zea mays
  misc_feature (1321)..(1321): n is a, c, g, or t
  misc_feature (1324)..(1324): n is a, c, g, or t
  misc_feature (1335)..(1335): n is a, c, g, or t
  misc_feature (1338)..(1338): n is a, c, g, or t
  misc_feature (1344)..(1344): n is a, c, g, or t
  misc_feature (1347)..(1347): n is a, c, g, or t
  misc_feature (1356)..(1356): n is a, c, g, or t
tcgtgctttttgtgcgtggttggagtggttgagcgagccgatggcgacgatcccgggcggcgtggcgccatgacggcagccatttcaatacgcgccccccagcagctgaaacctgacaagctaaccagattttaggtggttacccgtgccgtgtcgcctgcctcgcacacccctcgcccttcgcctcttttcccccctggacccaggatatagttcccgctctcgtcgcttgcgcttgtatcttcctcgtctcaggcctccccgccgcgcctttcggttcgggttcagcgaattcagccacgaagcgagcgggcggccggagggttcctggtaacggaactcgctcgctttccagtttccaggtcaggccaggcgacgaccgccgcctcggcagttttctattccagcgtcgcggttccgggtcagaaattggttgcaggctcgcagccagccagtagcccggcgagatcgtcttgtgacagcggcaagtccacggcggttagcgggctgagcgaaccagttgcctggctacttaccagcttgccgtgccatgtgcaactgcggttcttcctgctgatctcgggagctgcaagccggctctcggcgaccgttcgtgggcgtcatggcggcggaccacggggagggcgtcggccggtgcatactggtggggctgcacatggacgccgtcggcagggacctgctccagtgggcgctccaccaggaggccaggcggggcgaccgcatcgtcgccgtgcacatttaccgcaagtccgacaagacgaacacactgaagctgatcaggacgctggacgactacctggcggaatacgaggccctctgcaaccagaaacaggtggttctcgtcggccgggtgacgccgggaagctcgatccagaaggagctggtgaaggaggccaagctctgcgccgccatggtcgtggtgcttggcgccaataagaagtactccttcggagggtcgtcctgcctggccaagtactgcgccaagaagctgccgccgacaaccaccgtcgtcgccatccaggacggcaaggccgtcttcgtccgggaggcgcccaggccgccacttggagcagagccaaagccggtgctccgcacggtgctgcacccgagcgtggggctggagcccaaggtgatcatcccgaacccgaaccggcgcgcgcggtccatgtccatggacttggacgccccatgctgcggtcacggcgccgcggacgcgccggctagcaggtgcttggacgacgccaccaaagccgacggcggcgtggcgcccgagcagaggctcgggtggccgctgcttcgncgngcgcacgccgncgncgccgncgncttagctgnccctgtacagacgcccggcggcaagaatcatgagccgcggaagcagtccgtggtgcactgggtgatgagcctgccccggcggtccgcgcc

SEQ ID NO: 320 - DNA, 3376 bp, Zea mays
  misc_feature (3262)..(3262): n is a, c, g, or t
tgatttcatatgccaacttgcattttgtcaaaagaattatactagacgtggtttatatattcactcacacacacatgcatgaccgatgaaaaccaataaggttttctctctccttttttaagagagacaagcaattggattaattagttctatgttcaggtctaatcaccccatttatatatattttggcgcctcgcatcatgattcatgctctaattacccattatatttatatatattttggcgcctcgcatgatggttcatgcatatgatgcatgcaggtccaatgcatctgatctggttcgggacgacgccgcggctggtcgtgagctcgccggagctgatccgggaggtgctgctgtcgcggtcgcagcattttgaccggtacgaggcgcacccgctgatccgccagttcgagggcctcggcctcagcaacatccacggcgacgagtgggcgcgccgccgcaagatcctggcgcccgccttccacgccgagaacctcaagctgctcgcgcccttcgtcgccggcaccgtgcagcggatgctggaggagcgcgtgctgctgccgggcgggcccggcgaggtggagctggacgtcgcggaatggtaccggcggctgccgcaggaggtcatcaccgtcgccacgttcggccgcaacaacagcgacgagggcagcgccgtgttccggctgcaggccgagcacgccagctacgccaccgaggcgcacagcaaggtcttcttcccgggctacaggttcctgcccaccaggaggaacaggcgcgtgtggcagctggacagggagatcaggagactgctggccaagctcgtcgccggactgcagagcggcggcagcggtgatcaccgacaccagggccgcgggaccacgggcgcgccggcggcggcatgagggacttcatgagcttcatggccccggccatggcggcggacgagatcatcgaggaatccaagaacttcttcttcgccgggcaggagacgctcaccagtttgctcacctgggccaccgtcgcgctagccatgcaccaggaatggcaagaccgcgctcgcgaggaggtcatggaagtctgcggcagccgggccgtccccaccaaggaccacatacccaggctcaagacgctcgggatggtcatcaacgagacgctcaggctctacccgccggcggtggccatgatccggaaggcgaagcgggacgtggagctcggcggctgcgtggtgccggcgggcacggagatcatgatccccatcatggcggtgcaccacgacgccggcgtgtggggcgacgacgccacggagttcgaccccgcgcgcttcgcggacgacggtggccgccggccgcggcagcagatggcgttcttcccgttcggcggcggcgcgcgggtgtgcatcggccagtacctggcgctcatggaggccaagatcgccttggctacggtgctgcagcgctgcaagttccgcctgtcgccggcgtacgtgcacgcgccgagggtgcttatgattctcaacccacagcacggcgcgccggtcatcttccggccattgtgaagccagccatctcgcagcttcgatcgaattcaattgcttcttgtaaataagttatcatctctcattgccaattgcaaatatataaagtataccatacttacgtgacaggtgtcagatgtacaaagaaggatagaaaaatttctagcgacatttgtaaagagggaagggaaaggaagcgacagcaaggccttgagaaattgaaccgaagtgtacgtgtcctttggaaagaagagggggaaagaagaagagggggaagggaaaggaagaaagaagatgaagagagagaaaaaaagaggaagaataagagagagaaaagagcaagaataggagagagaaaatgaagataatcagcctcgacccccattgcaacagatggatccacttgatgacaatcttactcatataaaatactacacaccctcacccaattttctcgatggtaccaacaccaaaccacagtgcagtttattcctgcagcgaattctgctacaagtgcataaatcaatgaattccgatacgaatgctaagtgtttcacacggagaatgcagtttgtggccaaaccttttccatatatgaaaaacaagctccatacagggcagcacattacacaggatgtcttcagaactttgaggtgagaaagggttcctgaacatcaacatcaaggagctatgttcgaatttcctgagggtttatactgacatccgcgcaagcttctcgatttctttgataattaaaatggggcacattattagcgcttcaatgcacatcactcagaaatcttaacatcgagttccaatcatcatattctgttactctattactagcatcgattgcttggacacagaatagggttagggttaagttagaattaggcaatacagtagtaatacctttgctagtggggagattgtggagtagcttcaacagttctctgtgattgtcagccaaaacctgagataatctctcgaggtttgtttggattggcaacaaatacctgcatccgcgtagtgaaaatgaaccttccaaaaaatggcaacaacatagtgctcacgcaaagctatgattaattcaaaccaacagctatccaacgtaaaaccgaaagggtaaacgtataccttcaaaatgtgcaaggaacatatcctgatatttttggttgaatcctacaaaagacactggctagtactccctccgttcttttttatttgtcacgttttaggtcaaaaataaactagcggacgacaaatattcgagaacggaggtagtacttagtagaggcattaaaaaaagaatgtgtatagcatgaaaaagatggccactagttatgaagatgaaaacaaactatctatgactaacctgtgttgttttcatcatttgtcttaaaagaagaaaatttgtagcactggctagttggcaagtgtgtatatttggactactttttttctctcaaacaacgcaggagatttgcgtgtcatttcatttaagaaggaatatttgaactacttttgtattagaaactatgagaactgctcgaatactcactgttagatacaagatgactggggtacccaagcaatacataaatagcccagagaaataaaatgggtagtattcaacatgaacaatggtgctatgcaatttagctataaacagaaagccatttagatctgaatggccggatctctggcagtcactaaagaacanttgcaagagtatagttctgcacgtatatcttagtctctgaggatgacctttgcttggcaagatatccaaaagccaaagcaggatctctcatctattgtgctaataacaaccgcc

SEQ ID NO: 321 - DNA, 1194 bp, Zea mays
ccgtcccgcatcgccaacgcaaccaggcgaaacacggggcacagacagggctacagcctacacgagcacggggaccggggaggagaggaggaaccgaagcggaaaagaagatcaaaaaatcggggagaaaccagaactggagagaagaaaataaataaatttatggccaaaccctagccgagacccgccccgcttgcgctctccgccgagcgccccaccccctctccgtccgcgatgcgccgggcgaagccgccgccgcagcagccctcgccgtcgccggagattcggtaccgcggcgtgcggaggcggccgtcggggcgctacgccgccgagatccgggacccggccaagaagaccccgatctggctcggcacctacgactgcgccgaggccgccgcgcacgcctacgacgccgctgcccgatctctccgcgggcccaccgcccgcaccaacttccccagcgctgcggtccgtgcgccgcggcacagggctccctccgcctccgccgcagctcccacggcgccggcggccgcggccacgtccagccacagcagcaccgtcgagtcgtggagcggcggcgcaccccgcgccgccgccctgccgcggagcgccgtgcccatggaggaggacgatgacgaggactgccacagctactgcggatcctcgtcgtccgtcctctgcgacgacgcatgcggcgacgacgcggtgggtcccgcgcgcccctgccgttcgacctgaacctgccgccgcctcttgacgcggccgctgagacccatcagatgggtgcccgctacgacacactactccgcctctagctcccgagaacggccaggaatcagaggaaggatcgacattcgacaccgcttgttcttcttcggctgctgacccggtggtgctctctcgctagatgggataattcttgcctctttcccctttctttttttcttttcttaccaccacgacgatggtgaagattccacattatgtgaataattcagttacgtccatgtaatttgtgaggaaggaaatctgagcttttctttatctctctcttgtgtttctagtgataatgctgctgctgccctttcacttgttggcaggggcggagctagagctgacaccaatagagaaacatcatggtataatgctttacagtttagatgatcgtaccttctagtaacgatgacaccagcg

SEQ ID NO: 322 - DNA, 803 bp, Zea mays
gccggccgggtcggggcagaagacacctcattgccatcatctctccacacaactaagaagccagcggcagtaacaggagtgaagcaaaaaaatggcatcatcaacgggatcagagatgagcgaggaaatcgatgtccagcttagtccagaggagaaagaaagtttagatgagatcatcaaggaagctgagagcgacttggagtctgaggaagtcctggatcaatcccttgccattgttgccgagaatgaaggtctggacaaggacgcagctgcaaaactcacaatttacactgtaggtggtgttttgaagaatctgacagagggccccttgagtgttatggataagcacatatatgcaggacacactgtcaaaccatttcccagcctgattggagctggaaagtctggttgtttcgtcatctcaaatatatttgctaaaggtgttgaggctggagtggtgtacaccggcaacaacaaaaataaagttccatgtgcatggctactttgcttcatcgaaaacaaggctaacgtgaggatttatggggagtgtggaaataaaaataaattcattaatgtcgactggaaattagttgaaaagaaattgcttactgctggtaagactgtgaagttccatgacaacgtgactggaacctcgcttatagccaccattcgggtcatcacagctggcaaagctgttggtgctgctgccttctttgggtaaactacattgttattatactacccataatgtatgtactagatcccagggatcgatacggtcttttgtgtgtgtcagcgactat

SEQ ID NO: 323 - DNA, 930 bp, Zea mays
aacacaaacacattacatacatcccacgctctctgccgcacaggccacacaggcacgcacactccccgctccgcccgcctacccttcacccaagaaccgcccgccgccgcgccgcgccgctcccatggagacgccgacgccgcgggtgaagcccgggttcaacggcgtcggcgtgggcatggggtcgtccgtgaacggcagcagccgccgcgccggctactacatgggcccggccggcgcagtggccgtggcgggcggcggcagggcggcagcagcagcgccggtagacgggtgcagcgtggcgctgcgcgtgtttgtgctggcggcgacgctggtgtccgcggtggtgatgggcgtggaccggcagacgagcaccatccgaatcaccgtcaccgacgcgctgccgccgctggaggtgcccctcaccgccaactggtcctactcctccgccttcgtctacttcgtggtggcgaacgccatggtgtgcctgttctcggcggcggcgctggcggcctgccggagccgcgccgccatggtgcccgtgatggtgggcgacctgctggcgctggccctgctctactcggccgtgggagccgccgcggagttcggcatcctgggcgagcgcggcaactcgcacgtccgctggcctaaggtctgcaacgtctacggccgcttctgcgagcgcgccatggcggccgtcatcgtctccctcatcgccgcattcgccaacctcgtcctcctcatgctcaacatcctcaccatccacaagagctcttcctactactaagctagctactatactgtagagaagagaaaccatatacaatgcgagctagctactcatatatagctgttgctgcatgcatgcatggggattaactaaagtgatcgaccccaacttgttgaaagagtccaaaaaaaaaaaaaaaa

SEQ ID NO: 324 - DNA, 998 bp, Zea mays
gggcaacggcaccttccattccaaccagtactccatctatccggtacctcgaaaacacaacacattacatacatcccacgctctctgccgcacaggccacacacgccccgctccgcccgcctacccttcacccaagaaccgcccgccgcgccgcgccgctcccatggagacgccgacgccgcgggtgaagcccgggttcaacggcgtcggcgtgggcatggggtcgtccgtgaacggcagcagccgccgcgccggctactacatgggcccggccggcgcagtggccgtggcgggcggcggcagggcggcagcagcagcgccggtagacgggtgcagcgtggcgctgcgcgtgtttgtgctggcggcgacgctggtgtccgcggtggtgatgggcgtggaccggcagacgagcaccatccgaatcaccgtctccgacgcgctgccgccgctggaggtgcccctcaccgccaactggtcctactcctccgccttcgtctacttcgtggtggcgaacgccatggtgtgcctgttctcggcggcggcgctggccggcctgccggagccgcgccgccatggtgcccgtgatggtgggcgacctgctggcgctggccctgctctactcggccgtgggagccgccgcggagttcggcatcctgggcgagcgcggcaactcgcacgtccgctggcctaaggtctgcaacgtctatggccgcttctgcgagcgcgccatggcggccgtcatcgtctccctcatcgccgcattcgccaacctcgtcctcctcatgctcaacatcctcaccatccacaagagctcttcctactactaagctagctactatactgtagagaagagaaaccatatacaatgcgagctagctactcatatatagctgttgctgcatgcatgcatggggattaactaaagtgatcgaccccaacttgttgaaaaaaaaaaaccgccaacactcgccccagccccctcgccccacccttaaaat

SEQ ID NO: 325 - DNA, 1781 bp, Zea mays
ccacacacacataattatacacatatatttatatatgtatcatctatatatacatatatttataaacacatataaatatacatatacaaacatgtatgtacataatatatacacaaatgtataattacatatacacacaaatatatatacatatatacacatatatatctattgcgggtacacggatttgcgggaacatgtataacatttttataccccgagaaaaaatctgtctgattgagaatcaaacctacacccgtacatgtgggtataaactcacacttaaattcatacctatatggtttttaccgtgggcaccggcgttgccatcccgatgtggacgtacggtcaagccacctactacaacttgacaatggcaaccatggcactgcaaggaaatatcgcacacggcttgtggatgtctcgctcacaaagtcaacctggacaggggcagcctttgaacccttcaattccttggcgtttgtatcgcacgtcctcttcacgcgcgcgcgcaccacacatacacttgctccggtttatatcccgtgggccacctcgaggccggccggcaatcgaagctcagcacgatcatcgacacacacacacacatatcgatcgatcgtgtcacgccagcagagcacgagcacggtgctccaatccagagccatgtcgaagccagcgtcttcgtcgtcgttcctcctcctgctgctgctgtcggcgacgctgctcgccaccgtctgccgcgccgacccggacccggtgcaggacttctgcgtggccgtggcgccgggcggccacaacaacgcgtcctcctcctccagcacctacccgggcttcccgtgcaagccggcgtcgacggtggtctcggacgacttcttcttcgcggcgcacgcgggcggcgcgagcacggacaacccgatgggcgcgggcgtgacgccgggcaacgtggaggcgttcccggggctcaacacgctgggcctgtccatcaaccgcgtcgacctcgcccccggcggcgtcaacccgctgcacacccacccgcggtccgccgagctggtgcacgtggaggccggcgagatgctggtcggcttcgtcagcacggagggcaggttctactccaaggtggtgcgcgccggggagagcttcgtcatcccgcgcgggatggtccacttccagtacaacgtcggcaaaggcgccgcgcgcgccatgaccgtcttcaacagccagctgcccggcgtcgtgctcgccgcgcagaccctgttcggggccgacccggagatccccgacgacgtcctggccaagagcttccaggtggacaccgacaccatcaagctcctcaagtccaagttccagaaaggatagcgcgcgtagccgacctgctcgctagatttgcagttccttacagttttgtttcatcagtacataactaatgttgtttcgcattattaaataattttatttgatcaataataaagttgtgtgatttagccacaacacgaggtaaaaaaaaagaaattcacggtgcccgaccgcgatttccgtaacttgcgtcgtgcataggcccacgaaaattagacttacctcatataattagctattttttatggtaatacctaaatttcgctgttgaataggtgttgtcatatcttgatgatattggaagttataacattccataggcttttgtctcgtaatcaagctcgtgtgctctatagaagaattcggagttacttcgactagctgaccgggcatcccatatgaacacccctaatcgcattatagca

SEQ ID NO: 326 - DNA, 1343 bp, Zea mays
agtccaccggcatttggaacttgttcgcgagtcgcgactcgcccagccgccccttccgagttccgacgccgataccgtgactccgctcgctccattccgctcctaccgccgctggccgccgcaccattcgatccctgtttcttaatccggcggccggcctggagccctcagctcaacactcggcagatcatctcggctgttcgcctactttcttcttccccacggtcgttcgcgtgcagcacggccggcggtaccggaacagggcccagccggagcagcggtgccgtcccggcccggctgccttttgctactgctaacatcccaggacgcagtccggaagctgtagctcctttccggtggtctggtcttcacggttctactcctattcgtctgcttcaatccagctgcgtcatctaatttatgctccaccatgaagatagcctggggtaagaaatctaaggttaagaagcagtcagtggttgtatcaactataccaggcctaccatttggagcggggagtgacaacgatgaggttgaaacggaggaaaaatcagatgcaaacacaaactgtcctggaacaaagccagttgaaactgctgagttgctccagagtcagggagacaagctagccgaggaagggaagtaccatgaagcacttgctaaatgggaggctgctctgatcttgatgcctgataatgcgatacttcatgagcagaaagctcaggttttacttgaagtgggagatgcatggcgtgcactgacagcagcaaccagagcaacagaactggatccattttggcctgaggcttgggttacacttggtagagctcaattaaattttggggagccagattcagctatactgacttttgacaaggcgttagctatgaagcctgactacaccgacgcaaaagctgaccgtgaaactgctgctcgcctagtcaagaaacgaggacagctgcatacgtcaggtttaagtgctaacaaaagacgcttcacagttggggagtacccaaaggagggaggtgcagagggtgaagaaaaagggaaagaaacagccgagcaactccaaaagatcacccaagaaaattagctaaattaactgattttgttactgtgtaaaatagatattacaaaaaaatattacattagtgttggtcacctgctttaattcgtaaagggaaccataacaaggcaatacaattaaagataatcggccttcgttttcctaatctatctaatagataaattaagggaggagaattatggtaatccaagaccttcgaataataaaataggaatgtctgatgagaatcgaaaaaaaaaaaaaaaagacagcaacg

SEQ ID NO: 327 - DNA, 2437 bp, Zea mays
caatatatcttaaggccttttttaatgatcaatgatttgtctgatgtatatgacgcatgaagctacttattaactgtacaaaacttgttccgttgttgtgaaatatatggatggaaccgggaatgattgatattgcagatggtgtttggcaagctatgatacataaagaaactgcaccccgcttctgtagttttgtgatatgactacattgcttattatgtccccacttatctacaggatctcgtacttattttagagacaatgaggataattgcaatcacactatctcctatcactccaagcctttctctgaggatttacacacagcttggtttcacagaagaccagtttagggtgttgagatgggtatgttcttgtatcatagacatgctgtatgattccgttcttatttatatatgttcatcctcaaaaatacaatcaggcatcatcaggaaatgcagtcttcaatcttatatggatcagcctcagtattttccagagcatgtaatcattttcagttatgtcattaggaggatacgaaatggggaggccttaaagcaggccaggtaatgtcggagccaaagccagtatttgcaaggatagaaaccgaggtggaagaggaagcccaagcaagttcaaaagcagcaaaaggtgggaagaaagcacgcaggaaaggacttgtggaggcatagtttctgttggaacagtgtatcagcatcgttaaaaggagaatatttcatcttctcttttttttggaaaaaaatctttagcctatctgttcctgaaatttgttctttgctaacgtgtcacattgtatcatgtagatagccaaaaaaagaccactattgattctgatgctctgtcagagagagagctcggataattgcgagtagagctagcagcggatttggatcatccaaaatctaattggatatttgttgttttggataaggtggagagcaacttaaaaaaacccaatgtccattagatatctttggacttgacttgtttctaatgtttggagacatgctgatttttatgaactaataacacagtagctggttgttatatggagttgttgcaaataaatgtttaatcgactttgctaaaattttaaggcgtgaatttaagattttaaattttagagtctagacggtcgacggagagtttgcgcggggattgcaaccgcatcgcacggaagttggaaagctgacaagttggcggcgatgatgggttcgaactgggcggcgatgatgggttcgaactgtccacacggcacggcagtaacggtatggggtttttgctcggatctgttccgtccgatcccactggagccgtccgtctaggtgtctacagtgtgcctagacttgaggcaataaggcgcgggagcggtccccagtctcgttccggaggcacatgctgccgttgcggcctcacagcagtacagcacgggccactcctgcacgcacactcgcacagccgccgatgtccaccgctgcgcgtacaggtacagccgtagtgtcagcttcgcattcctttctttattttcttttgactactccatgagacgacagcacggggcgctcctccttttgaggcaaccaaaaggctaggcagcgctctcccagcttttgggcacgctcaccctgtcatacccaggtccggcgtttactttaattttccgctagcaaacaataccgtattttgtatgatgttggatctaaggacggttgaaacggatcccctaacgtacatgagccgacgacaggggtctactggttttactccgaccttgatcgattcggtccgttggttggttagtttacgaatcattcgatatgaattgcgttgtagttgaaccgatcgatattgattgatcgatatgaatccatgcactggcgaatcggtgatatcgatctaaattgatcggtattgatagtctttagccacatgtagacatcattttaaagtaaaaaacatttttcaaaactaaaaaaaatctagaatacgggaagcttactgattttgagtacgacactcttcttgtctagactctagcgtgcctactactctcccgccaatgtttttcaagctttcttgtttagtttgtgatgagagcttattgatgttgagggttgtttggtttttctaagtataagagacaattaatagactatataatataactttgagacattagatcataaatacagctaaaagacaacatgtatgagagtcgtaaaaagacgagctcttcacaaagagcatgtctcttatatttttttttcaaataaacttttaaagacccctcaaaagaccacatattaaataggattgtacatgctttaagtatgtacgagtttactaaactgtatcaccctagagcacattatgggctccgagccctttactgatcatgggttcgtaggtgaccaaa

SEQ ID NO: 328 - DNA, 920 bp, Zea mays
  misc_feature (40)..(40): n is a, c, g, or t
tgggctactaaaaaagaaactgtaaatccgtactagcttntgattcaattgctgccgcagatggaggtttgttcagaaataagatagaaaatctggtggacaaggcaaaacaccaaatatgaaaaccttttactgtcatcagcatgtgaaactgttttagagattggtgatcttggaaacttgtacatcgatgagcaagcaccatggtcctgttttaagcaagggggtgagagtgctgaaaaggctgcaaaggatctcgtacttattttagagacaatgaggataattgcaatcacactatctcctatcactccaagcctttctctgaggatttacacacagcttggtttcacagaagaccagtttagggtgttgagatgggaggatacgaaatggggaggccttaaagcaggccaggtaatgtcggagccaaagccagtatttgcaaggatagaaaccgaggtggaagaggaagcccaagcaagttcaaaagcagcaaaaggtgggaagaaagcacgcaggaaaggacttgtggaggcatagtttctgttggaacagtgtatcagcatcgttaaaaggagaatatttcatcttctcttttttttggaaaaaaatctttagcctatctgttcctgaaatttgttctttgctaacgtgtcacattgtatcatgtagatagccaaaaaaagaccactattgattctgatgctctgtcagagagagagctcggataattgcgagtagagctagcagcggatttggatcatccaaaatctaattggatatttgttgttttggataaggtggagagcaacttaaaaaaacccaatgtccattagatatctttggacttgacttgtttctaatgtttggagacatgctgatttttatgaactaataacccagtagctggttgttat

SEQ ID NO: 329 - DNA, 925 bp, Zea mays
  misc_feature (11)..(11): n is a, c, g, or t
  misc_feature (29)..(29): n is a, c, g, or t
caggaacagtntggggatctccacagttnccttggatgagtctgacaatagcaaccccggcagtgatgacaacaaaaacccacagccaagagcaactgatagtgcagatgtgtatctcaatgaatccaaacgtttaaagctcaccaatggagcaaacacaagaagagttgtagcgaggagtacaatgggacgagaattccacatatgaggtccaaaccaccccctccaatacgccactgtgatgaacacctgttgacgatgttcctgataggacatcaccaataataatcatgtatacaatcaacacgccgacattgtttatcaccaccgatgcttgtagcgcaattctcccccactgaccaaatgtgtcacccatcaaccagccgtaggatgtaatcttgccctggtggctgcacctgaccagcatgtcaatggatgtctcggtgagcagcgccacaaggatgatcattagaataccaggtataaggcctagcatcttgatactcgcaggcagagccatgattccagctcctacaatggttgttgacagattgaagaccgcgccagagaaagaagctccgtcgaactcatgaactgcgtcctcctcagctttgatcgggagaagaggtgtgatctcatcttgcatcactttgtgcggcacattccttgatgaccccatttgtttcactcaactttcaagaaccccgaatctttcctcaacacgcgaccaaaaccctgaacaaatacagcagcgcaaactaaaccaaatacaggacaacttgtacttgcagagggagggagctccctcctcgcctccggtcttcttataggcgaacggcagaccccgtcccggccggctatcagaatatgatataatatctctctccgcctaccaagaactgtccaagagcgatcttgccgcccc

SEQ ID NO: 330 - DNA, 1608 bp, Zea mays
aaccaaaagccgcagagtaaaacatcacagatcccaacggtcacattacaaaaacccactgggggaccacatcaacccgtgatcgagggcagcattcgacaatctcctaaaaaaggacttcagaagtagctcaccaagtaaaatcggtccctcagggcgctagtgttggagcgaaggtcgagctccctcgatcagactaacctagctacaatcaaacaggttttaaatgcaggtacaggttgtgaagggtacttcgacttgtaacaacgtcggggtcttcaaccgcggcctttggaggggatgaagcgaagggccacgatggtcaagggggttcgatgaagccccacgtacgcgttctgaaggctcaaactctttcctaggcagcaaaatccgagtccacacgaagttaggggcgcgacttcacgaggtcaagggtgcaacgtgcaaggaaagaccgtaccagatcacagtggggcctaggctccgtcccgtcaccatctggcccatctgttagcccttcacagggtagattttatagtatatctagactactgtacttcaccccactataatgaccccgtcgaagggcttattctagaaatgtagcaggtagccagggtataacggtacttaaagattaacctacccatccagttacctataaacactatcatactatacataacacgcataacaagacgatattgttccttacctactattttattatgctcctgagttctcttatctgcgagtaattgagcccacctatccatgtgacggctggtcctaacggtctccacgttaaagtcagaacctgagaaaattcttgcttcaaagctactcagatgcaggattgcacgtttatgatcatctatccgtccagttaatatctccaaattgacgtgagttccagctttatatttgtgagtacctgtttcagtttgctactgcatcggtgcatattattatatatttatatacagctatttcaatcatccattacaagaaaaaaattgttccacgggtgatcatagcacacgtggtcccatccagatgtggaggcagtttatgttcaggaaactagacaaatattcgcagcaaaccaaagtttcttcgaagtgaccaaacaaaaactattgaccaccatgagattcgtggtactgctgctcagtagtagcttacttgaagctcaacaatcacccttgacctgtacaaagaggttctcttcccctgaggtatgggctctaggcctcctgcttcctgtagaagatgttgaacgcatcactgtacagggccacacaattggacaccacagcaagcacaatcattgttaccgccaaaaccttgtcacgcttggttgaaacaccatatgggtcccttagtataatcatggcaggaaagatgaaaccgataagcacagcagctgtggcgccagtgaattggaaagcatcccagatgcttggtatgaagatggcagcaagataaattacagcaataagtgagatggtgataatggtgaacctcttgttgtcaccggaaatgtgccttgcggtgggaaagagtaatccatccaagttgagcctaagggcaaagcggacgcgtggg

SEQ ID NO: 331 - DNA, 874 bp, Zea mays
gcacgagaccattacctagaacatcctaatcgaaaaattcctatttcctaatgaaacaggggtttccctttctgttaaaaaactatcgaagagcttgtaggagcagatcgcggtaagcttaccacctaggcaccggcggacccgccagtccgcccctgcatccagtgatccagtcaatcgcggacgcccgcttggccgcttccatgggttccatgaggcggagttccgtgcggcttctcatagggttcctgctaattcggctcaattggtgctcggcggtgggcgacaagggcgcggagaaagtaggcgtggctttcccggtggtggtgagcacctggccgttccgtgaggcggtcagagcggcgtggaaggtggtttcgaccggtgaaggatggggttcggccgtcgatgctgtcgtcgctggctgctccgcctgcgaggacctccgctgcgatggtacaggtcagtacctgctggcctgttcccttgcacgtgtcgtccttcatatgtcaagagcaaggccgaacttgggtggcaatggccatgctgtcctctgaagcacattgttgatgcagcagcattatcacattgattggaaacatgatgcaacatcagggactacaatagaaatgggttgttaagttttatggtttggatctggattacctgttgactgctgtatgccaatattgttgctttcatctgtagtcctgcaccagtaaagtacagtgtcagtatcaattgcaaatgttgttcaatgccttgtgccagacgtgccacgttagaggcttagagctctttttcacccagtgtgccatcataagagctgatcaatattcaaaattggttggggtgtataaaaaaaaaaaaaaaa

SEQ ID NO: 332 - DNA, 877 bp, Zea mays
ttaactgtgtttgattctcaatagttttagctgcagatcatctatagtttttcttcctttcaatctttaacatggggccatgggcagccattcccctgtcagttcaggaatgcatcggtctttgaggaagactgaatgcagtcttcattttatggaaggttgtcctttaaggttgcacacattgtcttataccctgataattgtacatttttatgttttctggttgcaaatcacagctagttgatataggcacttctgtgattaatgggtgagaaagcagtttgtttatcttccatgccagttttcttcccattttatttgattattttccacattggacaagagattatcattcatttatcttttaaaatattttttgttttgctggaatttgtctgaagggtctggttgtgttaatataagggcgcatctttagtgaatgtggaaaaactttgaaaaatggttaactttcatccgaaagcgtactttgaagttctggaaaaaaaacttggcatattgatagaccatagtcattcatagatgtactttgttggaaacctgagattccaactcattctatattagttcgtacaaaaacgggtgccaaaatgttcattttcatatgaattattctataatgagtttgagtctcaacttttttttgacaaagtacatcataacatgaactatcaacacaccaagtttcagagttcgtggaaattccattgtatatattagacagatgttcatcattgtgatatctgtcgcatattaatcagagatgcaagcgcaggcagtatggttcacataaaactagcatgagcagagaagcttctggtgttaaacacaagaaagttggaacgggaggggggaaaat

SEQ ID NO: 333 - DNA, 896 bp, Zea mays
aatcaactaggagcttgatgagattgttttatgacgatcgttcccccctccacttcccacgtgtgggtgaatccttagctaagcaacctattattagttccttttgtcttagcggtgataacaaattctacttctaaatgctttacaagaagctttcctcaactcctacattacatttgtagcttgcaacgaagggagtaacaaatattatttactgagttgcagttgcacaatggtatatcactttctcacagtcgccaaattgctctaatagatactgtgcctaactgcattggttttatgatattataagaacataccatatgtttatagtgctagtttgtcgtaaggaaaggggcgaaattgatacatcatccttctaaatatgtcaggctcataaacattgagtctgtacactgatggtttcgatactgttggcacaggggcacagcactctactagggtaagagataattccaggtgcatgtgtagtgtcccaaatatttcgttcttccaaacaaaaatgccaataattcgttccaagcaatctgttagtaaattggaaaactgcttgacatttaatttcatggacaaagcagtgaggtaatttgtaatgctagttagagtggactgatcacattccaactcctgcacatagacatctatcttgctaacaaaatgtgaactcggtaccataataccattgaagtgctgtcaaaatgtgcagggagccccctgttttatgccaagatgatcttcttgctgcctgattttctgccatctgcttaccacccgtggtaagtttacacctaaatgaactttgatttttttcatccctgaggacatatggatggtgtttaaacacaataaagttggaactggaggggggaaaggag

SEQ ID NO: 334 - DNA, 1636 bp, Zea mays
aacagccagcccaataatgacatatgggacacgtcactatcgaagagcttgtagttgtaggagcagatcgcggtaagcttaccacctaggcaccggcggacccgcagtccgccctgcatccagtgatccagtcaatcgcggacgcccgcttggccgcttccatgggttccatgaggcggagttccgtgcggcttctcatagggttcctgctaattcggctcaattggtgctcggcggtgggcgacaagggcgcggagaaagtaggcgtggctttcccggtggtggtgagcacctggccgttccgtgaggcggtcagagcggcgtggaaggtggtttcgaccggtgaaggatggggttcggccgtcgatgctgtcgtcgctggctgctccgcctgcgaggacctccgctgcgatggtacagttggtccaggtggaagtccagatgagaatggggaaaccactttagatgctcttgtcatgaatggggcaacaatggaaattggagctgtggcggccatgagatatgtgaaggatggaatcaaggcagcaaagttagtcatggagcacagcgagcatactctgctcgttggagagaaagcaacagcatttgcaatttcaatgggtcttccaggaccaactaacctcagttcaccagagtcaattgagaaatgggaaaagtggaaacagaaccactgccaaccaaacttctggaaaaatgttgatcctgtcggtaagtgtggtccataccatcctatcaatttagcctcagttgaagttgagggttctgtaaagaatgaggtagtggggagtcaaggtggtctctgccaggggtattttgaaagtgataatttactggagccaataaagtccaatttgaaggttgttaatcgccacaaccatgacacaatttctatggctgtgattgacaagatgggccacatagcagttgggacatcaaccaatggtgctacatttaaaattccaggaagggtgggcgatggaccaataccaggatcttcttcatatggtgatgatgaagttggggcttgtggagcaactggtgatggtgatattatgatgcgcttccttccatgctaccaagtggtagagagcatgcgacaagggatggatcctcgagatgctgccacagatgctatatcgagaattgcccgcaaatacccagatttcatcggtgccgtatttgcagtcaacaaggaaggggtgcatgccggggcatgccacggatggacattccaatactccgtacggaattccagcatgcaagatgtggaggtcattacagtatatccttagcaatcgcaattcaacgaaaacaaaagtttgctttatcagcatgtttaaaaatgtcacggctgcccccctgttgatgttttaaaaatgttctgtgcggattatttcaatgttttcttaaagtcgattgttttgaaactagtagtactgtatgtaccaatctgaccttagttgttttttccctggaaagtgttgaatgtcttggaaagtcgaaaccttggatcttctctgttggagttggagttgattgtacagaagttagacttggatatagtcaacttcgtcgaaccagctatcatgtttataataatatatcgtagcctgtc

SEQ ID NO: 335 - DNA, 1951 bp, Zea mays
aataatgacatatgggacacgtcactatcgaaatcgaagagcttgtaggagcagatcgcggtaagcttaccacctaggcaccggcggacccgccagtccgcccctgcatccagtgatccagtcaatcgcggacgcccgcttggccgcttccatgggttccatgaggcggagttccgtgcggcttctcatagggttcctgctaattcggctcaattggtgctcggcggtgggcgacaagggcgcggagaaagtaggcgtggctttcccggtggtggtgagcacctggccgttccgtgaggcggtcagagcggcgtggaaggtggtttcgaccggtgaaggatggggttcggccgtcgatgctgtcgtcgctggctgctccgcctgcgaggacctccgctgcgatggtacagttggtccaggtggaagtccagatgagaacggggaaaccactttagatgctcttgtcatgaatggggcaacaatggagattggagctgtattggagctgtggcggccatgagatatgtgaaggatggaatcaaggcagcaaagttagtcatggagcacagcgagcatactctgctcgttggagagaaagcaacagcatttgcaatttcaatgggtcttccaggaccaactaacctcagttcaccagagtcaattgagaaatgggaaaagtggaaacagaaccactgccaaccaaacttctggaaaaatgttgatcctgtcggtaagtgtggtccataccatcctatcaatttagcctcagttgaagttgagggttctgtaaagaatgaggtagtggggagtcaaggtggtctctgccaggggtattttgaaagtgataatttactggagccaataaagtccaatttgaaggttgttaatcgccacaaccatgacacaatttctatggctgtgattgacaagatgggccacatagcagttgggacatcaaccaatggtgctacatttaaaattccaggaagggtgggcgatggaccaataccaggatcttcttcatatggtgatgatgaagttggggcttgtggagcaactggtgatggtgatattatgatgcgcttccttccatggtaatgaaaacataatttctgttgaaaatgacatttgaaaaaggatggctgagtgtgatgtctagcttgtcaattggaaccggattagttgctccaatctatgatttaatttgaaagaaagatgacagagttgtgctctgattattatgaacttctttttccctcatgtttattttttcaagtgtagcatcctagtacatgatggtatgcaatttcaatcatctttgggcaatcaattttaaacagtccctgatccaactgcaaacactaatgctggtaacagcatatgctagttgtttactctatcgtaactctatcgactcttgtgcacttcgtgccaatcttattataaattctgttgtagctaccaagtggtagagagcatgcgacaagggatggatcctcgagatgctgccacagatgctatatcgagaattgcccgcaaatacccagatttcatcggtgccgtatttgcagtcaacaaggaaggggtgcatgccggggcatgccacggatggacattccaatactccgtacggaattccagcatgcaagatgtggaggtcattacagtatatccttagcaatcgcaattcaacgaaaacaaaagtttgctttatcagcatgtttaaaaatgtcacggctgcccccctgttgatgttttaaaaatgttctgtgcggattatttcaatgttttcttaaagtcgattgttttgaaactagtagtactgtatgtaccaatctgaccttagttgttttttccctggaaagtgttgaatgtcttggaaagtcgaaaccttggatcttctctgttggagttggagttgattgtacagaagttagacttggatatagtc

SEQ ID NO: 336 - DNA, 3260 bp, Zea mays
cggtgacggcgggcgggcggacgcgctcccccaatttccctcccattttctactccctcccctttccttccttcaccggcatcggcataggcgtctctccctgatctacctggagtctctctcctcgtactccagcgccgcctgcccctccgaccaccgctgcggcagcgcaccgacttcccgcctgaaccccagatctcacccgcgccatacacgccgccagccccagcccagatctacggcgcgcccgccatggacgccggcgccggggccacggccatccgagtgccctaccgccacctccgcgacgccgagatggagctcgtcagcctcaacggcggcgctcccggaggggacacgggcccgcccccgccaccgcccaaggaccagccgcggagccgcgccgacaggaccaagctcgtgctcgcctgcatggtcgccgcgggcgtccagttcggatgggcgctgcagctctccctccttacgccatacatccagaccctaggaatagaccatgccatggcatcatttatttggctgtgtgggcctataactggttttgtggttcaaccttgtgttggtgtttggagtgataagtgccgttcgaagtatgggaggagaagaccatttattttggctggatgcatagtgatatgtgctgctgtaactctaatcgggttttctgcagacctcggttacatcttaggggacaccactgagcactgcagaacatataaaggttcaaggtttcgagctgctattgttttcattctaggattctggatgttggacctggcaaacaatacagtgcaaggtcctgctcgtgctcttctagctgatctttcaggtcctgatcagtgcaattctgcaaatgcaatattctgctcatggatggctgttgggaatattcttggtttttcagctggagcgagtggggaatggcacaagtggtttccatttctaacgacaagagcatgctgtgaagcttgcggtaatttgaaagcagctttcttagttgcagtagtatttcttttgttatgtatgtctgttaccctgtacttcgctgaagagagcccactagatccaaaagatacacaaggactatcagattctgctcctctgctgaacggttctagagatgctgcccatgcatcaaatgaaccaaataatgaaagatttcctaatggccatgtgggtttaaacaatgtgtcggctaacaacaacactgaggaatttacaaatgtgaattccaacacagagaatggaggagtcttcaatgatgggccaggagcagttttggttaacattttgaccagaatgaggcatctacctcctgggatgcattcagtgcttctagttatggccctaacatggttgtcatggtttccctttttcctttttgacactgactggatgggacgcgaagtttaccatggggatccaaatggagatttgagtgagaggaaagcttatgacaatggtgtccgagaaggtgcatttggtttgctattgaattcagttgtccttggcgttggttcattcctcgttgatccactatgccggatgattggtgcaagattagtttgggccattagcaacttcacggtgtttatttgcatgatggctacaacgatactaagttggatctcttctgatctgtactcaagcaaacttcatcacatcatcggggcaaataaaacagtcaagatcacggcattggttgttttctctcttctcggattgccactctccatcacttacagcgttccgttttctgtgactgctgagctgactgccggtacaggaggtggacaaggttcgtgttgcgcatatactgtattaattagcagccttgcgaaccacagtgactggtactgtttgtgctccatctccaggtttggccacaggagtcctaaatcttgctattgtggttccccagatagtagtgtcgcttggagcaggtccatgggacgctctgtatggaggagggaataccccggcgttcgtcttggcttcggtcttctccctggcagcaggtgtgctcgcagttctcaagctgccaaagctgtccaactcgtaccaatctgccgggttccatggatttggctgatgctcatgcccaaaacacccccgtctgccatgtaaaacatcacaccaacacttggccccattttgccattcgtttacagagaaatgattcttttttcctcgtacaactacagaataatgacagtgaaagtaggagtttaggtgagagagagagagaggctaggtaggttgatgtgaaggtgtaaaagctgtatcctcctttttttgtttttgtttttgtttttgacagtgtatgtaagagctgtccacaagaaaatttacaagtggtgtaacctgccctcgtttgtacattgtactactactacatgacaatcatatgtcctttgtctttatccaaggttgaagacgtaaactgaggccatctatttatcttgggccatgatatatttttgcacaaacacggagccatttcattagacggatgtgttttaatagctcaatatcaccttctgtatatgaccaccagcagcagctgcctttcttggatttgcttcatgagctccaggttgccgacgctatctatcaccgagaatggcaggcgttccacagcattaggaaacagcaggccgccatttggatttcgacaggaatgaaaacaagcaagaaacggacatccagccgacaaatagtgagcgaggcgtacttggcccatccggggtatgtgcagcggatgaggaggaggttgcagcggcaagggagggttttgaactcaatatttgctcctgtcgatcaagcgcaccaggaagccaaacaaacagaaaactaaggttaataaatgttgttagccaggcatcaaatttgtaacacatgatgctgtagaaatatcagagaacagaaaaggtccacaatcagaacaaataatgaacaacacctactacctacttcttacagaactgaatattgcaaaaaaaaaaagtttgaatgtttgatttgtgtctcatcaacaagctgattgtgattgagtggcttttgaatttggaaagtgaattcttagctttacatccatgcatgtgagtctgtgactgaaatactaatgatcataatcgaagcataatcaataggtgtaaggtaactcaagagggaaaaccctatgggctccagccattacccaaagctgtacctgcctaagcagcaagcaattacacctgcca

SEQ ID NO: 337 - DNA, 3186 bp, Zea mays
  misc_feature (2384)..(2384): n is a, c, g, or t
  misc_feature (2947)..(2947): n is a, c, g, or t
ccttgcgggcgtaaaaacagtgggaggaaaaatctagcccagaaccaggacaggatttctcttcgcctgatggatggcaaagagaaagtagccaacttcatgcctccagtatacctacaagggtaggtgatgaagtccaaatgctggcaatcaacaacgaaggcagcaggaactatgcttctggtatcgcaaatatcgcgcagcattcaaactccgaagacgcacacggtcctttatatcccgtcggtgctgttaattcttcgcgtaccggagaaacaggctacatcgattctccaacctccctccacatggatagcgtcgaaggccaaacaacggtgagggactcaagatctgtacagcaagcagatgtcaccatggccaccaaggagcagacccttccctccacctctggcacaaccgattcttcgagcggcagcgcctcaagtcagcctgctttcaaggggaacccaggacgtgccctcaaagttagcagcagcgatgcactgacggtgaaagctacctgtaacggcgacaccgtgcggttcaagttcctgccggcaatgggctggtaccacctgctggaagaggtagcgaagaggtttaagctggcgacaggagcgttccagctcaaatacaaggacgacgaggacgagtgggtgatcctggcgaacgacgccgacctccaggagtgcgtggacgtcctggactcgatcggctcgcgcagcgtgaagctgcaggtgcgcgacctcccctgcctcgtcagcagctcgggcagcagcagctgctgcttgcaggtggaaggaagcgcctagctcatgacggcaggacggaagcctgggtcatggcacgttgactgttgtagtaggttttagccttctgctgtcgccgtaatggatccatgtctacgctcaatacaaaatggcgagtgcagaaaaggagaagtgtaatactcgtcgcacggctgaaacaatgccgtgaaggccttgccataatctgttgtttgttcacaaaagtcgtggcaataatctgttgccatgaatatgggaggttttaagacgcgacaccaagtttctgagcttgctgtgttccgaattttcagaatctagttctctccggatcccgtcggtctgtatgatcggcgatttgcggctatggtatagcctgcagcgtttacagaaccatgtggacgtgatgcagtttggagtcggtttcgagaaatcttttctccgatatcctacgactacgagtgacagcctgacgttttggctttgagtgcggggagtggaggttggtttccagtcgtgtcgcggcgcctgggcgtgccgttgaaggcgtggtgcagctcgtgagtctggacgggatagctactatttgtattcagactgatcagaagccgtccaacttggaagaattacagttcgcagaaagtttccgcggtagggaacggctgcactgccaattcgcgtgaaactggggaactttgtactatggtggaggacctggaggtagtttaatcgtggtagagaactcgacggctcgaggagctggagtggcttacagtgtaattcttgtctgttgtccccctggccatggcgcttgtgcagcttactctgtctccagtagatcgtacacatggtcgtgtaaaacattgttaaacattatagaagatgcgatgatcttaaataatatggtatttataaagtgaaatttgaaatagaagatgcgatcacccctatgatgtgtaagctgctggagactatcttactcgtttactctaaaactatgtccagtagatcgtgcatatagttgtgtaaaatatagttttatactgtaaataacattgtttgtgtagtgaagtttaaaataggaggtgtgatagagaatgatgaagatagcctaatatctcttttcagcatcaaacaatgatattaatgttttatacagattctctttcttacaaacttgctagtcgtgaagcctcgtaagtataaaattaacgggcacaactatgataacttgggagggtattatgttataaaaagttaatatataaccattttcaagttgcttctatttaattgttagagcgaaagagccaaatagccacaatcattcaggtgatgcatacacaatcaacatcattgaacatagatcagacacttcatacctataatcaagtattattattagggcgaaggccgaacacgacctcgaccaaactcacttggttagagttaaccatgtttggacgcatgatctggaacggtgagagacttcgctccctgtcggcaatgaggtcctcgaccgccccgccaaaggcgactgcgtggaggaccatgcaatgagactcgtcgtttcccatgtcggacggacgaaggcccctntgcttgacgaattcaacatcttgacgaagacgccttcggcggtcaccaaaagcggagggatcaacatttgggcaaaggcctctagcatcctacgttggggcctaggcttcactcggctgtggctgggacccacttgtaagccccaacaggggtagagttttaggtgcagttaggattagtgggttctgctatgctgcccgttatgtggaatgttctgtgaatgtagcaggtaaccgaggacatgatggtactttagtctacctgtcccctggttacctatatatactctcgttctatacacggatgggagatacataacaagacactacagttccctgctcaaggttttctcgtgcacctgtgccatttgttcgccacctgtcacaccgctctcgagtgcttgggcccactgttcacagacccaacaatcatccagtcacgattaacgatgctaggatacgactgatgtgtagatgaaggtgttgcaacttgcataggttgtgacatggcactaccatctaggtgctcccatgagatgttaggcaaaaaccaggtcaacctcntagaatcgcaccaatgacagcttcaagcgaggacctatgtaccttaggggcttgcctctggtccatcgatgggcatgataggcaggagaccgtagggcaggtagtgtgatgggggtacaaccttaatgtcgggggtagtagcctaggagagaagggcgacactggatcggagaggtgcaacatagggcggtggggcgccagttcagggagagaaggttggtgtacctctagagggcggc

SEQ ID NO: 338 - DNA, 1432 bp, Zea mays
ttcttatatggtatcagagccattagagtagatccaatccacaaacatggctggtagctcttcttctatatctggatttgcctccatgatctcccatccagtttcagagaaactcaccaaaaataaccatgcaacatggaaggctcaggtcgtcgcaacaatacgtggtgcacgtctagaaggctacctcaccggcaagaccaagatgcctgccgctgaacttgtcagcaaagatggtgacaaagttgccaactctgcctacgaagattggctagcttcggaccaacaagtccttagtttccttcttgcctctgtctccaaggatgttttgatccagattgcgactaagcacaccgcggcggaggcatggcatgcaatcgagaccatgttctcgtcacaaacaagagctcgggcagtaaacacgcgcctggctttatccaccgcccacaaagggaacatgtcggtggccgaatatgtcgggaagatgcggtctctcggcgatgaaatggctgcagcaggacggcctctcgaagatgaagaattggtggagtatatcctcaccgggttggacgacgactacgactcactggtgtctgcagttctcgctagagccgagccgatctctgtaagcgagctatactctcaaatgcttgctttcgagactcggatggacctgcggaataatgggaactcatccgggtcatctgccaacgtcgcaaatcgacgggggcgtagtggtggacggtctgggcgtggaagccgtggtggtaggaataatactcctgcacaacgcggtggtcgaggaagcttcaatccacgtcaatcaaatcatgtccctcgtggtcacaatagcagctcttcagatcgaccaatgtgccaagtttgtttcaaacttggccacactgcagacagatgttggcacaggtatgatgagaattttgttgctgaccagagacatgttgctgcagctgctacaaactcctatactgtggacacaaactggtatacggatacaggcgccaccgatcacattacaggagagttagataaattgtccttccgagagaagtacaatggcggcgagcaaatccacacagctaatggagcaggatcaagacacgaggaacacacttcttaaaggacgatgtcacaaagggctatatcccataccatcagcaccaataaaacaagccttcgttgttagcaaaccatcctttgataggtggcacaggcgccttggccatcctgctgcccctatcattcatagagttatcagtagttttaatcttccgtgtcatgttaagtcaaataaagagtctgtatgtgatgcctgtcagcaagcaaagagtcatcaattaccatatccaaagtcatccagtgtctcgagtcatcctttagaactcgttttttcagacgaaaaaaaaaaaaaaaa

SEQ ID NO: 339 - DNA, 1305 bp, Zea mays
  misc_feature (1292)..(1292): n is a, c, g, or t
gtctgccccgcgtgcgcatacccatggaggccaccgcggtgccgcgggctctgtccctccttgggccatctctgtcgacggcgcagctgctgccttggatgcgtatgaactgcttgcgcgtagccgttggaggaggtgtcaggcggcaggggggcgtagtctgggcgaagaagacgagaaggggccgggacgacgtggcggaggagcgggtggacacgcacagctttgcgccaaaggccgtcctgcttagaaagaaaatggtgagagaggatggccaagtgtcaccagaatttgctgatgcaaatgaagaaaagctgtatgattttcttaatatccagctaaaaagcgatatgaaaagaattcaaaggaggaatgtgctgtcgacaatgctctccgcttggacgatcctgctcttgagtccgggtcaggtcagcttagcagagacaaccggtggcgcattcagggagtatatcgacacgtttgacggctacaccttcctgtacccgaagaattggatccaggtccgtggagctggcgcggacatattcttcagagaccccatggtcctcgacgagaacatgtcggtggagatatcgtcgccttcgtcgtccaggtacacgagcgtcgaggacctcggcccaccggagaaggctgcagagaaggtcctcggtcagtacctgacggagttcatgtccaccaggctgggcgttcggcgtgaatccaacgtcttatcggcgtcatccaaggtcgctgacgatggcaagctctactacgaggttgaggtgaacataaaatcctatgcgagcaacaacgagctggcggtgatgccacaggacagggtgcagagcttggagtgggaccgccgatacctgtcagtgctcggcgtcgagaacaagcggctctacgagctccggctgcagacgcccgagcaggtgttcatgcaggaagaggaggacctcagaagagtcatggactccttcagggtcatcaaggcggcgtagtttgtcgatagtagagtgcacatgttttgtttttgtttgcttgtttgtttcttttgtacccgcagaaatgttcatatcacttgtttcttctgcagagcgcacatgtttccattcatgtctccaaagggatgtttacactttaaaataagtaagccaactatcagaaggttggtcaacagaacactggcaaaatcgctattgtgcagaataggaagaacaaaaggcagtaatcactatccacgcaaggagctactgcatatcacaaatagaagccttaaaatgagaggaaanatgtgggagtgcc

SEQ ID NO: 340 - DNA, 2642 bp, Zea mays
ttgggtacctcgaggccggccggggcgcctccgtgacgcaggcaggagccccccaattccccattcaccaatccccagtattgtagtaggggggaaaaacgagagaaaagaaacagcagtagcggaggcaagacgaaatggtggccgccgtcgcgtcgccttcgtcggcggcaccctccgccggccgtccccatccgacatacaaggagatgatcatgcaggcgctgacggagctgcgggacccgagcgggtcgagccgcagcgccatcgccagctacatcgccgaccacttctccggcctccactcgcgccacgatgccctcctctccgtccatctccgcagcctcaagtcccatggccaacttcgcctcgtctctggcaactacttcgtctccaccgccgctcagcggcaggggcgaggctccaacatcccgcccaaccccaaccctgctccggggcagaagcgtggtcgggggcggcctcgcaagtacgcagattcagccccttccgcttcgaccccggcgtttcagggcgccaagcgagggcgtggacgcccacgcaaacgcaagagcgcccaggacccggtggcttcctccccctccccttcgccgctacagggagcaagtgttccgccgcctccatctggggtcaagagggggcgtggacgccctcggaaggacgcccttgtccctccgccttcctcttcttcgccactgctgggagggattgatccaccgcctccatctgggatcaagacgggccgtgcacgtcctcggaaggcccttgtccctgtgcgttcctccttttccgagctgctgggagctgttgttctaccacctccgtctggggtcaagcgtggccgcggacgcccgcgcaagagtgcctaccccgctgtggcgccgttggtgggagctgagaagggacctgctggtggacaaccacagaggaataccactcctctctcaccgacacctgctaccatgtcccacagtggtaagagtgagactgtccggctgcccaaggttgctgttgatatcagtgctttgcgtggttcctccatgaacatatctgcttctagtaacagtttggttggtgcgaagcggggaagagggcgcccacctaaggttgtggttgctgggaaagagaagatgcaacctgaatctgtgcagtccgtggatgcttcattgactaagagagggcgtgggaggcccagaaaggagaaggcattggaaagtggccgcatgaaagcctcgcagatgactgagggtcaacgtgaagctctgactgcagaccaagctggggctgtccaaaatgaagtagaagatagggatttgcaatccttgggtactcctttgacagagaagagaggccgcggtcgtcctagaaagaggccgttggaaatcgaaactgcaaaagcaggggctgctaagcgtgggaggccaagaaaggagaagacatcggaaactggggacttgaaagttgcacagatgactgagggtcggcatgaagctctgcctgcacaagctgtagaccaaactgggcctgtgcaaaatgaagttgaagctatgattttgcaatcccttgctactactcctttgatggagaagaggagtcgtgggcgacctagaaagaggccattggaaactgaaactgcagaaacccaagttgctgcatcggtggagaagcgagggcgtgggaggccaagaaagaagaatccatcggcagggtggtctgcaggaaccagggatactgcattaaaggggattaagagagggcctgggaggccaaggaaggccaggccttttgaaactgagtctgtgaaaactgcacttgaggtgtctagggacttgacagaagatgggcctcaaaaggatggggatcttgtgtcagggaagaaagcagatactcatggtgtggtttggtagtgtcaactgaggaggtagccattgctcccatggatgctgggtgcgcagacgccaagggttgatctgatggatgtgggcaccaagagtcactagtgctctgatggtgcgaacaagaacaaaaaagaaataatgatagtacctgaaaggctaaacagaacatgcagctaataagtgtgttcatggatataattaatagccatactgcaagtattgctatatgtttgcaccagtttgattactcgtatgtttttgagcagttccattggaaactgcgtttgatgggtttcacttttgggggttggatttaaatatctaacccacatcctctttctttgtcaaggactataacatttttgtaattttgttgcttgtactggaaactagccatcataaggttcattttgttttccaaaaaaaaaaaaaaaaagtcatctgtgcacataatatctctgttttgtgctttatttggtgtgtctattgggtgtttggttggaggaatgggacgagttggtccactattgcttcattcagtcattcctcatactaataagcacagagtattcagtataaaaacaaggatttgtgtcatctgagtaaattttgtagaatggtattatgatgtaccaaaccattgaggtttctcataccaacaagtcaacagcccccatatatttccataggctactcttcactagcatgtcatattcaatttgcatg

SEQ ID NO: 341 - DNA, 2117 bp, Zea mays
  misc_feature (2066)..(2067): n is a, c, g, or t
cattgggtacctcgaggccggccgggctgacatctattgttgtaaaggtgctcactcaggctaacaaccactgcagtgcagagtcgtacgtgtaccctagttctgactagtcagtcaatccgagattgcaattctcccgtcccgtggtctctacctccatatgccacaaccaccaccaccactgcattctcaaacgagcagtgcctgaacccaagtgcagtgcagcagccatgggagcagcagcagcaggtggccacgcgctgcgcgccgtcggcgacgtcgtctcgttccccgcgaccgtcgccgccttcgtggaggcgctgctccagggctgggccgaggccagggccgggctgctggtgccgctgctccgcgccgcggtgctgctgtgcacggccatgtcgctgatcgtgctggccgagaaggtgttcctgggcgcggtcagctccgtggcgaagctgcggcgccggcgtccggggcgggtgtgcaggtgcgaccccgacgaggaggcggctgcggcatcccaggcctatcccatggtgctcgtccagatccccatgtacaacgagagggaggtttaccagctatcaatagaggcagcctgcaggctcacatggccggtagatcgactaatagtgcaggtgctggacgactccaccgactccgtcatcaaggagctggtgaagggcgagtgcgagcggtgggccacggaggaggggatcaacgtcaagtacgagacgcgcaaggacagggccgggtacaaggccggcaacctcaaggaggggatgcgccacgcctacgtgcgcgcctgcgagttcgtcgccatgttcgacgcagacttccagccgccgccggacttcctcgtcagaaccgtcccgttcctcgtccacaaccccagcctcgcgctcgtgcagacacgctggaagttcgtgaatgccaacgactgcttgctgacgagaatgcaggagatgtccatggactaccatttcaaggtggagcaggaagctggctcttccttatgcaacttctttggatacaacggaaccgctggagtatggagaacgcaagcgatcgtcgagtccgggggctgggaggaccgaaccactgctgaggacatggacttggcgctgagagcagggctcctgggctgggagttcgtctacgttggaagcataaaggttaagagtgagctgccgagcactctcaaggcgtaccggtcccagcagcaccgctggtcatgcggacctgccctcctgttcaagaaaatgttctggcaaattctcgctgccgagagagtgtcggtctggaagaagtggtacatggtctatgacttcttcattgcccggagaatcgtaggcaccttctacacgttcttctttttcagcgtcctgattcctctgaacattctgctacccgaagcgcagattcctgtgtgggagctcatctatatccccatagctatcactcttctcaactctgttgggactccaaggtctatccatctggtcatactgtgggtcttgttcgagaacgtaatggcgttgcatcggtttaaagccatcttgatagggtttctcgaagctgacagggccaacgaatggatcgtgacgcaaaagctggggaatctgcagaagctgaaatcgatcgccagacttacaggaagctaccgtttcaaagacaggttccatttcctggaggtgttcattgggctgttccttttggcctctgcgtgctttgactacttatacagagatgactatgtttacctctttgttcttccccaatcgatcatgtatttcgcgattgggtttcagttcgttggtctcaatgtctctgaagactgaccaattgcaagacaactgaacgttttggttgcgatattatgattgctcgggtcaaggttcttgtatcgatggtctacagaagggcaggtttgtgtgcgatctagtagatacgtcatacttcaggagaggataagcacacgctggaggttgagacgaatctattataatccagtaggtgccaaaaaaatgcatctaaaacctgttgacgtgtctggaaaacgnnaaaaaaaaaaaaaaaaaaaaaaagggaaaaaaaaaaaaaaaaaagcggcc

SEQ ID NO: 342 - DNA, 2885 bp, Zea mays
  misc_feature (555)..(555): n is a, c, g, or t
aaaatatagagcataccatgaagtgatctaaatatactacacccgagactagtgccctatcctgttttctacaccattttcatcatttctttcttaataatataatttactttctaaaatacatgatttatggcttaactgttagagcataatttgtttagtgccctaaacactttaaataattgtagtattttagtttttgcgtcactttgttgggatgctatagcaccacacatgcacattaaataaaaaaagcacaatagtggtgcattgagacgatatgcaatcatatttgatacctataaaaagtaactttaatatcagagtgaatatatggttcacatatcagatattaaactatattaaactgataaaaacaaatattacaccttatcatagtcaaaagacccaaaagatataagttaagtagaagcccgatccttttttataagccgcttggttgcttgtccttcttaagctgataagatggtactacgtgagagcattatgctgtatgtgacttcatatcgtgttgggattgaatggtttttcaanatctatttagagatatttgatttctagagactaattaactctattttattttattttaatatctaaattgttaaatacgtttgcaacttttccggtgcctcactggtcactagttgttacaatttcacttttgcaatttttaatagaaaataatactaccgagaaaatgttcctcgaagtcaaacaggtattttccagactccagactctagacgctcatggacaaggcgaccagcccggaacctagacgctcatgggccggtgctgccttatctccctccctcctagtcctaccacttcctcattccccacgtactctctcggctgctcgcttatggcgatcgaagctgcgcgcctctcaccgtccatcgccgccgccgccttcctcgccagccgcccccctcttgccctccgcccgttctcccttcgtcgcaggtttcccctcctccgcgtcctcgccaactcatcgggcggggacggacgcgtcgtcgctctgtcctcatctgagctccgaaagcgccgaggccggtcttcctcctctggggctgcggactccgcatctgacggggatgagaagctacgctcgcttcgtcgactcttcgcgcggcccgacgttgctattgacgcctacatcgtcccttcacaggacgcccaccagagcgaattcattgcagaatgcttcacgaggcgtgcctatctgactgggttcactggcagtgctggtacagctgtggtcacaaaaaataaggctgctctctggactgatggccgttattttcttcaggcagagaaggaattgagccaccactggacactcatgcgcagtgggaatcatggtgttccaactactagtgagtggttgaatgatgttttaccatctggttgccgagttggtattgatccgtttcttttctcatttgatgctgctgaagaactgaaggattcaatcgccaataagaaccatgagttagttttggttcagggcatgaacctagttgatgagatatggggagatgcaaggccaaatcccccaaaagaaccaactagggtgcatgacatcaaatatgctggtattgatgtgccctcaaagttgtccttcattaggtcccaacttgctgaaaatgggtgtgatgctgtggtaatttcaatgctcgatgaagttgcttggttgttgaacctgagaggaagtgatgtccccccttcacccgtattttatagctacctcacttgtggaggttagccctgctaccctatttgtagacacgcacgcaaagtttctaaagatgttctggagccccttgagcaagctggtgtgaaacttaagccctatgaagcaattatttctgaagtagaaagactggcagagaaaggtgcaaagctctggttggattcttcaagcgtgaatgccagccataattactgcatttaaatcaagttgtgacagacacatgaaaaagaaaggaaaaacaggtgaaaaagttggagaaaaagaagcatcttcaaacaaccggataactggagatcctagtgtccacaatggagtcataagtgctgtatacaatgtttcaccggttgcacttgccaagtcagttaaaaatgatgcagaaattgagggaatgaagaattcacacttaagagatgctgctgctttagcagaattctggtgctggctggaggaggaaatctgtaaaagtgtgccccttacagacgggcgcgtggctgaaaagcttcttgagtttcgtcaaaagcaagatggatttatcgagacaagcttcgacactataagtggttatggtgcaaatggtgctataatacactacagaccaaccccagagagctgcagctctgtaggaagtgacaatctgtttttgttagatagtggtgctcaatacattgatggaactactgacataaccagaacagtgcattttggtgaggcttccccaaggcaaaaggaatgcttcaccagagttttgcagggccatatagctctcgatcaagcagtgttccctgagagaactccaggctttgtgctagatgttctggcacggtcatctctgtggaagattggactggattatagacatggcacaggccatggagttggagctgcgctaaatgtccacgagggacctcagagcattagctatcgatatgggaatttgacagccttacagaagggcatgattgtcagcaacgagcctggttattatgtggacaactcatttggcattcgtatcgagaatgcacttctggctagggagcttaatctggcaaattcggtcggaggaatctcataccttgggtttgagaaactcacccttgctcca

SEQ ID NO: 343 - DNA, 2133 bp, Zea mays
cagtcccctccctcgacccgcccgggaagccggctcccgtcccatcgctcgcttccccctcccgcgaatcattcgattcggcccgcctcgtctcgcccgcccgattcgatttggccgtcagggtgatcggaaccggcgctagggttagggttccggcgatccccatacctatggtgcagctgccgagctcggggaagcggcacgcggagccggccatggctccggcgcggcgcgcggcgacggtcaagctagaggtggaggagctcggggccgacgagcgctgcccgctcagcaagcgcgccaaggcagctctgccgatgcccccgacgcctccgcagccgcagcaggatatgtaccacaatgtactcgatgaacctagcccattgggtctgcggctgaaaaaaagtccatcactcttggatttgattcagatgagactttctcaagcatccaatgctggcgagtcatccatggacaacagcggttctgagccttccaagaagaaagacaataaatctggtgcttctgcagcaggcgaacgactaaaagcttcgaattttcctgcaagtatattgaagattggttcatgggagtatgtgtcacggtacgaaggtgatttggtggcaaagtgttactttgcaaagcataaacttgtgtgggaagttctggaaggtggccttaagagtaagatagagattcaatggtcagatattactgctttgaaggcaacttgccccgaaaatggccaaggaaccttggacgtggcgttggccagaccacctcttttctttaaagagacagatccgcagccaagaaaacacacactgtggcaggctacctcagatttcactggtggtcaagcgagtgtgcacaggcggcattttctgcagtgcccttcaaccttgttgagcaagaattttgagaagcttattcagtgtgatcagcggctatatcaattgagtcaacaaccggaaatcacattagactctgcgttgtttgaacctaggagctcaatatttgaggatccggttgaatcaaaatgtgctgggtttactaatttgaaagatgaacatgaggctctacctggcttttcaggcccggtgtcaccatgtgctggttcctccatatctgctaagaatgaaaacaatgattccattggaatgacagctgaatatctttctcagacagtaggaacaggagttggtgctgtaggtgtacaagctgttggcagaaatgtgaatggtgcagcaccagaattcagtattccccactggtggagtcaattgaaggtgcctgggcttagaccatcgatgtctgtggatgattttgtgaaccacctaggcaactgcatctcagagcagatcacttcaggcaatccggcgttggccaacaacgaggtgccgaccaaagaaacactcgaggggattgctcagtaccttcttggtgacacacaaggcccaccggtttctgcttcagacgagagatcactgatggccagggtggactccctctgctgtttgattcagaaagacacagtgccggttaccaaaccaaaacctgagccaaatgacagcgacagcatcggtgttgaagcctcggatggttccgacgaagaattcagctctgcaccaactgggaaacctacagatgccaccaatctaccagccatgtcaagaaaggattcgtttggggagctgctgacaaacctcccccgcattgcctcgctaccacagttcctcttcaagataccagagggtacagagaactgaacctggcagtcaagacctcgcgcccttgtgctgtaaagattgtatccaagcaataagaaagctggtaggttgtattctggtgcaccggttccccgccctgtaaatgtaacactcggtaggttgccccacttgtgtttcgcgactcaaatgggtagtggaaaaattgagatgttcgttggttcttttaactcaatcgtgcccccacgcaaaacttctgagcttaattttcaggcggcacctccactggtaccctgtatgttcctgattgacgtgtatataaaggttgttccgatctgtcatgaacgtaaggttttcatattgacatgttccagattgacgcgaaaaaaaaaaaaaaaaagcggcc

SEQ ID NO: 344 - DNA, 2056 bp, Zea mays
attagcccaacctggcgtccccggccgccggcccccattccgtccgccaccgccttccccctccctcgaatcattcgattcgcctcccgtcgtctcgtccgcctgattctactcggccgtcacggtgatcggagccggctagggttagggttccgtacttccgttgatctccacgcccatggtgcagctgccgagctccggtaagcggcacgcggaaccggccgagcagacgatggctccggcgcggcgcgcggcggcggtcaagctggaggtggaggagctcggggccaacgagcgcggcccgctcagcaagcgcgccaggccagctcagccgatgcccccgacgcctccgcagccgcagcaggatatgtaccacaatgtacttgatgaacctagcccattgggtctgcggctgaaaaaaagcccatcactcttggatttgattcagatgagactttctcaagcatccaacgctggggagtcttccatggacaacagtggttctgagccttccaagaagaaagacagtaaatccggtgtgtcttcagcaggcgaacggctaaaagcttcgaattttcctgcaaatatattgaagattggttcatgggagtatgtctcacggtatgaaggtgatttggtggcgaagtgttactttgcaaagcataaacttgtgtgggaagttctggaaggtggccttaaaagtaagatagaaattcaatggtcagatattgctgctttgaaggcaatttgccccgaaaatggccaaggaaccttggacgtggtgttggccaggccacctcttttctttaaagagacagatccgcagccaaggaaacacacactgtggcaggctgcctcagatttcactggtgggcaagcaagtatgcacaggcggcattttctgcagtgcccttcaaccttgttaagcaagaattttgagaagcttattcagtgtgatcagcggttatatcaattgagtcaacagccagagatcacattagaccctacattgtttgaacctaggtgcacaatatttgaggatccggttgaatcaaaatgcgctggttttactaatttgaaagatgaacatcgggctttgcctggctattcagattcggtgtcaccatgtgccggttcctccatatctgctaagaaagaaaacaatgattccataagaatgccagcagaatatcctcctcagacagtaggaataggagttggtgctgtaggtgcacaagctgtcagcagaaatgtgaatggtgcagcaccagaattcaatatccccaactggtggagtcaattgaaggtgcctgggcttagaccatccatgtcagtggatgatctggtcaaccacctaggcaactgcatctcagagcagatcacttcaggcgatccggcattggccaacaacgaggtgccaaccaaagaaacactcgaggggattgctcagtaccttcttggtgacacacaaggcccgccggttactgctgcagtcgagagatcactgatggccagggtggactccctctgctgtttgattcagaaagacacagcaccagttgccaaaccaaagcccgagccaaatgacggggacagcatcggcgtggaagcctcagatggttccgacgaagaattcacctccgcgccaacagggaaacctacagatgccaccaacccgccagccatgtcaagaaaggattcgtttggagagctgctgacaaacctcccccgcatcgcctcgctaccacagttcctcttcaagataccagagggtactgagaactgaacgtggaagttaagatccctggaataggtagtttgctgtaagcctgtaaagattgtatccaagcaataagaaagccccttatcacctcctcggaggcgtgttccccgctctgtaaatttgacaccggtaggttgctccagttgtatgttttgcgaatcatgggtagtggaaaattgaaatgttcattggttctttaactcaaaaaaaaaaaaatcaaaatgaccttaataatagtgataaataaaaattttttagtattacatattatac

SEQ ID NO: 345 - DNA, 1515 bp, Zea mays
tcgggcaactcgcctaccatggccgcttgggtaccccgacgcccccccaccagcgaaaccccagaatgttcgtcctccgcaaaaccctcctccatgcgccgccggccgccgccgcggcggtcccctctcggatctcttccctcctccgcctcatcccctctgcatctttttctgaggtaagcggaggtggggaagaatggggcgcctcctcacccggaggcggcggcggcaggggtgggggtgggaacgaatggagctccacctggtctaccggcctcaccaaggaccatttcgacggatcctcgccctccgtcggccgttctgtcccttccgagtcagcgcccgtctctcgtgagcgggcggccattcgcgctatggatgagtgggacgagagggtccgggaactggagcgtaacaatgtcgaggcgaaggcgtatgtggattcatgggacgaccggatgcgggagacctgtgcgctgctgaagcaggtgcgggagccgggcgctcggggctcgtatctcaaggactcggagaagcaggagatgtaccggctgcacaaggaggaccccgcgacttacaccgtggagcggctcgccaaggacttccgtgtcatgcgacagcgcgtgcacgccatcctctggctcaaggagatggaagaggaagaggagaggaagaggggccagccgctcgacgactccatcgaaatcctgctcgacagctgcccagagttcttcaattctcatgacagggaatttcatgtagcatctcttccatataaacctgacttcaaagtaatgcctgaggactgggatggcacaacacgagatcctgatgaggttctatatgaaatttcaatgaaggaagataaaatgttgtatgaggaattcgttcaacgcttggaattcaacaagaagaaggtggcaggagaggttaagtgccacaagtacagccggcgcaagccagacaatggatggagctacatggtcgaaaagcttggttctcagggaaagcgtggtgtaggagggggctggaagttcatcagcttgcctgatggatcaagccgtccactaaatgatatggagaagatgtatgttaagcgggagactccaaaacggcggcggaggataattgcaccatacaagtgacatggacaacttcagtttgctgaaatgcaaattttctcaactgtcttttgacattgtccagcgaggctgaagcaagaaactgtgaagtagtttggaaccgccagaacagctcctgtttttttcacagcacagtagatggtttgatgtgttttgtaacaaggattatttccccacattttggcagccgaataattatcttttaaacttttcggtgttcctcccgtctctatgcactgccgagcaacaattccaaaaaaaaaaaaaaaatacccgtgctgcaaggaaaaacgccctgttgtactttttgcacatataaacattttgcacatataaacatttctcttaagcaaactcaaaaaaaaaaaaaaaa

SEQ ID NO: 346 - DNA, 1191 bp, Zea mays
gggaccccccgggcccgcccggccgggacgacactgcattcagcgtgcgaccgaagctagctagcagttattcttgctttgcattaattattgcgagatcgatgacgatgtccattgttgctgccgtgctgctgttgctgctcgtcgtacatccacgggcggcagcgtcgcagccttctccgggctacttcccgagctccacggtgaggcccatggccttctcggatggatacgacaacctgtgggggccgcagcaccagacgctgtcgcaggacaggatggcgctcacgctcttgatggaccgcacctcaggcagcgggttcaagtccaagcgctcgtaccggaacggctacttcggcgtctccatcaaggtgcagccgggctacaccgccggcgtcaacaccgccttctacctgtccaacaacgagctgtacccggggaggcacgacgagatcgacatggagctgctgggcaccgtgccgggggagccctacacgctgcagaccaacgtgtacgtgcggggcaccggcgacggcgcgcgcctcgtgggccgggagatgcgcttccacctctggttcgacccggccgccgacttccaccactacgccatcctctggaaccccgaccagatcgtcttcctcgtcgacgacgtccccatcaggcgctacgccgccgccagtgcgccgttcttccccgaccgccagatgtgggcgtacggctccatctgggacgcctccgactgggccaccgacggcggccgctacagggccgactaccgctaccagcccttcctggcgggattccgggggttcaggaccgccggatgcgaggacgcccagtgccgtcccgtgccggcgtcccccgccggcgccggactcagcgtgcagcagcgggacgccatgcgctgggcgcagcagacctccatggtctactactactgccaggattacaccaaggatcgctccttgtacccagagtgctcgctcgctagctagcctagctaccactaccagagcaagagcatgcatggaggaggcgtgcgagtgaagaagcgccgccctacgtacgtaccgttctaaaattgtatgtacaattaagtctccatccacatccatatatacatatgtaatgtataattaagtccattattaatttaatcatcaaaaaatggaacatgcctatatatttcct

SEQ ID NO: 347 - DNA, 1053 bp, Zea mays
  misc_feature (823)..(824): n is a, c, g, or t
  misc_feature (839)..(839): n is a, c, g, or t
  misc_feature (856)..(857): n is a, c, g, or t
  misc_feature (960)..(960): n is a, c, g, or t
gccggccggtactcggaacataaatgcatgcaactatactagatgaacaagaagaaagtctctttacgtactagctagctgcatggtggatttgcgagctagcaatgcgatcgtcacctgtctccgatccgcctgtcctgtgttattggttagttacgcgcgcgctcatcaattaacggtcaccaaccgcgcgcttcttctctccctgtgggctgcctgcctgtctgcctctttacgcctgtgttatatagctggcgctcctcgacgcccccggccggggacactgcattcagcgtgcgaccgaagctagctagcagctcttcttgctttgcattaattattgcgagatgacgatgtccattgttgctgccgtgctgctgttgctgctcgtccatgtccatccacgggcggcagcggcgcaaccttcgccgggctacttcccgagctccacggtgaggcccatggccttctcggagggctacgacaacctgtgggggccgcagcaccagacgctgtcgcaggacaggatggcgctgacgctcttgatggaccgcacctcaggcagcgggttcaagtccaagcgctcgtaccggaacggctacttcggcgtctccatcaaggtgcagccgggctacaccgccggcgtcaacaccgccttctacctgtccaacaacgagctgtaccctgggaggcacgacgagatcgacatggagctgctgggcaccgtgccgggggagccctacacgctgcagaccaacgtgtacgtgcggggcaccggcgacggcgcgcgccttcgtggggggcgggagatggcgcttccacnnctctggttcgacccnggcccgccgacttccannccactacgccatcctctggaacccccgaccagatcgtcttccctcgtcgacgacgtccccatcaggcgctacgccgccgccagtgcgccgttcttcccgaccngcagatgtgggcgtacggctccatctgggacgcctccgactgggccaccgacggaggccgctacagggccgactacagctaccagcccttcct

SEQ ID NO: 348 - DNA, 2719 bp, Zea mays
  misc_feature (1829)..(1829): n is a, c, g, or t
ctaccactataccccacaacttcagatagtgttctttgcaaaaaactatttagtaactagaggcgtaagacctgattattaaatatatacacctgatatgtaattcacagtgctgaaaggatgataaggtttatttttttaaaaaaaaattgtccttggacagatgattaaacttttgtcgaattggtgtgcaagttgctagtaatttactagtgcggtgcggccgaaatgatgtggatctatttgtttcggcttctggttggattctcgccgttataatcggctcgggtagtctacgtttcgcttctcagtccgcttcagtgaaaatcatccaaatcaatatgaatgtaaaatccattgagtcgtcacgacggaagaaattcgcctatttataaattctagaccatgtagactctttcatgttccttcgcaacgtaagttcccaatatccagattctagtaatagaactgtcccaaacagaccctgtatatgcctgaatatagcatcgcaggaaagaacctattttacttggatcaaaaggaaggagcggtaaaattagcttggtttattctttgctgtttgtgggggacagtaagccgaaagtgtggtggaatacttggccgccattattggaagaataagcaagaaacatgtcgcattttgcagcaaaattccgctgctgcatcattggatgcttggatttcagcacggactaaacagtgtacggcgcaaattttactgttgcatttacttttggggccgaaaccatgtccactcttagtagctagtacacttcacttgctcatcctgggccccaagcctccaaagttcgtccccatcaacatgttcctactctgcaggaccaacacctcacaacaggcctgatggcattctcacctcctataaaacgtcttgcagaactggacacgttcaatatatcaacacggtcaccaagtcctctccggatggcaaggccttgtgaccttccgccggtgcggcaagcagcggctcttctcctggcatgcgcgcttgctctgctcgcggtgcagctgcggccgtgcagagcccagcagcagcagcagcctccgtcgccgggatactaccccagcggcatgttcaggccgctgggcttctccgaggcctaccgcacgctgtggggcgcgcagcaccagacgctgtcgccggacggcaagtccctgacgctctggatggacagcagctcgggcagcgggttcaagtctgcgcgggcgtaccggaacggctacttcggcgcgtccgtcagggtgcagccggggtacaccgccggcgtcaacaccgccttctacgtgagtgcacgagagtacgtatatatattacctctatataagaatatgcaatatagattcagtgcctggccgttgctgccgatgcagctgtcgaacagcgaggagtacccggggcaccacgacgagatcgacatggagctgctggggacggtgccgggggagccgtacacgctgcagaccaacgtgtacgtgcgcggcagcggcgacggcaccatcgtcggccgggagatgcggttccacctctggttcgaccccaccgccgacttccaccactacgccatcatctggaaccccgaccagatcctgtgagtctctccgtgtcccttcccccggccccctgcgcgccattagctgcctgcctgcccggtcgatcactcacatcacatggcatgagctgcgcctgcgtgcaggttcctggtggacgacgtgcccgtcaggcggtacgagaggaaggcggaggccacgttccctgaccgggagaatgtgggacgtacggctccatnctgggacgcctccgactgggccaccgacggcggccgctaccgcgccgactaccggtaccagccgttcgtgtcgcggttcgccggcctcagggtcggcgggtgcgccgcggacgcgtccgcggactgccagccagtgccggcgtctccggcggcgccggggacggcggcgatcagcgcgcagcaggaggccgccatgcggtgggcgcagcggaactccatggtgtattactactgcctcgactcaaccagggaccgcgcgctctaccccgagtgctgagacgctgcgctgcgctatacctacagactacagtggcgagctgagggtgtcagagctatatggaaccgcgagcacctcgcattcgcaacacaaacgtatatttgaatattacaacttggaagatgaaagacgatccaatctgatatagaattatcattgtcaggttgtgttctgaaaacaaaaatgaaattataattccatcgagagaatatcgaggtacagggagaacgggtgaatgtctgacgttacgtgttataaagtgatgtgcaatgatgactacaaactaaaaatatcagtggatgaccatagcaggaagcatcaaaggtgtgacagattgctacccatttgttcccttggttcgtggcacaatgcaaatgcggcatcagtacaacagcgtacgcaatccttcgcacgcgcgcggtgcagcatggttttacgttttacacgctgcctttagtgaaaactgtacggagctgtcagtacttgtacaggtagtgaagaagaaccaaggcatgaagtcaaaacctgcatgcacagctaccagaaacagaagcttttcggcgctgtcagcacctgtagcttttcggcactttgagcaaccaaggtatctctc

SEQ ID NO: 349 - DNA, 1264 bp, Zea mays
gcacgagaccattacctagaacaccccgggcccggcaatatatcaacacggtcaccaagtcctctccggatggcaaggccttgtgaccttccgccggtgcggcaagcagcggctcttctcctggcatgcgcgcttgctctgctcgcggtgcagctgcggccgtgcagagcccagcagcagcagcagcctccgtcgccgggatactaccccagcggcatgttcaggccgctgggcttctccgaggcctaccgcaccctgtggggcgcgcagcaccagacgctgtcgccggacggcaagtccctgacgctctggatggacagcagctcgggcagcgggttcaagtctgcgcgggcgtaccggaacggctacttcggcgcgtccgtcagggtgcagccggggtacaccgccggcgtcaacaccgccttctacctgtcgaacagcgaggagtacccggggcaccacgacgagatcgacatggagctgctggggacggtgccgggggagccgtacacgctgcagaccaacgtgtacgtgcgcggcagcggcgacggcaccatcgtcggccgggagatgaggttccacctctggttcgaccccaccgccgacttccaccactacgccatcatctggaaccccgaccagatcctgttcctggtggacgacgtgcccgtcaggcggtacgagaggaaggcggaggccacgttccctgaccgggagatgtgggcgtacggctccatctgggacgcctccgactgggccaccgacggcggccgctaccgcgccgactaccggtaccagccgttcgtgtcgcggttcgccggcctcagggtcggcgggtgcgccgcggacgcgtccgcggactgccagccagtgccggcgtctccggcggcgccggggacggcggcgatcagcgcgcagcaggaggccgccatgcggtgggcgcagcggaactccatggtgtattactactgcctcgactcaaccagggaccgcgcgctctaccccgagtgctgagacgctgcgctgcgctatacctacagactacagtggcgagctgagggtgtcagagctatatggaaccgcgagcacctcgcattcgcaacacaaacgtatatttgaatattacaacttggaagatgaaagacgatccaatctgatatagaattatcattgtcaggttgtgttctgaaaacaaaaatgaaattataattccatcgagagaatatcgaggtacagggagaacgggcgaaaaaaaaaaaaaaaa

SEQ ID NO: 350 - DNA, 801 bp, Zea mays
atatgtctctctatggtaggtgggtccagactgcggagaggacgctccgcaactagcaaaggcggggtgctgtagcgccggcggcccttcgccgactcgcccaggtgcgcgcgggacaggcaacaacgactagcaggagtccggcggtgtggggcagcagaagctcatcggtgcggagcattgttcacacaaactgactttattcctgcaggactttattcttgattgttcctgatcgaaacccgaactttttggcaaatgagtgccggtggtgcttttggcggaaataggggggtgaggcctgtacctcctgaaaaaggtgtgttcccattggatcacttacatgagtgcgacttggagaagaaagattatcttggctgcctgaaatctacaggattccagtctgaaaaatgtcggcagttctcaaagaagtatttggagtgtcggatggagagaaacttgatggccaaacaagacatgtcagagcttgggttcagaactgtggacgaagcgggtacatctcctgacaagaacagcaaactggagagccctcctaatcagccaaaggattaaaaaaatagttgtttggctttgatgtagcttttgtatgtttcttcatcccggagatctgtcaagatctcaaacaaataagggtataatgaaaggacgatgttagtttacatagtaaccaaatttgaaacttgtatgttggctgttttgagttttgacgttcctaaggagcagttatatgatttatgatgtgattaagggctgatttgcacttcaaaaaaaaaaaaaaaa

SEQ ID NO: 351 - DNA, 1925 bp, Zea mays
accacgcgctgcagctgctcacacacagtgcaacagaccccctccacctccacgcgatcggacgacacgaagcggccatcggggatcccctccgctacgcctctcgatggtctcctccagcgcgccgccgccgcaggcccagtccgacgcggccgggtcgggggaggaagcgagcaagaaggtgcggaagccgtacacaatcaccaagtcccgggagagctggacggagcaggagcacgacaagttcctcgaggccctgcagctctttgatcgtgactggaagaagatagaggcttttgttggctccaagactgtcatccagattaggagccatgcacagaagtaccttttgaaggttcagaaaaatggaaccagcgaacatgtcccacctccacgaccaaagcgaaaagctgcccatccatatcctcagaaggcttccaagaatgattcatcttccatccataggaactctggcatgaacgtgcctgtttcttcatgggctcatagttccatcccacaagctgttgcttcatcaatggtgaaagatttaggtgctggaacaccaggttcaaacaatttttgctcaagtagtactgaaggccttccaagaacttggcaacctggtgaaacaaatgatccaataaatcaaattccgtcactccgccgtctgtacctcatgatatttctgataatcatcttgtagtgcaaaatacttactccgattctgtccatctctactatttctaagaattatgtcttaaccatcctcctgtgcatcttttcttgtgaatttgtaagcttcaatctcaaatccgctggccccttcttttagaatgaaccgaacctccaatattctcttgatgatgcttaacatacagagaaacggtgtaacacaaaacagcacaatccatttctttgtactgtttctttttcaaatattttactgttttcaatattgaatctatgtcttgaatgaattgctagcttatctaattcatatttacattcttgacatttcaattatgtctttccaatgtttgatatagttatgccagattttgcgggagtgtacagcttcttaggtagtgttttcgatccaagtacaagtggtcatctgcagaaacttaaggagatgaatccaattgacgttgagacggcactgttgttgatgaggaatctctccatcaatttaaccagtcctgattttgaagatcaaaggaagttgttgtccttatacagcgcttctgatggacctgggttagggagctcaagaagttcagctctagcgacgagcgcgcctttcatgtaaggtctctcggcatataatttcagttcgacagacctcaggaggatggtgcctgccctggcgtagtagcaccgatgagtgatgaaggaggcgtttgcaccttttgtgcttctcgctagctccatgccttcggctgacgattgtgaagcgtgcacccttcctggcctttcctatccccaaaagctcggccatctaggctcgtgaaatgctgcttcagatcaaggctgtccttggaaatgggaagatgaaaggagaatctgggtaatgccggttgctccctttcccattctttgttgagttcagctttctgattggtttctggtggccctcttgatacggaacttgtgcgctccgtctgagaaagcatgtgtgcaaagtttcatttgaggagttgaggcgatcatggcgctgtaaaatgcggcttatcttcccccttcagggctggtttggtggaccgaccctcaaacatttgcaattcctatgtacgtctgtagtgcatcaggtgttgttgcccatgtgtaaaaggaaaataaattcacaatgtaaaggagacttgtgcgttagcactaccatttgaaccaataaaatgtcaaagcaccccagcgagtttgtacttgcc

SEQ ID NO: 352 - DNA, 1836 bp, Zea mays
cattgggtacctcgaggccggccgggggaagcgccggaacgaacgaacgcgcggcgccaccacccacatcactgccctgccgtcgtagcccagccccacccacccagcgccgcccgcccacgccaccacgcggaccgcagccgcgccgcagctgctcacacacacagggcaacagacgcctcctccatccccacgcgagcggacgacacgacgcggccatcgccgcacgttgagatcccctccgctcctcctctcgatggtctccgccagcgcgccgccgccgccgccgcaggcccagtccgacgcggccgggtcgggggaggaagccagcaagaaggtgcggaagccgtacaccatcaccaagtcgcgggagagctggacggagcaggagcacgacaagttcctcgaggccctgcagctctttgaccgtgactggaagaagatagaggcttttgttggctccaagaccgtcatccagattaggagtcacgcacaaaagtactttttgaaggttcagaaaaatggaaccagtgaacatgtcccacctccacgaccaaagcgaaaagctgcccatccatatcctcagaaagcttccaagaatgaaccaaactatggtctcaagacagattcatcttccatacataggaactctggcatgaatgtgtctgtttcttcatggcctcataggtctatcccgcaagctgttgcttcatcgatggtgaaagagatttaggtgctggaacaccaggtccaaacaatttttgctcaagcagtactgaaggccctccaagaacttggcaacctggtgaaacaaatggtccaataaatcaaattccgtcactccgccttatgccggattttgcgggagtgtacagcttcttaggtagtgttttcgatccaagcacaagtgatcatctgcagaaactgaaggagatgaatccaattgatgttgagacggcgctgttgttgatgaggaatctctccatcaatttgaccagtcctgattttgaagatcaaaggaaattgttgtctttatatagcgcttctgatggacctgagctagggagctccaggagttcagctctagcaactagtgcacctttcatgtaaggattaagggtggatagtgtggccaggtctgtccgcatataatttcagttggacagacctcaggatggtgccctggcgtagcaccgatgagtgacgaaggaggcgcctgcaccttttcgcttctcgctagcttcaggactgctgattgtgtaagggtgcggccatgaaaggtgagattggtctgcggtcatgaaaggtgagattggtctgcggcctgatgtgtatataaaatttttgccacgaaggaggcgcctgcacctattctatcccaaaagctcggccatctagggcattggatgctgcttcagttcagataatcaaggctgtccttggaaatgggacgagaggaaagatcccttccccattcgttgagttcagttctctgattggtttcttgctgccctcttgatacggggacctgtgcgccatgtggccgtctcgctgtttatgtgggcaagtttcacttgaggagttgagagggcttgaggcgatcgtggttttgtagagcaacgagtgcaccttccgaatattccttgttcctgtgtgaatcgtctatattgcatcaggcgtcgttgccattgtgtaaaagggaaataaaatcacaatgtaaaggatacactaccatttgaattgtattcagtatcgaagcaacctggcgacgagtaaaatgcaagggtggatatgttatttgaagtggcctttccaaatgctttcggtttattagtt

SEQ ID NO: 353 - DNA, 1029 bp, Zea mays
ctcgaggccccccccgggcccgcagactctagtactctacccccacacatcccccttcccttcccttccccgcaactaccctctactctctactgcacgcttctactatctaagaaacaacgcacacgggccgaaactaaatttctccaagcgcgcaatcctgtcgccaaccccggccacggatcggggatgtcgtctgctgcgggccgcgcgccggcgccgacgccgatgggctccgccgatcgctgtaagatcgacgggatcgtggcggcggagaaagccaccaggagctgcgtcgaatgccgcgccaccaccacgcccatgtggcgcagcggcccgaccgggcccaggtcactttgcaacgcctgtgggatccggtaccgaaaaaagaggaggcaagagcttggcctagaccgcaagctgcagcaacaacaaaataatggcgaggcgaagacggatgaagcaaaagacagctctagcaacagcagcagcgggagcagcaacttgcaggtggtgcagaaacggaggctgctaatgggagtggaggaggctgctctgctgctgatgaccctatcttcttcgcccacatccacgttgcttcatggataaggaccctcctccaacgccagatcagcagtgtacatacaacgtaccccctgcacagtgactgccgaacgattgcaggcctatctcagggttgtgtgatcttgtgattggggcggattattagtgccaagctaatcactccgttgatcgtcttgtcttcctctgttttcgccgcacccgtagatcttgatgccagccagccatatatcttctacgtgatttgtggtaggctccataatcagaggtctgttgatcccattccccccgcacatcttttttctcttggcttttctctttttggttttttgtatgtactttgatgttgccccatttgtgagggatgggtgatcaaagaggagacgccatcccttctcgttctggaataatggtccaaataataaaggattgagctgttttgttttg

SEQ ID NO: 354 - DNA, 1622 bp, Zea mays
taccggccaatgcttgaaagtggatttgacgatggaggagctatttgcatttgagataaatgaaactgctctattagtttttcatggaaatattgcttttatattcatactaatacttcttgacttgttgatatttctctctatccaattggactgcaagttggtagttaggtgagctgttcctcccaacagtgctaaaaaccgagccaatgatgtgctgggagaaaaaaaaagatactttatccactttgattcccctagctgaaaacagatgattacattcagtctatacccttaaaacaaatcgaatgcagtcacttttttttctctcccttaactcgtttcaattctgctggcagtcactttgcaacgcctgtgggatccggtaccgaaaaaagaggaggcaagagcttggcctagaccgcaagctgcagcaacaacaaaataatggcgaggcgaagacggatgaagcaaaagacagctctagcaacagcagcagcgggagcagcaacttgcaggtggtgcagaaacggaggctgctaatgggagtggaggaggctgctctgctgctgatgaccctatcttcttcgcccacatccacgttgcttcatggataaggaccctcctccaacgccagatcagcagtgtacatacaacgtaccccctgcacagtgactgccgaacgattgcaggcctatctcagggttgtgtgatcttgtgattggggcggattattagtgccaagctaatcactccgttgatcgtcttgtcttcctctgttttcgccgcacccgtagatcttgatgccagccagccatatatcttctacgtgatttgtggtaggctccataatcagaggtctgttgatcccattccccccgcacatcttttttctcttgtcttttctctttttggttttttgtatgtactttgatgttgccccatttgtgagggatgggtgatcaaagaggagacgccatcccttctcgttctggaataatggtccaaataataaaggatttgagctgttttgttttgaaaaaaaatttcagtaaggattttttttgctgattaagagaaccccgtcaaatcgaagcagcttcggggttcatgttcaggtatgacttgagcgtcatgacagggctacgggcttccacagttccactgtttcgacagaactttgtccattcatccgattcaccaccgcggctgtggcatgcggcatgcctggacaaactggtagcggaaccaaagcaagcatgcgttgcttgcgcgccaccgttggcgtacggaccaccgttagcggtactggccggacgatgctcctctaccaagtaccgaccgagggggccgccgattgcttcccgcattgattgcctccgttgtccagcgctctgctctggagaagctgcggaatgcagagcgtgtgctgtgtgccatcagagcaggtggccctgtacagtgggtagagatggcaataggtaactgcgacccgatactcaatgatgattatttactttgttagatatgtatatgagctaaatgttctatccatatgttttttattgaataaaaacattcactcaatgggtaaaaaaaaaaaaaaaaaactcgaggggggg

SEQ ID NO: 355 - DNA, 1820 bp, Zea mays
ggcccaaatactgaacccacaacccgaaaccagcaggcaacaaagcaaccagaggcagagcgttcttcttccccgacggcccggggcccgggccgacggctcgactccactagtcgctggaaccctctgcaacaaagccgcctccacctgaccacctcccttgagctcttccccttcctcgtgggttgtgcgagccctctaccggcgcgcagtacaggggctgattgggtgatcaaacccgcaagatttgggtttgtgatttgggagcaggaggcggtggcaatatggaatataaggcgagatctactggaacttcaggaacttcgtctaaaagtttccgtgatctgtacaatatgaagtactcgagctacttaaacgacgaaccaatgccggatgctacatcggaaaaggagcagggaaatgagtatttcaaacagaagaagttcactgatgctattgaatgctactccagaagtattgggctgtctcctacagcagtcacatttgcaaatagagctatggcatatcttaaactaagaagattcaaggaggcagaggacgattgcactgaagctctgaatctggatgatcgctatattaaagcatactcacgccgaattactgcacgaaaagaacttgggaagcttaaggaggcaatggatgatgctgaatttgctatcagtcttgatccaaacaattcagagctaaggaagcagtattctgagataaaagctttgcacatggagaaaatggctaaaaaggttccagtgccagctaaacgtgcagtttctggaattgataaaactgcagatgtcacttctcacccaccgactatctcccagaaggacactattatggaagttgatctgcctgttagagatgcaatgaagatcaaagagagtgcaagcgtcaagtctaacggaggatctggagtaatcatcaatggcaataacgtgcagcagctccaaggtcgagatgccaaccagaagactgggccagaagtttcagtccaagatcttgcagctcgtgctgcttcacggtatatggccggcactgtgaaaagcattaagacacccaaaacagcttatgactttgaggtttcttggagagctctttctgatgacactgcccagcaaatacagttactaaagtcgattccaccagcaagcctaccagagattttcaagaacgcactttctgcaccttttcttattgacatcgtgaagtgtgcagcctcaattttccgggatgcggaggcattagctgtcagtattttggataatttggctcgagttccacgcttcgacttgataatcatgtgcctttcatccatgcacaaatttgaactgaggaagatatgggatcaagtattccttgctgaaaaagcgctggctgatgatcagatggaagctctgaggcagctgcgaggcagatacattccgggaggatggcaggatagcatgctcacttcgagttaaatcaatcaatcaaatgacgacgatgtaaagcaggattgttacaaaaaccttttgctggcttcgcaactgatgtctctgcatccatctgttctagaatcaggagtgcctgtcgattgttaagcccactggtctggatgtagcgaacggttgaagcatccagtgtaggaacatgtgtcgactgcaaatggttgagatccgttctgttgtgcttgccgctactgtaacctcgctttgttgtgcgccggattcctgacgctggcacatcgtacgcttgtcggcgacaactttatggaacacacacattttgatgatttaaaaattcaaaaaaaaaaccccgcgcat

SEQ ID NO: 356 - DNA, 1157 bp, Zea mays
ctgcagcatttgggaaaattagctcacgggatgaacatgaagattccggaactgtacagcaacctctgtcacattttatgttgatgatggtacatgttcaaaattacaataatttcaccagaactcttgttgcatggcattcaaatactccatccctttcacaatttaagtcccacttgcatacctaggaagcaaaatgatgagtaataatgcaatatattacagaattctatcatacttgttactatttagatagatcggtagattatggaaagcatgattaagggctaatttggaaagttaaatcctctacgggattcccggtgattgagtgagaaaatgagctaatttcccgctcaatccccgggaatcccggaggggatttaagttttcaaactagccctaaagtgtgattacatttattactatgcctcctaggtgcagttctggaaaggaaaccagataaatagttcaccacatttgattgactattactcgcatggtgatataatatttatgtacaagaatcatacctaggtatatttctgaaaagaaactggttttagttcagacttcagactgatggacacattatgtaagtttgagacaaaatgattacttcaaaacaatgagctgtgatcattgcatctgtataatcatatgcaatgatgctattaaacagcacttttcagttgatgcgaaataattgttgaccagaaactaattcggtcatccaaaaaaaagtaagagaaagaaaagtaacctgattacatgtaatatattaaactgttgattgtaactgcaatcacttgctcacttttgctttccagtgaaatttcaaccagatacagcccaaaactaacacaagggataagatactgactcattgacaatacctgtatcttggcaagaacaaagtttcatcccgatgtccagtccatacatgtgcttaactgtatgtctgaagtttcttgaatggtcaccttctccatggtatacaggggcatctgtgcctagaccatctctgctataacttacatgacttcctgttgcaggaacaaagacagtctggacagattaatgaacaagttataatgttacattcgatgaatgacaacactcagaacacactgcaaaactaccttttcattctgcag

SEQ ID NO: 357 - DNA, 3283 bp, Zea mays
  misc_feature (2233)..(2233): n is a, c, g, or t
  misc_feature (2253)..(2253): n is a, c, g, or t
cttcttggcgcatgtatgagatgcacctggctttgttccttaaagccgggtgtgacattattgatctattgacatgccagattggtatatattattcttatgacagtcattgattatggtggatattactttcattaggtatattcttgcatcttttttcctcatgttacatgtctaggctgttgaaaatataagatcatttcatgttcttgcatcttttttcctcatattacgcgacctttttatttgtgggcttatgctcgcacagaaaaatggcgagcaaagtattttcaccatggctacatgatctgagaatgacgattgtgtctagtgaacgaagaagaagatatctctcaaaataatgtatttgtgattgtgtaccatctcatcgaacggacatatataactagtgcagcacgtgactgaccgcacgtccctcttcccacaccccacatattccacaaaacctctgtgctacggccctggctctggcccacaccgcattgaaattaaccatcccgcacggccgcacactcgtttcctcctcccagtccaagtctccaagtctccagctacgactgccaggtctccgcttgtcgccgtcacgcgcgcgcaggggcagggcgcaccatccccgcgccgccatgtccggcaccgggtgcctccccaccgacggcccggccctatcccgggtctgccgggacggcgcggccgccgcacggctcaagacggggtcgctgctggccattctcgtcgccagcgccgtcggcatctgcctccccgtcgcgctcacgcgggccttccgcggcagcccaaactacgcgcggggcctgctcctcgtcaagtgctacgcggctggggtcatcctctccacctcgctcgtccacgtgctccccgacgcgcacgccgccctcgccgactgcgccgtcgcctcgcgcaggccctggagggacttccccttcgcgggccttttcaccctcgtcggcgcgctgctcgcgctcctcgtcgacctctccgcctcctcccacctcgaggcccacgcccacgtcggcgcccaccacgaaactccctacgccccgatcccgaagaaggtacccgtgttcgagctcgccggcgaaatgagccccaagaagcgcgctttcttgggcgacgaccgagaagaggaccccgcgccgcacgccgccaccaacggcgcagacccggaccgcgacgacgtggcgctcttcggacccaagaagggcgcccgcagcgacgaggtcccggtcatcactgccgggtgccatgccgtcgcccatgaagtggtggaggtaggggaggggcccggtgaggacgaggaggaggccaggaggaagcagaagatggtgtccaaagtgctggagattgggatagtcttccactccgtcatcatcggagttacgatggggatgtcccaggatgtctgtgcaatccggccacttgtggttgcgctctccttccatcaggtgttcgaggggatgggcctgggcggatgcatcgcacaggtgagaatcaaaacaacctataattgaagagctcagagttgctgattttgtcaataaacctagcagtggctggagtgagatttaagttcataactaatttgcgattttttagtgcgaatttaggttttgcagtatcaggaactagaaagttctaactttaacgaatttgtgatgtcaccgttccctctcttatacactaagctagataaaatatcatttgaccaattggcttccttctggagtataatgaactgataatcatatccttattagggagggggtcacattgcgtgattagctacctatatgctcatgcctgatatgataatttgcacatagatacgacaaagaatcatctcttattttgatttttcagtgaagtgtttggttgttttcagtttcagacttgggaatccggtccgcagtgcatttctatattctatactaattgttgattatgatttgtttaagcccccttgtgtcccctgatccctccgtctatggagtttaaaatgattcctggaccctggtcgaaggttccccgtggtccacaacaattaacctgagtgagcttttttgtactgctcattgcatttattttagcaataaaaagctgaatgctgaactttttgcaccatgaaaagccatgtggccaatccgtcctctttttgccaccaacttctgttggtttatgactcatcaaatgtttgganaatgtttaccttttgtcctncttcccccatagaaggcaatgaagctgatgtgttatgcacatataggaggagcgacaaagcatatggcattataaggcttaaaagtcctttttggtttggtggtatcttgtttgagagcaattccacgaagaatgaaagtgaaagagtaaagtaaagagattgcagggtatgcccaaacactaggactcataaaaagattaagagcacctgaaaaatacaacagtagtacaatttgccaatttctatcctttttcgtcagttaataattcataatgtaaaccaaataaagccatcaccttggcttccatttagcatgctggctgtcttatttagatattcataactagagatgcagagtgatttccagttgcatacattacccttgcatagtattatgtcttctcttcactgaaacaaactaaatatctgcttctgcagtctgtctttgtttctgacctagtgacctgtactagcgtatagtgacacttgcactcttcgctgatgtgtatgcacctgtctatttctctcaggctggttttgggatggcaacagttggctacatgtgcataatgttctcagtgacgacgccattgggaattcttcttggaatgctagtgttccacatgactggctacgacgatagcaatccaaatgccttaataatggaagggatccttggttcactttcggctggaattctcatctatatggcgctagtcgacctagtttctcttgattttttccacaacaagatgatgtcagcgtctttgaagctgaagaaggcgtgttacattgccttggtgcttggatctgcttctatgtcggtattagctctctgggcataggcattttgaagaaaagccttatttacgatcttcagaggtattgctccttgatgtaaaggaatggataatttgggggccaacagtacactagtccctcatgtaaatttgaacacaaaggaaactgaaaattcacgaccacagtttgtgagctataaaaaaaaaaaaaaaatggcaactaacgatc

SEQ ID NO: 358 - DNA, 1447 bp, Zea mays
agtccaagtctccagctacgactgccaggtctccgcttgtcgccgtcacgcgcgcgcaggggcagggcgcaccatccccgcgccgccatgtccggcaccgggtgcctccccaccgacggcccggccctatcccgggtctgccgggacggcgcggccgccgcacggctcaagacggggtcgctgctggccattctcgtcgccagcgccgtcggcatctgcctccccgtcgcgctcacgcgggccttccgcggcagcccaaactacgcgcggggcctgctcctcgtcaagtgctacgcggctggggtcatcctctccacctcgctcgtccacgtgctccccgacgcgcacgccgccctcgccgactgcgccgtcgcctcgcgcaggccctggagggacttccccttcgcgggccttttcaccctcgtcggcgcgctgctcgcgctcctcgtcgacctctccgcctcctcccacctcgaggcccacgcccacgtcggcgcccaccacgaaactccctacgccccgatcccgaagaaggtacccgtgttcgagctcgccggcgaaatgagccccaagaaacgcgctttcttgggcgacgaccgagaagaggaccccgcgccgcacgccgccaccaacggcgcagacccggaccgcgacgacgtggcgctcttcggacccaagaagggcgcccgcagcgacgaggtcccggtcatcactgccgggtgccatgccgtcgcccatgaagtggtggaggtaggggaggggcccggtgaggacgaggaggaggccaggaggaagcagaagatggtgtccaaagtgctggagattgggatagtcttccactccgtcatcatcggagttacgatggggatgtcccaggatgtctgtgcaatccggccacttgtggttgcgctctccttccatcaggtgttcgaggggatgggcctgggcggatgcatcgcacaggctggttttgggatggcaacagttggctacatgtgcataatgttctcagtgacgacgccattgggaattcttcttggaatgctagtgttccacatgactggctacgacgatagcaatccaaatgccttaataatggaagggatccttggttcactttcggctggaattctcatctatatggcgctagtcgacctagtttctcttgattttttccacaacaagatgatgtcagcgtctttgaagctgaagaaggcgtgttacattgccttggtgcttggatctgcttctatgtcggtattagctctctgggcataggcattttgaagaaaagccttatttacgatcttcagaggtattgctccttgatgtaaaggaatggataatttgggggccaacagtacactagtccctcatgtaaatttgaacacaaaggaaactgaaaattcacgaccacagtttgtgagctataaaaaaaaaaaaaaaa

SEQ ID NO: 359 - DNA, 969 bp, Zea mays
ttcctcagagccgcggcggcgcggcccctcccccctctcccgtgcgctgcgcccccaattcccgctccccacgcacccagagacacgccgagcgggagaggaagcgacagccagcagccgaggcggccagcgccagcgcaggcatgaccactcccactcccagtggcgacggctcgcccccgggctcctccgacctcgtgcccccttcctaccccgagatgatcgtcgccgcgatcaccgccctcgccgaggagaacggctccagccaggccgccatcgcgcgccgcatcgaggcgcaggcccgcggcgacctgccggcctcgcacccggcgctcgtcgccgcccacctctcgcgcatgtccgccgcaggggagctcgtcgccgtcgcgggggggaagtacgcgctgcccccgccgccggcgcagccggcgccggagtcaccggctgacgacggcgaagacgacgacgacgacgacgactgcgccgacgaggtggacgaggaagaggaggcgccggagcctctgctcgtgcctgtgcctgtgccgcagccgcccgccaagcgcgggcgtgggaggcccccgaagccgcgtcccgctggcttccccatcggcgtccccggagccgctgcgtcccccgccgccgcgccgcgacggcgcggccgccctcccaagccgcgtgacccgcacgcgccgcccaagatcccgcgcccgcgcggccggccgcgcaagaacccgctcccggaggggatggccccgcgcccgcgccccggcgcgccggcgtcggccaaggcagcgcgcccgcagttcgccgaggtcggattcgtgtgacgcgaggggctctcacccgccgcggcgagctggcgcaagctaacattctgcccctgtttcagctcttgtctgtctgatgtgggtctcgtctcagttcgtgtgttgctgtctaatccggggagggtaggggggcaggaatatg

SEQ ID NO: 360 - DNA, 1092 bp, Zea mays
  misc_feature (1064)..(1064): n is a, c, g, or t
gcatttcaggttcgtgccccgtttccactctccactccactcgcgcgtccgttccgcctccactgaacatctccttttaacacccggctccggcgactcgccccttcctccactggtgcatccaccattccacctaccccacccccacaacccgctcgcgcggctgtccaatggcgggaggcggggcgccgtcagcgtggggcccgagcccggcgctggtgaccgcactggtggcgctgcttgggctcggcctcgccgcctacatcgtcggcccgcagctctactggcacgccgcggaggtgctcacggcggcggccgcgtgccccgcctgcgactgcaactgcgacgcgcgcccgctcctcgaccttccggaagattgtgctaaacacttcaaaggggtcaagagtcgcgcatctggtgaagagacagaaaagagtttcacagagctgcttgtagaagaactaaaacagagagaagaggaggcaacacaagctcagcaagaggccgatgttaagttgctcgaggccaaaaagttagcttcacagtatcagaaggaagctgacaaatgcagctcaggcatggatacctgtgaagaaactagggagaactcagcggaagcattggtccaacaaaagaaactgacttctttgtgggagcgaagggctcgggaactaggatggagacccgagaatgccaaggcacgtctaaagtagtaaaaccagtggatggtgttggatactatgtgtagcaatagatctcattgtaaaaccagtggatggtgttggatactacgagctcgagatgatgaggaaacaaatgagttcctggttggactcgactctctttacacgccatggggccttattgttcatagtaaatttatgttcagtttgtagtgtactttcattgttctttgtgaacactgttgtgtgttgtacttgggatggtcataggattacattgttcattatttcctggatgttctaaaaaggagaaaagtaattgtctgggggtggtggcaataaagaagagattgcctgcagttcttaaaaaaaaaaaaaaanaaagtactctgcgttgttaccactgctt

SEQ ID NO: 361 - DNA, 2366 bp, Zea mays
  misc_feature (2346)..(2347): n is a, c, g, or t
  misc_feature (2357)..(2357): n is a, c, g, or t
cattgggtacctcgaggccggccggggcgctctctcctcctccacccggtccatccgtcgcgcgccaggagcccagaaggccaggggttcaccgtgctgtacctgtacccctatataatccctcgcatgcaacgcgcctcggcttagcccgcgcgaccgacgagacgacaacgccgccgtgccgcgcgcacgcccgacgccgacgacacgccctccgctcggccccggtgaggcagcgaacgcccgccacacgtacagataccgtgcgcgcccggcatgggggtgaccaccgccggggaggccgtctgtaagtccccggcgcgggcctcggtcatcgtgaggctcaacgccgcgttcctcgccttcttcctcttcgcctacgtggcgctcctcctccaccccaagtactcgggcctcctcgaccgcggcgccacctccctcgtccgctgcaccttccgcgactcctgcccgccgccgtcgccgtcgaaccagcagctctcacggaagctgggaggcgtggcggcgaacaaggtggcggaggaggagcgcatcgtgaacgcggggcgcgcggcggccatgttcgacgagctccggggccggctgcggatggggctggtgaacatcgggcgcgacgagctgctggcgctgggcgtggagggcgacgcggtgcgcgtggacttcgagcgcgtgtcggacgcgttccggtggtcggacctgttcccggagtggatcgacgaggaggaggacgacgagggcccgtcctgcccggagctgcccatgccggactgggcccggtacggcggcgacgtggacgtggtggtggcgtcgctgccgtgcaaccgcagcgcgcccgggtggaaccgcgacgtgttcaggctgcaggtgcacctggtggcggcgcaggtggcggcgcgcaagggccggcgcgacggcgccggggcggtgcgcgtggtgctgcggagccagtgcgagcccatgatggacctgttccgctgcgacgaggaggtggggcgggagggggactggtacatgtacaaggtcgacgtgccgcgcctggaggagaagctccgcctgcccgtgggatcgtgcaacctcgctatgccgctgtggggatcaggaggtcgagggatccatgaggtgttgaacgcgacgtcgtggtcgggcgggcgtcgtccccggcgcgaggcgtacgcgacggttctgcactcgtcggacacgtacctgtgcggcgcgatcgtgctggcgcagagcatccggcgcgcggggtcgacccgcgacctggtcctcctgcacgaccacacggtgtcgaggccggcgctgcgcgcgctgtcggcggccgggtggacgccccggcggatcaagcgcatccgcaacccgcgcgcggcgcggggcacctacaacgagtacaactacagcaagttccggctgtggcagctggccgactacgaccgcgtggtgttcgtggacgccgacatcctggtgctgcgcgacctggacgcgctgttcgcgttcccgcagctggcggcggtgggcaacgacggctcgctcttcaactcgggcgtgatggtgatcgagccgtcggcgtgcacgttcgacgcgctcatgcgggggcgccggaccgtccgctcctacaacggcggcgaccaggggttcctcaacgaggtgttcgtgtggtggcaccgcctgccgcgccgggtcaactacctcaagaacttctgggccaacaccacgggggagcgcgcgctcaaggagaggctgttccgggcggacccgcccgaggtctggtccgtccactacctggggatgaagccatggacgtgctacagggactacgactgcaactggaacgtggcggaccagagggtgtacgccagcgacgaggcgcacgcgcgctggtggcaggtgtacgaccagatgggggaccacatgcgcgggccctgccgcctctccgagcggaggaaggtggagatcgcatgggacaggcacgtcgccgaggagctcgggtacaccgaccagcactggaagatcaacatcacggacccgcggaaatgggactgatccacgactactccgtccgtcgcctgctgcattttcgtacataataccccacacgtagctggtcgagagccagatcgctaggcgcgcagcattttggttcgtgggtacatttaggccagctcagtttcataagtggagctgttgttccgaggtttttagcttcacgtacgaacagcttttccgatgaagctgaggggttttcgtgatcttatttggcaaatcagctttgcattggacaacaaacaaataaaatgaccgtaatgctctctgcttttgtttccttctaannaaaaaaaaanaaaatttaa

SEQ ID NO: 362 - DNA, 1964 bp, Zea mays
tccaatttatgccatcatcttgtaatcagagggaacaagtttcagaagcaatggttctggtcattacagtttcagaacccagaactctgaaccgtgcatctctctcttttgttttgtatgaaaagtggacggagagaagacaaataaggagttatcgtcagaacgccttgctcaggaagagaagatcggtacggtacggtgcatggttccttccaaatccgattgactttgaccagctgccgatgttgacgcctcctacgaatggctgcccccaccggcccacgtgtgcccggccgcagagcaactgggtcgctacaaaatgcaccagccccgccgccccgctctcctcccgcccgcgccgatcacatcccagtcatccgtcacaagctagatgccgcgctctgaccgtatgaccaggcttgtcccccagcagctgctcgtggtggtcgtcggagcagcagccatcaccgtcgcaacggcatcggcggcgcacgtcgactccttcagctacccgaccttcgacgccaccacgacgcaggacctcgtggcggcaacaaacacctccatcctgacgtcggcctccctcctcttcggccacgacgccgacttcaacttcaaccgcaccgagggcttcatcctgctctcgcgcaccgtcgacgtctggcgcgccggccccggcggcgggccggcgcgcgaggcctccttcaacaccagcttcgcgctgagcggcgccgcgcccgtcgcgtacgtcgtactccgcgacagctacccgccgctgcacggcacgggcggcctccgcggcttcgccaactacagcgcgtcggacgccgaggatggcgccaccccccgcaacgcctccagcggactcgcgtccgtcgaggtaggccccgtgcggtcgtacggcccggacgacccggccgtcggcctcaacgtcaccgtcacgcccaccggcggcacggcgcctggtggtggtggtggcggtggcggcgcgcgcgccgtgtggatcgagtacgacgccgccaagcacaggctgtccgtgtacgtcgccgccgcgggggagccgaggccggccgccgctctcctcgacgcgcgcctcgggctcgctggacgtcgcaccaccgagacagccatggtcggcttcttcgctagcgccatccaagacgttctcgtcggcgtacgtgactggaacctgacggtggacaggctcgacacttctgagggtggcgggaggaaggagggtgccgcgtgctgggtcttcgtactgctggcggtgcttgggtccgtggcagccacggcctgaatgccatcatcgtcgtggcggtgttctctactccagtcaagaaaggcggggtcggcagcacatggggcacggcctctcatttactgccacctatacagctagccgccatcgtcgtcgtggcggtgtgctgtgctctactttgttcaggaaaggcggtgtcgtcggcagcgcatggaggatacaggatatatgtaaccagtaatatctcatttaatttgttgccacgtatgtacacgcttattaacaaccctgatttaatagaacttactacgaaggatgggttgtttatcccgcggccaactttcatgttgatttaagcatacgaagtttgactaaaaataataatatttatgataacgaataaatactaaaggtctatttggttcttttagtttagagactaaattttagttttcatttgtttggtttgagggactatgttcggaatcaactcataagaaaaccgaaacgccttttaccactctcccactattagccctatttgaaacttctagggctaataattagcagttaaaactagttatatagattctaaacatccttagctaatgcatcatctaattattagctatctcacaactaataattagttcattagttggctcaacctagctaataataatttattagctggctaactatt

SEQ ID NO: 363 - DNA, 2796 bp, Zea mays
atgcataattttggaccgtgtcatgtttaggcggtgtttttgttttgtacttcagagcagcccaaaagaacccatccaaatgtacacctcaagacgagcctcccgtgttggtccagttgcaaacaaactctggcttctattgtggtggcccgtaaacgaagtgcggttggcttgcaacagtgaaaaggaaggctgcaaagcccatggaagggcccaagcccaacaatacatgcagagaccagagagttctctgtatgtgaagacgtcaggtgggcgtaataaagaacatttaaattcgtgggccagtcatgttatcgagaacatctcccatttttctcgctgtgtcgccacgcagagatattgttgggtggagatcttccgttgattttctagctccagcgttgtgttgataagattggagtagcgtgagctctcggccttgcgacgacctgagctctgtctccagccaaccaataccactagatgttagaaacttgggcgagcctcctgctcagtcaccgtggtttcgcctcgatgcatgcatccaattccaatcgccgcaatttgtgtgttttttttgttctgttagtttagtatcgcatgagtacgcttggaaaaatggccgaagcctacctcctccacttgctaaactttggcaaatcatcattagcgctaacccttcggtcttatcacaagagcacccacacttgcttagaagaaatccccacttgggccacttgccaatacagcccttcccacaaactggggggcgggaggaggttttcggtttagcgcaccccgacagtccgacgctggcaaccatctctgcggcatcggctgtggccgcctcgtgagtcacggcgcgctccaagggttccggcgcgtggcggccacgcgctctggcggtctgtccgttcggcggcaacagcgatggccgcagagtagaccgctgtcccggatccccgaaaagctcagaaaccgcggcgtaccagccacgtccgcggcgcgtccccagcccggacgcccgggtctacacggccgtcgctgtctgcctgtctgtcctccgccctcaacagagcgacagcggctggccgcagacgcaactgaatggaaggtggggcggggcacatgcattgcaccacctcttgcggagttccaaccgccgaatagcgacaaggtggcccgtgcccgcggcgacatggtagccttatcccctcacacgctgacatgacacgttcacgatcacgcagctctagcctcccccgcccgccccgcgaattttggagcccccacgccatcagtccaccaccaccacacaggcacacacacacacacactttcctcgcccaaccccagcgctttctcctcctggcttcccctatttaagagccgccccgtcgtcccgagaccgcgattcccaagcaaacagccaaacacacgcgaagaaaaggagatagagtacaggttacagacaggcagagagcaaagatgtgtggtggtgcgatcctcgccgagctcatcccgaccacgccggcgcgccgcggcggcgcggcgtggcccgccggcaagtgcaagcggcggaaggcgaacgacttcgaggccgcgttccgggagttcgacgaggactccgaggaggaggaggaggacgacgagggggtggtggagagcaagcccgccttcgtcgtccgcgcctcgtccgcggcgacgcagcccagggcgcgccaggagcagcggagccggcgccgggcgcccgaccagcagcagtacaggggcgtccggcgccgcccgtggggcaagtgggccgccgagatccgcgaccccgtcaagggcgtccgcgtctggctcggcaccttcccctccgccgaggccgccgcgcgcgcctacgaccacgccgcgcgccacatccgcgggcccagggccaagctcaacttcccctcctcctcctccgcctccgctgccggggcccccgccagccgcaagcgcgcccgcaccgccgacgccgacgccgtcatcgacctcgaggaacaagagcagcgcccggccgcggcggccctgaagcacgaggccgccgagtgctccggatccgacgcgctcccggacttctcgtggcagggcgtgtcggcggcgtacgacgaggcctccgcgccgcgcccggccttcgacttcgaggcgcggccggagagcgccgcggacgaggcgtcgccccgggcctccgactccgagtcggacgcgctgttcgactcgctcctcttcggcgaccagttcgccttcttcgacgccggcgcgtacgagtcgctggacagcctgttcagcgccgacgccgtgcagagcaacgccgccgccgcggcggaccaggacatgccgctgtggagcttcgacgacggctgcctcgtcgaggacaacctctcgttttaagcttcggcgactgttgctgtgtcttgagttttgtaaattacgacctgttttttttttggagtttctgctcatgtatatctgtatcgatggtgagctgaatgaaatcatccttctcaggaagtaaaacaaaggaacatccctcccttctaaaagtcatgaacacactaatttcataattgatcgacagcctaacccgactagaagatgcatcttctagaccatgttgaagacggaccctcgcctgctcgacggaggcacatgcgtgtccatgtttgggttgacgatataccactttttaaaaatctggaataattcagtgttgacaaatccggtttggcatacatgctactaaaaaatgagcaaaacaaatcaggattttgc

SEQ ID NO: 364 - DNA, 961 bp, Zea mays
  misc_feature (7)..(7): n is a, c, g, or t
  misc_feature (22)..(22): n is a, c, g, or t
  misc_feature (47)..(47): n is a, c, g, or t
  misc_feature (73)..(73): n is a, c, g, or t
gttgctngaaacgaaacaccanactttcgaacgcatctcttggttgngaaattcaacatcgatttcttggcgngaaagagtagccagccagccacatgcggtgtagtcacggcgcctctgtggtgtggcttcctccccaccacaaggctccccaccctttccatctcttccatcccatgcgtcggcctcgccgccgcccgcccgacccgacccattcccctagcttcagctgcgcgcttctcttttctctcctatacgttctaggttcgttgctgttcgagcggggtaagcttagccagcctctagcaagagcaagagcaagggcaaagggcatggcggcggctgtctccttctcccgggtgcgagctctcccgacgtggtccagctcggtttccggcgacgaccaccacgcctactccgtgttggcgacgtcgtcggtgtcagccagacctcggtctggcgcgcgaccgctgcggtcgccggcgcagatgatgggcaacgtgaacgatggcaaggggctgttcgcaccgctcgtcgtggtggcgcgcaacatcattggccgcaaacgcttcaaccagctgagggggaaagcaatcgcgctgcactcgcaggtcatcaacgagttctgcaagaccatcggcgccgactctaagcagcggcagggcctcatccgcctcgccaagaagaacggagagaagctcggattccttgcctgatctgatgatcgacgcccacgatgacgatgctaatatatatatatatatatatatatataacaatactaatataagtacaccatcttcaagtagtgacgaacaatgatacctttcttgcttatcccaaattctcttttaagtggtagctatagtacgttccttgatgtaacgatgcttcaattcagcctcagatgtttgtttgtcgaaaaaaaaaaaaaaaaaaaacccccccgccgccgcgaatt

SEQ ID NO: 365 - DNA, 873 bp, Zea mays
gtgcggccctcgaggcggccgggtccggaggacgcagccgtgcaacgagttgagtggcttcctccccaccacaaggctccccccaccccgcccgatctctatctcttctcccgtcctcccttagctcggagtcggacacccacccgccacgaccaccagaccactcgcttccccgaagcttcagctccgcgcttctctgttcgagctagccagcctccagcaagagcgagcgagcgagggcaacgggcatggcggcggctgtgtccttctcccgggtgcgagctctcccgacgtggtccagctccgtgtccggcgacgaccaccaccgctcctactccgcggcgctggccatgtcggtgtcggtgcggccccggtgtcgcgcgcggtcgccggcgcggatgatgggcaacgtgaacgccggcaaggggctgttcgcgccgctcgtggtggtggcgcgcaacatcatcggccgcaagcgcttcaaccagctcagggggaaggcaatcgcgctgcactcgcaggtcatcaccgagttctgcaagaccatcggcgccgactccaagcagcggcagggcctcatccgcctcgccaagaagaacggagagaagctcggattccttgcctgagacgaccatgttctacgcacatatataagtatataatctataagtactacatcatcaagtagtggcggacaatgataattatattgataccttcttccttgctccgatcgagtcctctatcaagtggtagccagtacatgtcatgtgatgatgcttcaatccagcttccgatgctcggctgtccatcatcaagctagctgcatgcttttgttgcaaagaaaactaaaaaaaaaaggcccctagggcc

SEQ ID NO: 366 - DNA, 4314 bp, Zea mays
  misc_feature (3784)..(3784): n is a, c, g, or t
  misc_feature (4183)..(4183): n is a, c, g, or t
atccccctcccttcctccctctcctctcccccaactgcccccccgcccgcgcaagggaaaggaaaaaaggggtagacgactttgccggacgcggcggtgcatcccccatcccatcccgtcccacccccacccctcatcgccgcgccgcgtcgcatcgcatggctgaggaagacgcggcggccgcggcgggctctcccatcctagacctgccagagcctctgctgctccacatcctgggcttcctcgacgacgcgcggtcccggcaccgcgccgcgctggcgtgccaccggctcctcgcggcggagcgggccacgcgcgccgcgctctcgctgcgcggggacccacggtcgaacgcgtttctcttcctcaggccgactttctgcttcccggcgctggagcggctcgacctctcgctggtgtcgccgtggggccacccgttcctctcctccgcggcgccgtccgccgacgccgtcgcaccgtccgtgacggcggaggaggtcgcagagcagaacgccttcatcgcggcgcgcctcgcctactgcttccccgccgtgtcctcgctcgccgtctattgccgcgaccccaccacgctcgccagcctcaccccgcactggaggtccggcctccgcagtgtcaagctcgtgcgctggcaccagcgcccgcccggcctcgacgcaggcgcggatctcgagcctctcctcgaggactgccccgcgctcaggacgctcgacctctccgagttctactgctggacggaggacatcgagccggcgcttgcagcgcacccggcagccgccgcggcgctcaccgagctcgacctcggcctcgcgggcgccacggacgggttccacgccgccgagctggaggccatcgccggatcctgccccagtctccagaagctcgtggcgccctgtgtgttcaaccctcggtatattgacttcgtcagcgacgacgcgcttctcaccatcgccgccaggtgccccaagctggcgatcctgcggctccgggaacctttcgagccggcggccaccggccaacgagaggacgcggcaatcaccgtcgcagggctggtttccttcttcgctgcactaccggcgctggaggatttcacgcttgacatgcggcataatgtgcttgagacagcgccggcgatggaggcgcttgcccgcaggtgcccacggatcaagttcttgacgctggggggcttccagggcttgtgcaaggcatcttggctgcacctcgacggagttgctgtgtgcggttcgctggagtcgctatgcatcaagggctgtttggatctcactgacgccagccttgctgccataggccgtgggtgcgggaggcttgctaagtttgccatccatggctgtgatcttgtcacaccagctgggatcaggagactagcaactgctcttcggcccacaatcaaagaagtcagtatcttaaactgccggcttctggacacggcagcatgcctcactgctctaagtccgatccgtgatcgcattgagagtcttgagatcagctgtgtctggaaggaagttgaacagcctgagagtggggccaacggcatagccggatgcaatcgtgaagatgacgatctcggtggtgaagtatcatatgagtctgcttcgaagaaatgtaggtacatggaattggatgatctagtcagctgggagatgctgcgttcactctccctctggttccctgccggtgaggtactctccccactcatctctgctgggcttgatagctgccctgttctagaggagatctcaattaaagtggagggtgattgccggacatgtgcacgccctggcccattatttggcctgagtgatcttgcaggtttcccagtgctggccaagatgaagttggatctgagtgaggcagttggctatgctcttactgcaccagcaggtcaaatggatctctctctgtgggagcgattttatttgcagggtatagattcactaatgactttgtatgagctggattattggcctccccaagacaaggaagtgaaccagcgtagcctaacactgcccgccgtggggctgctccagggctgcgttggactcaggaagctcttcgtccatggcaccacgcatgagcatttcctgacctttttcttgaaggtgccaaatctgagggacatgcagttacgggaggactactatcccgcaccagagagtgatatgatgaacacagaaatgcgagccgagtcttggctccggttcgaggtgcagctgaacaacaggctaattgaggattaacggtgaatttggtgagctgtgagagcatcagatgaatacagagaggtgctgatttacttgaaccaagtggagttgatgccggggtggtgctgtgcgatggatgatcacggaagtagcaagggtagctgccgtgcttgtgtatccgacaattatcggtgatctttactagttgcttttccttttaaaaataagagtgtatgataagggagttgatgcagaattcagatatttgcatgagtttggacgataaactagaatcgagagaattttgcagggatgctttttttccctcccacttttgagctgagtccagttgaacaccgaccggattaagtggcaattaatgaatggtcctgtgcgctgtaacaatctacgtggttctgtaaaaacaaattaaaaaatgtcatttttgtggtctgttttcccagtgctgccataacatagtgatgatggtcacgtccaaaaaataaaagatagtttgatcacatctaaaattgatgaatgatcattacgcaagaaatatggcagcctgatcatcaggcaagaagcacagcaaactcctgctccagaatggccagaatccttgtttcatttgacagaatgctattttttttcccttctatgcaggcatcaagaacaagctttgccccggccctttgcctcccctcactggccgcatggatatttgacgagaccgacgtgccgaacaagaccggcatccaacgcggagagaagatctcgccactaccacaagctgtctacggctgcgcccggcgccgtgctgaagatgatgccgcgcgatcgtggcaggggtttcgtctttccgaggggcaaatccgggcgattcttagtgcccctctactcttgttctgatccataaacaggtggcgcccgccgctagtgcctttcagtccagctgcagctggaggcctgacgagttaaaaggcagttgcccgcccctctggcccctctagagcagatccaatttataattcatttgatttttttatcaccgacttgtcttatttaatttattaaaaaaactaaattgtatttaaagtatattatatatatgctaaatgatatcactgttaaagttggtaaaaaaaaaaaaaatgtgattaagatgggctggttaaatttagagtaaaaaaagtcaaacagagaaagtactagtcagtacaccagaccagtccctttccttcattgtaggatagtttttctagtagattaacttatatattaaggccctattttaatattaagagataaactttagcagttttttagctgtttttagccatttggtgatctaaacatgagagctaatagtggtgtgatataatttagcacatattatctaataagctgctcaaggggtgctaaaaggagctaaacgtgggtcacgaaaccctattttccacccataccctctaacctcattctctatctgcattagggcacgtgtgtctttttattccaatatactaaactttattagagtgtcnaaacactcaaagaagctaaactttaacactttaattcatatggctgtaggaagctaaaatttatcccatgagattgaaacggagcctaattttatgactacctgtattaatttggaaggtatagttgtatattttatcatgtaaaggcttgaattttacatataaatatgttgggtctctaattctttatgtggtaaatagagctgttaattagactaaaaatctagtcaccacgcttctatggctaaccttagctacaatttcttttgtcggtcatactattaccgagaaacttagcaagatgaaatatctcatatgaaaggcatatgttttgaacatggcacgatggtgctcgtagaagaccacctcatcgatgcgcctttggtgtcctaagctacnataaaaatacaacatgatgataagaaagtcttcattgccaactctaaatatggagatgcataccttctcttatccataacaaaagatgtcataacaaatgtgacaccacgtcataacacagggacgccatc

SEQ ID NO: 367 - DNA, 3248 bp, Zea mays
  misc_feature (3224)..(3224): n is a, c, g, or t
cttgtgtgttgtgttcagtggtcttttgtttccttccgctaaaccttagatacagattgggacatgggaaacctaaattatagaactataaaaatttgaaaaataaaaatcctaaagatagattggaacataagaaacataaataaaatatttataattcacgaggacatttataagcttctagaaattagatttatcttttgaaaaataaaaaagtatctagtaaaaactggaaaattttcaaaacattatgttgaatgtctatacatattttagaagttcacaataaaaatatgagaggccagcatgagtgtaacgtgcatgaaggctaaatgtatttatgttggttgcatctattttttttgtattgtgagaagttttaaaaacgtgggttgacatttattagaatatttttttcggaattttcacagcttcttggatactttttttccatttttcttttgccaaatctaaagcttctaaatcttttcataagtttttactgtttgggtataggtttttcccgtgatttctaaaaccttattaattctttacacacaaattttaataaaattgataaaaaccactttgataatcacttctaacaaggacattgagataatttaaatggttgggtgttgaaagaggcagtctgttcggttttagagctagaggaaaaaattagactttcaaaaagattttgaaacctagattacgatagtttagtacttcagtttatgaagtcaaaaaagtttttttccccaattatcaccagcagccggtttgggcttgggccggccagaggcaggccgagtcgcaagcgccgttgccatctctaacacgcggcactgtaggaatcggctacctccggctgctctgctttgtgagatgctcttcctcgtccggcggcaccgccgcctcgctctccccttctccagtctgcacgcacccgcacccgcgcccgctcccacactgccctcctctctcgacgcctcgtcggtgctcgagacgctgtccctctacgccaacgattggcgccgggcgctcgacttcttccactggtccgcctcccccgccggcgccaacttgcccccgaccgccgccaccctcgcccgagcggtcgacatactcggcaagcacttcgagttcccgctcgccacctccctcctcctttcccaccacgatcctggggaccccgccttcctccgccccgcgctccgcgccctcctcaaccgcctcgccgccgccaacctcatcgacgacgccctccacgcgttcgaatccaccgctgcctccatcggactctgcgatgaggtctccttccacatcctcgtcgacgcgctctgcgaccaccgccgcgtcgacgaggcccaccacctatgcttcggcaaggacccgccgccgttcccaccgggcacgaagacccacaacctgctcctccgtgggtgggctaaggcccgcgcctgggcgcgtctccgccagctgtggttcgacatggaccgccgcggcgttgccaaggacctccattcctactcgatatacatggatgcccttgctaagtcaggcaagccgtggaaggctttcaaagttttcaaggagatgaagcagagaggcattcgaatcgatactgttgcttacaacactgcgatccatgctgttgggatggcacagggcgtcgactctgctgtaaggttgtacagacagatggttgatgccggttgcaaaccaaatattgccacttacaatgcgattatcaagttattctgcaaggagggtaggttcaaggaagggtatgcgtttgttcagcagatgcgcaagactggctgcaagcccgacgtgctcacataccattgctttttccagtatttgagccgtccacaagaggtcctcggactgtttgagaaaatgcttgagaggggttgccagccaaggatggacacatatgtcatgcttattaagaggtttggacgctgggggttccttcggccggtgttcattgtgtggaaggcaatggaagagcagggtcttagcccggatgcatttgcatacaatgcacttattgatgcattactgcaaaagggtatggtggggggggcttgggagtcggctgcgggcagccttgcgaagggactctcacctaagcccaggaaagagctggggactaagttgccagaagcagaatctgatagtgataacacattagatggtgtgctttgatttctgtgagctagacagggatgtacattatcatgttctactacccattgttatcatcgaaacaattgtttgaatatgctcatgttcccaaatataggctgttttcattcaaggagatctaatatgatttcatggattttatatggaattcaaagcagacaatcatattgcattgccatcagttatcattaggttattatctgataaatctgtggaagaggtgggcctccagagcattatgtgttcctggaatcataggtggacatggtcacatgtgtaggaaaaagaattatcatatgctcatgggtctggtgcagcggtgagaactctcactgagtcaccaggtcgcacattcgaagcagcctcttcgtatttgcggggaagacttgcctcggtttattccttccccagacctcgctcctgtgtgagcctccggcactagatccgcccttttttatacgctcatgggcgtccaccccagttgacataagaagtggatgaaagaaccaagacgaatcagcaatgaagcaaaggccatgtagtttgtaaggtccctagtaagtcagcttcaacttgctaaacagctcatgacgagacctggagccccacgcctccgaagtcagcttcagcttgctaaacagtttcatggcgagacttggagcatgaatacttcaggtacttatcatgtcatatcagactcattttttggctcatttattactgaattaaattgggatgaaagtcgaaatgcaaaacttttagatggaatgcagatcttctgatcttcatgtggttgctccttcagtgaagccatcacatcagacaaacggcaatcatggcattcaaacttaacttgttagctctcctgtgagcagcatgaagccggttctcctttgattatcaactggcttctgttcgtaacagatttggcatgcagtggcaacttggtcaagcatagattctcttgagtccaaccccagtaggaatcaaatcaagatgcttcacanaatatgaaaaactggtgacacaag

SEQ ID NO: 368 - DNA, 1471 bp, Zea mays
ggggttaaagtatttttttttcaaacacgcaggacaactgtgtatctttgtattaagaagatgaaaagggatagagaactgagaaccccaaaacagattacaaagaaaaaaagaaaaagaatagaaaaacaacccactcacaaatctcgaccagaacaaagaaacatgacctggatcaagctagaggattactcgccaacaagtcaacatcctaattcccttcgcaccagctagcccccaaagtctcatttcctctgtggctaaggacaacacatgctgcacatcgggcttgatcccaatcccatcgaagacacatcggttacggtgcttccaaaggagccaagcaccaagcaggatgatgtagtagaaaccctgctgaaattgctcatccaccactgcagcagaacctgaccaccattctaggaagaaggacgtgtctggctgtggagataggcgttgaagacccaccacttgtaacagcacgaaccaaaattgcctgagagaaggagcaagagaccagaagatggttaatggtttcctcgtcttggtcacaaaacaaacaacacatagggtgctgcctgtaaaccccgtctggctagacggtcggcactccaacatttgtcaagagcaaccagccataggggaaaaaaacgacatttctttggggcccacgatttccagattagatccgaaggaccaaaaaccgtggctccaatgaagaaacccccataagctgacttggctgtgcaaacaccagtagaagaaagcctccatatatgtctgtcatcacttccaggctactgcagcacctacagagagtgcaccctgcaggtcatgtttaaaagtattgctgtttttatgtattgaaaaacgggttgctattcaaagtgaatataggaatcactatactaacgtacaaggtaatataggcattaaaggatggatatgaagagaaaaaaaaacctgtaaatgggttgcaaagcagatagcatgtttcaggctcccccaatttatactcgtacaagcctggtgatcttctgtatgccctctggcagagacacgatgcccttgcaattgctgatgactagtattttgagagaagcgaggtcgcccagccatcctggaagggcagtaattctgggacaccgctccaaacgtagcatcttgagggaggtgaggagctgcatactctccggaaaatcgctcaggtttggccactctgagatgatcagttctttgagagagatgagttctcccaaccattgcggtagtgctgacatgcttctacaatttatcagcgacagcttccggaggtgggcgagttgcttcatgccatccagcggtgcctctagccctgggtacttcgatatctccaacgtttcaagagaagtgagctcacccaaccaattcggaagctcacactgagcatcgtcttctaggcataacgattcgatgaaggcgaggccttgga

SEQ ID NO: 369 - DNA, 1548 bp, Zea mays
tttttttttttttttgtattttttttttttttttttttttttttttttttggatcggaaagaatactactcttgttccagtttcgagtcacgacaatatgtaattgtaaacgcataagttcttctgaaacacgggcgagcacgatgagctagactgcaagaacaacacagtactgtacaacacggcgcgtctcgtgtcatcgagggtcgaatagcatggattatctcggtagacaggcgactgaacatgcctgagttcatgggacaggcaactctgaatgagttggttggtggcttctccctcgagtcgagcctggacgacgacgacttgtggttgtggcttgcacacctgccgccagccgatctgggcaggatctcggcccacgcactattattctctgaaggaagcctgtgggctctctaggagaagataatttttttgattgaccacggatcggaagaactgttttctttatctgccgccagcctgcttgctcataagcgcacagttcccttacattacttggacacttttatatatcttgcagcctcatcactagcttctctgcaaacaagaaaagagaaagcaaaaaaaaaaaaaaaaaaatctagcccaaaaaaggatgatatgcatgtcagactcagaccttaacaaaacgtcaattgtgaagagactgccttgaccctattggactaactctccccttcttccctaccgcgcgcaacatatgaactattaattacgcatggtgcttgtctgaatataattgtattttcaggaagatttgtgcgttctggatcagcctatatatatacgtacgtaccttgtataactgagcttcctagctcaagtttcaattattcattcattattctatctagctactcgttccctgatttcaggcgagttcgatctgttttgtatttggggttattagacagaggatatcttataattcagcttatgagttccataagaataatcacacggctcaactacaacttgtgcgagacaaattatgaggaaaaagatatataccacaacatagtagcaggtctgcttgatttatttatcctacaaatctggacataattaagttcagtaccgtttccatctacctaacttataaagtgacctgttaacaagacctctctctatatgttagatgcaaacaatggtaaacatgcatcctttctatattaaaaaaaacaatggtaaacatgcatatagctagacagtagctgtattatttggtaggacagataaatcaaagagatcagctacctatctttcttcataatttgtctagccaagctatagttgaaccgtgtgattgatgttaagaaactcgtaagttgaactgcataagaaatacactgttcaataattccaaatacaacgtgccttgtgtagtcctggccgaggaagtagcacgtagtgcgttgcttcacagtaccgtgcctgactgcctggagagatggatccgaggctgaacagagagaagaaactggctagagatgctaatagtagtgcaggtgtgggattgac

SEQ ID NO: 370 - DNA, 3670 bp, Zea mays
  misc_feature (688)..(688): n is a, c, g, or t
cccaaacacccaactaaaagtatgttggttttaggttgcaaagtccctctcaaccttctgctgtcccctagcttgagttgattcccttcattcatttaataatttattacgtaacctcatcatctttgcctaaatatataagtacttttcttcttcttccgaggaaaagacgttaatgtccctcgtccatctgcgcagcgtccatatattttgtcacaaaatactttgttccccccatgaatttagtggcatccacgttcgctcttcaacttcctgcacaggaacagaggaatggtaccgatgaaccacgcactaatgaaatttattagcaattcgtttgcacactgccgggtactctggggtcagctaagatgattcatggcgtcttggtcacggccacgttagcgctgcgtcagcggtgtaagcatctcggcgttaagaactgtaccatcgagccgtgttatctcgtcgccacggtctgtggctgtgacgttgagtaaagggtccaaaaacgattaagtcgtgaacaatttttttaaaaaaagtttaaatacaaaaacttcgggatcttcaactgcactaataatcacgccgcaaagtctttactgctacgaatggactctctctacggactatggtagagtagagtcgtcattgaacaggctggtttaggtgcacagtagttgcntcggccatgccagcatcagacaattgtacagtcgtcctacctaataagcttgcactagaaggaaaatccacaaagacaacaacgcctgctcttactttagttaagcaattaatcacaacaccttcccttcttccgtgctatgtaatgtatagaacctcgaaacgacctttgcgttgtgtccagctgcgatatacacactacactaacaatttccatgattgctgtctgtctgtcagtctgtcatgctcatatcgcaaccattccatttaaaaaaacaaaagaacgggagaggatcgtccgaggccagtttagtcaattcgctcaacactaacgctgaaaagcgtccaggcaacgaccacattcatgatgaaaaaaccaggaggagaattttgattgctggattgtcgccgtcagcggcaaccaccgcgcgcgcgcgcgtaccagttccggaaaaagaaacagcagcctctgcccttcgtttttatacgctcacccgacgacaggcgatggggggaacagctatagccctgcagttagtagcatctcgtttcagagctcagaggagggaggaggaagaagaagcagcagcaaggcatggattgctgcatctgcagccccgtggcgtccgtgtacaggctgccaaggaacgccatctgcgctccctgccaccaaggcgccaaggccatcatcggtttcctcgacagggatggtgagcgggaagaggacgacggcggtggccgttctgtccagctccagcctcgcggctcggccaaggtaaccgctgctcacttgatgatctgttccttgcggttcctggtccagcttttctttacgtacgtgtctgagtcttcttgtcccacccgattgttccgttcctacgtcacaatcgtaggatgatggttgacgtacgtatgcttcaactcaaaggtattctctagaattgatggcgggatgctaacggatgcttgaggtttgcttaagcaacatcgttacatgtatatatacactagtacgtcttgcgttagaacagccgagatttgccttctttctgcagccagccgcagggacgctgaacatgtatcgaaattatttctgtttgatgcaaagtttaactagttgctgacagtgaattcagaggtggtgctgatagaaagggctttgaataatggctgacagaactctgtttttttcttctttttgttttgtttaattcaatgaaggggctgagagatgcgtgggagcaggtgaaggagatgagagccagggaggaggagaccaggcagagagctgccttcctccagcacggcttcgcgtcggcgtggaaggagggaatccacaccgacatcgtcgtcaaacctggcaccggtcccgcgattccagcccacaaggccatcctggtgagtgggcttccggccgggcctaataatacaagtggtcgacggacgagttggttgggccggaccgggccaggcctcttccgcatattaaaccgatcgagcctctcagctcacgaactccacgcccgatccattcgtgcaggccgcgcggtcggaggtgttccggcacatgctgtccggcgacgaccgctgcaaggcccccgccggcggctccatctcgctcccggagctctcccacgacgacctgtccctcctgctcgccttcctctacacaggcgctctggaggcgccaggaggaggaggaggagaggccagccaggaccaggagcggcagctgcacgcgctcttcgtcgcggccgacaagtacgacgtgccgttcctgaggcgggcatgcgaggcgcggctggcggcgggcgtggcgccccggaacgcgctgcggacgcttgaggtcgccgagctgagctccagctccgcgctcatggagcgcgccatgggcgccgtcgtggagcacgccgaggaggtcgtgttctcggcggaatacgagcggttcgccgcacggaacgcggggctgtgcgtcgagatcacccgcgcgctgctggccaggatgccgacgccggcgaggagtgatggcccgtgcttagagcttggaagcagctagctgatgcatgcagttgtattgtatcagatgatgatggatcggaaagaatactactcttgttccagtttcgagtcacgacaatatgtaattgtaaacgcataagttcttctgaaacacgggcgagcacgatgagctagactgcaagaacaacacaggtcggcgcggccccgcgcgccgcttgtcatcgagggtcgaatagcatggattatctcggtagataggcgactgaacatgcctgagttcatgggacaggcaactctgaatgagttggttggtggtaaaaagaacaagtggtcggagttgcttctccctcgacctcgagtcgagcctgaacgacgacgacttgtggttgtggcttgtacacctgccggctgccgccagccgatctgggcaggatctcggcccacacactgttaggcgactgtttggttcgtggctaattatgtcacactttatctaagataggttaatagttcgaattgaacaactaaccgtaggcagaaaagttagacaaagtgtggtaagttaggtagccgatcgttgatttatgtagctgtccatcgttggcatactattcggtacacaccgaacaatccggtgcaatagcgtccgagagtccctagttgcggggtctctctactcagactgtccggtcccacaccggacagtccggtgcacaatgagcaattactgttgactattcggtgcgtcactagagcgctggctgactgccctcttcttggatgtcttcgctgtttccatgggttttgttcttgagtcttggacttctacgcatcttttaagtcttcttttgaggtgttgcatcatcagtgccttcgtccaatcctctttgcatcctatgaactaaaaacacaaacgctagcaaacacattagtccatatgttatgttgatcatcaaacaccaaa

SEQ ID NO: 371 - DNA, 773 bp, Zea mays
aaacacctgccctactcgcgaaaaccctaccgccgccgctctccaaggtcccaaggctccagatctccctctctcgcagctacctcggtggcctttggagcgcacgagatggcggaagaagccccagcaccagttgttgccccagcagaggcacctaccccggttcttggtgagccaatggacttgatgactgctctacagcttgtcatgaagaagtcaagtgctcatgatggccttgtgaaggggctccgtgaggctgccaagtccattgagaagcatgctgctcagctttgtgtgctggctgaggattgtgaccagcctgattacgtgaagctcgttaaggcactatgcgctgagcacaatgttcacctggttactgtgccaagtgctaaaactcttggagagtgggcagggctttgcaagattgactctgagggcaaggcaaggaaggttgtgggctgctcttgcgttgttgtgaaggactacggtgaagaatccgagggccttaacatcgtgcaggagtacgtcaagtctcactagatgagaatgtttcatgatgcaaacacttgtgttgggcattttggtcctcggtttcatttatactttattctcgggcttcctattgttcgaagtttcaagtgtgagcctagcagatatcgtcaatttggacctctgaacctttgtttatcaggcagctgctgcctttagcgtaaatcatcaagagctgataatatatttctctttgcaatattacgattttgattttttgccct

SEQ ID NO: 372 - DNA, 903 bp, Zea mays
ctggccgggagggacccccgcgcccaacaccctcgaggtggcggcgcgctcctccccttctccctgctactagtccccccccgtctcaattcgccctcgcagcccgcccggccggcgcggaaaccctagcagctcaacaccctcgaggtacctccattcgcagtcggccgtgtcctcggagccgcgggagatggcggatcaggagaccgtagctgtggttgaggcacctaccccggttcttggggaaccgatggacctgatgactgccctgcagctcgtcatgaagaagtcaggtgctcacgatggccttgtgaagggtcttcgtgaggctgccaaagccatcgagaagcatgccgctcagctctgcgtgcttgccgaggactgcgaccagcctgattatgtcaagctggtgaaggctctctgcgctgagcacaatgtccacctggttactgtgcctagcgccaaaactcttggagagtgggctgggctttgcaagatcgactctgagggcaaggcgaggaaggttgtaggctgctcctgtgttgttgtcaaggactacggcgaagaatctgaaggccttaacatagtgcaggagtacgtcaaatcgcactagatacagtctgtcagtatctggaagttgtgttcaacactacattttgcacctgagtttaaatatgtgtttggttcttgggctttgctaggagattagaacagttttcaagtgagcctaggatccatgtgaacgatttgaatatctcgcctcttgcttgcaagtgttctcatctgctgttaatacaaaatcagcaagagctagtattttgttcttcaaaaaaaaaaaaaaaaaaaccaaagcaaaaaaaaggacaaaaaaaaaaaaaaaaaactcgagggggggcccggtac

SEQ ID NO: 373 - DNA, 901 bp, Zea mays
  misc_feature (777)..(777): n is a, c, g, or t
  misc_feature (783)..(783): n is a, c, g, or t
  misc_feature (799)..(799): n is a, c, g, or t
  misc_feature (816)..(816): n is a, c, g, or t
  misc_feature (849)..(849): n is a, c, g, or t
  misc_feature (855)..(855): n is a, c, g, or t
  misc_feature (865)..(865): n is a, c, g, or t
  misc_feature (868)..(868): n is a, c, g, or t
  misc_feature (891)..(891): n is a, c, g, or t
tggctgccgcgcgtcccgcccggccgggccgcggaaaccctagcagctcaacaccctcgaggtacatccattcgcagtcggccgtgtcctcggagccgcgggagatggcggatcaggagaccgtagctgtggttgaggcacctaccccggttcttggggaaccgatggacctgatgactgccctgcagctcgtcatgaagaagtcaggtgctcatgatggccttgtgaagggtcttcgtgaggctgccaaagccatcgagaagcatgccgctcagctctgcgtgcttgccgaggactgcgaccagcctgattatgtcaagctggtgaaggctctctgcgctgagcacaatgtccacctggttactgtgcctagcgccaaaactcttggagagtgggctgggctttgcaagatcgactctgagggcaaggcgaggaaggttgtaggctgctcctgtgttgttgtcaaggactacggcgaagaatctgaaggccttaacatagtgcaggagtacgtcaaatcgcactagatacagtctgtcagtatctggaagttgtgttcaacactacattttgcacctgagtttaaatatgtgtttggttcttgggctttgctaggagattagaacagttttcaagtgagcctaggatccatgtgaacgatttgaatatctcgcctcttgtcttgcaagtgttctcatctgctgttaatacaaaatcagcaagagctagtattttgttcaaaaaaaaaaaaaaaaagggccctaaggccaaaacaangggcgnaaaaaaaaaaaaaacncgagggggggccccggnacccaattccccccataagggaggccggattanaattcncctggcccgncgnttttacaaccgtcgggactgggnaaaaccctgg

SEQ ID NO: 374 - DNA, 816 bp, Zea mays
ccggccggcacgcggtaccccgagcccctcaacaccctcgaggtggcggcgcgctcctccccttctccctgctactagtccccccccgtctcaattcgccactgacgtccatcattccgcttgcttgattgctccaggtacctccattcgcagtcggccgtgtcctcggagccgcgggagatggcggatcaggagacagtagctgtggttgaggcacctaccccggttctaggggaaccgatggacctgatgactgccctgcagctcgtcatgaagaagtcaggtgctcacgatggccttgtgaagggtcttcgtgaggctgccaaagccatcgagaagcatgccgctcagctctgcgtgcttgccgaggactgcgaccagcctgattatgtcaagctggtgaaggctctctgcgctgagcacaatgtccacctggttactgtgcctagcgccaaaactcttggagagtgggctgggctttgcaagatcgactctgagggcaaggcgaggaaggttgtaggctgctcctgtgttgttgtcaaggactacggcgaagaatctgaaggccttaacatagtgcaggagtacgtcaaatcgcactagatacagtctgtcagtatctggaagttgtgttcaacactacattttgcacctgagtttaaatatgtgtttggctcttgggctttgctaggagattagaacagtttttcaggtgagcctaagatccatgtgaacaaattgaataccccgcctcttggcttgcaagtgtctcatctgctgtaaacccaaaccagcagagcttatattttgttcacc

SEQ ID NO: 375 - DNA, 799 bp, Zea mays
cattgggtacctcgctcgcggccggccggggcggaaaccctagcagctcaacaccctcgaggtacctccattcgcagtcggccgtgtcctcggagccgcgggagatggcggatcaggagaccgtagctgtggttgaggcacctaccccggttcttggggaaccgatggacctgatgactgccctgcagctcgtcatgaagaagtcaggtgctcacgatggccttgtgaagggtcttcgtgaggctgccaaagccatcgagaagcatgccgctcagctctgcgtgcttgccgaggactgcgaccagcctgattatgtcaagctggtgaaggctctctgcgctgagcacaatgtccacctggttactgtgcctagcgccaaaactcttggagagtgggctgggctttgcaagatcgactctgagggcaaggcgaggaaggttgtaggctgctcctgtgttgttgtcaaggactacggcgaagaatctgaaggccttaacatagtgcaggagtacgtcaaatcgcactagatacagtgtgtcagtatctggaagttgtgttcaacactacattttgcacctgagtttaaatatgtgcttggttcttgggctttgctaggagattagaacagttttcaagtgagccaaggatccatcccatgtgaacgatttgaatatctcgcctcttgcaagtgttctcatctgctgttaatacaaaatcagcaagagctagtattttgttcttccttgtccctgccagaaaaaaaaaatgacaaccagcagaattctaccaacacccggcc

SEQ ID NO: 376 - DNA, 1073 bp, Zea mays
gggaaaccatgtcaccattcactttgtttaacaacaacacaacaatttaatgatgttcggattgtggattttgtggatgactactactcagtggagaagttcgtgaaggtgtactcaagggtagtagagccaattggtgacaaatctttttggccaagagtgtcatttgcaaaggaggtgggtgcaccaattggaatgtggggcgatggccgcccgagaaaaaacaagattaaagggtgcgtagaaggaggaagtggtaagaaagccaatgaaaatgaaaatgtcacaagtaagaaaatgattcgtgggaggtttaagtgtccaaactgtggtgaatttggccacaggaaagcaagctataaatgtcctttcaatggaacaaagaaaaggaaaaggagaccaaggaaaaatgtgactaaaggttggtttccaaaagatgtcgaagcttcgtcgcagctcgtcctgcaagagaacgaagtgcatccactagctacttaactacctgcaagagaacgaaggcgagggtgagggtggcaagggtgtcaaagagaagcgggaggtagcgtggcgtcgccatggaagcatcggaggcttgggattaggtcggaactcagtagcgaagaggacccataacagatatcctaacaaacccaaacattaatctaacagacttagctctgttgatggcgtcttctctggtagggaatactggtcatagcagttggtcttgaggtacaattgttcaaatgatctattgcaaagttcctgaatctagagtgcaaagcttccaaagatgcgacaaatagaaaagaatgaagggagtacgagctttgaagcttggagtaattttttataaatgtgatggctgataattcttaatttgggagctcaaagttttttcaattacaatgtttccatctagtttcctttttttaaggataaacgtagcactagctgactagctcactttaggggagaaaaaaggaatttgtgtcttctagtaacattttgttgaaatgttgacactttttgcttaattgcattgtttgcttcatctaaaaaaaaaaaaaaaa

SEQ ID NO: 377 - DNA, 3221 bp, Zea mays
  misc_feature (2467)..(2467): n is a, c, g, or t
tgcagaaattgtctttctgactgtgtttaaatttgtgaacaagttgaaaataaaaataaactgtgtcaaacaggacctatatttttagaacttagcttgtgtcatataaatgcaaccaaacaggcccattgtatctcagcccatgagttttttttcatgtcgacccggcccatgattcccgacctggctcgtcgcgcaagttgcttcgcgtgtctcccctccacccctctcctctccttccgcttccgcagtacctcgccgccacggccgacgttgataaagccccaaacggctaaacccacgtctccctcttctgccctccctccctacttcccagccaccccatggctcgcttaacccccacgaagtccaaatcctccaggaagcccaagccctcctcctcctccgccatgggcgccggagcggagccggatgcgatgtccacgcggcggccgaagcgtggcaagtcggtgggcggcgtcagcaagaagtccaagtcgggcgggttcgagtcgatggggctctgcgaggaggtgtaccgcggggtgcgccacaaagggtaccgcgtgcccacgccgatccagcgcaagaccatgccgctcatcctcgcgggcgtcgacgtcgctgccatggcccgcacgggctccgggaagaccgccgcattcctggtgcccatgctgcagcgcctccgccgccgcgacccgagcgccggcgtccgcgcgctcatcctctcacctacccgcgacctcgcgatgcagacgctcaagttctccaaccagctcggcaagttcacagacctaagaaccagcataattgttggtggagatagcatggagagtcagtttgaggacctgtcagagtgtcctgatatcataattgccacgccaggcaggctcatgcaccatttgaatgatgtcaaggacatgactcttcgctcagtggaatatgttgtgtttgatgaagcagattccttgttcagcatggggttcgccaaacatttgcacgatattctgaagaagctaaatgatacacgacaaacattgctctttagtgccactttgcctagtgcccttgcagattttgcaaaagctggtctgcgtgatccgcacattgtgaggctcgacttggacaaaaagatcagtcctgatctcaggatggtgttcttcacactgcgccaagaagagaagcttgctgccttactgtatttggtcagggaacgcatcagctctgaggagcagacaatattttttgtttcaaccaagcatcatgtggagttcttgaatgttttgttcagagaagaaggtttagagccttccctatcctatggtgctatggatcaggaagctcgtatgattcatatttcaaaattcagggcaaggaagaccatgctacttattgtgacagatgttgctgcgaggggcttggatattccgttgctggataatgtagtgaactgggactttcctgcaaagcctaagttatttgttcatagagttggtcgagtggctagacaaggtagaagtggaacagcttatacatttgtcacttcagaggacatgccatatttactggacctacatcttttcctttcaaggcctcttagacctgctccaacagaggaggaactcctaaaagacatggacggtataactatgaaaatcgatgaagctattgcaaatggggaatcagtttatggacgatttcctcaaactgtccttgatcttgcctctgatggactaaaagaagttattactggatgtacggagttgatagcattagaaaagccatgtgctaatgctttccggttgtatctcaagactcgtcctatgccttcaaaagaatctatcaaaagggtaaaagatttgcctcgtgagggtcttaatccaattttcagggatgttctccggtcagatgaactttcagctcttgcattctccgaacgcctgaaatcatttcgaccaaagcagactattttagaggctgaaggtgaagctgctaaagcacgaaattcgaagggttctaatcaatggttagatgtgatgaagaagaaacgagaagttcatgaagggattataaatttagttcaccaaaagagttctgaggatccaaggccagaggttgaagaggttgttgacatttcaaattgggagaaaaaagaagtttgtggcaagaaacggaagttacagagctttagagatgaggactactacataagttcagtacctcaaaaccatcatttggaagctgggctgtcggtgagggacaatgaaggatttgttgaaaataggttggatgctgctgttcttgatttagttgatgatgaagcttctggtatgcaagcgcagaaaactcgatatcactggatgaagaacaaatttgtcaagttgaatgcaggggatcgtgtcactgctacaggaaagattaaaacggaaggtggtgcgaagataaaggcatcggcaacagggantatataagagatggcagcagaagacacattaaatcaatcaacattggtgggaaatctggcaactttgcagacgagggcacatccagttcaggcgggtaccagagaggcaacaagaagcatttcacgggccatggccgcagatctataccaaatgccaacgtgccctctgaaataaggaatcacgagcaaatgcagaagggcaggcagcagaaggcaatggaaatcacgcggttgaagaacaaatctgcgaaggacggcaaattccagaacaagttccagaagagcaggcagcagcctgataggcacggtaaggggaggggtagtgggaaagggaccggaaaagggtttagcaaaggggctggtggaagaggagggaaaggtaagggcaagggcgggaggtgattgatgttttcgaagcagaatgatggtctaagattgatcgagcgttgatgatgttcagcagacaccacctttgcttctcgcagttttgtttatctgttgcagtggagagaccatagcgtctccttcctgtttgcaaccagactggtgtttaattatactcggctggataatctcagagcattaattttgtggaaactggtgttgtgcggggggggggggagggaaaaaaaaaaaaaaaaaaaataatattcacctaatatgcttaaatacaacccctaaaatattgattctgtacaatcaaatgtggggctttttcatacttatgctgcacttcaccttggtgcataaaact

SEQ ID NO: 378 - DNA, 2228 bp, Zea mays
gcacgagaccattacctagaacatcctaatcgaaaaagtgcgaacaggctcgtcagccaacaggaagcaagtgcacactcccacggtcccaccccactcccgcgcgccgcgcccgcgaccggggccggtggtggtggaggcggcggccatggcggagctgcggcactcgatggcggtgcgctcgtccaactcccccgccaagcgcgattccgacacctccgcggcgttgtcccccttcctcctgtccccctccacccgcggcagccgcggcggcggcggcggggacgacgacggcaaggacgctcaccgctcgtcccctctcctctcgcatcaccaccacaagcgtgtccacctgctgacgtccccgttccgctccctcctcgcactcgaggaccccaggtcctccgccgcctcgtcctcctaccggatcctgcttgctctcctcgcgctccttctcgccgctgtgatcttctgcgcgcccttgttctggtcccgcctcaacactccgttcttgtgctacaaggaggggatcacgctccactgccctgagacgaaggaacccccatctctatgggaaaatccacgtgctgccacgatgtcctggaagccctgtgcagagcgatgcagcaatgagccctcagatgtcccatcagtgaatgaaacctctgggtatatttttatccatgccgagggaggactaaaccagcaacgcatagctatatgtaatgctgttgcgattgctaaaataatgagagcaacacttattctacctgttctgaagcaggaccaaatttggaaagaccagtcaaaatttgaagatatctttgatgttgatcattttataaattatttgaaggatgatgtacggattgtccgagatatccctgactggttcacagagaaggatgagctgtttactagtataaagcgtactgtgaagaacatcccaaagtatgcttcagcacagttttatattgataatgtacttccaaggatcaaagagaaaaggataatgtctatcaagccatttgtcgacagattgggttatgataatgtaccaacggagattaaccggctgagatgcagagttaactatcatgcattaaagttcctacctgatattgaggaaatggctgttaagcttgcagcaagaatgaggaacagaactggcagcataaatccatacatggctcttcacctgagatttgaaaaagggatggtggggctttctttctgtgattttgccggcacacgggaggagaaggcgatgatggctgcttataggcagacagaatggccaaggcgcttcaagaatggatcccatctatggccactggcgctgcagaagagaaaagaagggcggtgccctcttgagcccggtgagatcgctgtgatcctgcgggcactggggtacacaagcggcacacagatatacgtcgcgtccgggcaagtgtacggcggcaagaaccggatggctcccctcaggaacatgttccccaacctggtgacgaaggaggagctagcgagcgcggaggagctggcgccgttccggcggcacgtgacgagcctggcggcgctggacttcctggtgtgcctgcggtcggacgcgttcgtgatgacgcacggcggcaacttcgccaaactcatcatcggggcgcgccgctacgcggggcaccgcctcaagtcggtgaagcccgacaagggcctcatgtccaagtccctgggcgaccccgacatgggctgggcctccttcacggaggacgtcgtcgtcagtcgtcacgcaccgcacgaggacgggcctccccgagcccaccttccccggctacgatctctgggagaacccgctgacaccctgcatgtgcagggcatgagacgggccatccctcagatcagagtggccgtctggccgagtcctcgtcttcgctaggctacgactacgagtagtctcgtgctcacttccatcagcgcgcatttcagcgagcatatgcttctactagttaaacacctagatttgtatgtatttggctggcctaatctgtagtttcacatagatcacttcatgctgaaaatgtcttggacaaggcagtgaatgaagataacatcagtaacgacctgcttttccaaaaaaaaaaaaaaaattaccaagctgagccaagaaatggctaacctgagttttgacttgcagccttgcaggcatgacgtgggcgacctgaactcgctagtcgtag

SEQ ID NO: 379 - DNA, 6198 bp, Zea mays
  misc_feature (1931)..(1931): n is a, c, g, or t
  misc_feature (2527)..(2527): n is a, c, g, or t
  misc_feature (5672)..(5672): n is a, c, g, or t
atttaggtgacactatagaagagctatgacgtcgcatgcacgcgtacgtaagctcggaattcggttcgctaaacctcgcgcacagaaacacaagcgagtaccagagcagctaggagtggtcagcaatggcgcagcttaaagcagccgccgacgagcagcaggaggcggcgctgcacggcgtcgcctccggcggcgggaacgagagcaacaagaaggcgcgcgcggggctctgcggcctgctccgcgagcgcaaggtggtggacctggcgcgggccaagcggcggctggtggaggtcccctacaccgcgacgctggcgcacacggccaacgcgctcctggcagcgcgcgtctctgccgtggccgtggctgcgccaccgggccactggatcggcgccggcggctccatgatcctcgagtccgacccggccaccggcgccgtccgcaagcactacatcggcatggtgaacatgctcgacatccttgcccacatcgccgaggccagcgacgacgacgaggcggccgacctcgaccgccggatggccgtgccggtgtcctccgtcatcggacactccctcgagggcctcactctgtggacgctccacccgagcaccaggtacgccggccgatctccagctcacactcgtatttttcttcttcttcctcgcattgtacgcaatctgcgcgtgtgcgacatgttcgttgcgttgcgccagcgtgctggactgcatggagacgttcagcaagggtgtgcaccgcgcgctggtgccgctggagagctcggcggacaacgtggtggcgctggagctggtggagtcggcgccggggtaccggatgctcacccagatggacgtggtgaggttcctcagggcgcacggcgcggagctcaggggcgtgctgttgcgcaccgtgcgcgagctcggcgccgtgaacgacaccgtgttcgccgtctctggcgttaccaaggtgatcgacgtcatcaaggcgatgcgggcggcgtcgctgaccgccgtgcccgtcgtggacgccgtcggtagcggtacagagacccttcaatacgtgagcactgcacgcgcctccgatccgaacacgccatctcctgccggatttcctcctgtctgaaattcctgtcgtgctgctgcaggggagcgggcaaagggcggtcgagacgttctcggcgacggacctgcgggactgcccggtggcgcggctgcagccgtggctggggatcagcgtgacggagttcaagaggaaggtggccgagtaccgcgccagcgccaggcttgtggtccccggcgccgacgccacggacactggcacccctgtcgccgggtacgccgacacccccgcggctgccgccgccactgacgaagagcagagcgagcagcaggagtcggcgctggtgacgtgctcccaggagagcaccctcggcgaggcgatcgaggcggcgacatcgaggcacgtgcaccggctgtgggtggtcgacgaggaagggctcttgcgtggggtcgtgtcgctcaccgacatcctccgggcagtgcgggaggccgcgctcggcgaggacctggagctgcacagcatcgtgccgtgagcccgtgggccgtgagtcgtgacgtccaagaacaagctcgtagctgtttctgcccatagtgtccgtccacctgtcgtgctcctgcagaggagggggaaaagggcgatcgagacgtgttggcgacggccgaccggcgaccgccgccgagctcgttttgccttgttgctttgtttgttatatggccctggctccgatccgggcttcgtatttcgttgacaggccttcatcgtgacgccttattttgcatcgttttattgatcaaccaaaaatacggctcgtttgagttcgagctagagctttaacgagcttgctcgactctgactctcttaagctaaagagttanaaatttagctcgtttacagagttagcttgtctatgagctggctcgctggagcagaaagtaataataattaatttctagttaattttaaattaatttaacaatagaaaataagccggagtagaaaagtaataataattaatttctagttaattttaaattaatttaacaatagaaaatagtaattatactcatagttttactgaccataacatcaaattaacacaacttatcactcattcatttacaattatcactcatctatttacaatttacataaatgttcatccgtataatctagttatatttatatagatcaatttaatatataaatacagtctattagtcattattttaatttataggtcatagatataacatgtaatatcaattgtatagtttcgtttttaatatgatagtagctcgtttatctatgtttattaattgttacgtactatgtttattaatggttacgtaaatgatatatatagttttggatttctgaaatgtgatagtagcttgtttacctcgctcgtttatctcgtgagctgactcattaacgtgagctgactcattaacgaatcaactagcttattgangaaccaagctacgaacggagctaaaatgtaaaatgatttcctgaaatgtgatagttcgtttacctaaaatgtgatagttcatttatgtcgcgagagctagctcgtcaaataatcgagataggagttaagaaccgaactcaaatgttaactcaacttataaaaaaattcaaacaatcccgtctaacccaagccgagctgcccaatcgttcgtccagcgctaggtgcactgccagtgtttccagtgatgcatcggtgtcagtgatgatgagcatgattggttgcagggacgtctcccgccagcatcgtactagcctgggccgctggagacgaggagaagttgcgtgaagttgcgtttccgcgcatgcagactacccactaaaaaaataacaatgttacatgcgtagaagcaggtggtagagatgctatgcatctatccaaacactccctgcctgcagtcaacggatcgccgcgggcctgaacatagccaaccaatcacccgggatgtgcctggaacgcattccacgagccgcggcctcgaaattgaaagatgcaagcgcttactgtaggtgtttgaggggcgtatcgacacacaaaatcgacctaaacacctggttgaaacagaaacaaatcatctattgagaacatgattctctaataggatgttatcttaatcgaacgtgacagatatgtatatgtagaatagaaagcaggctaagctagctcaataatggtggctgagtgattaacgttgcggaaggctttcgactctcttgttttgcttgtggcatggctgatttggaaagacgaataaaagagagaaataggcgggtgttggatccaggacggcgcagcagctgctcgcacaggacaaacattgacatttaattgattcaaaccagccaggcgccaaattaacacgatgcagacgaatccgtgccaaaaataaacctcctagttattctttccgccattgctatctccaacgacctacgctacgctacgcatggccggccatcgtcaagcgtacgtgatgcagaagcagtcgccggggaagccgctgggcagggtgtcgcagcgcccgccggcgtagcctttgctcgtgcaccgctggtagcaggagaaagcgctgctgccgccgtcgctgatggggaagcatgctccgatcttgatctcccggtgacggtgaccttccatttattatatttggggttggggcagcaggccgggtaaacgaatttcagtttagaaaaaaggctaaacaatcgaccaaaagaaacagatactacaatatgcatggccacgcgttcttgttagtacgcaccgccggttggtgccggttcctccctcagggtttcgtagcccttcggcgccggcgcctgctccgccggaacagcgcgctgctgtgacgttgccggctcatcggcgtcggcttgaccacctaaatatatagacatgtgtagcacagttaagcaagtaaaaatgggatcggagcgagatctaattgataacggtggtgtttatcgaacgcatgaatagattcgtatatcagggtagcttaccggtggccaagagtagcacgagtaagagagcgaggagcagagccatggctgcagaccgctcgatcatcatcgtgatgctgatgccccctgaggaagagagctgagtgctgatgtctactactactggagttgttggtcgctcatcagatcactatgcgcgtctgtttatataggcagccaaacagcaggtgcgttattgtttattattggatgattataatggagcattagtatgtgctacgccagggtggcatcatcattggcaggaaaccaattcgtgctatatactaggatctagtctactatgcaattgcaacgttattggcaggaatttatagtgtgtttggtttgagtaattagctagtacatcatcttctcactcctcactatttttgtttggtttgtggaatggaattagttgattcatcaccacatcattccttatagttagttagttagtactaatatgaggaatgaggttatcccaccaaatttgagaaataaaccaatgatgcaccatctcaatttggatgtagtgattccttaaaccaaacatccccttaaactgctactaacactattactctagtacgagaaactttatatggacggttatgaacacatttgcactgtcgattttcagaaccgacggtgctaagaattcatagaaaaaattatttgtacgagcgggtaattgagaaccaccagtaaaaattgatttctacttacggtcgacctaaacctaagtcatcagtaaaaatagatttttcaccgacagtcaatgtgataaaacataaaatgtttttttaaatagcaaaacatttatttttattagagaaggagcctcactaaaaaacgtttgtttttattattggatggttataataaaattattgtgtgctacgccagggccgcatcatcgttggcaggaaaccaattcgtgctatactacgatctagtctactattatgcattgcaacgttattggcacgaatttaaacttactaacactagtaaaaaaagctttatacagacggttatgaatacatttatactggtgttttttagaaccgtcagtactaagagccaatatatagaaaaaaacattatttgtacggacggataactgagaaccgcaagtggaaatcgattttcactgacgaccggcccaagtcgctaataaaatagattttcactaacggtcgatgtaataaaacaccagtgaaaatcttttctataaaacataaaatgtattttaaaaatagcaaaccatttatttttattagggaaggagcctcactaaaaaccgtttgtttttattattggatgactataataaaacattagtgtgtgctactcccgggccgcatcatcgttcgcaggaaaccaattcgtgctatactacgatctagtctactatgcattgcaacgttattggcaggaatttgaacgactactaccattagtacagagaagctctatacatatatagacggttctcaacacatttacattgtgtttttcagaaccaccggtgttagaggcaagtaaaaacaaaaaattatatatacaagcgggtaactganaaccgaatcaatttttactgtcggtcgatgtaaaaaatttatttgtacaggcgggtaactgagaatcgaatcgattttcactggcggtcgatataagccattagtgaaaatcttttccagcaaacataaaatacgtttgaaaaataacaaaacatttatttttattaggggtggggcctcactagggaacatttatttttattagtggaaatcgattttcactagcaagtcatgacaaaattcgtggctacgcgaccagtgggaatcaaacccacaaacttaccctcgcatgaagcctcctttatcactccgtctatgacgtgacttgtgtatatattgtagttttgttgcccacgtattagaataatctgagtctaaattgactattttagactgtaaacgaacttaaacgaaaaagttgtcaactacaaactttcataacttttgaagctctacaacttttgttttgataatttttccatctgaggtcgttagcaaaatttgcattttaaattgacaagagtcg

SEQ ID NO: 380 - DNA, 1030 bp, Zea mays
  misc_feature (928)..(928): n is a, c, g, or t
  misc_feature (966)..(966): n is a, c, g, or t
  misc_feature (973)..(973): n is a, c, g, or t
  misc_feature (975)..(975): n is a, c, g, or t
  misc_feature (983)..(983): n is a, c, g, or t
ctcgaggcccccccgggcccgcccaagcaccccgggatcggccactgccagcggcacagccgacgccttatccagcaaccgtcttcctcatccatggcataagccgcgcccgcctccgcacgccccgctccgatggcagccacggctgtgaccctgccctcctcgggcacgcccttcgccgtcgccacaaccgcctcttcctcatccgcccgccgctgcctgctcctgccctccgcggctccccgccgagctctccgcgtcgtggcctccgccgctaccgaggcgccgcccaagcccacgcagccgccgacctcgccctccggcatcgtgctcgtcgacccatccgaagcccagagggtgcaccggctcaaggccgtctacgaccagaaggtcgtcccgctcatcaccgaggagttcggctacaccaatgtccaccaggttcccaagctcgagaagattgtggtgaactgcggtctgggcgcggaggcagggaactccaaggggctggatgccgccatgaaggacctggccatgatcaccgggcagtggcccgtcaagaccaaggccaggaagtccgtggccagcttcaagatccgtgagggaaacaccatcggtatcgcagtcaccctccgcggcaggataatgtacaacttcctggataggctcatcaaccttgggctccctaggaccatggaccttcctgggtgtcaaccccaacagcttcgacgggcacggcaactacagccttggcctccgtgaccagggcgtggttcccggagatcccgtacgaggtgggcgggaagaagaacggcatggacgtgtccatcgtcaccagcgccaagacggacaacgaggcgttcaggttgctggtcctcctcggcatgccgttctcggagaacatcaagaccgacgtggtgatccggaaganaagggtgagcgccaccacttcctgagcaaggggcaggngaaaggnangacgacgntgagggagaggaccagccagccagcccatggttgcacacgctctgct

SEQ ID NO: 381 - DNA, 1184 bp, Zea mays
ccggccgggagaaccactggattggccactgccagcggcacagccgacgccttctccattgggtacctcgaggccggccgggataagccgcgcccgcctccgcacgccccgctccgatggcagccacggctgtgaccctgccctcctcgggcacgcccttcgccgtcgccacaaccgcctcttcctcatccgcccgccgctgcctgctcctgccctccgcggctccccgccgagctctccgcgtcgtggcctccgccgctaccgaggcgccgcccaagcccacgcagccgccgacctcgccctccggcatcgtgctcgtcgacccatccgaagcccagaaggtgcaccggctcaaggccgtctacgaccagaaggtcgtcccgctcatcaccgaggagttcggctacaccaatgtccaccaggttcccaagctcgagaagattgtggtgaactgcggtctgggcgcggaggcagggaactccaaggggctggatgccgccatgaaggacctggccatgatcaccgggcagtggcccgtcaagaccaaggccaggaagtccgtggccagcttcaagatccgtgagggaaacaccatcggtatcgcagtcaccctccgcggcaggataatgtacaacttcctggataggctcatcaaccttgggctccctaggaccatggacttcctgggtgtcaaccccaacagcttcgacgggcacggcaactacagccttggcctccgtgaccagggcgtgttcccggagatcccgtacgaggtgggcgggaagaagaacggcatggacgtgtccatcgtcaccagcgccaagacggacaacgaggcgttcaggctgctggtcctcctcggcatgccattctcggagaacatcaagaccgacgtggtgatccggaagaagaggttgaagcgccaccacttcctgagcaagggcaaggggaagggaggacgacggtgaggagaggaaccagccagccagccagcccatggttgcacacgctctgttcagcttgttttaattccgatctttttgcagaatttggcttacaaattcgatgctgttgttgtctgtcaattatgtaacttgtgcacctatgaaaaaggtttgcaatgatcatgtccgttttgctgatttcttcttggagcataatttgtagtcacaaggtataccact

SEQ ID NO: 382 - DNA, 2091 bp, Zea mays
gggtacctcgaggccggcccggacctcacccaggacgaggcccagggaggatcctcccgactccgacgctgcgtaggactccccgactccgacggcgtccgcccgcgtcgcgtgccacgcccacgccacgccggccgccgcgaggaaagaacaccgggtacttccccttcccttacgctccagtttcacaagtcgcgagccgtgcgtcgcgtcgacgcgagttccgcgtgagggagcaggcagttgcagttggaggcggtgacgaaaccctaggacttgagctccagcgcacggctcgggtcctcctcaccgttcccggcgatggaccggcggcaggagctctgcaggaacttccagcgcggcagctgcaagtacggatcgcactgcaggtttgtgcacgcctcctctcagcagcagcagcaggcgaagcccaacccgtttgggttcggcttagggagtaggcagcagcaacagcagcagtcttcgtttcgtgcgcagttccagcagcagcagcagcagaagcccaacccgtttggatttggagtgcaaggcagtgcggctgcacagtccagaaacgctcctggccaggcaaagccatttcaaaataaatgggtaagggacccctcagccccaacgaagcaacaggaagcggcacagccaccagcagcagcccacacctcctgtacagatcctgagtcctgcaggcaacagattgccgaggattttaagaatgaaactccactctggaagcttacgtgttatgctcacctcaggagcggtacttgtgacatcacgggagatattagctttgaagagctgagagctaacgcgtatgagcaaggcaggcaagggcatcctctgcagtcaatagtagagggtgaaaaaaatttgaaaaatgcaaagctgacggactttaataatttcctgaacatgccacgtctatcggtatcacaaactccaagctttccaactgtggcttccttccctgaagtgaaaaataactcagcatttggggtttctcaaaataatggaccaccagtgtttagtagtttcagtcaaattggagtaacaactaatatgggacctgggtccagaactacaccaggagtcccaaccaatactctttttggtcaatctacccaaccaagccatccaacatttcctgcacctacttttggtcgttctgatatgaaatttggagtttcaggtccatttggaagccagatatcacaacaatcatctgggacttttcaaggctcaaacatgtccagttttggcaatttctcaaagcctcatgccagctaccagcagtccccttcctcctctagccatcacagagacattgataggcagtcacaagatttacttagtggaattgtggttcctacaagtgccacaaacgaagctcctgttgaggacaataaaaatgaaaatcaggatgatagtatctggttgaaggaaaaatggtcaattggagagattccgctgggtgaaccgccacagaggcacgttagtcatgtgttttagcaacattcttgtatttctgtgtcgtggaaccactgtcaagtcagcttcactgtctccttccatattgtcgggacaccatcttacaatttctcctccaggttcataaccataacacgtcaaattgggggcataaaatgcacctgaaatgctgattgggcagcgtagaaacttcttgtatcctgcatcacatactctgtctctattgttttcttgttagctccatgtacttcgtcacattcagggctcgtaatatcccgatttcttgttttagggtttgttgagtttagctgtgggttttaaaaagccgttgcagctgtttttttttttgcggaaattgtaccatacatggaagcagtagtttttgaagaagcggaatttggttctaaaaaaaaaaaaaaagtgtgtttttttttgcggccggggaggggggcttggcgatttgtttgtttctcttttttgtagaagagacggtttctaaaagttaaactgtacgtccactaggtcaatcttgcagggtttgtgattctagggtcctttgcgcatgcaagacgattttgtttctag

SEQ ID NO: 383 - DNA, 1129 bp, Zea mays
caagatgcatggcaatgtcggagcatgaagggaggttttgctcctaaatgttcaagacaacagagagggtcttattttgcttatggatgccattgagaaggcaggctacactggaaaagtgtgatatcatctaactagtttcattggccacttgtttgattgctctcttgttttttactttaaatgttaaacacaaatcctaatgcagatcaaaattggtatggatgttgcggcatctgagttccttacaaagggtgggaactatgatctaaactttaagaatcagcctaatgatggagcccatattctctcagcccagcatctgggtgatctgtacagagattttgtcaaggatttccctattgtatcaattgaggacccttttgatcaggatgactggagttcatgggcatcattgcagtcctcagttgatatccaaattgtgggtgatgatttactcgtcacaaacccaaaacgtatagcagatgctattgacaagaaggcttgcaatgctctgttgctaaaggtcaaccagattggtactgtcactgaatcaattcaagctgctctcgattcaaaagctgctggttggggtgtgatggtcagccacagaagtggtgaaaccgaagacaacttcatcgcagatttggctgttggcttagcaagtgggcagattaaaaccggggctccatgccgcagcgagaggctggccaaatacaatcagcttctgcggattgaagaggagcttggcaacgtgcgctatgcaggggaggcattcaggtctccatgagaaatacagacttcagagtctcagtaaagcctaaagtatgtgtactgcccagtagaagaaataaaagaactagatcatgaccagtcatgctttcatccttgttaccacgagttatcccaattttttgcggattttttttcttgatacatcttattatctgcgagcaattgaagacagtcatcatccggaaagatgcttcctgtgcacccgcgcgagtctgagaaagtgacagctttatatggacatgaccattaacatttaacaatcatgcttgtaatggtgcgttatggtcatacaataaattaagggacatttacattcaaaaaaaaaaaaaaaaaa

SEQ ID NO: 384 - DNA, 876 bp, Zea mays
cattgggtccctcggggcctggcgccgaaaccccttgccaatgccacctcgccgcctccgcccgacccaacaaaaaggcacgacgacctctacctctacctcgccgccaccgtcaccgtggcccgccgccatataagtaaaccctcgcctcgtcctcctcccaggctcgccaccctccgcctccgacacatggcccacccgcacctcgtgctcccctccccgaagtccctcctccccgccgccgcaactccatcgcgccgcgccgtcgccatccgcgcggcgctctccaccgctttgtctccggccaaggcggcagctggagcagaggcggtgcgatcgatccgcgcgcggcagatcgtggacagccgcgggaaccccaccgtcgaggtcgacctcgtcgccggggacggacgcctccaccgctccgcggtgcccagcggggcgtccacggggatctacgaggcgctggagctccgcgacggtgacaaggccgtatacggcgggaagggcgtactccaagctgtgcgcaacatcaacgaggttatcgcgcctaagctcataggcgtcgatgtgaggaaccaaagcgatgttgatgcagtcatgctagacattgatggaactcagaataaatcgaagttgggtgccaatgctattctcggagtctccttgagtgtatgtagggcaggcgctggtgcaaagggagttcctctgtataaacatattcaggagctagcaggaattaaggagcttgtcatgcctgttcctgcttttaatgtaataaatggaggtagccatgctggcaacaatctggccatgcaggagttcatgattttacctgttggagcactacatttgctgaagctcttcgtatgggca

SEQ ID NO: 385 - DNA, 1928 bp, Zea mays
cattgggtacctcgaggccggccggggcgacgacctctacctctacctcgccgccaccgtcaccgtggcccgccgccatataagtaaaccctcgcctcgtcctcctcccaggctcgccaccctccgcctccgacacatggcccacccgcacctcgtgctcccctccccgaagtccctcctccccgccgccgcaactccatcgcgccgcgccgtcgccatccgcgcggcgctctccaccgctttgtctccggccaaggcggcagctggagcagaggcggtgcgatcgatccgcgcgcggcagatcgtggacagccgcgggaaccccaccgtcgaggtcgacctcgtcgccggggacggacgcctccaccgctccgcggtgcccagcggggcgtccacggggatctacgaggcgctggagctccgcgacggtgacaaggccgtatacggcgggaagggcgtactccaagctgtgcgcaacatcaacgaggttatcgcgcctaagctcataggcgtcgatgtgaggaaccaaagcgatgttgatgcagtcatgctagacattgatggaactcagaataaatcgaagttgggtgccaatgctattctcggagtctccttgagtgtatgtagggcaggcgctggtgcaaagggagttcctctgtataaacatattcaggagctagcaggaattaaggagcttgtcatgcctgttcctgcttttaatgtaataaatggaggtagccatgctggcaacaatctggccatgcaggagttcatgattttacctgttggagcaactacatttgctgaagctcttcgtatgggcagcgaagtttaccatgtcctgaagagcatcattaagtcaaaatatggtcaagatgcatgcaatgtcggagatgaaggaggttttgctcctaatgttcaagacaacagagagggtcttattttgcttatggatgccattgagaaggcaggctacactggaaaaatcaaaattggtatggatgttgcggcatctgagttccttacaaaggatgggaactatgatctaaactttaagaatcagcctaatgatggagcccatattctctcagcccagcatctgggtgatctgtacagagattttgtcaaggatttccctattgtatcaattgaggacccttttgatcaggatgactggagttcatgggcatcattgcagtcctcagttgatatccaaattgtgggtgatgatttactcgtcacaaacccaaaacgtatagcagatgctattgacaagaaggcttgcaatgctctgttgctaaaggtcaaccagattggtactgtcactgaatcaattgaagctgctctcgattcaaaagctgctggttggggtgtgatggtcagccacagaagtggtgaaaccgaagacaacttcatcgcagatttggctattggcttagcaagtgggcagattaaaaccggggctccatgccgcagcgagaggctggccaaatacaatcagcttctgcggattgaagaggagcttggtaacgtgcgctatgcaggggaggcattcaggtctccatgagaaatacagacttcagagtctcagtaaagcctaaagtatgtgtactgcccagtagaagaaataaaagaactagatcatgaccagtcatgctttcatccttgttaccacgagttatcccaattttttgcggtttttttttcttgatacatcttattatctgcgagcatttgacgacatagtcatcatccggaaagatgcttcctgtgcacccgcgcgagtctgagaaagtgacagctttatatggacatgaccattaacatttaacaatcatgcttgtaatggtgcgttatggtcatacaataaattaagggacatttacattccaaaaaaaaaaaaaaaaaatgcgtgcgcccaacacaat

SEQ ID NO: 386 - DNA, 1879 bp, Zea mays
gcacgagaccattacctagaacatcctaatcgaaaaaatgacacgcgggcaccatatgccacctgccgtccctcgcccccaccggcaccgacccccgccttcttcaaaaactttattcgccgaaaccccttgccacctcgccgccaccgcccaacaaacaggcgcgacgacctctactctacctcgtcgccaccgccgtcaccggtcaccgccgccatataagtaaacgctcgcctcgtcctcctcccagactcgccaccctccgcctccgacacatggcccagccgcacctcgtgctcccctcgccgaggcccctcctccccgccgccgccactccatcgcgccgcgccgtcgccgtccgcgcggcgctctccaccgcttcgccgcccgccaaggccgcggcgggagcggaggcggtgcggtcgatccgcgcgcgccagatcgtggacagccgcgggaaccccaccgtcgaggtcgacctcgtcgccggggacggacgcctccaccgctccgcggtgcccagcggggcgtccacggggatctacgaggcgctcgagctccgcgatggtgacaaggccgtgtacggcggcaagggcgttctccaagctgtgcgcaacatcaacgaggttatcgcgcctaagctcgtgggcgtcgatgtgaggaaccaaagtgatgttgatgcaatcatgctagacattgatggaactcagaacaaatccaagttgggtgccaatgctattctcggagtctccttgagtgtgtgtagggcaggcgctggcgcaaagggggttcctctgtataaacatattcaggagcttgcaggaattaaggagcctgtcatgcctgttcctgctttcaatgtaataaatggaggtagccatgctggcaacaatttggccatgcaggagttcatgcttttacctgttggagcagctacatttgctgaagctcttcgtatgggcagcgaagtttaccatgtcctgaagggcatcattaaggcaaaatatggtcaagatgcatgcaatgtcggagatgaaggaggttttgctcctaatgttcaagacaacagagagggtcttgtcttgcttatggatgccattgagaaggcaggctacactggaatgatcaaaattggaatggatgttgcggcatcagagttccttacaaaggatgggaactatgatctaaactttaagaatcagcctaatgatggagtccatgttctttcagcccagcatctgggtgatctgtacagagattttgtcaaggatttccctattgtatcaattgaggacccttttgatcaggatgactggagttcatgggcatcattgcagtcctcagttggtatccaaattgtgggtgatgatttacttgtcacaaacccaaaacgaattgcagacgctattgacaggaaggcttgcaatgctcttttactaaaggtcaaccagattggtactgtcactgaatcaattcaagctgccctggattcaaaagctgctggttggggtgtgatggtcagccacagaagtggtgaaaccgaagacaacttcatcgcagatttggctgttggcttagcaagtgggcagattaaaactggggctccatgccgcagcgagaggctggccaaatacaatcagcttctgcggattgaagaggggcttggcaacgtgcgctatgcaggggaggcattcaggtctccataagaaatagactttaaatcaccgcgcgtgtgtgagaaagtgccagctttatatggacaagactattcagagaggataatgaatgagagctaataatttttttacacaaaaccaaaaaaaaaaaaaaaactaaattctctctcaattcttcaaaacaccagaactctttcaaatcc

SEQ ID NO: 387 - DNA, 790 bp, Zea mays
gcacgagaccattacctagaacatcctaatcgaaaaaaaccgacccatcatatcatcacctgagagatccgtcccaacaatacggaccaagcccaataaaccagggtttttgtaaggaaaatccccgtcgttctcgcgtctggagctcggcggcggagcagggcggcagggggagggcgatggaattctgcccggtgtgtgggattctgctgcagatcgatccgggcaccggaagccaccgcctgcgcctcttctgccccgtctgcccctacgtctgccccatcctgaacaagatcgtgaagaaggcgaggttggtcaaaaaggaggtggagcccatctccagcacggcggatgagatgaaatcggcccctaagaccgcagttacatgccaaagatgcaaccatggagaagcatacttcaagcagatgcagattcgatcagctgatgaaccgatgacaacaatatacaggtgttgcaaagaagaatgccagcatgaatggagagaggactgaccatagcattcgcactttgcttacacttcgctccctgtgcttcttcagttttgagtgttgggatgtcctgttgcacatgtaatgcttctaatcagcgtatacttaagtacaaatttttggaaatgtatgttctatactatggcatcgctttttggctgcaaaagacattgcatgacacatcatctagagttatttgtgatgatgatctcaatcatcagtgagagctcacttaaaaaaattcattgagttacaaaaacaaaaataaacaacctgcggtc

SEQ ID NO: 388 - DNA, 2375 bp, Zea mays
atcatgttatgagtatgatctagaactcccagttgtgtgggcaggctgtgatttcttatttacaacagaaaggttttccagaagttgctcttcactttgtgaaggatgagaagaccagatttaacttggcccttgagagtggtaacattcaaattgcagttgcttctgcaaaggagattgatgacaaggatcactggtacaggttgggaattgaggccctgaggcaaggaaatgttggtatcgtggaatatgcataccaacgaacaaaaagttttgagaggcttgcttttctgtatctcattactggttacttggacaaggtgggcttcatgtacaaaattgctggacagaataataatttgatgggccaatttcacaatgcattgtatcttgggcatgttaataagagagttgagatcttggaaaatgctgggcagctgcctcttgcttatgttcttgctgtcacacatgggctcactgaaattgctgagaggattgctgctgaattaggcgagcatgttcctttgctgcctgaaggaaaatacactcgttactgatcccccctgcacctctcacagcctgtggtgattggccattgctgtgccctcggcctcgccgggttgaaggtggactggattctactggaagggcagagcttgaggaagatgatgaagcttctggtgctgactggggtgatgaggacttggatattgttgatgcaagtgaggtggtggcaaatggtggcgattattttgatgcagagggtgaaccaaacgaggaggagggtgaggaaggtggctgggacctggaagatctggaacttccacctgatacagagactccaaaatctgctggcaatgctcgctctcctgtatttgtcactccaacagcaggcatccctgtcagccaaatttggactcaaaaatcttctctggctggggagcatgcggctgcagggaactttgatacagcaatgaggttgcttagccggcagttgggcatcaagaactttgctccgctgaagcccttgtttcttgatctgcatatgggcagtcattcatatctgcgtgcccttgctgctgctccagttatatcagttgctgtagagaaaggttggaatgagtccgcaagtcctaatgtaagaggccctcctgcacttattttcagcttctcacaaatggaagacagactcaaggctgcctacaaagccacaactgagggcaggttcccagaagcactgaggcagttccttagcatcttacatacgattcctgtaatcgttgtagactcacggagagaagttgatgaagtgaaggaattaattgagatagtgagggagtatattcttggtctgaagatggaactcaagagaaaggaattgagggatgatgtgacccgccaacaggagttggctgcttacttcacaaattgcaagcttcagagaattcatatgaggcttgtgctttctagcgccatggctctttgcttcaagcagaaaaactatgctactgcagcacactttgcaaggatgcttcttgagaatagccctcaagaggctcaagcaaggaaggctcgacaggtgctgcaagcttgtcaggataaggatgattctcaccaactgaactatgactttagaaatccatttattgtttgcggtgctacatatgttccaatctaccgtggccaaaaggatatttcttgcccatactgtggatcccggtttgctccttccatcgaagggcagctttgtaccatatgtgagcttgccatagttggggcagacgcctcaggcctggtctgctcccctacgcagatgaagtagacggtaggtctcctatattctttctactgtcttaaaggtctaagactatcatatattttacatggaagttcagtgattataaggaataagtatataaatggttttaccaaattgttcttttttcgtttttggttgcctagtctgctgttatcacttgccatatgctccaggagtcaggactgttgagtgacccatggaagctatgcggcggagatgtttctttcacacttcacaattctttttggctatcttggggcaatctatattccggttctaatctttgcttgatagtagcttctatgtgatactatattaaactttatggtaattgcatggttgcaaatgtaacagaagtcatgtatgtctgatgaaccattgcactgttttgttggggctgaaagaatttgttgatgaacatcaggtgacaagcagtagatcgcttcaatgttcttttactaccttgaattatgaatgcgaagtttcttatgtatgtctgatgaaccattgcactgttttgttggggctgaaagaatttgttgatgaacatcagggg

SEQ ID NO: 389 - DNA, 2545 bp, Zea mays
  misc_feature (846)..(846): n is a, c, g, or t
  misc_feature (1811)..(1811): n is a, c, g, or t
agtggcatgagtaatagatgaggattgtttgtatcttaaaaactcggccggtaggggaaagaccgtccccacggtatttatattaagaagaagctcaatcggaaccccgaccgaaaaaggtcacgaaagctgccccctcgtgcaacaagagggtccaccccctataggtcagatctttactcgtgttttgagccctcccagcccctacacgaggatctgtccccataggtcagtccatctcatgtgcacagaactagaagaaccagcaagtgtgagcttttttaaccttagcctgaaattcgctcacactggaattcgaactcatgacctaaggactgctactcataccgcctaaccaactcggctagaggcccttgcgtaaggattgtttgtatcttataatgctaattaccttcaaattttatctggtttactcagtttgcatatccaattaatctctttagattgttgtacttgctgatattagcattctgccctcatagctatttgatgtgacacttacaatttaattttatattcttagtttttatgaaagtaagcgtctattttgtactgtcttgactcttgcacttttttatcctagtttagaatactagaattatatgtcgtagctatcatgcagtttgcatctccatttctaaaatttgtttaggatgtaattagaaactctaaagtgcatctcgtgtattgttctgcaaagctgatcatggttttagctgattgctttatcctaatcctagaatttactagtaattccttgtctagagtacattctacgtttaggataaaatttatagaatgtactctaattccttatcgtacaangaaaaaaatgtcatagttatcttgcagtttgttggatttgtgactattgttgaattgtgttgtattactgtttgctaacttcatttactagcctgtacagattgatgtgagattattagcacaagtagctctttttttttccaagtatgaaatgttgatctctttatgttacgaccaatattggatatgacactgtactggattggaagaatgcttcgtagtgttgatatacgtgcatgcctgcttatctgtttgtttatgtttggccagtaatccctttcctcttcagccaagtgtctaacattaacttttacagtttgaatttgcaatcaatcgccattaggtgacggaatgcggttgatgattttttttatgctgattgcagatgttatcttacctcctgctgtccgcatcttcagcagcaccatctcgcaatgatgtctggatgtctcgatctggaggggatgaaacaattcactgaacaccaaacttatcaacgccctccatggcattccaaattttcgtctggaggggattcatcttggtcttgtctcaattatcgcagctgcgttttcagctctgttttgtaaacatattgatgtacgaaagctgatgtgagtgctggttcactgaaaccgattttctgttatggcatgccattttaatctctacagtttcagtatattgcacagtagattgtaaacacttaaaatttgattgtaccgaggattgagaccagtgttttaacactggaaaattatgattgatacacaaccttttgtcactgaattgatgggtagtaattgcaatatcaatatattttttgtccactttatatgatggccaagtcattcgtgggtgtgcttcattttgcagtgccactgctgagctgtcagcggcatttcatttagttgctttaattgatggacgttgagtatgcgataccaatttgaccatttctttgncatagatgaattagcaactgcaatgatattctaatgcttgtggcttttctggtttcgtgccaatgaaacgtgtctatttcaaagccaagtctaccggtatgcgtgtattgtcagctcatggagaaggctatacctagcaatacgtctttcgaatatcctgtcagtacatgtacatagaggtggtaatgaatcgtgatccaaatgcttcttcacaaaatggtagagctctaaataaattttagtttaaaaatgaataaaaatagagcttaatcctaatccaatttgatccttagattttatagtgtaaaattaagagcctattgtcacctctatatgtacattgctagcgtctaaagaagattagatttctgatactagcaatacgcctttcaaagatctaagtcgtggcaatgtctttcgaagatcttgtcagcagaacaaaactcaaagtgggcttggttgatactagccaggtacccccatgatctgcgcctagaagattatgccttgcttcggcggagtccagaaccctatagattaaagtagctcttttggctcccgaggctctcccaacctctggcgctctccaggtcaagtaaccaaatcctgaaaccctcgtagcccatagggctccctagatcgaggaccaaaccctcagtttggcccagattagagatggcaatgggtacccgcgatcagatacccgatgggtatttactcgacggtatcgatag

SEQ ID NO: 390 - DNA, 2313 bp, Zea mays
ttatgagtatgattaagaactcccagctgtgtgggcaggctgtgatttcttatttacaacagaaaggtttcccagaagttgctctacactttgtgaaggatgagaagaccagatttaacctagctctcgagagtggtaacattcaaattgcagttgcttctgcaaaggagattgatgacaaggatcactggtacaagttgggaattgaagccctgaggcagggaaatgttggtatagtggaatatgcttaccaacgaacaaagaattttgagaggcttgcttttctgtatcttattactggttacttggacaaggtgggcttcatgtgcaaaattgctggacagaataacaatttgatgggacagttccacaatgcattgtatcttggggatgccaagaagcgggttgagatcctggagaatgctggacagctacctcttgcttatgttactgctgtcactcatgggctcacagaaattgctgagaggattgcttctgaattaggcgagaatgttccttctctgcctgaaggaaaatcccactcactactgatcccccctgcacctctcacagcgtgtggtgattggccattgcttagggtagtgcgcggtatttttgaaggtggactggatgctactggaagggcagatcttgaggaagacgatgaagctgctggtgctgattggggtgatgaagacttggatattgttgatgtaagtgaggtggtggcaaatggtggtgatggtgttgatgtagaagagggtgagccaaatgaggaggatggtgaggagggtggctgggacctggaagatctggaacttccgcctgaaactgagactccaaaagctgttggcaatgctcgatctgctttattcgttgctcctacaccaggtattcctgtcagccaaatttggacccagagatcttctctggctggggagcaagcggcagcagggaacttcgacacagcaatgaggttgcttagccgccagttgggtatcaagaactttgttccactgaagcccttgtttattgatctgcacatgggcagtcatacatatatgtgtgcgtttgccgctgcgcctgttatatcagttgcagtagagaaaggttggaatgagtctgcaagtcctaatgtgaggggccctcctgcacttgttttcagcttctcacaaatggaagatagactcaaggctgcctacaaagccacaactgagggcaagttccccgaagcactgagacagttccttagcatcttgcataccattccagttattgtggtggattcgcggagagaagttgatgaggtgaaggaattaatcgagatagtgagggagtatgttcttggtctgaggatggaactcaagagaaaggaattgagggatgatgtgacccgtcagcaggagttggctgcttacttcacgaactgcaagcttcagagagttcatatgaggcttgtgctcgcaagcgctatggctctttgcttcaagcagaaaaactatgcaactgcagcacactttgcaaggatgcttcttgagaatagccctcaggaggcccaagcaaagaaggctcgacaggtgctgcaagcctgccaggacaaggacgattctcaccaactgaactatgacttcagaaatccattcgttgtttgtggtgctacatatgttcctatctatcgtggccaaaaggacgtttcctgcccatactgtggatcccgatttgttccttccatcgaagggcagctttgtaccatatgtgagcttggtgcggttggggcagatgcttcaggtctcctctgctctcctacacaatcgagataagccatggtagttagagcccccctatattctttctagtgtcttaagttccaagacttaatcatatattttaccagggagtttagtgattgtaaggaataagtattatacatgtttttatcaagttttttttttcttttttcgtgttctgttaccataatttttgtttgcctagagggtgctgtcatcacctgccgtatggtttagacttctgatcaactttggaagctatgctggaaattgatgtatgagatgtctctttcactctttaaaattctttttttggcaaaaaaaaaaaaaaatttttagtttatagtctggaggtattctttgctcggtacgcgggctaatgtgctttatgtcaaaatacattaagcatggaagagtttacctgctagggtgccaatcccatctaaagagcagtgtcttcagaaaaacttgatattatatgaactgtggaaaatcttctctgtgatatgtggtgtaataaagtcaa

SEQ ID NO: 391 - DNA, 1360 bp, Zea mays
gtctggctggggagcatgcggctgcagggaactttgatacagcaatgaggttgcttagccgacaattgggcatcaagaactttgctccgctgaagcccttgtttcttgatctgcatatgggcagtcattcatatctgcgtgcccttgctgctgctccagttatatcagttgctgtagagaaaggttggaatgagtccgcaagtcctaatgtaagaggccctcctgcacttattttcagcttctcacaaatggaagacagactcaaggctgcctacaaagccacaactgagggcaggttcccagaagcactgaggcagttccttagcatcttacatacgattcctgtaatcgttgtagactcacggagaggagttgatgaagtgaaggaattaattgagatagtgagggagtatattcttggtctgaagatggaactcaagagaaaggaattgagggatgatgtgacccgccaacaggagttggccgcttacttcacaaattgcaagcttcagagaattcatatgaggcttgtgctttctagcgccatggctctttgcttcaagcagaaaaactatgctactgcagcacactttgcaaggatgcttcttgagaatagccctcaagaggctcaagcaaggaaggctcgacaggtgctgcaagcttgtcaggataaggatgattctcaccaactgaactatgactttagaaatccatttattgtttgcggtgctacatatgttccaatctaccgtggccaaaaggatatttcttgcccatactgtggatcccggtttgctccttccatcgaagggcagctttgtaccatatgtgagcttgccatagttggggcagacgcctcaggcctggtctgctcccctacgcagatgaagtagacgatgttatcttacctcctgctgtccgcatcttcagcagcaccatctcgcaatgatgtctggatgtctcgatctggaggggatgaaacaattcaccgaacaccaaacttatcaacgccctccatggcattccaaattttcgtctggaggggattcatcttggtcttgtctcaattatcgcagctgcgttttcagctctattttgtaaacatattgatgtacgaaagctgatgtgagtgctggttcactgaaaccgattttctgttatggcatgccattttaatctctacagtttcagtatattgcacagtagattgtactcaaacatttaaaatttgattgtaccaaggattgagaccagtgttttaacactgaaaaattatgattgatacacaaccttttgtcactgaattgatgggtagtaattgcaatatcaatatattttttgtccaaaaaaaaaaaaaaaa

SEQ ID NO: 392 - DNA, 1197 bp, Zea mays
  misc_feature (64)..(64): n is a, c, g, or t
  misc_feature (73)..(73): n is a, c, g, or t
atatggcctgcctgcagagaccatcctagagccaagggtctgtatggtggtcccgtttgtatantttcgatancatttgatgcaatatatggcaaggacagctctgctggggaagggttggaagggtctgaagctgcaattgctaacatggagaatgaaaatataaatgaagttggagatgacgaagtggaagaggacaggatgtccacaggaatatctggtcgctccccggccgcaacgttaagctctaagagtcagaagaaagacaattatgacgggaaaacgaataggaccgaatcaaattgcccatctctggacaagttcaaggatgtaaatgttcagtttcagaatgccattcagcatgccagcacaatggctgctgcaatggagctgttcaaggacgtacgtgatcgcttccaaaatgtcgtccagcatgctagcgagatggcagcagcagtggagctgttcaatgatgcacacagtcgttttcagagcctcttcagaatgtcaacacctcagcagtaattgaacagttcaaggatgctcttgatcattttcaaagtattacgcataatggcaagatggtagcggctgtggagtacggtactgaaatgcaagagaagtcaatgtgtgaagagcctcagaggaaggccaaagtaatagcaattgctgaagtactgaagcttgggtttagtggaattgaagtggtaaccaccgcaagcattttcgctaaggaaccaaaccaaatggacatgtttctagcactgccagaaatctataagaaggattacatacttcagatgctcagtggtggacaatgtatccaatattcagccggttagtttgtattcagcatgatagtagtcggctagatatttgtaaacagttagtagtgtaatgtgttacgattattttcacttccttcgatgtggtcctttccaagtgtaatgtgttttcgattttagattagatgtggtatatatatccgcatgtgcattgttagaaaccagcatgtatatttattttgggaatattatacaatgtagatgctaagttgttttgaagactttattctattctaattatgttcaaaggtcattaaaattgaaataaattttagttgctcccttaaaaaaaaaaaaaaaaaaaaaaaaaaaaaaaaaaaaaaaaaagaaaaaaaaaaaaaaaaaagcggcc

SEQ ID NO: 393 - DNA, 765 bp, Zea mays
attgcaccatcccatggaatcccatggcgcatcaggctttaagcacggaagcacggaaggggggcaaggggggaacaaaaaaaaagtaaaagaggatagttcattaacttagccttctaaagcatgtctcgatgtagctacagcagctagctcagcacaccgtaacatgtaacacagagaaaattctccatagagtcaactcctttgatctgcaaggtgcaagctttagcgttcatgttatgtatgcccacggcctccacatttggagcacatgatgttcccagttccaccgcaacctaggcatctgactttcacgatgattccctggctctctagtatcgagtcgacgtacaagcctgaaccagcgcacgttgcacacagcaaggcacctttagcttcacagcttgagcagggaggcttgtccccgacattcttcttttccagatttagaccagatggttctccaatgtcctgctcggggacagatttgtcgtagcagaataatgattcgagattacttctgtttctttggaggccgttaattgcagctgctctgatcttaaccgcgcgggacacggaccgcacagaatgggaagccgccgcgcgcggcggcaccgacgcggaccgacagccaaggagcgacgctgccgcagcgacgggcggcagccggagcccagcggacacctccatgcgctcgtagaggaaaaaatttcttgggctcgcagtcgcagcagcggaggcgcgcgcaagtcgggggccgccccg

SEQ ID NO: 394 - DNA, 1087 bp, Zea mays
tttttttttttttttccttttttttttttttttttttttttttttttttttttgaatctaatctctcccataaacgaagtgtatctttcacatttcattaacctttatgattacaacataacatcgaatcctttgacgcatcgtcctttaaacttttaggcatgaaacgaggggaataaaaagcaaaagggggggatggggttcaatagcttctaaagcatgtttcgatgcagttacagcagctagatcagcacaaggaaaattctccggaagaatcgtaactcttttgattgacgatgacaccatgagaccaaatatacccaccaacgtaactcgggaaggatgctagcaggattgtactgtcttgctgcggagacactgcaatgtccaagctttttatcattcaggtatgcccacggcctccacacttggagcacatgatgttcccagttcctccacagcctaggcatctgactttcacgatgatcccttggctctctagtatcgagtcgacgtacaagcctgaaccagcgcatgttgcgcacagcacagcgcctttagcttcacagcttgagcagggagggttgtccccgacatccttcttttccagatctagaccggacggttttccaatattctcctctgggacagatttgtcgtagcagaatagcgattcaaggttacttctattcctttggaggtcatagattgcacttgctttattcttaaccgcgcgggacacggaccgcaccgaatgggaagccgcgagcggcggcaccgacgcaaaccgacggcctcggagcgacgctgccgcagcgacgggcggcggccggagcccagcggacacctccatgcgctcctagaggaaagttttcttgggctcgccgtcgcagcggagagggggcccgggggaggaaaggggcagcaggcgagcagctccaacttcttgtagcgcttctcagatttccaagccgcaccagcttccccggcagcgccccgcgggagagggcccacttgcagagagccgatcgatccccgccggcctcgtggcgcccggtgacatacccgacgccggacacaaaaaatt

SEQ ID NO: 395 - DNA, 839 bp, Zea mays
gaagcagagcgtttgagtaaaatcttttttttttttttttttggcacaactgaatttaatctctcattctcctccatgaacgaagtgtgtctttcacataccattacacctttacgattacaacatcacatgaaatcctatgacgcatcatgcttttaagcacggaatgaggggaacaaaataaaagcatgtctcgatgtagctacagcagctagctcagcacaccgtaacatgtaacacagaaaattctccatagagtcaactcctttgatctgcaaggtgcaagcttttgcgttcatgtatgcccacggcctccacatttggagcacatgatgttcccagttccaccgcaacctaggcatctgactttcacgatgattccctggctctctagtatcgagtcgacgtacaagcctgaaccagcgcacgttgcacacagcaaggcacctttagcttcacagcttgagcagggaggcttgtccccgacattcttcttttccagatttagaccagatggttctccaatgtcctgctcggggacagatttgtcgtagcggaataatgattcgaaattacttctgtttctttggaggccgttaattgcagctgctctgatcttaaccgcgcgggacacggaccgcaccgaatgggaagccgccacgcgcggcggcaccgacgcggaccgacagccaaggagcgacgctgccgcagcgacgggcggcggccggagcccagcggacacctccatgcgctcgtagaggaaattttttcttgggctcgccgtcgcagcagcggaggcgcgcgcaagtctgggggcgggggcctgcgtagctgctcga

SEQ ID NO: 396 - DNA, 1253 bp, Zea mays
ttttttttttttttttcttttataattgtatgtacttggattatttcccatttcccctttcagtttagtgtactgtgtacgtgtattgtgtactcacgcggtcacgccccagctcgagtcagcccggcctgttcacagctcgtggtcgtatgtctaccggcccccatctgcccgtgggccgtggccgtgctcgccggcgcctccagtggcgttcctcaggctaagccacaagtggacggtgaccccgaggagcaccaccacggcgatcgccacgttcatcagcaggccgcggctcgcgaaggccggcccgggctggttcgcgaacgccatctctttctctgccagcattgccttctcctcctgctgctggtgctgctccgtgaccgtgtccttctcctgcaccgtctccttcctgtcctcagccatcttcccctcttcgtccctcttcctctgcctgtcctcctgctccttcggcctctgaacagcccccagcgacgactcggcgggcttggtggtggttgcaggttgttccacttgcggcgccggcgccggcgctggtgccggtgccggcacggaagcgtacgggttcttcggcatcgacggcctgggctcggcgggcttggtggtggttgcaggttgttccacttgcggcgccggcgccggcgctggtgccgttgccggcacggaagcgtacgggttttcggcatcgacggcctgggctcggcgggcggcttcacggaaggaggaggagccagcggcgccgctggcggcaccaggggccgcggcgcggcaggcctcgccactggcctagcagtcaccggcggaagcctcgccgacgacgtcgacggcgccttcacgtgcggcctctgcggcggcgccggaatgggcgccgaggaggtgctcttggggagcgtgatggtgagcctgtcgttctcgaacttggcgcggatgccgtcggcgttgcagttggcggggaggtcgacgtccgtctggaagcggctccacctgttgccggcgatgtgccgctcgccgcgcgtccgcaggtggccgtggctgtccaccagcacgcgtatgtcctccctcttgaaccctgggagcgagatccggacggcgtccgcctcgtcggagcggctccattcgacggcggggttgtactcgtcgaagatgcggttgttggccatgcctgcggtttcctcgcgtgttcctggaactagctaaattgatgtgctgctggtggtggtggtgtgttgatt

SEQ ID NO: 397 - DNA, 1318 bp, Zea mays
  misc_feature (222)..(222): n is a, c, g, or t
  misc_feature (270)..(270): n is a, c, g, or t
  misc_feature (382)..(382): n is a, c, g, or t
  misc_feature (400)..(400): n is a, c, g, or t
  misc_feature (429)..(429): n is a, c, g, or t
  misc_feature (472)..(472): n is a, c, g, or t
accgcgagtccgcgactccgcaccaagcaaatcccctgcccccaaaatattgctagggattcgaggggaggaaaatccaggcgcccaggcctggcaatccgttcgtcggagaggccatgagctcggcgcaggatccgttctacatcgtccgggaggagatccaggagtcgattgataaattgcaaagtaacttccaccgctgggagcaaactgcttcaaacnacaggagaatatgttcatctgacaaaggagcttctgaccagctgtganagcatcgagtggcaggtagatgagctggaaaagacaatctcagttgcatcaagggatccatcatactatggaactttgatgaagttgaactttccagacgagaaaacctggnactggttctgctcataangcagggttggtacagtttaagagagctanttgaaaagggcaagagcaatgtagcaacttcaaaataccaggnatacaagcaggaccaaccactattctgcccaagataatgatgactttatctcttcagaatcagataggcagcttctactcatgaggcagcaggatgaagaacttgacgagctcagtgaaagtgttcaaaggattggtggcgtaggactaaccatacacgaagagctgtctggacaggaaaggatcctaaacgacctaagcttggagatggagactacttccaacagacttgatttcgtgcagaaaagagtggccatggtgatgaagaaggccggcatcaagggtcagatcatgctgatcgtgttcctggttgttctgttcatcattctttttgttttggtgttcttgacatagccaagtgcaccagggtcctcgattttctccctcccatttgttgtgcctccctccctagtacgaacataagtatacgtgctggagctatcctttataaatcccgattttaatgcattttgttctgcgtgagatcaccgtcattggaacggtgttatggtatgtatgccctagtcgctcttgttcgaagaactctgaagatcaattctacgactaagacgacttcattttgaggtactgttcatcatccaaaatggaggcagccgattcgattcctctttctccacgtaaagcaaaatgaggatgggagcggtattgttggagtgatgaacagtgcttggtttatagcgtgtaaaatggggacggggagtgcctgttggaggagaggagatgagatggatgcgtgctaaaaggcaaccgatactaaatgaatgttcaccaaccaaatgaatgttggaacttttgtttcttaaaaaaaaaaaaaaaaaaagcggcc

SEQ ID NO: 398 - DNA, 1120 bp, Zea mays
accctggtggcagtgtcaccgagacgaaacaaggaaggagccagcggaagggggatctggatctctcctctctcgtctgcaccgcgagtccgcgactccgcaccaagcaaatcccctgcccccaaaatattgctagggattcgaggggaggaaaatccaggcgcccaggcctggcaatccgttcgtcggagaggccatgagctcggcgcaggatccgttctacatcgtccgggaggagatccaggagtcgattgataaattgcaaagtaacttccaccgctgggagcaaactgcttcaaacacaggagaatatgttcatctgacaaaggagcttctgaccagctgtgaaagcatcgagtggcaggtagatgagctggaaaagacaatctcagttgcatcaagggatccatcatactatggacttgatgaagttgaactttccagacgaagaaactggactggttctgctcataagcaggttggtacagttaagagagctattgaaaagggcaagagcaatgtagcaacttcaaaataccaggatacaagcaggaccaaccactattctgcccaagataatgatgactttatctcttcagaatcagataggcagcttctactcatgaggcagcaggatgaagaacttgacgagctcagtgaaagtgttcaaaggattggtggcgtaggactaaccatacacgaagagctgtctggacaggaaaggatcctaaacgacttaagcttggagatggagactacttccaacagacttgatttcgtgcagaaaagagtggccatggtgatgaagaaggccggcatcaagggtcagatcatgctgatcgtgttcctggttgttctgttcatcattctttttgttttggtgttcttgacatagccaagtgcaccagggtcctcgattttctccctcccatttgttgtgcctccctccctagtacgaacataagtatacgtgctggagctatcctttataaatcccgattttaatgcattttgttctgcgtgagatcaccgtcattggaacggtgttatggttaaaaaaaaaaaaaaaatctgcggccaagaactctgaagatcgaaaaaaaaaaaaaaaaaagcggcc

SEQ ID NO: 399 - DNA, 1595 bp, Zea mays
gggacccggcctcttctccgacatcggtgggaaggaaggatctactcattaaggactacacctacgaccagaagctgtccatctccaccgccagcgcctctggagtggatacctgaccaggacaagagatagagtctagttcggtcctttaagcgaatcagaatccgttcgtcggagaggccatgggctcggcgcaggatccgttctacatcgtccgggaggagatccaggagtcgattgataaattgcaaagtaccttccaccgctgggagcaaactgcttcaaacacaggagaatatgttcatctgacaaaggagcttctgatcagctgtgaaagtatcgagtggcaggtagatgagctagaaaagacaatctcagttgcatcaagggatccggcatactatggacttgatgaagttgagctttccagacgaagaaactggactggttcttctcataagcaggtcggtacagtcaagagagctattgaaaagggcaagagcaatgcagcaacttcaaaataccaggatacaagcaggaccaaccactattctgcccaagataatgatgactttctttcttcagaatcagatagacagcttctactcatgaggcagcaggatgaagaacttgatgagctcagtgaaagtgtccaaaggattggtggcgtgggactaaccatacacgaagagctgtctggacaggaaaggatcctaaacgacctaagcttggagatggagactacttccaacagacttgatttcgtgcagaaaagagtggccatggtgataaagaaggccggcatcaagggtcagatcatgctgatcgtgttcctggttgttctgttcatcattcttttcgttttggtgttcttgacatagccaagtgcaccagggtcctcggttttctctctcatttgttgtgcctccctagtacgaacactagtaaattggtcgcgctccgcgtgagttgttgcttgatgtgcttacataagatgtagaatcttgttgctataggcatgtatcaacaggtgctagcagcttgcagttctccttctaacagaaacaggtcgaagcagattttttgttctccaagtgatcagtttgtccaaggttgttaggctttccgtaatcgcttcgagtttgcttttcaagatcatcattcacaggttgcttgttagactttggctcaacataaggaggcagcatggattctttatgtttgcaacatttagcttagtgtaaggagccttgtttctagtggtaccaccacccggtatactaagaagactcaatgaacgcccttgattctctgggtgctgagctcttacccctgaatctgcatgtctcccattgtgttcatgaccaccaggccattgagatcaagctctactacctccatcagcttcttttccaaagggcgaacaacttttctgtttagcttctgaacatccttttttgggtcctgttagtgtccacaggagacactggtttatgcaaatgttcattctcaacagacacatcaggttgttgcttcctcgaattcttatcaattgtatggtgtgcgttagcaacagaacgaatatcttttggatc

SEQ ID NO: 400 - DNA, 952 bp, Zea mays
  misc_feature (920)..(920): n is a, c, g, or t
cccgggcgacgtcctgtctagatgaaaaatagcccagccaaaggccccacaaaagagcccgtctgtagattggttcttgtttgttcatgggtgagccaggaagtaaaggagaggcgattggttcttgtctgaagaagacggaacagatgaggcaagcgagtttgattggctgaggcgctgaaccgtggcatccttcctgtcacatgtgcccgggctctctaaaccacctggctccgtcacgttattcctgataatttttgtccctgtcagtaatgaaaagagataagaatagtgtaccctgactaaactcaaatttcgtaggcagattacatgtatagttatgcatagttccattccagggtagccatgtggaggtcacatgtttttgcattgattttgacatgttttacacaggcagcaggatgaagaacttgacgagctcagtgaaagtgttcaaaggattggtggcgtaggactaaccatacacgaagagctgtctggacaggaaaggatcctaaacgacttaagcttggagatggagactacttccaacagacttgatttcgtgcagaaaagactggccatgcggtgctgtcgggccggcatcaagggtcagatcatgctgatcgtgttcctggttgttctgttcatcattctttttgttttggtgttcttgacatagccaagtgcaccagggtcctcgattttctccctcccatttgttgtgcctccctccctagtacgaacataagtatacgtgctggagctatcctttataaatcccgattttaatgcattttgttctgcgtgagatcaccgtcattggaacggtgttatggtatgccctagtcgctcttgttcgaagaactctgaagatcaattctacgactaagacgacttcattttgaaaaaaaaaaaanaaaaaaaaaaaaaaaaaaaaaaaaaaaaaaaa

SEQ ID NO: 401 - DNA, 1202 bp, Zea mays
ccacgcgttcgacgagtatgaacagacgggggctcggcagggcatctccggactccccacacagctcctcttggtggcgccctctgacatctccccggcccgcgccttcgatcggtggccgccgccctcctcgacttccgtcccgacgccgccgccgccatgaagggacccggcctcttctccgacatcggcaggaaggaaggatctactcactaaggactacacctacgactagaagctgtccatctccaccgccagcgcctctggagtgaatccgttcgtcggagaggccatgggctcggcgcaggatccgttctacatcgtccgggaggagatccaggagtcgattgataaattgcaaagtaccttccaccgctgggagcaaactgcttcaaacacaggagaatatgttcatctgacaaaggagcttctgatcagctgtgaaagtatcgagtggcaggtagatgagctagaaaagacaatctcagttgcatcaagggatccggcatactatggacttgatgaagttgagctttccagacgaagaaactggactggttcttctcataagcaggtcggtacagtcaagagagctattgaaaagggcaagagcaatgcagcaacttcaaaataccaggatacaagcaggaccaaccactattctgccgaagataatgatgactttctttcttcagaatcagatagacagcttctactcatgaggcagcaggatgaagaacttgatgagctcagtgaaagtgtccaaaggattggtggcgtgggactaaccatacacgaagagctgtctggacaggaaaggatcctaaacgacctaagcttggagatggagactacttccaacagacttgatttcgtgcagaaaagagtggccatggtgataaagaaggccggcatcaagggtcagatcatgctgatcgtgttcctggttgttctgttcatcattcttttcgttttggtgttcttgacatagccaagtgcaccagggtcctcggttttctctctcatttgttgtgcctccctagtacgaacactagtaaattggtcgcgctccgcgtgagttgttgcttgatgtgcttacataagatgtagaatcttgttgctataggcatgtatcaacaggtgctagcagcttgcagttctccttctaacagaaactggtcgaagcagattttttgttctcc

SEQ ID NO: 402 - DNA, 763 bp, Zea mays
actctcctccacagccacagccacgagccaagcgcgacggatcccaatccatcttctcctcatccccaccacgaccaaaaaaaaatccggtcgccgatgccttctgctgcctgacatcggtcagccaaggtagatcgacgcaggcaggcagccccacacacatacgaaacccaatcctgcttcgatcccgtcggccggcgatggagggccggcggccgggcgcgcccgtggcgggcctgcccatcggcttccgcttccgccccaccgacgaggagctgctgctgcactacctccgccgcaaggcgctggcctgcccgctccccgccggcgtcatccccgacgccgacctcgcgcgcctccacccgtgggacctcctccccgccgccgcaccagggggatccggagccgacgccgacggggagcgcttcttcttccaccgcccggcgacgcagtgctggcgcaagggcggcggcgcggccagggcggccggcaccggcgtctggaggccgtccggcaaggagaccctcgtcctgtccccgcgctgcaagcgccccgtcggcaccaagcggacgctcgtattctgcccccgccgcggccgcgcccgcacccactgggccatgcacgagtaccgcctcctccccgccggcctccacccctatggctgcgccgccggcgccggcgccgacgcgcctccgcccactaatgtgagctcccacggcggcgacgcggcggccgactgggtggtcggccgcattttcaggag

SEQ ID NO: 403 - DNA, 2268 bp, Zea mays
tgcctgcaggtcaaccggtcgaacgcgctgacatttcacggcgggcggacgcgcgcacgctcgatcgcctggccccggggcgccagccagcgggagggagagagagaggacaaaggcgacgacttttgcggcgcctccacctccctgtgcgtctgtagcgccgcggcacgagggacgtcgggtagccaactttcggggttccctttttggaagcggcgtgctagacaagctgcaagcaaggtcgcgaggtgaatgtgggggatccaatgctggtaggcggcgcgtcgtcgatcgggtgaagtgtgaggtgaggactgagggaggagggcggtggccatggcgtggaagcttctcccttgtgtgctccctcccgttcggaaaggcggcgagaggcccacgaccacgacgacgagtcgaggcggaaaaaggcaggcggaggagggcagaggaaggaagagagcatgcgcaagcaaagccaagcccggaaaggaaccgcacccgaccgtaccttgggaaccgaggccgatagatagggcactgaactcaaccatcgggtccgagagacgttgttgcccttggccactgctcttgaccgagatgcagtatactactcctactaccactccgatagcacttggtacagtagtggagcacagcaagactactcatctgtgtaaatgcaagcttcagattgaaattattcaccgtttttttttaaaaaaagcagccttgtaggagcacagcaagactactccaatccaaatccaaaaagagagacaaaaaaaaaatgaataggaagagacgggcacgggcagggcagttgagtttgggcggagttcaattgatagagtccagcttacgccaccgccgctacccctataaaacggcggagccgacggccccttcttttcctctcctccacagccacgagccaagcgcgacggatcccaatccatcttctcctcatccccaccacgaccaaaaaaaatccggtcgccgatgccgtctgctgcctgacatcggtcagccagggtagatcgcgcaggcaggcaggcagccccacacacatacgaaacccaatcctgcttcgatcccgtcggccggcgatggagggccggcggccgggcgcgcccgtggcgggcctgcccatcggcttccgcttccgccccaccgacgaggagctgctgctgcactacctccgccgcaaggcgctggcctgcccgctccccgccggcgtcatctccgacgccgacctcgcgcgcctccacccgtgggacctcctccccgccgccgccgccgcaccaggtaccgtgcctctccatcacacccctccccgcattgccgctcgcgtcccttacctgacgagcacgcgcgaccgaattggatccaaccctgcagggggatccggagccgacgccgacggggagcgcttcttcttccaccgcccggcgacgcggtgctggcgcaagggcggcggcgcggccagggcggccggcaccggcgtctggaggccgtccggcaaggagaccctcgtcctgtccccgcgctgcaagcgccccgtcggcaccaagcggacgctcgtattctgcccccgccgcggccgcgcccgcacccactgggccatgcacgagtaccgcctcctccccgccggcctccacccctatggctgcgccgccggcgccggcgccaacgcgcctccgcccactaatgtgagctcccacggcggcgacgcggcggccgactgggtggtctgccgcattttcaggagggccaggccggcccaccgcgcccgccttggtggcgccagggaggaactagaagaggagcacgcggcggaggagagcccgtcgtccccgtcgtcctgcgtcaccgacgcctccgagaccctcgaccaggaagaggatgacggcgacgaagggagcagcagcagcaccgtcgcctcctctaactgagactgagtagaagagttggctaccccctgtcgatcagatcgcgggcgccatgttctaattgccgtagaagcctcatcatcagtacctagttgcaatcaatagagagacaagaagatcggcctccaacaaaccaacaaaaaaaaagagctaagcgctttggtggtatgttgctgttggagctcgtcgcgaatccatattgttaattagcgagaaattaatccgttcccccctccggcaattattaattaatcaccgttccctggttctcccacaatgtgttgctcattcgtcgaagcaaaacaatgccattcgccct

SEQ ID NO: 404 - DNA, 686 bp, Zea mays
gggtacctcagctacgtaggccccccccccatgagccccatggttatgattacttgtatggttcctggaaggcttctccaaccccacaccatccatggatgccctgaccatgaggtgctaccgctactcacctagtgtcgccatggttccgatgaggaagacctcgaggacgacgatgacgagagcctccatctccacagatggctgctcgagttctgagcccaagaagaaatcccactctgtcagcttcgctggcaaggccaacaaggtttacgaggacaaggacatgggaatcctctgctacaccgacgagaacggtgaactggtgtgcgagggcctagacgaaggcccgaggctgacgtggcaggacatggaaaaaaaaaacgagaatcaagaacgtcagaggaggcagaggacaccgccgcctacggttggtaggatcgactggagcagtctccatgctgcagttagcatggggaaaaactgaaacaagtttcagtatcgcgcgtggtgtgtttttgtttgcttgccttgtgttttagaagttaagatgtaaagttgttgagagtgagttttaagaactcctgaagatgctcttgagcatataaaaactatgttggtaaatacttaattccttgcaaacgctcccgccggccaccgttaaaaaaaaaaaaaaaaaagcggcc

SEQ ID NO: 405 - DNA, 1297 bp, Zea mays
ccccgagtgatagtgagcgacggccgccacgggacaggcatggcgagccgcgagcggcagcacacccgcagctacgactacgactacgagcacctcgtgctcgacccggcgtctctgggcgtgccgtgggccgacccggccgccgtggagatcccgccgcagctcctcgccgcgctcggggagtacctctccggctccgcggcccgcggggacgtcgaggcggaggcggacgacgagttcatgatgcacgagttcaaggtgcggcggtgcgcgcgcgcgcggagccacgactggacggcgtgcccctacgcgcacccgggcgaggccgcgcggcgccgggacccgcgccgcgtcgcctacgcgggggagccgtgcccggacttccggcgccgcccgggcgccgccaccgccgcgtgcccgcgcggggccgcctgcccgctcgcgcacggcaccttcgagctgtggctccacccgtcccgctaccgcacccgcccctgccgcgcgggcgccgcctgccgccgtcgcgtctgcttcttcgcgcacgccgcggccgagctccgcgccgccgccgccgccaagcccaagcccaaggacgggtgctctccgctcgcgctctcgctctccctctcgcccaagtccaccctgcaggcggcgctctgggagtcgccgccggtgtcccccgtggagggccgcaggtgggtcgacgagccgtcggaggacggcgacgccgacgccgagatggaggagctgatgttcgcgatgcgggagctcagcttcaggaaggcccaggcgtcgccagcgccggttctgcctgcagtcacagaggacgacgggccggacttggggtgggtgtcggagctggtgatgtaggcgaggcatatgccagcgcctgcccggtgccgacgcccgaaattaatcaaagccaagacgtggacgccgccatctccagaggcgcctctcgccgtttggaacagcttcattaagcaatgtttatttttagcatttccatgaattgcatcattcttctgtggatagaccaaacatggtgcaagtattattaatactgcaatctgtaagcgtggcgtgtgtgccccccttctctttttttttccggagaccatggcctcactcaacatgctactgtcgtccatggttttcgttcgatcgtgttactactaccagtaccagtgtacgtctaaccaagtgcagttggcagtgtgttctccattccatccctgcagctgcagggatcgatgttgcatttgcaaaataggaacccaagcaaatttgcctctca

SEQ ID NO: 406 - DNA, 930 bp, Zea mays
ggaccggaaaacccgcgaatcgtaccggtacgaacactgagcacgcacgcacgcaaactcaaaggagtgtgaccacggaactgaagccatggcggttacagttgagaagggcgctatgggcgagccggcgctgctgctggagcgcagccgggcgatcacccttcacggccgtgaccggaagggccgtgccgtcgtcaggatcgtcggcaactactttccagcgcgcgcgctgggcggccgggcggaggaggcgctgcggtcgtacctgcgggagcgcgtcctcccggagatcggggaccgcgagttcgtggtcgtgtacatgcactcccgcgtggatcgcggccacaacttccccggcgtcggtgcgatccgcggcgcgtacgagacgctgccggccgcggccaaggagaggctgcgcgccgtctacttcgtgcacccggccctccagtccaggatcttcttcgccaccttcgggcgcttcctcttcagctcagggttgtatgagaagctgcgatacatgagccggcttgagtacgtttgggcccacatagacaaggagcagctggaggtccccgaatgcgtgcgcgagcacgacgacgagctggagcgccgcccgctgatggactacggcatcgaggcgacggagacccgctgcatgtatgacgccgcgtccatggacacctcggcgtccctgcactcgctccgctgcgtctcctagtcgcctggacagtggcatcccgattcccgccgccggtacggcgtgctttctgtgttctggttggtaggaggtagctgcatggcttcatagcgcttcggtactgtagtttagctgtgtatttataatggataaaatttggagtaaaaaaaaaaaaaaaaaaccaaaaaaaaaaaaattaaaatattaattaaaaaaataaaaaccatttaatt

SEQ ID NO: 407 - DNA, 1655 bp, Zea mays
ttcttgtttgttgattaacccttaattaatccgggcgcgcctgatttatcacaagtttgtacaaaaaagcaggctcctgcaggaccatggcggttacagttgagaagggcgctatgggcgagccggcgctgctgctggagcgcagccgggcgatcaccctgcacggccgtgaccggaagggccgtgccgtcgtcaggatcgtcggcaactattttccagcgcgcgcgctcggcggccgggcggaggaggcgctgcggtcgtacctgcgggagcgcgtcctcccggagatcggggaccgcgagttcgtggtcgtgtacatgcactcccacccgtgggatcgcggccacaacttccccggcgtcggtgcgatccgcggcgcgtacgagacgctgccggccgcggccaaggagaggctgcgcgccgtctacttcgtgcacccggccctccagtccaggatcttcttcgccaccttcgggcgcttcctcttcagctcagggttgtatgagaagctgcgatacatgagccggcttgagtacgtttgggcccacatagacaaggagcagctggaggtccccgactgcgtgcgcgagcacgacgacgagctggagcgccgcccgctgatggactacggcatcgaggcgacggagacccgctgcatgtatgacgccgcgtccatggacacctcggcgtccctgcactcgctccgctgcgtctcctagtcgcctggacacttggacagtggcatcccgattcccctcgagacccagctttcttgtacaaagtggtgataaattggagctctgcagagctttcgttcgtatcatcttcttgcgggccaaaaaacacgcgaatcgtaccggtacgaacactgagcacgcacgcacgcaaactcaaaggagtgtgaccacggaactgaagccatggcggttacagttgagaagggcgctatgggcgagccggcgctgctgctggagcgcagccgggcgatcaccctgcacggccgtgaccggaagggccgtgccgtcgtcaggatcgtcggcaactattttccagcgcgcgcgctcggcggccgggcggaggaggcgctgcggtcgtacctgcgggagcgcgtcctcccggagatcggggaccgcgagttcgtggtcgtgtacatgcactcccgcgtggatcgcggccacaacttccccggcgtcggtgcgatccgcggcgcgtacgagacgctgccggccgcggccaaggagaggctgcgcgccgtctacttcgtgcacccggccctccagtccaggatcttcttcgccaccttcgggcgcttcctcttcagctcagggttgtatgagaagctgcgatacatgagccggcttgagtacgtttgggcccacatagacaaggagcagctggaggtccccgactgcgtgcgcgagcacgacgacgagctggagcgccgcccgctgatggactacggcatcgaggcgacggagacccgctgcatgtatgacgccgcgtccatggacacctcggcgtccctgcactcgctccgctgcgtctcctagtcgcctggacagtggcatcccgattcccgctcggcggtaccgcgtgcctttcttgtacaaagtggtgataaattggagctctgcagagctttcgttcgtatcatc

SEQ ID NO: 408 - DNA, 1109 bp, Zea mays
ctcgaggccggccgggaaaaacacgcgaatcgtaccggcacgaacactgagcacgcacgcacgcaaactcaaaggagtgtgaccacggaactgaagccatggcggttacagttgagaagggcgctatgggcgagccggcgctgctgctggagcgcagccgggcgatcaccctgcacggccgtgaccggaagggccgtgccgtcgtcaggatcgtcggcaactattttccagcgcgcgcgctcggcggccgggcggaggaggcgctgcggtcgtacctgcgggagcgcgtcctcccggagatcggggaccgcgagttcgtggtcgtgtacatgcactcccgcgtggatcgcggccacaacttccccggcgtcggtgcgatccgcggcgcgtacgagacgctgccggccgcggccaaggagaggctgcgcgccgtctacttcgtgcacccggccctccagtccaggatcttcttcgccaccttcgggcgcttcctcttcagctcagggttgtatgagaagctgcgatacatgagccggcttgagtacgtttgggcccacatagacaaggagcagctggaggtccccgactgcgtgcgcgagcacgacgacgagctggagcgccgcccgctgatggactacggcatcgaggcgacggagacccgctgcatgtatgacgccgcgtccatggacacctcggcgtccctgcactcgctccgctgcgtctcctagtcgcctggacacttggacagtggcatcccgattcccgccgccggtacggcgtgctttctgtgttctggttggtaggaggtagctgcatggcttcatagcgcttcggtactgtagtttagctgtgtatttataatggataaagtttggagtaccgagatggcttctgcaagaaaacaaaagaagcatggaaaagctgatcaaagaacgcgaacataggtagcagaacaagtgaacaccaatagaatcgctaatccaccaaacaggaaccatagtgtgatcactgatcggtctttgcctcctatcgaagacgttacttgacatcaaagaggttacttggaacaaaggtgacacaaaaatatatagagaagatacttggttggc

SEQ ID NO: 409 - DNA, 2938 bp, Zea mays
catccaacatccaatgtgatagagactaaaatttagtcagtgaaaccatgatgtggggcctgtttgtttcaacttttcttagataagcttttctgagaatctagtataaagaatctgagtatcgtggaaattatgtggggaagacgaatgagtccatagggtttagaatctagaaagtgacggatttctgctatcatatgactcggtcggttctatgttcatactgattttgaacagttttcatcgagtgattctcacaaaaacgggctaaaaagttggacgtttgacaatccgtaacaacttttgacgaccagaagctaaaaaaaagttgaaacaaatggggcatggtctggtgccggaactagtttcgttagctctttagctagctaaaggttacatttagagaggcgtttgacagagcttcaacagttctgctcctaccgagaatcacccctacacagctaaatagcaaaaaaaaaaaaaagagcttgaatagatatatatatggcatgcatatactatacatgaactttcattttcacattcttgatttgccagaaaaactacatacgacaacgtccaataaaccaatacatgatatagtgtgcattgtttctgattatatacagtaatctgtcaaccagtatttgtagaaacagaaataacaaaaaaaaacatgtgaatagctatactaggtattgtatctatcagatgctgcactgttgcttaagcaggacaattaaacatgtcgcgacgatgacgaatgccgagttatttttagcgagccataatgacaagcgactagaaaacatttattcctcagtacggctcatgcttctctgcttatcgtgtgatatggtttgagacaattttcaaggtttatttttttaaccaaaacaaacattttttttttttttttctgatgaaaagctcgtgatctctttcaaatgaaacacacacaaaaaaaactgcatgtttgtactgtgcgccttgcttcgtctttaaaatctaaaaaataaataaatgcgctgtagctgacgtcagcaagtttggcatcctggacctggaaatgagaaagaaatggatggacctcacgaaaacgttgctgccggcggcgtcggcgtcgtgttgggctggccattccagtcctccctccaccagagaacccgcagcgcccgccatggccgtctccgattccctcgcgcatccaggtcagtagcagcacctgcctccactgcctgcccggcagctgcatcctcctcctccacgcgtggtccaagtcaaaatagcagccttctcgcaagagattccgattcgggatttaatttgctggtcgctcgcgtagcggctgttcgtgtcgtgcgtaccagacaagctcgcgatctgaatcctgagctgagagtcccttgctgcgatgaacagccaaggagagccgggatacgttgggattgggcggctgctaatgctaaccgagcttttctctggggaaaattttggttgcagggctggcgatcgtggtcatgggagtcagcggctgcggcaaatcgtaagataccttcgtccccctcgctcttgtatcctcaagcttcaaggatccggtcagggttgcctaaggatgagcacagatcggcaggattcattcgtcggcgttctgccggtgacagtgcttacgaactggatctctctctcacacactgacacacacacacactgaacttgcagaaccgtcgcggcaatgctcgccgaagccctgggctgcagcttcatcgaagcagacgactaccattccgaggcaaacaaaggtacacgccacggcaccacacaactcacaccatcacgtctccgaaagctctggccttgtgccatttttgccatctctcaactcgtgctgagccgataggcatccgctctcaactcgtgcgcaaacccagccaagatgagcgcgggcgtgccgctctccgacgccgaccgcgcgccgtggctggagtcggtgcgggacgccatccgggggcggctggacggcggcgaggacgtggccgtcagctgctcggcgctgcggctcgggtaccgggatgtgctccgcgcggccgaccgcgcatacgagccggggcgctacgccgcctgcagggtgaggttcgtgtgcctgagggcgccggcggaggtgctcgcggagagggtgctgcggaggtcggtggaaggggagcacttcatgccggcgagcctgctgcggagccagctcgacctgctgcgggtcgaccccgcggagggggtcgccgaggccgacgcgacggcgcgccccgacgacatcgtccgcgacaccgtcgccctgttcagggacgagctagcggtgtcgtccggcgtccctgcttgacttgtttctggatgcgaacgcggtgcagtttcatggtttcatcccatgatgcagtcagtattcattcatccaccattaaagaacctccgtgcagtcggttcgaattaaagccggttatagactcgtgcagctgcaacctgtatagataaaaacactataaaaacagtagaaatttatacgaattaaagccaaaaaaaaaaaaaaaaacatgatgcaagttctcttcatcatttcccatctcgttcagaatcaaacacccatagcgatgaaacaggcatgctctgataaacatgaacacagaaggtagaaagaaagaaagaaatggcgagagctattgttctaacctgcaacctaaaccgacgaagcacagctgcatgaggacctgttgaaccacacaaatcatggtcacgggacctgttgttgccgtcgattgtaagtgtcctcgtggacaaacacggttttcgctgctctgctgggagatcacaaacacaggttgtacaaccgaatgtacgctcacatgcacattttaattctagaacatatatttaacatccaaccaagcaaaca

SEQ ID NO: 410 - DNA, 853 bp, Zea mays
cggctccccattccctagtcctccctccaccagagaacccgcagcgcccgccatggccgtctccgattccctcgcgcatccagggctggcgatcgtggtcatgggagtcagcggctgcggcaaatcaaccgtcgcggcaatgctcgccgaagccctgggctgcagcttcatcgaagcagacgactaccattccgaggcaaacaaagccaagatgagcgcgggcgtgccgctctccgacgccgaccgcgcgccgtggctggagtcggtgcgggacgccatccgggggcggctggacggcggcgaggacgtggccgtcagctgctcggcgctgcggctcgggtaccgggatgtgctccgcgcggccgaccgcgcatacgagccggggcgctacgccgcctgcagggtgaggttcgtgtgcctgagggcgccggcggaggtgctcgcggagagggtgctgcggaggtcggtggaaggggagcacttcatgccggcgagcctgctgcggagccagctcgacctgctgcgggtcgaccccgcggagggggtcgccgaggccgacgcgacggcgcgccccgacgacatcgtccgcgacaccgtcgccctgttcagggacgagctagcggtgtcgtccggcgtccctgcttgacttgtttatggatgcgaacgcggtgcagtttcatggtttcatcccatgatgcagtcagtattcattcatccaccattaaagaacctccgtgcagtcggttcgaattaaagccggttatagactcgtgcagctgcaacctgtatagataaaaacactataaaaacagtagaaatttatacgaattaaagccaaaaaaaaaaaaaaaaa

SEQ ID NO: 411 - DNA, 646 bp, Zea mays
caaacaaagccaagatgagcgcgggcgtgccgctctccgacgccgaccgcgcgccgtggctggagtcggtgcgggacgccatccgggggcggctggacggcggcgagaacgtggccgtcagctgctcggcgctgcggctcgggtaccgggatgtgctccgcgcggccgaccgcgcatacgagccggggcgctacgccgcctgcagggtgaggttcgtgtgcctgagggcgccggcggaggtgctcgcggagagggtgctgcggaggtcggtggaaggggagcacttcatgccggcgagcctgctgcggagccagctcgacctgctgcgggtcgaccccgcggagggggtcgccgaggccgacgcgacggcgcgccccgacgacatcgtccgcgacaccgtcgccctgttcagggacgagctagcggtgtcgtccggcgtccctgcttgacttgtttctgaatgcgaacgcggtgcagtttcatggtttcatcccatgatgcagtcagtattcattcatccaccattaaagaacctccgtgcagtcggttcgaattaaagccggttatagactcgtgcagctgcaaccgatagataaacctataaaacagtgaaattatcgaattaagccaaaaaaaaaaaaaaaaa

SEQ ID NO: 412 - DNA, 1077 bp, Zea mays
ggcgctcggcgactgacgtccgagcctccgtgatcctgattttctatctccgtacctcgtggcggaatgctcctacatgcgtcatccgctgcttaccatccgcttttcctcgtccccgccagaaccggagaccgaggaggagcccctcctcgattgcacgccgccaaactccaaaccctcaacgggctacagctacgctcttccttctccgctctcagctgctcctgctctccctctccttctcccggcgatggtgggaaacgcagcgcccgcagcctgttcgatgagctttccgttctttctccagtcgttccatgggaggtggatgatatatggagaatatatgcaggttatttcttcatcttgcatatccccctgagctttggagggcttggtgtgattgccaaagtaatgcagcgctcgtcacttgactcgatgacaacggtaatttctacactcatgcttcagttagcagagcttgttttgaccttagtgctactccagtattctgcaaagccagggcaagctatccaacctttcttttgtgggaaggtttttacagaacggaattgggtcaaagagactgtattaggctttgtagttttgataaccctggtattgaccacatccatcttagctgacaaattggtagggtctgaggatgcatatgacccggtattaaaggagatcctttctggcagtccagcctctgctctagtgtgtttctttctctactgtgttattgctccactatcagaagaaaccatctaccgtgggttccttttgacggctttgtcatcttcaatgaaatggcgagacgctgtcgtgatcagttcgctcgcgttcactgtggcacacctgtccggtaaaagttccattcaactgttcgttgttggatgtattacagggctggcttactgtcgaactggaactttagctgcttctttcaccattcattctctgtacaatgcagtattattgtatacggctttgatatcatgatcattttgtataatttgaatgcaaatgcttttactatacggcttgttcgttttgctcccaaaaaaaaaaaaaaaa

SEQ ID NO: 413 - DNA, 1552 bp, Zea mays
caaatataactattttttataattaaattatatttaatatttgtaattgatatctaaacattagatacggtacatactaaaatttaatcgagaaaaccaaagaccaccggtaacatccgtgttcacatcatgcaaaactgctccacacagcagatcttccggcaaaacggttgcgaggctaaactggacatttctagacttctctaccaagtcatatctcatatcccccgaaacagtcaggggctgagggaggcgccgcctgggtggagtggagagctggaggcagatcgaaataaagagcaccttccgaaccgacgtcctcgccgacgtcgtctcaaacgtgcccctcacgagaccgtcctccaaaatcctgaaacctatataattcccgctccatcaccggccggacgcctgatccgagtccctgagtcctgatagtacacgacaggcaccgcagcagaccggccggactcggcgccaagcgcgatggatttgtcatccgacgacgtgaaggcggcgaacatgcggcctgcggttgctgctgccgacggcacgtcgacgcttctgcggggttggcgggagttcatgcggagcggcgcgccggcgaggttcctctgttatgaggacggcaagtggatcggtatcaccggagaggcggtgccgcagctgcgccaggcgttccaggagaggagggcgatggccgatgcttcgtacgggggcaaggcgtacctgttcgacttcctccgcatgatcaggatcgacgaggtcaccggcgaggagaccgggctggcgtggatcgacgaccgcggggactgcttcttcccggcgcccgactgcggagggaggaagcgcaagagggacgacgagccggcggaggacgaggccgagtcatcctcgggcgtggacgtgcgctcaggggagagacacggcgtggacgccaagaagatgaaggcatgggagaacgcggcggtgaggctcgaggagaacgacatgtactaccaggtcgtcagcaagctattcctcagctatgggatggcgcaacgcggcgcggcgatcacggaggtgcgcaagatcgcgcccggcgcgaggaccgtggcgttccgggaacaggggcagcgcctcgcctacgcgcgctgcacagccaccggcaccgccaagttcgcatggtacggcgcctcggaggacgacgtggccgccgtcgtcgagcgaggattcgtgaggaacaacgcgccaaggctgggcgcgcgcaagcacggcgacggcgttcatctttcgccggcgcagtgcccttacacgaggtgagttctgagctggttttggcattccgattcagataaatctggacttcgcaattttgatcgatcccgagctgagttgtagtataatttgcctagttgccaagattcccatttcttttacttgcatatatatatatatgaagctgcatcgattttgccgggtgaatttgtaagaatcttgcacatagttcctcttctatctagcccgctgattggtaaatatatcaaactagagcgaagttcatagtcttttt

SEQ ID NO: 414 - DNA, 2577 bp, Zea mays
ccgcaaccatcaagctgggatgtcaatttagtattttcactttggtagttcatgcataaacctaaaaccgaagtttaaggactgaaacagcaattatcaagggacgaaattgagtctcacacgataaacgagggaccaaaatgactattttgcaaatttgaaatcttatcaaactcacatgtcacgtttccatgattaaaaaaaagaatggatgtagtggaacgaagttcttccgcatctagctcttggtgcaatccaaaaggcaaattccagaggacaaagggcgccaccattggcaagtcaatccagcccactacgctcccgatcacacgagacaaggcgcacacgtggcggataaggactggctgcgacttggcattcgcgcgggaaggatgacgccatggacacgagacgagagcaacaggcctgcttccaaattgcatttaatatattttttcgagcatcattgtttagttgattaatcgaatcattttgtgctaatccacccagcagaagaaatcgcaaacaacggcgaggaagagatgcccgcttggcttcgcgtgcacggcctcaagcctggcagtggcactatataaaccattgggggcctcgaggccggccgggagagaggcgcctcaactcaaccccacccccccacaagaacaacaagccacatcccatcccaactccacggtgaggtttgagcgatccgagcaaaaaaaatcaaccgaggcgcagcaacgcaggttcgttctctgaactctctggttcttttagcagcagggacgcgcagcacaagaaaggtccggttcaagaggctcttcttttgggtttattagaatcctcaaaggaagcgtgttcttgggttaggatttttttttctcacctcatcacacctctcctaggaggagcagagatccagagaaccttttttctcttctggattctcaccgcttcttttttttttctctgcacaaacacaccctcgtttctctacttttattgaggaacagggctgatttccaaactttttcctacccctgttttcataaacaagctccttttatttcttcccgttttaagttctgcccagcctcttcttctagctccatccaagctttctccatctagtagttccaatggccgcagccatagacatgtacaagtactgcaataccagcgcacaccttatcgcctcctcgtccccctcggatcaggagctcgcgaaagcactcgagccttttataacgagtgcttcctccccctaccatcgctactcgttggccccagattcttacatgcctacaccctcctcctacaccacctcgcctcttcccacccccacctcctcgcctttctcgcagcttccgccactctactcgtcgccttacgcggcttcgacggcgtcgggcgtggctgggccgatgggcctgaaccagctcggcccggcccagatccagcagatccaggcccagctcatgttccagcaccagcagcagaggggcctgcacgcggcgttcctgggcccgcgggcgcagccgatgaagcagtccgggtcgccgccggcgcagtcgaagctgtaccgcggcgtgcgccagcgccactggggcaagtgggtggcggagatccgcctccccaagaaccgcacgcggctgtggctcggcaccttcgacaccgccgagggcgcggcgctggcctacgacgaggcggccttccgcctccgcggcgacacggcgcgcctcaacttcccgtccctccgccgcggcggcggcgcgcgcctcgccggcccgctccacgcctccgtggacgccaagctcaccgccatctgccagtccctggcggggtccaagaacagctcgtccagcgacgagtcggccgcgtccctgccggactcccccaagtgctcagcgtcgacggagggggatgaggactcggcctccgccggctcccctccttccccgacgcaggcgccgcccgtgccggagatggcgaagctggacttcaccgaggcgccgtgggacgaaacggaggccttccacctgcgcaagtacccgtcctgggagatcgactgggattccatcctctcatgaacgatcaactacaactagtattttagtagtagtagcagcagcagcagcaaggttcagtcagtgatagctctgtgtaattttcgatttggggtttgcagctgcggtggatcgatggcattttagacatcggccatggcggctgtgttgtgatgcagaagtaaacgtacgtgctaatctcctggttgagctgccggttgttttttctcacggcacggccagtcgagaaagtcagtgtaatcccctgtcatgatctctctgttgcaacttaattaactcttctggcgtatgtatgtaaccatgtgtgttcatcttgaacgtatcgtgatgatgtgcgtctttttggtctcacgtcgcatctatggtgtgcgcacttgtgacttgtgatctaatagctgttgagctgtgccttttggctcctgattttgttttctgctctagctgtaaagcaaaatcatgctgccagccgcctgttggaaacaagccaaag

SEQ ID NO: 415 - DNA, 2607 bp, Zea mays
cttcagacgttttgttcaaaatacgaattgaaattgcatgatcttctaaataacactttgaccattcatttactacatcttacatttcatatttatttataaaaatatgattattgaatagtacaattacttataaatctaacaatatcaatttgtgttataatagttaaaaattgctagtgagattattagttacaacttttaaagtctgattcttgatatgaaagagaatggtggtagcagaacgcaaagttccagtaatattaatatcattccgtacgtattgagctcttgatgcaatgaaaaggcaaattacgcacaagaagggctccagcgttggcgagtcaatccagcccagcacgcgagaccaggcgcacacgtggcggaccagaactggctgcgacttggcattccccgcgtgctacctcgcgtgggatgacgccacggacgagagcaacaggcctccttccttccaaactgcatttggtaattttcattcacgggaacattgctcagttgattaatcgaatcattttgtgctaatcccccacggagaagaaatcgcaaacagcggcgagcaagagatgcccgcttggcttcgcgtgcacggccccggtgccaagcctggcactatataaaggcctggccgagagacctttcttccccagagagacagacacgcctcacccccaccacaagaacaccaaagccacatcccatccatctccacggtgaggcttgagcgacccgagcaaaaaaaaatcatccgcgacgcagcgacgcaggtttgttctctgatctctctggttcttcttttagcagcagggacgcacagcacaagaaaaggtccggttcaagaggctcttctgttgggtttttttagaatcctcaagagaagcgtgttcttgggttaggatttttttctcacctcatcacacctctcctaggaggaacagagatccagagaaccttttttctcttctggatccttgccgccttttggccttcgaaagggggttgttttgcaataccctctctctgttttttttcttcttcgcacaaacccacctcgtttctctacttttattgaggaacagagctggttttccaaaaaaaaaaaatctactttgattttccataaagaaaacctctcagcctctttcttctagctccatccaagctgtagtcctaatggccgcagccatcgacatgtacaagtactacaataccagcgcacaccagatcgcctcctcctcctccccctcggatcaggagctcgcgaaagcactcgagccttttataacgagtgcttcctcctcttcatcctcctccccctaccatggctactcgtcctctccatccatgtcccaagattcttacatgcctacaccctcttacaccagctacgccacctcgcctcttcccactcccgccgccgcctcctcctcgcagcttccgccgctctactcgtcgccttatgcggcgccgtgcatggccggccagatgggcctgaaccagctcggcccggcccagatccagcagatccaggcccagttcatgttccagcagcagcagcagcagcagaggggcctgcacgcggcgttcctgggcccgcgggcgcagccgatgaagcagtcagggtcgccgtcgccgccgccgccgctggcgccggcgcagtcgaagctgtaccgcggcgtgcggcagcgccactggggcaagtgggtggcggagatccggctcccgaagaaccgcacgcggctgtggctcggcaccttcgacaccgccgaggacgcggcgctcgcctacgacaaggcggccttccgcctccgcggcgacacggcgcgcctcaacttcccggccctccggcgcggcggcgcgcacctcgccggcccgctgcacgcctccgtggacgccaagctgaccgccatctgccagtccctgtcggagtccaagtccaagagcggctcgtcgggcgacgagtcggccgcgtccccgccggactcccccaagtgctcggcgtcgacgacggagggggagggggcgggggagtcgggctccgccggctcccctcctcctcctcctcccccgacgctggcgccgcccgtgccggtgccggagatggcgaagctggacttcacggaggcgccgtgggacgagacggaggccttccacctgcgcaagtacccgtcctgggagatcgactgggattccatcctgtcatgagcaataatagctccgtgtaatttaattttctactgtctgggttttgcggctgcggtggcccgatggcattttagacgtcggccatggcggctgcaagtagcaatgagtaactagctagctagtacatcgtcgtcgactcgtcgtcgtccagtgttgtgaagcagcgtcaagtacatgcgtgctagtctctcctggttgagctgccggttgtttttttttctcacggcacggccagtcgagaagagtcagtagtgtaatctcgtggtgttatgatcatcggttgcagcttatgtatggaactttgtctatctagtactatttattggtcttgaaaaaaaaaaaacccacaaaaaaaaaaaaaaaaaaaaaaaaaaaaaaaaaaaa

SEQ ID NO: 416 - DNA, 1635 bp, Zea mays
acttgtatggatgcaaataccaatctccacctgcactctcccgactcaggatttatacccacccccgtcggtcgatcccctccctccctcccgccgccgccgccgccgcccgtagccaagaccaagatcccgtctcgcccggcgtcgcacctgacctaaccctgagccctgtgatatgccggttcaggtcggaggcagcaaggtggcggacccgaggccggccagggtggtggacctatcgcccgtaggcgacaggtcccgcgcctcctccaagaagaaccgccgccgccacaagaaggccgacgccgcctcttccgtctcgcccatgcagaggctcttcgacaccagcagggaggtcttcgccaactcctacccgggcttcgtcccgccgccggacgccgtcgcccgcctctcgggcctcctcaatgagctgaagcctcgtgacgtcagggttgccccaagcatgtccgtcttcaagcatgccgatcctacaagcccccctccagttacctatttgcacttctacggttcctccgagttttcgtttggtatcttctgtttaccgaaatcggcaattattcccctccacaaccatcctgggatgacagtgtttagcaagatactgtttggttccatgcacctcaagtcctatgattgggctaaaagtctgccggcgggtagcaacgataatgcacttgagaactctgatggagcaggagctcgtctggccaaggtgaacacagatgccgtttttgacgcttcatctgagaccgtagttctgtaccctgaaaatggagggaacttgcactgctttacggcgctgaccccttgtgccgtgctggatgtgatgggccctccctacaaccgtgctcaaggaagggattgcgcgtattacagcgaatcgccctactcgtgtgctggagatgcacaatattcttggctcaaagaggttcacagcacatttgagatggaaggcataaagatggagcccaacttcatcgtctaataattaagcaggcatggcatgacatgacatggcatcgtaatgctgctagtttcatgtagataatctctagctgcgggggtgtagtacaactggaagacggccagatgctcttttgacattcgtttgccttaatttcatatgcctccctttatgtatgttaacaattcgaatcttgggtcatggtcactttttttccctgttttccctgtagacagcaggtgctactttttgaagtgatcatggaccaaattctgtgggtcgtttggttggtttttgttgagcagcagaacagtcttcaactttctgcctgccatcgtgtttcagtttcagggcccatgccttgtgttttctctttgaatgaacaaagaactgtctctagcatagttataaatggatatggtccaggcttccaaatcaggagctgtgaggtgatggggacggacgtagttgtgtagtacgggggtcaggtcaggtccggccggacgatgttcttcgttgcagcgtactctctgttggctgcaccgcattagcgcaatgattcggtctgatttgtcatactttttaacctacaaatgttatgcattagcaatggttttagataaaaaaatttggcataaaaaaaaaaaaaa

SEQ ID NO: 417 - DNA, 1223 bp, Zea mays
catggtccgcgggcatagccctgacgcacaccgtggcactggcgtccgcagatcttttcctttcctaccgcctacgccgtcgtcgcccagaggcaataccatgatccggtctcggccggcgtcgcacctgacctaaccctgagccctgtgatatgccggttcatgtcggaggcagcaagcattgggacctcgagccggccaggtggtggacctatcgcccgtaggcgacaggtcccgcgcctcctccaagaagaaccgccgccgccacaagaaggccgacgccgcctcttccatctcgcccatgcagaggctcttcgacaccagcagggaggtcttcgccaactcctacccgggcttcgtcccgccgccggacgccgtcgcccgcctctcgggcctcctcaatgagctgaagccgcgtgacgtcagggttgccccaagcatgtccgtcttcaagcatgccgatcctacaagcccccctccagttacctatttgcacttctatggttcctccgagttttcgtttggtatcttctgtttaccgaaatcggcaattattcccctccacaaccatcctgggatgacagtgtttagcaagatactgtttggttccatgcacctcaagtcctatgattgggctaaaagtctgccggcgggtagcaacgataatgcacttgagaactctgatggtgcaggagcaggagctcgtctggccaaggtgaacacagatgccgtttttgacggttcatctgagaccgtagttctgtaccctgaaaacggagggaacttgcactgctttacggcgctgaccccttgtgccgtgctggatgtgatgggccctccctacaaccgtgctcaaggaagggattgcgcgtattacagcgaatcgccctactcgtgtgctggagatgcacaatattcttgggctcaaagaggttcacagcacatttgagatggaaggcataaagatggagcccaacttcatcgtctaatattaagcaggcatggcatggcatggcatcgtaataataatagtttcatgtagataatctctagctgcgggggtgtagtacaactggaagacggccagatgctcttttgacattcgtttgccttaatttcatatgcctccctttatgtatgttaacaattcgaatcttgggtcatggtcactttttttctgttttccctgtagacagcaggtgctgcttaaaaaaaaaaaaaaa

SEQ ID NO: 418 - DNA, 1046 bp, Zea mays
  misc_feature (910)..(910): n is a, c, g, or t
ctgagggcgggcatggccacggcggactccctcgcaggtagcggtagcaggctaaagggccagctgagcttctcgtcacggcaggggtcattgatgtcccagatctcagagatggacagcgaggaggtcggagggagcagcccagaggctgccggcggaggcagggggtacatccctgggtacccaatgggttctggttctgggtgggaggactcatcggcgctcatgtcagacaatttgtctggcctgaaacgcccccgggactcgtcggagcctggccagagccgcatcacgcaccagttcagcctgcccaagacgtcgtctgagatggcaagtattgataaattcctccagttccaggacgcggtgccttgtaagatccgtgccaagcggggatgcgccacccatccgcgcagcatcgccgagagggtgaggagaacaaagatcagtgagcgaatccgaaagctgcaagaactcgttccgaacatggacaagcaaaccaacacatctgacatgctagatttggctgtcgactacatcaaggatctccagaagcaggttaaggtgttaaaggagacccaagctaattgcacctgcccagcaagcaagagccagcagcactcttgctgaagccctgatgcacactatacatgacctgcagaactcgaaagcatcttcacttgggatagaaaaagatgtaagacagctctcatttttttttttgtgggtttgaactgtagcatttgaggcttatctaccagacagtgtgtagctttatatgagcacaggggaatggaacaatggcatcatcctcaagcattcaagtgatagggagaagggtaaaattggggagatatataggagaaacaactgtatagtttcgttgtagctttgctatatgtatactacnctttcggtataaagtggttaatttacccctattgctagtcgtagcagctgtaaatgtgccgcagataagttgtagaaaaacttggatgcgttcaatgcgagcgatagtgtttcgactctgaaaaaaaaaaaaaaaa

SEQ ID NO: 419 - DNA, 1083 bp, Zea mays
cggcacgaccccgagcaggcggcggcggcaggctaaaagggcaactgagcttctcgtcacggcaggggtcattgatgtcccagatctcagagatggacagcgaggaggtcggagggagcagcccagaggctgccggcggcggcagggggtacatccctgggtacccaatgggctctgggtgggaggactcgtcggctctcttgtcagacaatttgtctggcatcaaacgcccccgggactcgtcggagcctggccagagcggccttacgcaccagttcagcgtgcccaagacgtcgtccgagatggcaactattgagaaattcctccagttccaggacgccgtgccttgtaagatccgtgccaagcgggggtgcgccactcatccacgcagcatcgctgagagggtgaggagaacaaagatcagtgagcgaatccgaaagctgcaagaactcgttccaaatatggacaagcaaaccaacacatctgacatgctggatttggctgtcgactacatcaaggatctccagaagcaggttaaggtgctaaaggagagccaagataattgcacctgctcagcaagcaagaaccagcagcactcctgctgaaaccgtaatgctcactgtacatgacctcgaaagcatgtccactcgggaaagaaaaagatgtaagacagctctcatgcatgttgtttcatgaggttttgaactgcagcagttgagaggctttatctaccaggcactgtagcttttgtatgagcgaagagggatggagcaatggcatcaccaagcattcaagtgattgggagaagggtaaaaaaaagtggggagagatatatatataggagaaacaactgtatagtttggctgtagcttttctatatatacacacacgcactaccctttcagtagaaagtggttaatttacctatgttagagcatctccaagagaggctctaaacatggtcctattttaaatatagggctcaaaaccataaaacatccttccaacagcggccctattttataaaatttcatcaaatggttatagggctcggtctctcgggtcctaaatatagtactcata

SEQ ID NO: 420 - DNA, 532 bp, Zea mays
  misc_feature (529)..(529): n is a, c, g, or t
ccccccccccccccccccccggaacgacatagtggcggatgtgctgttggggaacgcacaagtcatcgtcagcaagacgaagaaagtaatgccatctccggagaagccgtaggcaaagaccgatcgtgtgaaggtcgagccggaggtcgaggtccaagcgggcgccgtccccagcgaagtgctctctctcatctcctcctccctctctcttgtggagacaattggactgccatcgttgcagccctacgcggcaacgcctaggtcgcccttagccacgacgagcaacactagcaaaccaacacatctgacatgctggatttggctgtcgactacatcaagggtctccagaagcaagttaaggtgctaaaggagagccaagataattgcacctgctcagcaagcaagaaccagcagcactcctgctgaaaccgtaatgctcactgtacattacctcgaaagcatgtccactcgggaaagaaaaggatatagcagatataggcacctgctgttacaaataattgcacagttnttg

SEQ ID NO: 421 - DNA, 1514 bp, Zea mays
attgcttgttattatgctcgttatcctagtagttatttgctggccacataactctccagtgctcaaagatgtctctgtaaacaaaccagataaccttgcttcagcatcaaacaacattcatcccaagcttgtgatcctccacatgaacatggccctctatgtatatgatgatataatgaggatgactgaaaatttgagcgaaaaatacattattggttatggagcctcaagtacagtctacagatgcgacctgaagaactgcaagccaattgcgattaaaaagctgtatgctcactaccctcagagcttgaaggaattcgagactgaacttgagactgttggaagcatcaaacaccggaatcttgtaagccttcaggggtactccctgtcaccatctgggaatctcctcttctatgattacatggaaaatggcagcctctgggacattttacatgcagcttcatcgaagaaaaagaaactcgattgggaggctcgcctcaagattgctctcggtgctgctcaaggcctggcttatcttcaccatgagtgcagtccacgaataatccacagggatgtgaagtcaaagaatatcctcctagacaaagactacgaggctcatcttgctgacttcggtattgccaagagcttgtgtgtgtcgaagacgcacacatcaacgtacgtgatgggcaccattggctacattgaccctgagtatgcacggacatcccggatcaacgagaaatcggatgtgtacagctacggcattgtcttgctggagctgcttaccggcaaaaagcctgtcgacgacgagtgcaaccttcaccacttgatcctatccaaagccgcagagaacacggtcatggagacggtagaccaggacatcaccgacacgtgcaaggacctcggcgaggtcaagaaggtgttccagctggcgctcctttgcagcaagaggcagccgtcggatcgaccgaccatgcacgaggtcgcgcgcgtcctggacagcctcgtctgcccagcaggcccgcccccgaagcaggcgcaggcgcaggcacaggcacaggcgtcggagaagccgtccaccacggcgccgagctatgtcagcgagtacgtcggcctacgaggcggcggcggcggcagcgccctctcctgcaccaactcgtcgagcgcgtccgacgccgagctcttcatgaagtttggcgaggtgatctcgcggagcacggaatagtccaatagatcgacgatcattttgtgttacagtttacaataggtgtctggccggcgccctgtgatgtgactcgctgtaaatatgctgctgccttctcgttgggactccactaggcactagtagctatttttctccgttatgcacgtctctctctttttttttgctgggaaactcgaactgtaactaaaggaatggatttatgtgcaggctgcgtttactcaaaaaaaaaaaaaaaaaaaaaaaaaaaaaaaaagggcggcaccccgcccccgagaaccggacgcgtggg

SEQ ID NO: 422 - DNA, 1116 bp, Zea mays
cttgagactgttggaagcatcaaacaccggaatcttgtaagccttcaggggtactccctgtctccatctgggaatctccttttctatgattacatggaaaatggcagcctctgggacattccgcatgcagccgggcatcgaagaaaaagaaactcgattgggaggctcgcctcaagattgctctcggagctgctcaaggcctggcttatcttcaccatgaatgcagtccacgaataatccacagggatgtgaagtcaaagaatatcctcctagacaaagactacgaggctcatcttgctgacttcggtattgccaagagcttgtgtgtgtcgaagacgcacacatcaacgtacgtgatgggcaccattggctacattgaccctgagtatgcacggacatcccggatcaacgagaaatcggatgtgtacagctacggcattgtcttgctggagctgcttaccggcaaaaagcctgtcgacgacgagtgcaaccttcaccacttgatcctatccaaagccgcagagaacacggtcatggagacggtagaccaggacatcaccgacacgtgcaaggacctcggcgaggtcaagaaggtgttccagctggcgctcctttgcagcaagaggcagccgtcggatcgaccgaccatgcacgaggtcgcgcgcgtcctggacagcctcgtctgcccagcaggcccgcccccgaagcaggcgcaggcgcaggcacaggcacaggcgtcggagaagccgtccaccacggcgccgagctatgtcagcgagtacgtcggcctacgaggcggcggcggcggcagcgccctctcctgcaccaactcgtcgagcgcgtccgacgccgagctcttcatgaagtttggcgaggtgatctcgcggagcacggaatagtccaatagatggatcattttgtgttacagtttacaataggtgtctgccgccctgtgatgtgatgtgactcgctgtaaatatcctgctgccttctcgttgggactccactagggactagtagctatttttctccgttatgcacgtctctctcttttttttgctgggaaaatcgaactgtaactaaacgaatggatttatgtgcaggctgcgtttactg

SEQ ID NO: 423 - DNA, 4595 bp, Zea mays
  misc_feature (596)..(596): n is a, c, g, or t
ggtgctaaaagagactaaaagtccataattatcttattgcacttatcttctcttcgtagtattcggttgtgagagcatgtatgtatgaacagctaatgttatgagtgtattccaagggtatttgagtctttaaacagtgtatttaatgattttagaatatgtttagtctctaataccaaacaggtagggactaagactaattgaaaccaaacacggccttagtcgtgtaagcgatttatgtatgttccgccgatcaaatgagctcgggcgtccaaacttatcggcctatgaagccatatagactacgcgaggcatggccggggcgagacgggcggcacgggcagcgaggcggcgagcgaattggacgagaggcgaggaatcggccacgcccagcgcctcggcatggctctggatcggtcgacgcagcccccgaccccgtcacctgtcggcgtcaaacagtgcagggatttggcatccgctgggcgctgtgctatgcactatgcagtgcagtggccggccgccttgcattggccccgctcaattcttccgcctctccaccacccactactacccacctttccctccccgattggccnccctccctaccatgcatgtagccgctacagtgctggcgcttgcagttgcagtcgcacctgcctgcacggacaccggagttgcgtgtgaggttgcgctacgccgccgccggcagcatctagctgcctatagctctacgtgtgcctatactagctagctacgtagtacatctattgtgaggtcaccggcactgctctccatgctgaccgccgtaggacgaatattatctccgctccctgaacatacgtcatcatagttcttatacatgcagccatatgtttgtaactgcaagaagtactacggtatgtctcctttctttttttttttcttcggccatgacaagccatggcccatgggatgaacagcaacagtctacgcacatacggatcgacgtgaggctgttcgctgccgtagctggatcaaagttgttcggattgttgctgtggtgtggctagattaaatctgtggttgactcgttcgtcatctcatagcgtagcatcactcgagaacgctaagcattgaggcggatcatggtgagcacggagcagtgctggcggtaacatgcatgaggccatgatcgacgctgaaggttgaacagatataactgtgactcattgagtcgtcgaaactggtgaccgggtggtattgagttgatttaaattcatattaagtcaaaatcattttcactccatttcagtactcttcaatccacatgaaattagaataaccgaacaatgactaaaaagatttaaccgagactgacgacctgggctcttcaacctcactacctcagttgactgaactactgaaggttatccatcgatcgctgaaaaaaaaaacaattaagacacggtgtttggttccagatgcacttacatgaacagaaaagctctacttatattagcacacccggcccattccgacgttgcacttgcacctgaacgtagttttctacgcattcagtccatacaggtcccttgagtcttgagcagcgaatcagcgaacgaaacagcaggtagcgcccgcggaatccaatcagcaacggcgtcttgtgtggcctcgtggatcgtgatccagcacgccgcgcgcaccgcaacgcccccgcgccgtaacaagcaccaccacttgctcgcacgcaccgcggcaccggtaaaatacgtgaccgccaccggcatactagtaccccgtgagctggcgctggctctggctctggctctggcagtccggctggcaggagagaattggcgagggattgggatcgggagcgaattcccagccagcccctgtctagagagggacaggccgcgcgcgcacgcacgccaccgcgttccattggccgcgtcgttgccatcacgccgacgactaaactagtcgatcacaccaagctcacaggctctcgatcgcctgtgatcgggctgccctgccgcctcttgctcccttcctcctctcgcccagcagcctagctacttgagcgagacgagctccagctgaggaagtgagaggtcgtggtccgagaggcgtgcgtgcgtggccatggacggcgccgaggacgacgggacggagtggatgatgcatggtgccggagggaagggaaaaggcggcggcgcgctcgacaagaacaagaagcgcttcagcgacgagcagaccaagtcgctggagtccatgttcgcgacgcaggccaagctggagccgcgccagaagctgcagctggcgcgggagctcggcctgcagccgcgccaggtcgccatctggttccagaacaagcgcgcgcgctggaagtccaagcagctggagcgcgagtactcggcgctgcgcgacgactaccacgcgctcctctgcagctacgagtccctcaaggacgagaagcgcgcgctcctcaagcaggtcagggatcaggatgatgcaaataaagctcatgcatcatgcatgccctccatcgatctcccatgcatctctcgttcgttcgttcgttcgcgcactgcactgcacgcgccccatgctgatctatatatatgtatgctcgatctcagatgatcatgcatatatgtccggcggttaattcattttgctagcttctcctaacgatacgccggtggttcttaattcaatgcgtttatacgtgtagctggagaagctggccgagatgctgcacgagccgccgcagggcaagtactacggcggcaatgcggacgacgtgcgctcgggcggcgtcggcggcacgaaggaggaggaggagtccacagacgcctgcgccggggccgcgctctactcgtccgagtgcgctggcggtggcaggttcatcgcgcacttcttggcggacgacgacgtgggagcagccctcttccggccgccgtcgtctccgcagccgaccgctggcttactcacgtcgtcggggccgccggagcaccagccgttccagttccactccggctactgctggccgtcgtcgtcggcggagcagacctgcagcggctcgcaatggtgggagttcgagtccctcagcgagtgacgtacgatgatcacaagcggccgggggtcactcggttccaagcacacgtaagggccgggccaatacgagttcgttcgtagcggtctcgtcactcgtcagctagccctgcagagcaacggtgtatgcatagcttcagtagatcgaagtccaggtccaggactgcccatcaagcagtttcttcttctcgccatcgatcatcagatcatgcatgcaaaagattttttttctctctcccttgctaccagatcatgtaatccagcaggaacatgtagagaaagatcaaacgaggttatagatcgagaaggtcgcctgcatatgcgagctagtctattcttttccaatgcatggctgctttcttcgttctttctttctcccaaagatagaagatagacagcaaacatgaaagtagagattacagaaggacgccgacgtggatggagattcttaaatcgagcaggggacgaagggaatcgaacagcgaggctcggtacagtacggggggaaggtacagtacagtacagggtggcacagatcacacaagtaacatgcatgcagccattcttttatgcagatgataaggcgcgttgtttatctaggtcaagccgaaacgcatttgttatatttattttaaatttgattgatacgagatctctagtagtgtagtttagcctggatcgcactcaagttacggaatgcaaacaaaaggtaacaacggcatgcaaggtgcaagcaaagcttgaatgggcgtcgatcgaaaaaaaaataggataaaatacgttttcaacgtccagcttatatattactgtatttcgatcgtaaaaactagacaaatttgatcctattgctggtatcaatagtggttttctctgttttataaaatagtaacattataatttatattgcatagaatccataaatggtttattttaaattagaaaaatacaaagtttgtaccgatttttttaataaaaaagtgttctctacctatttataatctatgaattgtttttttgaactgatttattcataattctattgtttttatattgctcgtagttgtgctcattatttatttcaaacaaataagagtcaaatgactccttataattaaaccacaccttcgaactactcgataaccaaatttatctggtttcgatagttagagtgcatagggttgaaaaatcacacttacatgcactagcaccaaaaaggaaatacatataaatacgataaaaaggtgtcattaattcttgatctgtgtcatttcagcgataaacaacgttctctctatacacacgtccatcggtgcggtggtataaagagaattaaatatatttttttttgtctttgaactagaagtgattatgacttatatactcagactgagggagtaattttttagacaactaaggccctgtttgggaacaaaagtttttgaaaacccacagtttttgaaatactacagtatactttagtcatgacaataccgcag

SEQ ID NO: 424 - DNA, 1293 bp, Zea mays
  misc_feature (1268)..(1268): n is a, c, g, or t
gccggccgggttcactgtaggaccggactgtctgcgcacgagaccagctcccaggctctcgatcgcctgtgatcgggctgccctgccgcctcttgctcccttcctcctctcgcccagcagcctagctacttgagcgagacgagctccagctgaggaagtgagaggtcgtggtccgagaggcgtgcgtgcgtggccatggacggcgccgaggacgacgggacggagtggatgatgcatggtgccggagggaagggaaaaggcggcggcgcgctcgacaagaacaagaagcgcttcagcgacgagcagaccaagtcgctggagtccatgttcgcgacgcaggccaagctggagccgcgccagaagctgcagctggcgcgggagctcggcctgcagccgcgccaggtcgccatctggttccagaacaagcgcgcgcgctggaagtccaagcagctggagcgcgagtactcggcgctgcgcgacgactaccacgcgctcctctgcagctacgagtccctcaaggacgagaagcgcgcgctcctcaagcagctggagaagctggccgagatgctgcacgagccgccgcagggcaagtactacggcggcaatgcggacgacgtgcgctcgggcggcgtcggcggcacgaaggaggaggaggagtccacagacgcctgcgccggggccgcgctctactcgtccgagtgcgctggcggtggcaggttcatcgcgcacttcttggcggacgacgacgtgggagcagccctcttccggccgccgtcgtctccgcagccgaccgctggcttactcacgtcgtcggggccgccggagcaccagccgttccagttccactccggctactgctggccgtcgtcgtcggcggagcagacctgcagcggctcgcaatggtgggagttcgagtccctcagcgagtgacgtacgatgatcacaagcggccgggggtcactcggttccaagcacacgtaactggccgggccaatacgagttcgttcgtagcggtctcgtcactcgtcagctagccctgcagagcaacggtgtatgcatagcttcagtagatcgaagtccaggtccaggactgcccatcaagcagtttcttcttctcgccatcgatcatcgatcatgcatgcaaaagatttttttttctctcccttgctaccagatcatgtaatccagcaggaacatgtagagaaagatcaaacgaggttatagatcgagaaggtcgcctgcatatgcgagctagtctattcctttcncaatgcatggctgctttcttcgttc

SEQ ID NO: 425 - DNA, 808 bp, Zea mays
cctcgaggccggccgggaggccgcgtgcgcacgccaccgcgcttcattgccctcgccgccgccagcccgcccggtaaactagtcgatcgatcgcccagctcgcctgcctgtgatcgaccgggtcgctgcctccgatcctcttgctgcccagcaccctggctacttcagccagctagccaggttgagaccgactagctcgatctagctgctgaggcgtggccatggagggcgacgacgacggcccggagtggatgatggaggtgggcggcgcgggcgccacagggaagggaaaaggcggcgcgctggacaagaacaagaagcgcttcagcgaggagcagatcaagtctctcgagtccatgttcgccacgcagaccaagctggagccgcgccagaagctgcagctggcgcgggagctcggcctgcagccgcgccaggtcgccatctggttccagaacaagcgcgcgcgctggaagtccaagcagctggagcgcgactactccgcgctccgcgacgactacgacgcgctcctctgcagctacgagtccctcaagaaggagaagcacacgctcctcaagcagctggagaagctagccgagatgctgcacgagccgcggggcaagtacagcggcaatgcggacgccgccggcgccggggacgacgtgcgctcgggcgtcggcggcatgaaggacgagtttgcagacgccggggccgcgccctactcgtccgagggcggtggcggtggcaagttcgcgcacttcacggacgacgacgtgggagccctcttccgggcgtcgtctccgcagccgag

SEQ ID NO: 426 - DNA, 1244 bp, Zea mays
aaacggacgcagattgccgttcatgatccggctctttaaaataacgcagtagaaacggagagcgatctgaacacggtctgcagatttcaacgaggtgtggtgtgagcgcgatgagcgttcatggcccgtaatccgacgggatatccgacatttgtgccgtatccagcgcatgccgacaatccgtccggagatccctctccctctctctcatggcattcatgttttaaaccaaccaagccgcctctgctgctccgatccgtctccctctgttccagcagtcaggatggaggccgccgcaacacttccgccgctgctgctcctcatcctccttgctgcgactgcggtgccggctccgtcgcacgcatggggagtcgacggccatctcatggtctgccagatcgcacagggccgtctgagtggcgcggcggccgcggcggtgaaggacctgctgccgtcctacgccggcaacaacctgagcagcctctgctcctgggcggacgacgtcaagttcaggtacccctggtcgtcgccgctccactacatcgacacccccgacggcctctgcacctaccgctacgacagggactgcaaggacgaggacggcgtcgagggccggtgcgtcgcgggcgccatcaacaactacacctcccagctcctcgcctaccggagatcttcacccactgagtataacctaacgcaagcgctcctcttcctctcgcacttcatcggagacatacaccagccacttcacgtggggttcacctccgacaaaggagggaacaccattgacgtccactggtacacaaggaagactgttctacaccatgtttgggacgccagcatcatccagacggccgaagatgacttctacggcgacagcgtagccgggtatatcgacaccctgaagaaaaatataacgcagggagaatggtcggagcaagtgtctagctgggaagcgtgcggtacgaaccagactgcatgtccagacatatatgcgtctgagagcgtcgctgcagcatgcgactgggcgtacaagggagtcgaggaagactcaaccctacaagatccctatttctccagcaggctgccggtagtcagcctgaggctagcgcaaggcggcgtcagattagccgccactctgaacaggatttttggataatggtggagtacatttactatacatggaactattatggaattaaatgatatatataactattggtttcccaaaaaaaaaaaaaaaa

SEQ ID NO: 427 - DNA, 1199 bp, Zea mays
  misc_feature (27)..(39): n is a, c, g, or t
cctcgaggccggccggaaaaaatttcnnnnnnnnnnnnnaaaaaaaaaaaaaaaaaaaaaaaaaaaaattgaatagcttgggtacctccaagcagctattcattcagctatcacaaaagaaaaaaaaaaaggccgcgacgagccgacgagcaacgacgaccatggcgacgatggccgcttcttcctgccacgggcaacttctcctgtttctcctcgtggccgtcgcgtcggcctgcctcggctccgcggcagcgcatcaagccggatctggagagggctacacgatcgctggccgcgtcaagatcgatggcacgagcgtgaagggctttggtcttgcaacaaagacatcaaacacaaaagtgatacttaatggcggccagagggttacatttgccaggccagacggctactttgcattccacaacgtgccagctggaactcatctgattgaggtctcctcaattggttacttcttttccccagttcgcgtagatatcagtgcaaggaatcctggttatattcaagcagcattgactgaaactagaagagttctaaatgagcttgtcctggaacctctgaaagaagagcagtactatgaggttagggagcctttctccgtcatgtcacttttgaagagccccatggggttgatggttggttttatggtcttaatggtctttgtgatgcccaagatgatggagaacatagatcctgaggagatgaagcaagctcaagaacaaatgaggaacaaccccgtatcattgtctggcttgctagccagagcgcagggctagaagtagcacatgaggatgctgcaagggtctagattctataatgtgtttaagggcagtactgaagtgcttgacatgccatgtcactcggagtaatttcctggggacaaggtggaaactctttcccctgtttttactgtattttaacttgcagtttttctgttagggcttgttcggttattttcaatccatatgtattggaggggattgatacggattggaggggattttgactttgaatccccctcaatccatatggattggggcagaaccgaacatggccttatgtagaaccttctgaaacctctagctgagctagtcatttggcacatcatataaccacacattgagatattcttgttcaatttgtattgtatgaatcagctgaatctaacacattgattagtc

SEQ ID NO: 428 - DNA, 1178 bp, Zea mays
ttgggtcccgcgccatccgtcacatcacaaaccgaaaaaggccgcgacgagccgaccagctctactgcccccttccggccttcggcgaccgtgacgagcaacgacgaccacggtgacgatggccgcttcctccctctgccacgggcacttgctcctgtttctcctcgtgtccgtcacatcggcctgcctcggtaccgcggcggcgcatcaagccgggtctggagagggctacacgatcgccggccgcgtcaagatcgatggcgtgagtgcgaagggctatggtcttccagccaagacatcaaacacaaaagtgatacttaatggcggacagagggttacatttgccaggccggatggctactttgcattccacaacatgccagctggaactcatcttattgaggtctcctcaattggttacttcttttcccctgtccgagttgatataagtgcaaggaatcctggatatattcaagcagcattgactgaaaccagaagagttctgaatgagcttgttctggaacctctgaaagaagagcagtactatgaggttagggagccgttctccgtcatgtcacttttgaagagccccatggggttaatggttggttttatggtcttaatggtcttcgtgatgcccaagatgatggagaacatagatcccgaggagatgaagcaagctcaagaacaaatgaggaacaaccctgtatcattctctggcttgctcgccagagcgcagggctagagaagtagactgtagacatgaggatactgcaaaggtcaaacattctagaatgtgagtaagagcactattgaagtgcttggcacgtcactcactcggtgcaatttcctggggacaaggtggaaactctttccccctgtttttaccgtattttaagctgtaatttgtctgcggtgtagaaccttctgaaacctctaactgagctagtcatatggcacattagcatataccacagattgagatattttgtacaaaaaatgcaaaatgaatcaggtgaatcttttacaccttagtcatcatcagaccacggcggcctgtggacatttttagacttgtgtagtgatgcgtcagagacctcgccaggatggacagagggatacccatttcctctggggcaacataatctatgcacccatgcaaatttgtgcacttatgc

SEQ ID NO: 429 - DNA, 1190 bp, Zea mays
  misc_feature (1171)..(1171): n is a, c, g, or t
aaaccgaaccgaagtgcaaccatccgtcacatcacaaaccgaaaaaggccgcgacgagccgacgatctctactgcccccttccggccttcggcgaccgtgacgagcaacgacgacgacggcgacgatggccgcttcctccctctgccacgggcacttgctcctgtttctcctcgtgtccgtcacatcggcctgcctcggtaccgcggcagcgcatcaagccgggtctggagagggctacacgatcgccggccgcgtcaagatcgatggcatgagtgagaagggctatggtcttccagccaagacatcaaacacaaaagtgatacttaatggcggccaaagggttacatttgccaggccagacggctactttgcattccacaacgtgccagctggaactcatctgattgaggtctcctcaattggttacttcttttcccctgtccgagttgatataagtgcaaggaatcctggatatattcaagcagcattgactgaaaccagaagagttctgaatgagcttgttctggaacctctgaaagaagagcagtactttgaggttagggagccgttctccgtcatgtcacttttgaagagccccatggggttaatggttggttttatggtcttaatggtctttgtgatgcccaagatgatggagaacatagatcccgaggagatgaagcaagctcaagaacaaatgaggaacaaccctgtatcattctctggcttgctcgccagagcgcagggctagagaagtagactgtagacatgaggatactgcaaaggtcaaacattctagaatgtgagtaagagcactattaaagtgcttggcacgtcactcactcggggcaatttcctggggataagaaggaaatcctttccccctgtttttaccgtattttagggctagtttgggaacaccaatttcccaaaggatttatattttcccatgggaaaatgaactaatttcccttgggaaaatgaaaatctcttggaaaattggggttccaaactagcccttaagttgtaatttgtctgcggtgtagaaccttctgaaacctctgagctagtgatgcgtcagattgagatattttgttcgaaaaaaaaaaaaaaaatcaggtgaatctttgaccccttgcttagtcatcacgaaaaaaaaaaaaaaaaaanctcgaggggggggcccggt

SEQ ID NO: 430 - DNA, 1048 bp, Zea mays
ccggccgggagatcgaacagaagcgcagtcatccatcagctattcagctatcacaaaagaaaaaaaaagggaaagggccgcgacgagccgacgagcaacgacgaccatggcgacgatggccgcttcttcctgccacgggcaacttctcctgtttctcctcgtggccgtcgcgtcggcctgcctcggctccgcggcagcgcatcaagccggatctggagagggctacacgatcgctggccgcgtcaagatcgatggcatgagcgtgaagggctttggtcttgcaacaaagacatcaaacacaaaagtgatacttaatggcggccagagggttacatttgccaggccagacggctactttgcattccacaacgtgccagctggaactcatctgattgaggtctcctcaattggttacttcttttccccagttcgagtagatatcagtgcaaggaatcctggttatattcaagcagcattgactgaaactagaagagttctaaatgagcttgtcctggaacctctgaaagaagagcagtactatgaggttagggagcctttctccgtcatgtcacttttgaagagtcccatggggttgatggttggttttatggtcttaatggtctttgtgatgcccaagatgatggagaacatagatcctgaggagatgaagcaagctcaagagcaaatgaggaacaaccccgtatcattgtctggcttgctagccagagcgcagggctagaagtagcacatgaggatgctgcaagggtctagattctataatgtgtttaatggcagtactgaagtgcttgacatgccatgtcactcggagtaatttcctggggacaaggtggaaactctttcccctgtttttactgtattttaacttgcagtttttctgttatgtagaaccttctgaaacctctagctgagctagtcatttggcacgtcatataccacacattgagatattcttgttcaatttgtattgtatgaatcagctgaatctaacacattgattagtcatcgcgccaagccggcacacaggttt

SEQ ID NO: 431 - DNA, 2323 bp, Zea mays
gtgacattctataattttttggagcgagctggagggctcgagctgagaatattcccgatctagagttgcttccctcggtccgctcgtccatcaaacacgaaatagaacgactttattccacctcacttcttatctaaacggattcttaaatttataatgcacgtaaaacaagtagagaagagataagaggtaattagagataaagatgtattggtaaaatgaaaagatatattggcagcacaagataaaggtgcattgacagagagagacataataccaactattctgggactggatttagatcctacgatattttattttttttttcagatgaagacatcaattggttcgggacacagagaataaataattatttttgaggggccaactattttgagactaaatttgagtcattcaacgtttgataggaaagcgtcatctattttagcatagtagagaacaaacagtagcttcaggacaggttaattattatgagacaaaggagctaattattttagaaaagagagtgacaggctattttaggacataggttaattattttgagaggaaggcgtcaaggatagagaataagcagttattttaggagagagagagagagtaaacagtttcctgttcctggtcaaccgtacttgcgtgctatcgaccgtcggattcttccaactttggagtggtggaaccgtccaagcatttccatccttttttcacggtccataattcatcaagatattctttttttgagcagtcacagtcacgtcactgggtcagcgtccttccgtcggccacatgtgtcactgtcatcgcccatctccatccacgcaaccatcgttgcattattatctgtctttctggctttactgtttatcattttattaatataattaataattaatataataacgttatatacttgcttgcttatttgcttttgctcccggcccccgccccaaatttttttttttttttttgtaggaagaatccatctccagattttttttttgatcttcttctccccttgctctgaaccttcctcccaagttttttccacgccccctgttttttcacccttctaaaaactttacatccaggtcaaaaaaatgggtgcccgctcgctaaggttagccaacaaaggtaaaaataaaaaaaaggaaggctaatcgactggctgcggctgcctgggccctggggatggccatcagacggcgggcatggtctcgtggcgcagggccgcgagatccgacgggccacacgcgtcgtcgccgccgaacgcgaagaggccggcgccgaagccgtcgtcgtcccacgcggcggcggcggcggaggcagcggccgcggccgcggcctccggcgagtagccgccgaagccgcctccgtccacgatctcgtcctcgaagccccagatctggccgtcgagcgcgggcgggaacggcgcccccgcgcgcccggcctcctcctcctccgaagaggaggcgggcggcagccccagctcgtcgtccgaggcttcgagcaggaagcccagctccggcgccggcgcctccgcggcctcgtcgaagctggctatctcctcctccaggctccgcatgaccgacgctaggtcgccggccgcggccgcgtcggtgtcgtcctccagcatgtcgagcaggtcctgcggccgcagcctcttggcgtcggcctgcggcgagccctcctctccgcagccgccggcgacgaggtcgcccgcctcccgcgcccgcttgtgagaagagttctccatggaacgagctcagaggaaagggggatgacttgattttttctctctctctctctgtctctctctatttccttgctcctccctctcgctgcgttcgcgtacgccgagcaaggcaaggcacaagccagccaggcgagcgagcgtgacgaaggcgataacgcgagggcagagacgcaagagtacaaaaggcgaggtgttttgcgcgcccgccccctgttgggggggccggcttatatagccctgcccgtggtgggtggctctgcggacgacgtttctcgcagggggtttgccgcaaaaatcgctcgcgcggtttggtttggtctggtctggtgcggtggtggcggtgcagccagggagtagtactactgcttgttagcttatcttttgctagctttttctttatttggttgccggttgggggctgcgcgcgccgcgacgaacggacacggacacggacacggacggacggggactgtgatgggtgcgcgcgcgcctggctgaggcaccgcacgccatctggaaggcggaaggcccggccgggtcgcgtggccgtgg

SEQ ID NO: 432 - DNA, 3007 bp, Zea mays
ttccccatatttttatactcactccattcataaatatatgacactgttgatttttttttaaaatttttttactacttctcttattaaaaaataatgagttatcatttattttttgatttgttttatcacttaagttagtttgtgtttgacttaaaattttacatttttaaataatattttgaataagatgagtggtaaaagtttttgaagaaatcaatgatgtcgtacggagatattatttttttaaaaaatgaacaaaataaaaaaacggctgaaaaaccttttctagtccaggcttgggaccctcgagaaagccggccgggttctggtggttttcgaacggtttttgaaacccttgctccagtgcgtcgtcagccgcgtcgccctccgcggcaatggagtccgacaccgagcgagacgtccacaactcctcccgctccactaaccctagcggccaccaccagcgaccgcttcggttagtcaagtctacggcgttcaagcgggaggagcgccgcaagcgcaaggaccgcaagcggcagaggcacctcgttgacgagctcgtgcggtggcaacctctcggcgccccgacgcccctcccagccgccaccggatccgtgtccccctcccaagcgcagcccgatacgccttggccgtgtgacccgccgccgcctccggaccccgcggaagccgactcctggagctggggcccgcccgccgtaccctcgccgacgccgacgcaacccacagtcgacgtggcgggcgcggtccccttgcaccctcaggtcgtcgccgtaaggtcctgccgcgcgttcttcgaatcgcagttcgaagaggacgacgaggaggagaacgagggcagtgcggctcgattcttcagcgagctgctgggcagcgacgcggcgctgagggggttctacgaggcggagcgggacaaggggcacttcctgtgcctggtgtgcgaggggagcggcgccaggctgggcaagaggtttgccggatgcgccgcgctcgttcagcacgccgggtcgatcgcccggaccaagtggaggctggcgcaccgcgcgttcgccgactccgtcggcctgctgctcggatggggcgcaggccggattgctcctccgccggtaccgccaccggtaagcattatcatgttctctcgtggccccgcgcccctgaatatgtgctcgtgtgccagtcggccagattgctcaatggtttggcgtttatcttctgcaatgcaggcagattctgacagcgacggttcttttgatcaagtaggcagctctcagatggtagaaatggagctgtcgtgaccccgcatgcctgcagtctactgcaacaaggtttgtagttttctcgtaactacgcgttgttacagagtggagactgatcaggatggaaacagtggctagcatggtttaatcatcttgacctcaataatcatcacattgctgcatatctgatactatctcgacctgatgggctggggttgctgccttgctggtttacttttgttctattttggtgtccggttattatgccgcatatctgaaatcatcatcctcgatttttccgactggagcaataagctggaagttcttcacagagccaaccataacccgaccatgaacattcaaacaccagcaccgcagatcctcaagcgaacgtggtgctttaatgtacagaaccattgtggtgtcgacgtgtcgtcatttacagggcactggataccgcagtgtattcttctcgatcctcttcaggacacttctcccgtttcaacattaccgaatgggtctgtctgtttgtttccttgcaaaccacggtctgtatcagctgattggcaccttcatcatattgtagctgcagagcattagtgaacctttgttctcgtgaagtcagacctgaaagcaggttgctctatcaatgaaggttttgggcacctcgtcagcttaactccgtgcggtctggttctcatatctgagccaggctggccagaagcgaaacaatcattcactgacgaagcagctctaatgaagacagtatacggtcagtggggcctcaccttataaacagaaactcttgagaagggtttttggaaactgggaggttcgattagactttttgggtttcgaaagcccgagatgatattatgggatgtttggtttggataaaaccctaggtgcatttacgaacacttaaactcgttatccatatagagacaaggcatgaaaatgcaattgattacgaacattttagaaactaatatttttcattctctaaattgacaagcacttaattaaatcctgacaaacttttataaaaatactaaaaccataaattttatttaatgtttttatttacaatataaaatagaaatgttaggatatgaatatgcgataacaagatgtattcttagtgggcataggcccataagctccacattcaatacgggccacacgtgggcggtctttttttttttcgtctggcgtggcgtgggtctctggatgagtgtggaatacggcccgtctcgtctcagacttttggattttgggtgtttggcacgaatgcacgatggcaggcgcgctgtccaccacctatggttctaccaacacaccgcgatggactcgtggttcgtgaatacaatatgcttacactcggattttttgacgctagcggagcatgcgaaaaaagagagaggatatgtttttgttttgcgacttgtgagagatcccgtcaggctgtcacatatacgagacagtgatttaagtgatgctcttagggagtgtttgttgaaggaatcactccgtctaaatataggtgatgtatcatgagtttatttctcaaatttagtgagatgacttaattcctcgtattagtactaactaattatgaggaatgagatgatgatagatcaactcattctatttcacaaatcaaacaaaaacaacgagtagaagatgataaactagtttattgttctaaccaaacaccctattagtgctcaaaa

SEQ ID NO: 433 - DNA, 2426 bp, Zea mays
gcggtctgctcaagaagtacttgacaaagttgctcaagagactccgaattttggaacagaacaggataaggcccattgtccgtttcatctcaagacaggggcttgtcgctttggattgcgctgcagcagagttcacttttaccctgataaatcaatcacattgctaatgaaaaacatgtataacggtccaggccttgctttggagcaagatgaagggcttgaggtttgttagaggaaattctctaatgcataactttgtatccttaaactactgtttatttacgtttaaggatgctcaattttggtttcatgggcagtgccattttaagttgtgatagtttaatactaaagcaagctcatgtcaaaataacaagtattccactttaagcttgtaagcctttataagaagacatgagtataaataactgactacttggaaccatttgaatttttttaatctactgctcaagataactcttaccccaagttttccttggctactatcagactcgcgacagattgcatgttctttcgtgttatcttcagaacttcgacttgaggcatacagtgatcagaccagttgatttcacttgattgaggacgtcttgaactttgatctgctcatttcacagatgaagagattgaacaaagctatgaagaattttatgaagatgtacatacagaatttctgaaatttggtgaacttgtgaatttcaaggtatgtagaaatgggtctttccatcttcgagggaatgtttatgtgcactataaatcgttggattcagctcttcttgcctacagcagcatgaatggacgctattttgctggaaaacagataacatgtgaatttgttgctgtgacaagatggaaggcggccatatgcggtgagtacatgaggtcaagatacaagacatgttcacatggagttgcttgtaattttattcactgcttccgcaatcctggaggagattatgagtgggctgattgggacaatcatcctcctagatactggattaggaagatggttgctctttttggtccctcagttgatgagatgaatgaaaaggcgagtcataccccagattttagaagttcagtgggctctgataggaagaaacttaaaatttcctgcaacagatatgtttcaagaggatctaggaacgaagatgtgcatacacgacactctcctcaagattattcacattctaagcaagaacgaagtagccacaacatgaattatgagtacagacgacataaaagagattcttcagcagcagataagcaccgaagacaagatgttggagatacaaatgacagacaattttcaacaatgggaaatgacagcaagtcccataggcataagcatgaagaacggcatagaagtgatcatggtaatggagaaaaagaagatgacagcaaaactaggcctaggaagcactgttctgttaggcgtggaagtttggaggttggatattctgactggtctccagacttcactggtacagacatcagcaagggcccttcaggtgagaagtccactagcaggtatgatgatgccaaagggagcaggaggggatcatcagagtattacaatcttgaaagacaccactctacagctcaaaaacaatcaagaaatgagcacagcactacaagacgcaggagacatgacattgaagattatcatgatgaaaaaaatgacggaagaggggaatcccgaaagcataaccgccatgaatcaaacgaccggtgggtagccacaaatagtgatgttgattcggatgtagatagatatcagagttcaagctgtaaaggcactaggctgggaaggaaggatgatgatccaggcattgaagttcggcatcagaggtcaggtagaagtacgaaggatgacaagagaaggaagcatcacagtggaaacaggtggcacagcggcactgaagagggtacctcagattcaagcggtggagatttgagctctgattcgtggagtggtagatcgagaaacagtgagaacttttcagcacacaggtcaaggaggaagcgaagtcggagcaaggagtctggttagttgtaaatagttagcctctttttggagcacatgaattcgtaggaatcgtgcagaaattttacaggaatcggtttaacttcgcacgaaaaatttcccgcactccagaacatgcggtagtggcttcttgatattctactgtatgctttcaccgtttcgcttacaagttctgttactgtacactgcggtagtgcggttcatagcattgctcaattccggacccgttctcaagcgtctggctatgttaatacaggtattatttccgtgctatacctttcagaattttgatctcgatgaataacctcactggtaaaaaaaaaaaaaaaatcgctttggtttgtctaccggcagcacgcagcag

SEQ ID NO: 434 - DNA, 777 bp, Zea mays
ctagccggccaaaccactttcctggtggtggttcgtttctgatctctgagagtccgcccccctaaacaccgcttgggctatcccgaaccctaaccccgaccgccgcgccagctactcccgtttcgtcctcgcggtattcgcggcgttttctcccactgctcgaaccgcgccgacgagcgacgacaagagctgctctattcttcaaaacaaatggcgaccgttccagttaacccaaaaccttttctgaacaacctgacaggaaagcctgttattgtcaaactcaagtggggtatggagtacaagggttatcttgcttctgtggactcatatatgaatctccagcttgccaacactgaggagtacattgatggtcaattctctggaaacctgggagagattctgatcaggtgcaacaacgtcatgtatctccgaggcgttccagaggatgcagagatagaggatgcagagtgagaagatgcgatcaatgttagattgataaatgtaatatggttctgacatctatgttcgaatatgccggtgacaagtagatctatcggatcgctttgttctcttgagtgatgaaacatgatggcggtcgggctaagggtgaagctgctttcagttagactatgctgtcattctgctgaatatatatcagatttcttgaacaattcttcttgcctcattgcctactatcacggattaagttatatcagggaaaaatgaccggctcttttttttttcccgttgaaaaaaaaaaaaaaaaaccgccccgcc

SEQ ID NO: 435 - DNA, 794 bp, Zea mays
gcacgtcgtggcgcctcgacgatctctgagagtccgtcctccctaaacaccgcttgggctttcccgaaccctaaccccgacctccgcgccagctactcccgtttcgtcctcgcggcgttcgcggcgttttctcccactgctcgaaccgcgccgacgagcgacgataagagctactctattcttcaaaacaaatggcgaccgttccagttaacccaaaaccttttctgaacaacctgacaggaaagcctgttattgtcaaactcaagtggggtatggagtacaagggttatcttgcttctgtggactcatatatgaatctccagcttgccaacactgaggagtacattgatggtcaattctctggaaacctgggagagattctgatcaggtgcaacaacgtcatgtatctccgaggcgttccagaggatgcagagatagaggacgcagagtgagaagatgcgatcaatgttagattgataaatgtaatatggttctgacatctatgttcgaatatgccggtgacaagtagatctatcggatcgctttgttctcttgagtgatgaaacatgatggcgtcgggccaagggtgaagctgctttcagttaggctatgctgtcattctgctgaatgtatatcagatttcttgaacaattcttcttgcctcattgcctactatcacggattaagttatatcagggaaaaatgaccggctcttttttttcccgttttgagaaaacaatggtctccgttgaaactgcattgttgtagattatatatatatatatactgcgttg

SEQ ID NO: 436 - DNA, 746 bp, Zea mays
gcccgccggtggttcgtttctgatctctgagagtccgccccccctaaacaccgcttgggctatcccgaaccctaaccccgaccgccgcgccagctactcccgtttcgtcctcgcggcattcgcggcgttttctccctctgctcgaaccgcgccgacgagcgacgacaagagctgctctattcttcaaaacaaatggcgaccgttccagttaacccaaaaccttttctgaacaacctgacaggaaagcctgttattgtcaaactcaagtggggtatggagtacaagggttatcttgcttctgtggactcatatatgaatctccagcttgccaacactgaggagtacattgatggtcaattctctggaaacctgggagagattctgatcaggtgcaacaacgtcatgtatctccgaggcgttccagaggatgcagagatagaggatgcagagtgaggagatgcgatcaatgttagattgataaatgtaatatggttctggcatcaatgttcgaatatgccggtgacaagtagatctatcggatcgctttgttctcttgagtgatgaaacatgatggcggtcgggctaagggtgaagctgctttcagttagactatgctgtcattctgctgaatatatatcagatttcttgaacaattcttcttgcctcattgcctactatcacggattaagttatatcagcgaaaaaaaaaaaaaaaaaagcggcctaaaaaaaaaaaaaaaaaaaaa

SEQ ID NO: 437 - DNA, 797 bp, Zea mays
ggaggtcccccgccccccgggcggggcccgcaaaaccctaatcgtgaccgccgcgccagcgccagcaactgaagtttcgtcctcgcggccttctctccctccactcgaaccgcgccgacgagcgacgacaaccgttgctgcattcttcaatggcgactgtgccagttaacccaaaacctttcctgaacaacctgacggggaagcctgtaattgtcaaactcaagtggggtatggagtacaaaggttatcttgcttcggtggactcctatatgaatctccagcttgccaacactgaggagtacattgatgggcaattctctggaaacctgggagagattctgatcaggtgcaacaacgttatgtatctccgaggcgttccagaggatgcagagatagaggatgcagaatgagaagatgtgaatgtaatttgattctgacatgtatgtttgaatatgccggtgacaactagacctatcggatcttagttatgatcagtagggcttgaggtgctgttcaaactgctttcagttggactatgttgtcgttctattgaatgtgaggaatatcagatttccttgaaaaaaaaaaaaaaaaaacaaaaagccaaaaaaaaaagcccccctccgccagccactccaaacacttgcgccgccactgcctcacaggtaaggccgccatggtctccggttcgggcgtgtgcgcgaagcgcatcgtggtggacgcgcgccaccacatgctgggccgtctctcctcgatcatagccaaggagctgctcaatgggcagaaggtggtcgtcg

SEQ ID NO: 438 - DNA, 760 bp, Zea mays
tctgccgagttcccactactctctggtggcggttcgtccctgatctccaggaggtccctgtaccccgcttgggctcccctaaaccctaatcgtgaccgccgcgccagcgccagcaactgaagtttcgtcctcgcggccttctctccctccactcgaaccgcgccgacgagcgacgacaaccgttgctgcattcttcaatggcgactgtgccagttaacccaaaacctttcctgaacaacctgacggggaagcctgtaattgtcaaactcaagtggggtatggagtacaaaggttatcttgcttcggtggactcctatatgaatctccagcttgccaacactgaggagtacattgatgggcaattctctggaaacctgggagagattctgatcaggtgcaacaacgttatgtatctccgaggcgttccagaggatgcagagatagaggatgcagaatgagaagatgtgaatgtaatttgattctgacatgtatgtttgaatatgccggtgacaactagacctatcggatcttagttatgatcagtagggcttgaggtgctgttcaaactgagaaggaatatcacgaattatttgaatgtgaacttgcacgatgtattagacgttatatcaatgcaaaacaatcggctctggttgctgagatcatcaaaaaaaaaaaaaaaagaggctcgttttaaagaggcggaagagggggggggtgtcaatgcctgtatcatgaaaccttttaccgacccataccaaaa

SEQ ID NO: 439 - DNA, 695 bp, Zea mays
aactactttctgccggcggttcgtccctgatctccaggaggtccctgtaccccgcttgggctctcctaaaccctaatcgtgaccgccgcgccagcgccaggaactgtagtttcgtcctcgcggccttctctccctccagtcgaaccgcgccgacgagcgacgacaactgctgctgcattcttcaatggcgactgtgccagttaacccaaaacctttcctgaacaacctgacggggaagcctgtaattgtcaaactcaagtggggtatggagtacaaaggttatcttgcttcagtggactcctatatgaatctccagcttgccaatactgaggagtacattgatgggcaattctctggaaacctgggagagattctgatcaggtgcaacaacgttatgtatctccgaggcgttccagaggatgcagagatagaggatgcagagtgagaagatgtgaatgtaatttgattctgacatgtatgtttgaatacgccggtgacaactagacctatcggatctttatgttgtcattctattgaatgtgaggaatatcagatttccttgaaacaaaaaaaaaaaaaaaaaaaaaaaggaccaacaacaattcaaattatagattttttttagatacgaagctttatgtctagtaaagccaaaacgtataatctggagtggagggaatatcacgaattatttg

SEQ ID NO: 440 - DNA, 754 bp, Zea mays
ggccctttccactactctctggtggcggttcgtctctgatctccaggaggtccctgtaccccgccggtcccctaaaccctaatcgtgaccgccgcgccagcgccagcaactgaagtttcgtcctcgcggccttctctccctccactcgaaccgcgccgacgagcgacgacaaccgttgctgcattcttcaatggcgactgtgccagttaacccaaaacctttcctgaacaacctgacggggaagcctgtaattgtcaaactcaagtggggtatggagtacaaaggttatcttgcttcggtggactcctatatgaatctccagcttgccaacactgaggagtacattgatgggcagttctctggaaacctgggagagattctgatcaggtgcaacaacgttatgtatcttcgaggcgttccagaggatgcagagatagaggatgcagagtgagaagatgtgaatgtaatttgattctgacatgtatgtttgaatatgccggtgacaactagacctatcggatctttatgttgtcattctattgaatgtgaggaatattagatttccttgaaacagtttctcttgcctcattgccaactacctccctcgtttcaaattaatagtttttttagatacgtagctctatgtctagtaaagccaaaacgtatactctgtagtggagggaatatcatgaattatttgaatgtgaacttgcatgatgcgttagacgataaaaaaaaaagaaaaaaagcggcc

SEQ ID NO: 441 - DNA, 1359 bp, Zea mays
ttcctcctcgccacgcattgcctgtccacgcacggcgtgtacgcccgcgtggcccacgagctggagccgttcgaggtgccgggcttcccggtgcgcgcggccgggaacgtggccacgttccgcggcttcttccagtggccggggatggaaagctacgagcgcgccctcgcggcggccgaggccaccgccgacggcctgctcatcaacacgttccgcggcctcgagggcgtcttcgtcgacggctacgcggcggcgctcggaaggaagacgacggcgacgtgttgggccgtcggcccgacgtgcgcctcctcctccggtggcctggacgcgggcgcgacggccgcccgcggcaaccgcgccgacgtcgacgtcggcctcctcctgtcgtggctcgacgcccgcccggcggcgtccgtgctgtacgtcagcttcggcagcctcgcgcagctgtcgctgaagcagaccgtcgagctcgcccggggcctcgaggcgtccgggcggccgttcgtctgggccatcaaggaggccaagtccagcgccgacgtgcgggcgtggctgctggccgagcggttcgaggagcgcgtccgggacaggggcctcctcgtccgcgggtgggcgccgcaggtgaccatcctctcgcaccccgcggtgggcggcttcttgtcgcactgcgggtggaacgcctcgctggaggccatcacccacggcgtgccggtgctgacgtggcccaacttcgccgaccagttctgcagcgagcggctgctcgtcgacgtcctcggcgtcggcgtcaggtccggcgtcaagctgccgcccatgagccttcccgacgaggccgagggggtgcaggtgacgagcgccgacgtggagaaggcggtggccgagctgatgggcgtgggcgccgacgggacggcgaggagggcgagggccaaggagctcgccgcaaaggccaaggcagccatggaggaaggcgggtcgtcgtatgccgacttggacgacatgttgcgccacgttgcggagctaaacatgaagaagagccacgaagagggcacgggcttcagcactctgccggagcttggaactggaagcaagaacaatgacaacataggtgccggggctgccttgtcagtacagtcctaagttgcattgcaccatgcgcttgccttcttggacgatgtttaacacaagtagaccagtgtactttctctatgtttttgtacacataatacatgtagttagtattcataacaataacaccaacccacaacaacaatgataatatattatgaaaaaaaaacaggtgaattgatgtgttgctgtaaaccgaaacattcatagggactgcaggtcgacttagaggat

SEQ ID NO: 442 - DNA, 1147 bp, Zea mays
gtattagagagaagccattggaaattgtactatattgtcgtaacaatttatcgattttgacacctttaagctggatggcaaaacattgcccgaacttgatagctaatttggtgctctagatgatgaggatattgtaacttgccttgtgtatctttgggcatagaattgtgtcctcgtttagaacgcaaaaaatgtatagaaattgtacacagagtttagaagttttatttatagaaaaatcatacgttccaaagtccaaacagagctgaattactggtatttttcaggttcttacaagtaaactttactgaactaaacacatatttcaaactaaattcaggagatcaaatttacagaaacttcaccaaaattacgccggtacgccaggacgccacgcccatttcttctccacgaagcctttgaagtcccaaatcaactcccgcagacgcctccaaacacccagaccagaccaccgtcggccgtcgctagcctgcgcaacatctccaggtccagggtccaggccacagctcgagcccgacgaccgacgcctagacgcggctgggcggtcggcctcgcctcgtcttccccctccacgcctcctttctcctgctccgcgtctcgatctcgcctcccccgccgcgtggcgcgacccggccaggtatcgcccaccctgcgctgcggccatggataacttgatcaccctcgtcaacaagctgcagagggcctgcacggctctcggagaccacggagaggagagtgcactcccgacgctctgggactcgctgccggccatcgccgtcgttggaggacagagctctggtaaatcctctgtgttggagagcgtggttgggaaggatttcttaccgaggggttcaggcattgtaacccggcggccgctggtactgcagctccacagaattgatggtgacagggaatacgccgagtttatgcaccttccaagaaagagatttacagattttgctgccgtgaggaaggagatagctgatgaaaccgacagagaaacaggccgttcaaagcaaatatcacctgtccctatccatttaagcatattttctccatatgttgggaatcttactcttattgatcttcctgggcttactaaagtagccggtgagggccaaccgga

SEQ ID NO: 443 - DNA, 5890 bp, Zea mays
  misc_feature (600)..(600): n is a, c, g, or t
  misc_feature (602)..(602): n is a, c, g, or t
tgatggctctcgtcaatcttcgacttaactagctagtattcatgaagaatatagtaccaagtgtgaaactatatacaaaggattcctgtgactaatgactattagcattgaattatgtaatcttatcaatatgtagcaagccgagctccctcccattagaatacgagttctcactataaagtccacccttgaactataaaagggtagggcaactttctttctatacacaagcacaccagttgtaacatgctctagtgcaatactacgatcaacactacactggattagagcttcgacctgaaccagtataacccaatgtctcagttcttagctcggatcttcgtgatccaccattcgaagtgagtccacgtttgcatccccaccgaacacaaatttattatcccccggtttccgaaaccacaacgacaaataatatattttttgtgtattttatttatagctcatgagctaaaacaaactagctcatggctcatatttttttgtgtatgactaatattgtattttattattgtttatggaatttattatacttgttatatatatttatagaaatctagttgagttggagactatttgagntnttaaaatacaagttgtacccttatttttcgtttttttatgaagtacatcagaatgcagatgaactcccaccattttttgggatgaaaaaaaaaattaaagcgtttctggaaccaaggtggcaaacctgatccgtttttttccaaacaatcacgacaaaaggtccacggcaacaccaacacttgctgccagttggagagcgtgcccacacacccagatcggacggtgcacactgctcagggcccaccacgcttcaaagcggcgttgccggagtgtgagctcaccatgtcaccacactcgcggccgcggagctttatatagctcagcgcgcgcgcggcgccgactccctccctccgtcactcaccgcaccggccctctctcccacgccaggcgcacgtgcgcgcacgccatggacgccacgcgagttcgggttcctcttcccccgtctctgccggcgtggctcgctgtgctactgctcctcgttcaggtgacgcccggggtcggcgcggcggcagcggcgggcgtggggtgcgattgtggcggcggcgaggcggcggcgatcaaggaggaggacgcgcgcggggcgctgcggctgaagctcgtcgcggtggcgtccatcctggcgtcgggcgcggcgggggtgctggtcccgctgctgggccgctccgcctcggcgctgcgccccgacggggacgtcttcttcgccgtcaaggcgttcgccgcgggggtcatcctcgccaccggcatggtgcacatcctgcccgcggccttcgacgcgctcgcgcccccctgcggcggcggcgccagggccggcgggttcccctacgcgggactcgtcgccatgtgctctgccatggccaccatgatggtcgactccgccgccgcgggctactaccagcgcgcgcacatccgcaaggcgcgccccgtcgacgacgacgccgtcgacggaggccagggccgcgcggcgcccgcggacgaggagggcgccgccgccgagcccgcgggccacgtgcacgcgcacacgcacgcccacggagggcacggccacgccggtgcctcgcctcaggatgcctccgccgtcgccgtgtccatcaggcacagggtgatctctcaggtgagcaccttcccagcttccgtcaacagcggttcacaagagagagagagagagaaatctggtgaaacttcccaataatctggcatgctaatgattaaaacattccaacttcaacggagacaggatagatatgacgagctactttgatttggcaccaaccattccgaacgcccacttggggcacctcctcgacaagaacacacgccatgccatgaagaaaaaacaaacaaacaacctgtccttttccctgagcacaatccgtcgatacctactatgaaacttcaactgataagaaaaaatgtgtcatctgtctaataataagatgctctgataaatgacagtagtagttgttagcagtcaaaaccgattgattaggttgattgaaacactactctgaataccaacgaagtaaaagtatagtaacactagtcctcgttctgtaccgtcgaaaagctcgtgttcttgggcttatcgattggaaccaggaatccaatcagtgctagtgaacgaaagagacaaatcagcgcgtagctctcgcagcagtacccacaggccttccgtgtcgtctccatcggagaaagggggcgtcgtccctgccgttggtgctaaaggcaagagaatcctgctgcagacaagcggaacggaacaatgccttgttgccttccttctcccccagcctcacaatcgagccgccccccctcccctttgcagattcttcgagcaacatggcaggatcattcattattcgaatcagtaaccgtgagggcaattctgtggtggttggtgcaggttctggagctgggaatcctggtgcactcggtgatcatcggcgtgtccctgggcgcctccctgcggccgtccaccatcaggcccctcgtcggagccctcagcttccaccagttcttcgagggcattggccttggcggctgcattgttcaggtacgtacggcatgtagtatctgtttatacacttcacactgaagtgaagagtgacatgacatccgaacagaaggtgacaaatagaccgagatatttgtagcgaagagctagctcgtcactatcactagctacatcgcacagatcagtgaggagaggaccaagaactaggaccccgtcaatcattgatgcaatcatggttcatataactcctaaccgagaacttactccaggcagagttcaaggcgagggcggccgtggtcatggcggccttcttctcgctcaccgctcccgcgggcatcgcgctgggcatcgccatcgcttccggctacagcaggcacggcgccaccgccctggtcgtggagggcgtcttcaacgcggccgccgcagggatcctggtgtacatgtccctggtcgatctcctcgccgcggacttcagcaacccgaggctgcagacgaacgccaagctccagctggcggcgtacgtcgccctgttcctcggcgcggggctcatgtcgttgctcgccaaatgggcgtagaacagaacagattcgctacccgtcagttttttttttctgccgaatcaccgtcagcgagaatttcggtgcgcagaggaagcgaggaaagaaggcccggatgtgatgtatgtaagagcactcccaactctgctccgtggtttccatagctgccacctagtcaaggaaccatttatagaaactaatcttctcaatgcaaatggtagtttctacgctaaaaaaaaaaaaaaaaaagcaggcttcgtttctcagagggaaggggaagaaaacgaggatggaaaccaccgacggggctcaacgctattttggtcgtttccatgctcttttcacaataaatctcttgccacattatcaaaaagctgatatggcagtctaataaattctataaaaaccatatgagctggagagcgttgggagtgctctaaccgagttctagggggatgaggcggcggagtagtttggccttcaacgatctttggggctaaataatagctgtacatacaaagggtcgattttttttaggggaacgggcgaacggcaatgcacatgtctgttatcttttttttttttttttagcatgaaatttcttcatattcccctgaaagaaggcgtgactgtttgttgataagtgagatctgttttgactaacattcgagatgctctaacacgtagctctatctaactcacgactgcacgcctctcattattattagaaactaaatcttagacaaattaaacagactagtggctaaccacctattagtgtggatagtccgttggcacaaaccacatgggcatctgtaacggatcagctacgagtgagtaatagagctgctgcttgatgtgaccgtcacctccgatgccctccttgagatcaaagatggccgtgtcgtagccgtagggcgtgtcggagaggtagacgcagtccgcctcaagatccgcagaaccaaatctgtgccggaccgtgaggtagaaaggatagtttgcgcccaggaagagggcgcgatctccgccgaggtccgtgacacgccgccaactgccgccgccagcgtcgagctcgtggagcgacatgccgagctcgcagaagctcctcctgtcgtcgaacaccagtctgctccacacgcgactgtcccaacatctgcttcttcgcccgtacaggtaagcacgggcgacgtcgtagccgtgtatgcacatgagcataagccgctggccgcagacggaagcagccaggtagaacccgcacaggtcagtgccatagcggctcatctcgtcattctccggtccctgaaccaccgtgggctctgtcatggctccatcgtcgatgtcccaagagtacaagcggccgagctcgtccacggcgtacagcttcccatcgagggcgatggcgtccatgtacgagacatcggccgcggcgttcttcaacgccgtccacctgcactcgcctttgtctccgccgccggccgccgtgaacgccagcagacctccggagaagatagcgatggcgaggtggccgtcagcgtgcgacggcgtccggcacagcgcgaccttgaggatcttgtggaacttgcctaaggagtagccaccagcggtacgggcgacgacgtggaagttgacctcgacctcgactccgggaatggtggcgaaggacggcaggcgaacccgcgcgccagtcacggggttcagcagctcgacgtcgcagcgccagtccgcggtcgccagccacccatggttgccgccgacccaggcccggcccttcaatccctctgcctcgccgcaaaaggacctgcgcccgccgccgccgccggcggcagacacgtcgtggaggcagaatgcgcccgcgtcgacgttgctctcggtctcgcaaccgtcggggtccaggccgggcgtgagcagcgcaggcgcgcccgcccgcaacaggcgtggattctcctcgcacgcttcggaccaacccctgcagacggcagggaagcgaagtatggtgatggggtcgagatgctccatgacgaggtcgcacagctccggcagaaggtcggcccacggcggtgcggtggctgcgctcgaagacgaagacattgccgagcacctgcgtggtcaccgttcacgacggtgaggaattatttgtcctacattagtattgttgctgtaatagcagaattatatacatatatctggatcgtcaaacacataatctgaatcttatcgtaatatagacgatgcagagatgaaccgatgaagctgagttcgacagaaaaaaaattctatgcaaaagtcatacttgtttactcgagcatgcaacacacaagggcctacttgtttacatgcatgaccatgcatatacacatgtccctgcctaaatttcctcacgctataagatcgattcgaagctagatcaaatactccagatctgggagagtgggtcattgtaattccttggatatttcttacctagtagttctgtcaatcaattatcttggtccatactttttgtgtcagataaggaagattgaagaaaacgttgttaagtaattagacatatttcaaaattcaatttcgaatataaattatgattaacaataaataatctagctgattattacctaataagtaagctaacacgtacctaacatgataatcataaaaatacagcactgtaacagataaattaaagtatgaggctaaatcagtgatatatgctgaatgaaca

SEQ ID NO: 444 - DNA, 2515 bp, Zea mays
  misc_feature (762)..(762): n is a, c, g, or t
  misc_feature (901)..(901): n is a, c, g, or t
cagaagcaaggaaatgatgtggtttgttagactccctgcttattggtagagtatgtgtcacgtcacttgatgtttttggcagataaaaatgagaagaatcttctccttcccttctagctcgatccctcgatcgagtccgttttgagtcttgacgtcgttcgttcctcttggtgtattaggtgttgcagttgtattattaaaactctttccgatccgatcctatctaccctacccccaagttttaggaaataaaaaaaggcaaatgatatcttctctttttcataagactttgtttgagtactctattatttaagatattctattatttacctcgattcacatgtattaagctggattgacacttcacacttcagcacatgtggattgtgaagtacccaaccaagacctaagacggctggttttatcaacaaattctattcctagctagtggtcaggccatatacatagctgatagctcaccaagacatgacgagccacaggaagggtctttctctttcaaacgaaagatgccaacccgccaaatgtctctcttgtcggttgtaatcccctctagttaaattctctgaattgaaataaatttccaagtaaatcgtaccgctggtcacctctaaaaaaaagagtaaaaacctgcattttaatttcccgttcgcccctgttatttcgcacccatcatcgcctcctcagtgatctgtggacgctgtgtctgatttcaaatttattatcagaaaaaaaaactatacnacatatgaaaaacttcatcacgtaagtaatcagtcacatgctaggacaacaagaaaaggagagcgtctgtgtagtactgggcggcgtacaatgcgcctgtttctgtttcaaatctgtgtacgtattattcctgtgtagnacaagaagggggaaaaaaagaacgagagcgtttcttcgagtagttcgtagcgtgcgattgatgactccttttttcttctttctgttgtctagaagaaaaaaattatcaaccttttttttttttttttgggaaatatgcattattatacttattagtaccaaacaaatctgaatcgaggagttgtatttctttgtttgtttgtgtactcttttctaattcttgattgagagatcgatccagaaaaaagatgccatacggtagagacgatgcagatggacaagaaaacgatagcaatcgagattgtcctctatacaagcagaccaccatacgggctcgtcgtatggagtgcatgcagacggcgggcgtgcgagtgcgagctctcatcagaggccgacggcgacgaccggcgcgaacgcggtgccgaaggcgcagtcggcggcaccggccggcccgcggagggagccgatggcggcggcgccctcgaggaggtcgttgatcgccgtggcgtagtaggcgcgcagccgccgcagcgtgcgcctgtacagcacggccagccaccgcatccggagccgccggatcgcgccgaagagcctcctcttcccaccgagcctcgccaccgccaccttcttcttctttttctttagccccgccggcaccggcggcgacggcgacgctccacccgccgctctgctggccaccagtctccgcggcacccggaaggacatcatcggccgacgcggggtgacgcgggccgccgccggagcgagctgctgctctccccccatcagatcgatatgactgctcgatctcctctcccggccgcttggctgtgcctgggcaaggcaaggagccaaggagggctagctagctatgtgagagctaatagacaatggcatgtgaatatgtgatgctaatagacaatggctatactgttaaagcactcaaataaactttgcatagcattgtttatagcttgcgtggatgtggctaccctaccctgctctcgggaaatgctaaggtcagagatgggacggcgccgtgctatatactattgattatagatgttcaataatcacgaggtccgcgagcccgttgtttgggcccggtccgagtccggcacgatccggttctatacgggtccgggccggcacgaataagcgggccgggcttggaaaagaaataggtacggtgggctagcctggcacggctcgtttacctctaagtccattaaacctgcttcttttacactaacatgcttaccggtccgcttagcccgcttttttcgtgctaaacgcccagcccgtttagactcgttacgggtcgggctcggacagggaatcgagcccgcgggcttagaaggcccatcccatttttctaaccgtgactgtcgggccaggcccaaaacgaaccgagcttcaattcaccgggctcggcccggcgacccgtttggtcatccctactgctgatactctagtatcagcctgctattaccagctcaataagcaagcaagaaattaataaaactatacaagcatcttgcttaaacaagcaggagttagctagtttagtttagtttttttcttttcgagaaaatgaagctagtagcgtcaaagg

SEQ ID NO: 445 - DNA, 730 bp, Zea mays
cattgggaccctcgcgggcggccgggatgatagtatcatacacattgttcagactaacacgccatttatattattattagctgttatccatcaccaatggtgaagatcctagatcacataagcatccgagggttctttctacttttcatggttcttgtggcatcctttgttggtcatgcacagataataagaggtgaaaccaaagaggacaacgacactaagagcatgatgttgacaacaacgagaccaggaagctatgtaactagcatggatgaaaaatctagcttgtgctttgaggatataaaaactttatggtacatctgcaaaacaacttatcagctttataggacattgaaggattgcttgtcgcattgcaacagtatgtgatgcaccatgttggaaaaaaggactaataagaggccatgctttctcaagattgtagattgagatggtgaagatgttctacccaatcatccatgcatgtaccaagggataaaaaattataagattaattattagttattattaagtgttcccatctttaggaaatgtcattttctcaagagtattttctttgtgtgcgattatggaagtttcaaatttcttatatgagacaataaaaaaactttgtcagtcttcaacgacattagtcaagatgcggcctcctctcataccacaatggtccatatatgtcgttttgacagttcgaaaaaaaaaaaaaaaagcggcc

SEQ ID NO: 446 - DNA, 2178 bp, Zea mays
ggaccctgccggccggcccggggtttcttttcttccccactcctctcgtcgcgtccaataaaaaggggggaagagcattttccctttttttttgctcccctcccccctcgcttcccccgaatttgatgcttaaaccctcgccgggaggaggaggactccacgcgcgagcccgcccgcgccacctaccgccgcgcccggatccccgccatggccgccgcgccgcaccgggcccaggtccccgctgatagcacggctccgctgcagacggggcctgtacttgagaataacccctccaagagtgcaaacgccaaggaccagattctttctggtacagagaatgtgactacaggcaatgcacggggcgctagctccttgagaccgccaaacggcccaccagagaaggctagctctgtgggaaaagctggagagcaaccttatctctaccagcaaaatgtgtatgcaccgcagccacaaccactctatcctggaggatacatgaacccttcaggacaatgggaggaatatccccattatgtgaatatggaggggctccattccgtatctcctggaatctacaatgacaaccagtccctcatgctatctgctggatatgcaaacaacccccaaatgatgtatggagcatattctcctgtttccactgctggagatggccaacaatacttccctgtgcactattccttctcaaatccttactatcaaccaccagcttctcctagcatgggatattcaaactccgcaactggaatgtcccaaggagaccctatgctgcagcaagagtatttccttcctgatggccttctatattcacccacaccagggtatcatcaaccattcagctcatttgacagagcactgacacagccaaataatgctcctgggttgtttggtcaagggagtctaccactggcttctggaatgcatcatggaccgatgtatggtcctggatcctacaagggacgccagtatggtagcaaatttggtggcactactccaagttggagttctgctggccgcagatttggtactttcgacttgagtggcaatcaacaaagggggagcatgtcatttggtagtcataatggctctctggagtttatgaatgagcaaaaccgtgggccacgtgctacaaaaccaaagatacaagacacagagaactcaggagatgagaaaagcgagaaaactgttcttctaattgatagtgaactgtacaatcgctctgattttatcactgagtacaaggatgccaaattctttgtaataaagtcctacaccgaggaccatgtacataggagcattaagtataatgtttgggctagcacagccagcggaaacaggaagctggattctgcttaccgtgcggccagagagaaagaagagcattgccctattttcttgtttttctcggttaatggaagtggccaattctgtggcgtggctgagatgattggacctgtcgatttcgacagaagtgttaattactggcagcaggataagtggagcggccagttcccagtgaagtggcaacataattaaggatgtaccgaacaaccttctgcggcacatcattcttgagaacaatgacaataagcctgtcacaaatagcagggacacccaggaggtgaagctggaacagggcctccagatgctaacaatcttcaagagccatgaggctgagacaacaattgtggaagatttcgacttctatgagcatcgggagaaagccttgcaggagaacagacgtcaacagcatgctgccagcaccgatactcagaaactggtggataccaaggctcaagatcctgtggccgacatatcagatgcatttgccaaggccgtccagttgaagaatactgagaacagtgggacaacccccaaaactgagggtgcttcagctgaaaagggttccgctgccacagccaaggttgaaggaagtgcaaacctgaacacaggccctgtggaggaaagcagttgattcgtttcccttctatctgcaaatttggagcagcagatgaatagcatggtgcgatgtgaaggtcaaaaaggggaaggtgtggtgaatatggtcgtgcccccgtcaggtgaccacattataagctttcttttattgccatttaaggtattaaatttcaatatcataggtccaaaattggtggtctc

SEQ ID NO: 447 - DNA, 2385 bp, Zea mays
gggcattgggtacctcgaggccggcatggtttcatttcttccccccttctcgtcacgtgcaaaggggggaaaacttctttctctctcttttttttccctcccccgcccgaatctgatgcttaaaccctcgccgggaggaggattccaatcccgacgcaccagcccgcgcccgccacctacagccgcgcccggatctccgccatggccgccgcgccgcaccaggcccagggccccgcagatagtgtgattccgctgcagtctgaacctgcacttgataataatccctccaagagtgcaaacgctagggaccagattctttctggtacggagaatgtgactacaggcaatgcacgcggcggcagctccttgaaatcgcaaaaaggcccgccagagaaggctagctctgtcggaaaacctggagaacaaccttttccctaccatcaaaatgtgtatgcaccacagccacaaccactctatcctggaggctacatgaacccttcaggacaatgggaggaatatccccattatgtgagtatggaggggctccattccgtatctcccggaatctacaatgacaaccagtccctcatgctatctcctggatatgcaaacaatccccaaatgatgtatggagcatattctcctgtttccaccgttggggatggccaacaatacctccctatgcattttcccttctcaagtccttactatcaaccaccagcttctcctagcatgggatattcaagctctgcgactggaatatcccaaggagaccctatgctgcagcaagagtacttccttcctgatggtcttctatattcacccacacaagggtatcatcaaccattcagctcattcgacagagcaccaacacaactaaataatgctcctgggttgtttggtcaagggaatctaccactggcttctggaatgcaccatggatcgatgtatggtcctggatcctacaagggacgccagcaaggtagcaaatttggtggcagtactacaagttggagttctgctggccgcagatttggtactatcgacttgagtggcaatcaacaaaggggcagcatgccatttggtagtcacaatgggctctctggagttcatgaatgagcaaaaccgtggaccacgcgctacaaaaccgaagatacaaggcacagagaacacctcaggagatgagagaagcgagaaaattgttcctctgattgatagcgaactgtacaatcgctctgattttataactgagtacaaggatgccaaattctttgtaataaagtcctacaccgaggaccatgtacataggagcattaagtataaagtttgggccagcacagccagcgggaacaggaagctggattctgcttaccatgcagccaaagagaaagaagagcattgccctattttcttgtttttctcagtaagaacaactcatctcctttggttttttgcttttcccttcgaggaaaaaaaaagagtaacagtacatagtgggtgtttgatcctttattagcatgtgctaaggtgtttccgattttggtaatttcttttatgaataattgttccttttataggttaatgggagtggccaattctgtggcgtggctgacatgattggacctgtcgatttcgacagaagtgttgattactggcagcaggataagtggagtggccagttccctgtgaagtggcacataattaaggatgtaccgaacaaccttctgcggcacatcattcttgagaacaatgacagtaaacctgtcacaaatagcagggacacacacgaggtaaaccatgcattttttctttgtgatttttgctcatattgttggcatgagactgttggagctgataatatgctacaggtacttgaaaagaagcgatctttcaaaccgcatcattttgttatttgaaaaaaaacaaggccatatgtttatcaaatgtgtgacctctttcttctgacataagcaaatatagatgtcgtacatgagtatgccacaagactcgaatttgaaaaggtctctgaacaaactatatatagatgagtgcaaatcaaatctcacgatgccgacaattttactaaagcagcaatttgtataattgctaaacttctctgcaagggttgaagcagttgggcttcctaaggttatgcgttaaccatgtttttcagatgtaccgtatcaatacttaatgccatttactaactagcctaatatttaccactgactgtggtagcagccagtcactgccacaacagtttatgggtcatctgtaccttatgactagctgcattgcagccgcaactagcacaagggaacacataacaatttctgggtcatctgtaccttgtgagttgttattcatatcatcaacacctttttc

SEQ ID NO: 448 - DNA, 2665 bp, Zea mays
agagttgacctgcagtctgaacctgcacttgataataatccctccaagagtgcaaacgctagggaccaggtaatttagcttccatctagagtttatctccttctcatctatgctttgaaatgttgctcatgaatatgttgtcatgaatatgttgctgttgtgacagattctttctggtacggagaatgtgactacaggcaatgcacgcggcggcagctccttgaaatcgcaaaaaggcccgccagagaaggctagctctgtcggaaaacctggagaacaaccttttccctaccatcaaaatgtgtatgcaccacagccacaaccactctatcctggaggttagggtacatccattgcctttttaattaatgttagcacatgttctgaattctgttgcataaagcacaagacaaatatatatccatagcttctaaacaatcatgtttctgttgtttctggctgaatttgtcttttgactggttgtacaattgataataaattttcagtaatctgctttgttcacctctatttgaattaattgtggaagtgtcaatcttgtcctaatgagggcactgaagtgtattattcaattccagacttaggctctgtatcaaggcagcaactttcacttttcatggagtgctattttaaatttgatgtcctttttcttccccttactgtaggctacatgaacccttcaggacaatgggaggaatatccccattatgtgagtatggaggggctccattccgtatctcccgtaagtagctggaattactgagcttttttgtgttctgttaatagcttttttccctaaatatttttgttcttgaagggaatctacaatgacaaccagtccctcatgctatctcctggatatgcaaacaatccccaaatgatgtatggagcatattctcctgtttccaccgttggggatggccaacaatacctccccgggcccggtcccttcccggggccttactatcaaccaccagcttctcctagcatgggatattcaagctctgcgactggaatatcccaaggagaccctatgctgcagcaagagtacttccttcctgatggtcttctatattcacccacacaagggtatcatcaaccattcagctcattcgacagagcaccaacacaactaaataatgctcctgggttgtttggtcaagggaatctaccactggcttctggaatgcaccatggatcgatgtatggtcctggatcctacaagggacgccagcaaggtagcaaatttggtggcagtactacaagttggagttctgctggccgcagatttggtactatcgacttgagtggcaatcaacaaaggggcagcatgccatttggtagtcacaatggctctctggagttcatgaatgagcaaaaccgtggaccacgcgctacaaaaccgaagatacaaggcacagagaacacctcaggagatgagagaagcgagaaaattgttcctctgattgatagcgaactgtacaatcgctctgattttataactgagtacaaggatgccaaattctttgtaataaagtcctacaccgaggaccatgtacataggagcattaagtataaagtttgggccagcacagccagcgggaacaggaagctggattctgcttaccatgcagccaaagagaaagaagagcattgccctattttcttgtttttctcagttaatggaagtggccaattctgtggcgtggctgagatgattggacctgtcgatttcgacagaagtgttgattactggcagcaggataagtggagtggccagttccctgtgaagtggcacataattaaagatgtaccgaacaaccttctgcggcacatcattcttgagaacaatgacagtaaacctgtcacaaatagcagggacacacaggaggtgaagctggaacagggcctccagatgctaacaatcttcaagaaccatgaggctgagacaacgatcgtggaagatttcgacttctatgagcagcgggagaaagccttgcaggagaacagacgtcaacagcagcctcccaccacctatcctcagaagctggtggataccaacgctcaaggtcctgtggccgatatatcagatgcatttgccaaggccgtccagttgaaggatactgcgaacagcgggacgaccccgaaagctgagggtgcctcagctgaaaatggatccgctgccacagccaaggttgaagggagtgcaaacctgaacacaggccctgtggagtagagtccgtttcccttctttctgctaatttggagcagcagatgaattgcatgctgcaatgtgaatgccggaaaagtggaaagtgcaggttgatcgtgttaaatatggtcgtggctgcgtcagttgtacaacatcataggctttgttttatctccatttatgttatataagttcaatatcatagttccaaaattattgttcccaaaaaaaaaaaaaaaaaaaaaaatttgcgccccccttccgtggtcctcgtgtcgcaccatgaatgatcgttccattttagcgggtttataggcataagcacctgcagaattatgctgcgatgaagttgcattttctgcagttgaatgtgatactgtcgagtcttgcactgtctgtaatttcagagatcctctagtgtttcttcgtcttgtt

SEQ ID NO: 449 - DNA, 2347 bp, Zea mays
aataaaaaggggggaagagcattttcccttttttttgctcccctcccccctcgcttctcccgaatttgatgcttaaaccctcgccgggaggaggaggactccacgcgcgagcccgcccgcgccacctaccgccgcgcccggatccccgccatggccgccgcgccgcaccgggcccaggtccccgctgatagcatgactccgctgcagacggggcctgtacttgagaataacccctccaagagtgcaaacgccaaggaccagagaatgtgactacaggcaatgcacggggcgctagctccttgagaccgccaaacggcccaccagagaaggctagctctgtgggaaaagctggagagcaaccttatctctaccagcaaaatgtgtatgcaccgcagccacaaccactctattcactagtccccccccccccccccggacaatgggaggaatatccccattatgtgaatatggaggggctccattccgtatctcccggaatctacaatgacaaccagtccctcatgctatctgctggatatgcaaacaacccccaaatgatgtatggagcatattctcctgtttccactgctggagatggccaacaatacttccctgtgcactattccttctcaaatccttactatcaaccaccagcttctcctagcatgggatattcaaactccgcaactggaatgtcccaaggagaccctatgctgcagcaagagtatttccttcctgatggccttctatattcacccacaccagggtatcatcaaccattcagctcatttgacagagcactgacacagccaaataatgctcctgggttgtttggtcaagggagtctaccactggcttctggaatgcatcatggatcgatgtatggtcctggatcctacaagggacgccagtatggtagcaaatttggtggcactactccaagttggagttctgctggccgcagatttggtactttcgacttgagtggcaatcaacaaagggggagcatgtcatttggtagtcataatggctctctggagtttatgaatgagcaaaaccgtgggccacgtgctacaaaaccaaagatacaagacacagagaactcaggagatgagaaaagcgagaaaactgttcttctaattgatagtgaactgtacaatcgctctgattttatcactgagtacaaggatgccaaattctttgtaataaagtcctacaccgaggaccatgtacataggagcattaagtataatgtttgggctagcacagccagcggaaacaggaagctggattctgcttaccgtgcggccagagagaaagaagagcattgccctattttcttgtttttctcggttaatggaagtggccaattctgtggcgtggctgagatgattggacctgtcgattttgacagaagtgttaattactggcagcaggataagtggagtggccagttcccagtgaagtggcacataattaaggatgtaccgaacaaccttctgcggcacatcattcttgagaacaatgacaataagcctgtcacaaatagcagggacacccaggaggtgaagctggaacagggcctccagatgctaacgatcttcaagagccatgaggctgagacaacaattgtggaagatttcgacttctatgagcagcgggagaaagccttgcaggagaacagacgtcaacagcatgctgccagcaccgatactcagaaactggtggataccaaggctcaagatgctgtggccgacatatcagatgcatttgccaaggccgtccagttgaagaatactgagaacagtgggacaacccccaaaactgagggtgcttcagctgaaaagggttccgctgccacagccaaggttgaaggaagtgcaaacctgaacacaggccctgtggaggaaagcagttgattcgtttcccttctatctgcaaatttggagcagcagatgaatagcatggtgcgatgtgaaggtcagaaaggggaaggtgtgttgaatatggtcgtgcccccgtcagttgtacaacatcataggctttcttttatggccatttaggttataaaatttcaatatcatagttccaaaattgttgttcccggttgtcttcgttcctgttctgttttgcttccgtcttccatgttcctgtgtcgtaccatgaatgatggttcaatttagtgggtttaggcataagaagctgcagaattatgccgcggtaaagttgcattttctgcagctgaatgtgatactctgcactgtctccatccttgtgtaatttcagagatcctttctctaacagcaacggcgacagcaacgcctgtacactgctgccctcctcgtgc

SEQ ID NO: 450 - DNA, 1267 bp, Zea mays
cggccgcgtggggtataatatctcccgcgcgcccgggcccggggtttcatttcttccccccttctctcgtcacgtccaataaaaaggggggaaaacttctctctctttttttccctcccccgcccgaatctgatgcttaaaccctcgccgggaggaggattccaatcccgacgcaccagcccgcgcccgccacctacagccgcgcccggatctccgccatggccgccgcgccgcaccaggcccagggccccgcagatagtgtgattccgctgcagtctgaacctgcacttgataataatccctccaagagtgcaaacgctagggaccagattctttctggtacggagaatgtgactacaggcaatgcacgcggcggcagctccttgaaatcgcaaaaaggcccgccagagaaggctagctctgtcggaaaacctggagaacaaccttttccctaccatcaaaatgtgtatgcaccacagccacaaccactctatcctggaggctacatgaacccttcaggacaatgggaggaatatccccattatgtgagtatggaggggctccattccgtatctcccggaatctacaatgacaaccagtccctcatgctatctcctggatatgcaaacaatccccaaatgatgtatggagcatattctcctgtttccaccgttggggatggccaacaatacctccctatgcattttcccttctcaagtccttactatcaaccaccagcttctcctagcatgggatattcaagctctgcgactggaatatcccaaggagaccctatgctgcagcaagagtacttcccttcctgatggtcttctatattcacccacacaagggtatcatcaaccattcagctcattcgacagagcacccacacaactaaataatgctcctgggttgtttggtcaagggaatctaccactggcttctggaatgcaccatggatcgatgtatggtcctggatcctacaagggacgccagcaaggtagcaaatttggtggcagtactacaagttggagttctgctggccgcagatttggtactatcgacttgagtggcaatcaacaaaggggcagcatgccatttggtagtcacaatggctctctggagttcatgaattgagcaaaaccgtggaccacgcgctacaaaaccgaagattcaaggcacaaataacaccctatgagatgagagaagcgagaaaattgtccctttgattgatgcgaactgttcaatcctctgattttataccgag

SEQ ID NO: 451 - DNA, 5251 bp, Zea mays
  misc_feature (1576)..(1576): n is a, c, g, or t
gggcggttgttccagaggtccagatcaccggcctctccactctccagcactagtgatcccctctgcccgaactcccgatcaccgacagctgctcgcctgctccagtcacatgtgcccctctgcctgctccatagctccagttcagaactctagagtccagatcaacggtgggcgacgactactccagatcaccagtgtctccaacaccagtgacgagatgagcttgtcatctcaaggtcccccctgctccctctcccccatctctgtagttctgttctagttctgttctgtctgtgtctcccaccaatgatcaaacactaatggttgttgctgctctaatcctaagccgactgctgattagtgacttgtacctctgcctgttattttgtatatcctgttgtttatacctatagaagtataactaccagtctaaaaggtctaggacgaccagggaccgactatgaccgactaggggtcgactaatcgttctggtcgtcgcctaatcgcgaccagtgttcgaccaggcgacttgaaatcattgattcctactagtcaatcaaagtctttcctctttggatgtgtgtgttatacaactgtaatgggtctaggtccagtccacatacttttctgctattaatatagtagcctaactctaattagggtttggggggttttcaatagtaacttaagaaaaacaagccaggtaatattgttaagaatggaagtgagcccagcggatgatttgaattttgtagtagctgatcgcttgttacttatatgaaatgaaacaagcgatcagcccactttctacttcttgcgggtgtttgagaggcaactaatctataaaacttatagtttaagtttacaagctagattgtattgaaggagcataagatttagatttagagctactgagcctagcaacatcttagttcttttgtaggtaatcgatcaaccaaggaagattattgaattcgtctaaactaagagcatctccaacaatgttttagatcagtgtcctatcttgaaatataaagctcaacttataaaaacgcttttgttctatttttataactttttaagtgacacaaatatactataacccagattagtgcattatccttattttctatattatcctcaaacttttctttggcaataatttaatttatttcctaaaacacataatttagggcttagctattattagagctgaatttggttttagtgccataaacactttcaataatgtagtactttaaatgtttggactacactattttaagacgccttgttggagatgctttaaggaagatgtctaagaacgcaggtctagcattttaaacaatatttgctaatgcataaagcatggcaagtaaggattgatgcttactaaatgaaaactttaatttctatattcaaaatcagcctttcctttaacatctctgttgctagagatagcactggttggatgttaccaaacacctcacttttatttataacttcgatagctagcaccaaagtgcatagttactaagcttattacaaccactcgtacgtacgctgcttaatcaanctcgaagggattatattgtattgtttgtttagcttccaaggagagccagcaggaagctgctgtagtcacccgaggtttccttggcgatagcctgctgcaaggtacacgaagccctcttctggaacgcaccgcagatggcccccatgtcatccttctccgcgtgcagcaccaccacccgggtcaggctatcctcgtcggtccctgctgcctcgcgcgtcgcgttcctcagcacctgcttgattagtcgtcaatctcagatcgaattatatatccagaaaatacagtggcaataatcgacgacgagacggcgatgaacatcgatcatatatatatcgaccgaccacctctctaactaaccttggcgaagtacttggtcggatccgcgacgcacctcaccgccgcccgcagcgcgcggaggtagcccgtgggatcgtcggccccgcgcggcagcgccttggtgacgctgcggcggtgctcgtcctggtccttgaagcagctgaacgtggccctgagctgggccttgctccgggtgcccaggaccctgatgagctcctcgtggtcgtggcggccccccgccgcgcccgcgctgttcctcacggcctcgtgcacgatcttcgcctccgaccgcgctagctccgcgtccacgttgtcgtcgccgtcgtacctgtacgtgctcaccagcgccagcagaagctgaagggccggagtggacgatgcatatgatatgcatgcacacgccaagctgtcaacctaacctaccacactgaacagtgcaaatggagtggagtgcatgcaggtgtgcgtgtgtacgtacgctgcgaaggttgcccgtggcacgagcggcgacgtcttcctccagggagcggcggtacaggacgtggtaggcttgcttgacggacacgagctccgcggacgagttggtggcgcacgcgatctccacgaccaccgcgtaccgctcctggacgcactccgtcgcggcgtgcgccatcgcagcctgcctctcggcggggccgagcatccagtggtacaccgctctctgcaggacgaggaggacgacgaccgtgtatagcgatagccagtgcgagcagattagacggtggcaaaaacgagctcagcaggaggaggatcggatcggagggcacctcgaggtcgccggtgggctccgcctgcaggcgctggattaggctctcgctgtactcgtgctcgtactccagcgcgatctgcttcctctgagtggcgtcgcggtgggccaagatggagatcaccgcctgctcgtcggtgccccatcctttttttttgttgttgaatggaccacaaatactcatctcagcaaaattagaatatccattcaaatttaacaaacacctaccttttttcgactggaatgaaatatgaggcaaatatttgagcattttttttacgctagagccagaaagctagatcaggagcaaccttggaaagccttgaggagagccgcggcgtcttcggcgggggaagggacaactcgaggaagggtaatcgttgccattttcttctcttcttcttcttctttccttgttctccagactggtttattgtcaatcgccgcattcccccccttggtatttatggataagactgtatcttagcgtttgctaccgggcatttattaatcgaacgaaaccttgaagaaaccgcatgtcaatcgcgattcagcgttactccgttattttttccccagttagttttagctttaactacggggagtttcacagtgtgatgcatgtggttttcgattttttttaatgcctcatttgaacaaatgcactaatccgaaccgaagtaggagtagtaaatattttttttcctgaatcttttacgatcaagtatgcggccggtctttctgggccgtactgaacctgctgggcttcacgaaaaggaggaacgaacgatcgaacgacgaggccttgcgatcgatgatgcgtgttacgggcgggccgcacggcccagcaaccggcagcgccgtggacccgcccgtgtggtaggttaaggagacagcccagcgcgcacgacacctttgagcggcacacccgcgcctgacgttggccgggcagccgcctgctgccgtcctcccacctgtcccgcgtgacggcctcaccacgcaccgccttcccgagaccacgtctggtctctgactgactactaggatgctgtacaccgccttggcgtgtaaacgcttgcgggcgcggggtgtttgacccgcgcccggcctgcccgcctgccagattagccgcaccggcaccgcggtggcgcccacgtcaaaaccggagcgcagcgcagcgcaggcagccaagcggcggcagcgtcagaggtgggagagggggagtcagtctgcgtctgcgtgtgtgggacacactgggacaccgacacctgcagcgttttacgcggcgggggagggagagagatccagggaggggggccgtagaagatctggctgctgcagctgcccagaaggagaaacaactaggataccaccgccaccggcccccggcaggcggcaggcgggcgggagagacgaaatctagggaggactgactggacggaggaggaggaggagcggggagatctctcgctcttccgcccatggaggagctgggagacgccggccagggaccgcaaggcgacgcctccggggcccttgtcaggaagaagaggatgcggaggaagagcactggccccgactccattgccgagacgatcaggtggtggaaagagcagaaccagaggctccaggacgagagcggctccaggaaggcgccggccaagggttccaagaaagggtgcatgatgggcaaaggagggcctgagaacgtcaactgcgtgtaccgcggcgtgaggcagcggacatggggcaagtgggtggcggagatccgcgagcccaaccgtggccggcggctatggctgggctccttccctaccgccgtggaggccgcccatgcatacgacgaggcggcgaaggcgatgtacggccccaaggcacgcgtcaacttctcggagagctctgctgatgccaactccggctgcacgtcggcgctttcgctgctggcgtctagtgtgccggctgccgcgttgcaacggtctgatgagaaagtggagaccgaggtggaatccgtggagactgaggaggtggtacatgaggtgaagacggaagcgaagaatggtgacttgggaagcgtcaaggtcacctgcgtcattcagtccgcggaggagactgtgctacacaaggaaggggacgtgagttatgattacttcaacgtggaagacgtcgttgagatgataattgtagaattgaacgctgataaaaaatttgaggcacacgaagaataccttgatggagatgatgggtttagcctttttgcatattagaaagcacggtcatggggggggggggggagtagtaggaatagcttcattctagatgatgctgatgagacatagctttatactatgagccaaccggtacaacaagttgtcctgtgtgttgagttcctgtactatagtagggatgagttcgtgtttaatgagctctcttggctgttaatattgcacatttgttcgggtggggtgaaccctaaattagctcaaggaaaaaggaatggttacactgtacaccgaataaatttttaggattgcatt

SEQ ID NO: 452 - DNA, 1003 bp, Zea mays
  misc_feature (980)..(980): n is a, c, g, or t
  misc_feature (992)..(992): n is a, c, g, or t
  misc_feature (1003)..(1003): n is a, c, g, or t
atcagtgtgcaactgtgcatgcatcacagtcacacacacacagcagaagaagaagccgctcgtgggtctagctagcaaaataaacagaagcaagcaatcaagctagctagagctaaggatcgagatcgaccgaccgaccgacgatcagctagcatggcgcgcttcgtggatccgctggtggtggggcgggtgatcggcgaggtggtggacctgttcgtgccttccatctccatgaccgtcgcctatgatggccccaaggacatcagcaacggctgcctcctcaagccgtccgccaccgccgcgccgccgctcgtccgcatctccggccgccgcaacgacctctacacgctgatcatgacggaccccgatgcgcctagccccagcaacccgaccatgagagagtacctccactggatagtgattaacataccaggaggaacggatgctaccaaaggtgaggaggtggtggagtacatgggcccgcggccgccggtgggcattcaccgctacgtgctggtgctgttcgagcagaagacgcgcgtgcacgcggaggctcccggcgaccgcgccaacttcaagacgcgcgcgttcgcggcggcgcacgagctcggcctccccaccgccgtcgtctacttcaacgcgcagaaggagcccgccaaccgccgccgctagctagcaactcctctccgaggcacgccagatgcatgcgtgtgcgtgcaggtgcaaccaccgcactgtcggcggctacgtatgaccggtgaataaaaagttttactgcaccgtaagcatgctcgccctgttgttgttggtatatgttcgcagtgtggccgtctgtatgtagtagctattcgcttgcatctatgcactctatgttagtatgtgtacgtatggttccgggactttttgagtcctatctaaatactagaagtgcccgtgcgtttgtaacgggaaccggtcgcgtggccggaccctaggcgacnatagcatacacntcgaatcaacn

SEQ ID NO: 453 - DNA, 649 bp, Zea mays
gacacatcgtcatcgatcatcacacgcaatcgacacaagaagttaataaacagcccaaggacgcagagatcagctgatcgagaaggacttgtactactactcagtattgtcgtcacatgcacatatatgtacataaagagctagctacctgagctctacccaaggtcgcgttgatcgatcgatcatggcgcggttcgtggacccgctggtggtggggcgggtgatcggcgaggtggtggacctgttcgtgccctccgtctccatgaccgtcgcctatggccccaaagacatcagcaacggctgcctcctcaagccgtccgccaccgccgcgccgccgctcgtccgcatctccggccgccgcgacgacctctacacgctgatcatgacggacccagatgcgcctagccccagcgacccgaccatgagggagtacctccactggatagtgactaacataccaggaggaacggatgcaaacaaaggtgaggaggtggtggagtacatgggcccgcggccgccggtcggaatccaccgctacgtgctggtgctgttcgagcagaagacgcgcgtgcacgcggagggccccggtgagcgcgccaacttcaacacgcgcgcgttcgcggcggcgcacgagctcggcctccccacc

SEQ ID NO: 454 - DNA, 967 bp, Zea mays
  misc_feature (935)..(935): n is a, c, g, or t
cgtcgtaatttggtcctcttttcggctaggaggcttttttttttttttttgagatatcaaatctttaacatttaaactcttccgattgtcaggctaagcaacagtttatcgatatggggaggatgccatcgaagctaacaggaaacggtccagcagcacaaacatcatccgggaaaacatctttagggccatcaaaagctcgtctaactaaaaactctcttcccaattcgcaacacaaacaaatgttatttgaagtaaatttcgatcaactgattccactagacaatcgcatttgccgcgctggcaatcctaggccacagatcagcacactcctttccgatgggtccagtgatggcagagcctttcatctctccctttgggttcacaatcactccagcattgtcttcaaagtacatgtagacaccatcctttcggcgccatggcttgcgctgcctcacaatgacagctggcatcaccttcttcctaaggtcaggctttcccttcttcacagttgccataaccatgtcaccaacacaggcagaaggaagcctgttaaggcgccccttgattcccttcacagaaatgatgtaaaggttcttggctccagtgttatcagcacagttcacagtggctgccactggtagacccagtgacatccggaacttgttaccagcagaacctccacgtcctcgcttcgacatcttggaagcggagaggagcggcggagtggcggcggcgcggggtggacaggttggctcgtttatacggtgccaaggttagggttttgcggctattattcgagtaccccttgtaacaatttccgcggccttccccggtcttccgcattgtgctacgttcttcatcgatgcgagagccgagatatccgttgccgagagtcggtcttttttttttttttttttttttttttttttttntttttcccgaccggccgcctcgagcgccgcac

SEQ ID NO: 455 - DNA, 862 bp, Zea mays
  misc_feature (34)..(34): n is a, c, g, or t
ctggccggccgcccgggctccgagtataaacgangccaacctgtccaccccgcgccgccgccactccgccgctcctctccgcttccagatgtcgaagcgaggacgtggaggttctgctggtaacaagttccggatgtcactgggtctaccagtggcagccactgtgaactgtgctgataacactggagccaagaacctttacatcatttctgtgaagggaatcaaggggcgccttaacaggcttccttctgcctgtgttggtgacatggttatggcaactgtgaagaagggaaagcctgaccttaggaagaaggtgatgccagctgtcattgtgaggcagcgcaagccatggcgccgaaaggatggtgtctacatgtactttgaagacaatgctggagtgattgtgaacccaaagggagagatgaaaggctctgccatcactggacccatcggaaaggagtgtgctgatctgtggcctaggattgccagcgcggcaaatgcgattgtctagtggaatcagttgatcgaaatttacttcaaataacatttgtttgtgttgcgaattgggaagagagtttttagttagacgagcttttgatggccctaaagatgttttcccggatgatgtttgtgctgctggaccgtttcctgttagcttcgatggcatcctccccatatcgataaactgttgcttagcctgacaatcggaagagtttaaatgttaaagatttgatatctctaaaaaaaaaaaaaaaaaaaaaaaaaaagcctatcttcctgcttcggacagttgcaagagagagagagagagagagaggaagggatccagagcgcggcgaaggcaatggcaagcggagggaag

SEQ ID NO: 456 - DNA, 845 bp, Zea mays
  misc_feature (269)..(269): n is a, c, g, or t
gtggaaagaaccaggtctttgaccatttagactctaaccgattgtcaggctaagcagcagtttatcgatatgggaggaatgccatcgaagctaacagggagcggtccaacagcccagacatcggccgggaaggcatctttagggcccatcaaaagctcgtctaactaaaaactctcttcccaattcgcaaccacaaaccaaatgttatttgaagtaaatttcgatcaactgattccactagacaatcgcatttgccgcgctggcaatcntaggccacagatcagcacactcttttccgatgggtccagttcgcatttgccgcgctggcaatcctaggccacagatcagcacactcctttccgatgggtccagtgatgcagagcctttcatctctccctttgggttcacaatcactccagcattgtcttcaaagtacatgtagacaccatcctttcggcgccatggcttgcgctgcctcacaatgacagctggcatcaccttcttcctaaggtcaggctttcccttcttcacagttgccataaccatgtcaccaacacaggcagaaggaagcctgttaaggcgccccttgattcccttcacagaaatgatgtaaaggttcttggctccagtgttatcagcacagttcacagtggctgccactggtagacccagtgacatccggaacttgttaccagcagaacctccacgtcctcgcttcgacatcttggaagcggagaagagcggcggagtggcggcggcgcggggtggacaggttggctcgtttatacggtgccaaggttgggggggtgcggcctagtagttcgactcccccttgtaacaatttc

SEQ ID NO: 457 - DNA, 2757 bp, Zea mays
  misc_feature (99)..(99): n is a, c, g, or t
aattgccccttttatttcaggataaatcacgatcacgactggacttgcccaataatgcaattcacgagtgagaaaccttgcaaagcaaattccatgcgnaatcatggatgaaactaacgcgccccccgttgcctcgctttctcacccagagtcagaggaaattgaatcaccaaactggaacaaatcataataaacaggcgctggctgtcagctgtcagactcagagctttagcacgagagccaccacagctagagcgagtgacactgccaacccaccggggacggcggctgcgttggacagctgggacgacgtcggcgggttgaccttggagcagacctgcctgatctctccattgtggtgcgtgagcgcgcccagcttgctcatggcgacgaaggacgtggcgaagtcggcgaagaactcggtcgccggcgcggtggcgttggcctggcgcgcgacgtaggcgctagtggtggtgtcgaggaggagggcggcgtctgtggagagcaggcccttgttgccggcgacgagggtgtagtagtcggcgtcgaaggtggtgggcgtgggagggtcgaggtagacgagggtggcgttgtcgccgggcttgcactggccgcgaagggtggccgtgtagttggcgtccagcgtggggtcggacgcgccgttctgcccgccgaagttgtacagccgcggcgacaccgtggagcaccgcgccttcccgattgtgtgtgcgcctcaagaatttcgtacgccccgcaaattaataaaagagacagatgataatggtatgtaattcagtttaaccatataacgataataatacataccggagaggacggcgacgtccttggcggtgaggttgaactttttagcaaacagggcgatgatatcggtgatgttggcgtccggcggcggcgagttcagggcgacgtcggcggccaccgacctgttgccgtccctccggccagtcgggagcgggatgaacgggcctttcgtctgcccatgcattaatttaatcaatttctttctttctttctttcttgctagctgacatcaagcatgcatatgctcggcgcggttaccataccagcctgacggagtcacgcgcggcgagcgcgagcgtgtcagcgcaggagacgacgccggggcaggcggcgtcgagcctagccttgatggcgtccaccacctcgtacccgcggacgccctggttcagtgccgcgtccttctcggcggtgttgccggcggtggagtcgagcaggatggagccctcgcagccacccacgaagcagtcgacggagaagaggcggagcacggcgcccgcgaggtccggcgacttggccacgatggccgtcatctccttgagcaccacgtcctccgcctgcgggcacgtcttgttgtacgcgccgatcaccacgtgggcatccgctgacggcgccgtcgtcgacacagccaggagcagcaccactgccgccgccgctcttgctgctgcgacgacgctggccatcgtctctagctagatagagttcttggctatagctaggtagctggctagtactgcagtagtggatttatattgccatcgatccaacagagatgagtcgatcgtcgttgacaaacacaacacacacatctggatcgacgatcgtagctcgcaaggaacaaagtacagtacgtacttgcggtttctgtttgtactacacacggtatgaagaatgtcaacagctataaattcatagaaaatctctctcgagataaggttgacgtggaatatatatacgtgtaccaacaagaatgtgagggtgggtgagagtgttacacaattctgtcctgaggctgagtggaaaggcttgctttgtcactttgatcagttaatggagaaatcaatgacagaattgatagagatgtcattaacatataaatttaaaaaggtatatgttacggtgattgctcatatttagctctcatggcacgagaagaaaaaaaatactacaacgacatatattcaccaaatacttctaatactttgagttgtatcttagtcttcccgtcttaattctctgtgcacacagtgttaggataccagacactcgaaagcatcgtcaatgtggcatatatccagatgtgcaagtaatcaggttttttaggaaacgtctctacaactacttgttgatcaccatcttctttgtgggatgtatcgtaccgaactgagcagacactaaaatattttgtggtgtactatacttgagccgtgttttttcttgctttgggccagtccatcagaaccgacccaagtgtacagctataaagacgacaacacatgctaaaggaatggatcagagaatggcgatggcgtggaggaatgtaggatgccaatggggattgggggcgaccgtatggggtgtgggctttctgtaacaccacaaaaccatcaactaaaaataatgtatttagattattagtgataaatatggtaataaatttttctttcaagtgtttgattttcatttgcatttagaataattttgtttgctcatatttgatttatggttgttgcgtagaatttcttttatattgaaaatccaattaattaatataaaaatattggtccaaaaataaatattttagttataaataattttggtattattattatgatttttagaattatttaaaaatatatttatttatatttttaaattgaatagaaaataagagaaaaaagacataaaccctaaccggtcgaccggcccactagggac

SEQ ID NO: 458 - DNA, 444 bp, Zea mays
tttgggctgatttatgtgcttggtaggcgtctacccgccacgtcacttcgccgtacctaacacgatcatcggattatcgtaccgggagccctcgtaaagggtaagggtcatagataattaggcgcgtcgcgtcctcccgcgcgtcggcgccttaccccttccaatccctacccggtactaccccgttagccccacgtcccaaaacgccaactgatcgcccggcgttagtcgcccgccgtaatacgtggtttagtctgagacattagcgtaggccacgccgtccggggatatcttatctccgccggattcgcaagccgattcgagacccttacccatcccttcccagcctcgctagcgattaccgtccactcagtccctagatcgacatcacgtattattatacaatcaacctcgcattcgccgcgggccccgttaataactcgc

SEQ ID NO: 459 - DNA, 2656 bp, Zea mays
aagttgagcccgtgagaagccaaatcgcgaacccacccgggccaggggcaaacctcgtgctcccctccacttgccgaggaggctcgcgacccgcgacgccttccgcagccccgacccaaaccctagccccctccaccgtactgccaccgtcatggccgaatcatctgccgctgccgaggtcgggtcgccagcttcgttgccaccactggtcgccgaggaggccgatgccgccgcgatggaggaggccgcggcggtcgcgaagaggtggcccgggtggcccggggacagcgtgttccggctggtggtgccagtgctcaaggtcggaagcataatcgggcggaagggcgagctcattaagcgcctcgtcgaggagaccaaggccagggtccgcatcctcgagggacctgtcggcgccaccgagcgtatcgttttggtttctggaaaagaagatccagacttggagctacctccagccatggatgctctcatgagagtttttaagcgtgtcactgggataacagatggagctgctgagggcactcaggccgctgctactcctgatgtatgtgctgcccgattgttggttcctggagctcaggcaattaatctaattgggaagcaaggtgcaactatcaaagcaatccaggagagcacgagtgcaacaatacgggtaatatcagtagatgaacatgaacgaccattctatgtaactgacgatgaaaggatagttgagatacaaggcgatacagagaaagttctaaaagcactgcaagcagtttcaaatcatcttcggaagtttttggttgatcatagtgtacttccattatttgaaaagactaatactacagtgagccaagatcgcaatggtgatggttggagcgatatgtcacgtccttcaattggttctgcacaagtgaatcaactaccttcagtgttagatgactatattcttcaagtgaagagggatcctctgtaccttgaacgagaatctttggtagatcataacattcatcgctcaggcgtatcactttatgggcgtgatccagccttgtcaacactacgaccctctgcagtacatggtgctggctcactacttacacagataacccaaaccatgcaaatcccacttacctatgctgaagacattataggagttaaaggagcaaatattgcgtacatacgagctaatagtggggctgttgttacaattcaggagagtttgggtagtccagatgatattactgttgaaataaaggggacatcttcacaggtacaagctgcacagcagctcatccaggactcgttggctgcacaccgagaacctgtcagaagcagttatgtgggagcaggattagattcactgtataggtccagctactcacaatatggcagctccacctatccttcgtcatcactgccatcttattctagcatcgatgatgttagtaggtacccatcttcaggtcttggtggctatgggtcgagttacaggtactagtactagttcgtccttaggcttgaatgcttgatggcaccttgtatccattcctgggtgattattgtacaagtcagcaagttttctgctctgcgtgcttacgggcaggggatcattttacaagtcagcaagttctctgctttgtatgcttccgggcagggatctggtagattatactgcatcccaattcccagtacccagacttcggagtccaatttgctttgacaatggaatcggaaatcgtgcttgttaattcgatgattgcatctgtttatgtcgagactcgcgcgggcaaatcacaacacccataacaaatttatttgtttactggaccaggatggcaggatcgctgaaaaactagacctgaatagaattgttactggtctacaatgttctgaactatttttttgtacggcatcattttgaagcatacatgacatgtaggatagctgtgtacgtcggccattttcagcggggttttggtctaggaaaaagagaatttgtagagtaggataagttttgacagtataaggtaactggtcatataaggaacaaaaattacatttagtgacaaataggaaagaactatggtaccgtttggttcacataattgtaacgtaatgggtaagtgataacgttaattcatgtttgttttagtttaaccgtaatcagataccgtactaaaaattgatacagactattcaaacttgttaccgacagtaatcgagtgtaaaccattaccctttacgttacattttgtgaaccaaacattacctatgtttcgagagcttaagaataaatcaatgactttactaatgtcaaataagtaactgcctcagttttttaatggtatgcaaggggaccggcacatattctaataaaaaacttggtcggagtggaaagaccgtacttcgatattgtattaaggaactgaaataaggtctcggccaagaaaactcccatcactaacagaccaatcaactgtccactcagccaagtcagagaggcgcgcaggatatctatccccgagatcggtgggtgaggtatagtgagaggatctttttaacaagcccgaaatcactcctaaactgtgttattcgaaatccttaaccattatgctagagactctatcgccggtacatattttaataatataaaagg

SEQ ID NO: 460 - DNA, 1741 bp, Zea mays
actctccagcgccctccacttgcagaggttcgcgactcgcgacgcctccgcagccccagccccacgccccgcgacccaaaccctagccccctccaccgtaccgccaccgtcatggccgaaccatccgccgccgccgtcaccgcagctgaggtcggggaggagtccgatgccgccgcgatggaggaggtcgcggcggccgcgaagaggtggcccgggtggcccggggacagcgtgttccggctggtggtgccagtgctcaaggtcggaagcataatcgggcggaagggcgagctcatcaagcgccttgtcgaggggaccaaggccagagtccgcatcctcgagggccccgtcggcgccaccgagcgtatcgttttggtttctggaaaagaagatccaggcttggagctatctccagccatggatgctctcatgagagtttttaagcgtgtcattgggataacagatggagctgcggagggcactcaggctgctgctactcctggtgtatgtgctgcccgattgttggttcctggagctcaggcaattaacctaattgggaagcaaggtgccactatcaaagcaatccaggagagcacgggtgctacaatacgggtaatatcagtagatgaacatgagagaccattttatgtaactgacgatgaaaggatagttgagatacagggcgatacagagaaagttctaaaagcactgcaagcagtttctaaccatcttcggaagtttttggttgaccatagtgtacttccattatttgaaaaaactaatactgcagtgagccaagatcacaatgttggttggagtgatatgtcacatccttcaattggttctgcacaagtgaatcaaccaccttcagtggtagatgaatatattcttccagtgaagagggatactttgtatcttgaacgagaacctttgttagatcataacattcatcgctcaggcgtatcactttatgggcgggatccagccttgtcaacactacgaccacctggaatacatggtgctggcccgctacttacacagataacccaaaccatgcaaatcccacttacctatgctgaagacattataggagttaaaggagcaaatattgcgtacatacgagctaatagtggagctgttgttacaattcaggagagtttgggtagtccagatgatattactgttgaaataaaggggacatcttcacaggtacaagctgcacagcagctcatccaggactcgttggctgcacaccgagaacctgtcagaagcagttatgtgggagcaggattagattcactgtataggtccagctactcacaatatggcagctccacctatccttcgtcatcactgccatcttattctagcatcgatgatgttagtaggtacccatcttcaggtcttggtggctatgggtcgagttacaggtactagtactagttcgtccttaggcttgaatgcttgatggcaccttgtatccattcctgggtgattattgtacaagtcagcaagttttctgctctgcgtgcttacgggcaggggatcattttacaagtcagcaagttctctgctttgtatgcttccgggcagggatctggtagattatactgcatcccaattcccagtacccagacttcggggtccaatttgctttgacaaacaatggaatcggaaatcgtgcttgttaaaaaaaaaaaaaaaactgtttccaggatattcgtgctattaaacctcgtgc

SEQ ID NO: 461 - DNA, 1696 bp, Zea mays
  misc_feature (1668)..(1673): n is a, c, g, or t
aagttgagcccgtgagaagccaaatcgcgaacccacccgggccaggggcaaacctcgtgctcccctccacttgccgaggaggctcgcgacccgcgacgccttccgcagccccgacccaaaccctagccccctccaccgtactgccaccgtcatggccgaatcatctgccgctgccgaggtcgggtcgccagcttcgttgccaccactggtcgccgaggaggccgatgccgccgcgatggaggaggccgcggcggtcgcgaagaggtggcccgggtggcccggggacagcgtgttccggctggtggtgccagtgctcaaggtcggaagcataatcgggcggaagggcgagctcattaagcgcctcgtcgagggagaccaaggccagggtccgcatcctcgagggacctgtcggcgccaccgagcgtatcgttttggtttctggaaaagaagatccagacttggagctacctccagccatggatgctctcatgagagtttttaagcgtgtcactgggataacagatggagctgctgagggcactcaggccgctgctactcctgatgtatgtgctgcccgattgttggttcctggagctcaggcaattaatctaattgggaagcaaggtgcaactatcaaagcaatccaggagagcacgagtgcaacaatacgggtaatatcagtagatgaacatgaacgaccattctatgtaactgacgatgaaaggatagttgagatacaaggcgatacagagaaagttctaaaagcactgcaagcagtttcaaatcatcttcggaagtttttggttgatcatagtgtacttccattatttgaaaagactaatactacagtgagccaagatcgcaatggtgatggttggagcgatatgtcacgtccttcaattggttctgcacaagtgaatcaactaccttcagtattagatgactatattcttcaagtgaagagggatcctctgtaccttgaacgagaacctttggtagatcataacattcatcgctcaggcgtatcactttatgggcgtgatccagccttgtcaacactacgaccctctgcagtacatggtgctggctcactacttacacagataacccaaaccatgcaaatcccacttacctatgctgaagacattataggagttaaaggagcaaatattgcgtacatacgagctaatagtggggctgttgttacaattcaggagagtttgggtagtcctgatgatattactgttgaaataaaggggacatcttcacaggtgcaagctgcacagcagctcatccaggactcgttggctgcacaccgagaacctgtcaggagcagttatgtgggggcaggattagattcagtatataggtccagctactcacaatatggcagctcaatctatccctcgtcatcactgccgtcttattctagcatcgatgatgttagtagatacccgtcttcaggccttggtggctatggttcgagttaccggtactaatagcagtttgtcctcgggcttgaatgcttgatggcaccagtgatcattgtatcccagtacccagacttcagggtctgctttgttttgacaaacaattaattggttttatagattttcgccactcatggattcagaaaaaaaaaaaaaaaactcgtgcccggggaaaaannnnnnggaaaaaaaaaaaaaaaaaaaaa

SEQ ID NO: 462 - DNA, 1661 bp, Zea mays
cattgggacctcgagccggcgggaaaaaaaaaaaaaaaaaaaaatctatccttgtgaacaagttgagcccgtgagaagccaaatcgcgaaccccacccgggccaggggcaaacctcgtgctcccctccacttgccgaggaggctcgcgacccgcgacgccttccgcagccccgacccaaaccctagccccctccaccgtactgccaccgtcatggccgaatcatctgtcgctgccgtcaccgcagccgaggtcggggcgccatcttcgttgccaccgctggtcgccgaggaggccgatgccgccgcgatggaggaggccgcggcggtcgcgaagaggtggcccgggtggcccggggacagcgtgttccggctggtggtgccagtgctcaaggtcggaagcataatcgggcggaagggcgagctcattaagcgcctcgtcgaggagaccaaggccagggtccgcatcctagagggacctgtcggcgccaccgagcgtatcgttttggtttctggaaaagaagatccaggcttggagctacctccagccatggatgctctcatgagagtttttaagcgtgtcactgggataacagatggagctgctgagggcactcaggccgctgctactcctgatgtatgtgctgcccgattgttggttcctggagctcaggcaattaatctaattgggaagcaaggtgcaactatcaaagcaatccaggagagcacgagtgcaacaatacgggtaatatcagtagatgaacatgaacgaccattctatgtaactgacgatgaaaggatagttgagatacaaggcgatacagagaaagttctaaaagcactgcaagcagtttcaaatcatcttcggaagtttttgggttgatcatagtgtacttccattatttgaaaagactaatactacagtgagccaagatcccaatgggtggttggttggagcgatatgtccaggtcgcttcatattggttctgcacaggtgaatcagctaccttcagtgttagatgactatatccttcaagtgaagagggatcctctgtacctggaacgagaacctttggtagatcataacattcatcgctcaggcgtatcactttatgggcgtgatccagccttgtcaacactacgaccctctgcagtacatggtgctggctcactacttacacagataacccaaaccatgcaaatcccacttacctatgctgaagacattataggagttaaaggagcaaatattgcgtacatacgagctaatagtggggctgttgttacaattcaggagagtttgggtagtcctgatgatattactgttgaaataaaggggacatcttcacaggtgcaagctgcacagcagctcatccaggactcgttggctgcacaccgagaacctgtcaggagcagttatgtgggggcaggattagattcagtatataggtccagctactcacaatatggcagctcaatctaaaaaaaaaatcactgccgtcttattctagcatcgatgatgttagtagatacccgtcttcaggccttggtggctatggttcgagttaccggtactaatagcagtttgtcctcgggcttgaatgcttgatggcaccagtgatcattgtatcccagtacccagacttcagggtctgctttgtttt

SEQ ID NO: 463 - DNA, 1510 bp, Zea mays
gtcgcggccgcctccgcggccacagagaccatgccgctcatgccctccttcaagaggaagcgggcctcggccacggtggagaatgcggaggaggcggccgccacggccggcggcggcgagacgtcggtgctcgacctgccggagctggccatcgattgcattctggagaagctgcggccggcggagctgcggagcatggccgccgtctgccgctccatgcgcgagcgctgccgcggcgaccacctctgggagcggcacatgacaaacaggtggggccgtgtcctgggccgcgccgccagggacgaatggaggacgcacctggcgtccgccagcgagtcccgcgccgcgggcggcggcggcggcggcggcaagcgccggaggtggctcgccgcgctgtcctgcgtttgcccggtggtgtcctggatgcggcccagggccgacggtggcaagtcgtccgcccccgtgctggacgattccatcatgtcgtggtacctgtccgtggagagcggcaagttctggttcccggctcaggtctacaaccgcgagcatgggcatgttgggttcatgatgtcatgctatgatgcagcgctcagttacgatttccataccgacacattccgtgcaaggtacccaccacacggtcgacgaaccgtggtgttggaggatggcgtgcaatgggacagggtgagggcaccgcctgttgacacccttgcgcatgacctgcacacctctgactgcctgcatgagctccggcccggcgaccacatcgagattcagtggagaaggaacaaagaattcccatacggctggtggtatggagttgttgggcacttggagtcatgtgatggaagcgaacacttttgtcggtgccatcttagtgataccgtggtgctggagtttaatcagtacacgccgggctcaaggtggaggcaagcgttggtgaaacggaaggagcatagggaggagggcaacgagggcgacgggttctacggcggcataaggaagctccgcggcaacgatgacatctccaagtggaggcagctgtggccaacagacgtcctggagtaagcaggaaccgcatcccttctcacaccgacattgatccatcgctcaaatgacacgcctttctttcatcatcatattgaccaaattcgtcgtctctgtcgcgctgttgtaaacgggttagtagaagaacaaatcccgtagctggacaagggtgtaacacttactctctccgtttcgttttagttgtcgctggatagtgcaaaattgaactatccagctacaactaaaaagaaacggatggagtatttgttaggcgtaccaggcgcagactgcttcctatttgttcgtggggctgtaactgtaagccttgtttgtgacccctaagcagtctgcgtcttgtgcctgctgctgtagcggtagagcagagagagatcaaatgtaaattacatttttttagctcaaattcacgacaaaaaaaaagacaaaaaaaaagtcgacgcggccg

SEQ ID NO: 464 - DNA, 1910 bp, Zea mays
aaacgtcgaagccacacgtgaggatctccataatagcaaatttcccagtgtggagagtagggtgctgtggaagaggcgagctgaggaagggaagggaaccctcttgaccgccggcggcgaggggagatgccgccggagaggacgaggaagtcgaggacggaggagctgtgggagcgcgaggtcggcggtctcccacccaagcgcttcgccaactccgtcatggcctccaaggagtttgtgcagtctctcaacatccaaaagcggctacggaagcacaggagttgcgtcaacacgataagcttcagcgcggacgggaggctgctcctctccgggtccgacgaccggaccctcgtgctgtgggactgggaggaggcggcgccggccttgtcgttccacactgggttcagcagcaacgtgtaccacgcgctgttcatgcctgtctccggtgacaggagcatcgtctcgtgcgctgctgaaggggatgtgatccattcgcagatacaggaaggggggcgtgtggttacacacacacacaaacttgttgagttgggctttgcagtacacaggttggctgttgagccagcaagtcctcacacgttctactgctgctgtcaagatagctccgtgtggctttttgatctcagggcgcgaaatgccatggaattgtttaaatgtaggtctgcgaactatcacactgctgaaaatatcgcactctatgctatttccttagacccaaggaagccctgttgttttgcagttgctggatcagatcagtatgtaaggatatatgatacccgtaagatttttgtggatgggaattctagtttcagtcgcccaactgagcacttctgccctccgcatttgattggtcgagtggaagaagaaataactggtttggcctactcacagaccagcgagctattagcgtcctatggtcaagaagatatctaccttttctcaagagagcatggtttacacttcaacaatgttgaggtcaataaacgactcctggaggatatgattgagccttcatttagtgataagttgcctgtacctaagaaattcaagggacaccggaacgaggaaaccgtgaagggggttgacttccttggccccaactgtgattttgttacctctgggtcagactgtggcagcatatttatttggagaaagaaggatgcagaactgatcagagcgatgcgtggagataagcgggttgtaaactgtgtcgaacagcacccttctgggattgttctagcaagtagtggcattgagaatgatatcaagatttgggaacctggtgaaggtgaaaaccgatccatcgttcaagctgacgaggacgatgacaatactgtttggatccacggcagcagtgattctgatgacttctttgacgacaatggtttcggtttgatggtcatggaacctatccatttatatgaaaacagcgataatgattcatatgaggaggatacatcgtcagaggaacatgacagtgatggtgacagcagtgccggagatgaagattccgatagtggaaacagtgccggagatgagggcgacgattgatgatcaaggacacggatccatgcctagttcccagggagcaaatcttcatccgagaacagctgattctttcgtggttgtggttgtagccttgtaggttattttgggaggagcaaggcttacccaaaaaaaaaacgttaggattatcatgggttactgtttggtgttcctctgtgtatatatttttcgtcggaattggggtagtctaccctaccgatgcaaacgtactgtggaagctaatgttccaacgggagactgaagtggtcatgatgttgaatggcatcaagtattcaaccatttcatacaatagtttggtggaaagtttatcaaaaaaaaaaaaaaaa

SEQ ID NO: 465 - DNA, 2315 bp, Zea mays
cctcgaggccggccgggcccctctacttcccgccgctggccgtttcccccgcccccccaatccaaaccctagagagagagagagagagtgtgtagtgtgtgtgtgtgagagagagggggattggaggcgaaggcagcgggctagcgctagcggaggaggagagatccgctgaggtggaacgcccgatcggcggagccccatccaccaccactccacaagatgcggggcgggacgctgcagatcaactggcacgaccagcagccggtgctcagcctcgacttccaccccgtctcccgccgcctcgccacagccggagcggaccacgacgtcaagatctgggaggtagcgtcggacggcaagctccccaccgccaccttcaagaccggcctggtccccaacaccaccgcccacagctccgcggtcaacgtcctccggttctccccttcaggggagtatctcgcctccggtgctgatggtggcggcatcaccctctggaaactgcatcccgctgacgacggcgaggcatggaaaattcacaagacgttactattccatcacaaggatgttcttgaccttcagtggtcgcatgacagcacatttcttgtttctgcatcagtcgacaacacttgcataatttgggaagctagtaaaggcacagtgcaacaaaagctagagggacatctgcattatgttcagggtgtggcatgggatcctttgggccagtatattgcttcactgagttctgacagaacctgtaaaatatatgcaaaaaagcctcagggcaaatccaagaacgcggagaggttgaactttgtttgccagcatacactagtgaaggtagaataccagaatcatgatgaatctaagccaccaaccaaatctcatttgtttcatgatgagacactaccatctttcttccgaaggttggcatggtcacctgatggatcttttctagtattgccagcaggcctttctaaacactcctccgaggtgattaatacagcttatgtaatgtccaggcgtgacctctcaaggccttcgatacaactccctggggcaagtaaagctatagtggcagtacgcttctgccctgtactattcaaaccacgtggttctaactcagatggtttcttcaagcttccttatagagttgtctttgctgtggctactttgaactctctgtatgtctatgatacagaaagtgttcctccaattctagtccatgctggtctacactatgctgccattaccgatattgcatggtcttctgatgctaagtacctggcagtgtcatcacgagatggctactgtactataatagagtttgagaatgaggaactgggacagcctcacatactccccggatcaaaggaagttgctaatgggaatctgacacctgagaccaagaagcctgtatgtgctgatagcatgaaggttgataatagtgccaacaagcttaagatggaagccagtcctgttgctgtaggagttagagcaccactgctgccaactgagaacatcaagagaacaggagagcttgccgaaggaaatgtaacctgtgaaaacaaggagccggtaacaatagacagtatggaagtagatgccgatgataccaaaggcaaggaggcaaccatacccgtggcagctgaagtgacaccgccaccagcggtaccggcagcgaagaacagcgcatctagtaagcctgctaagaggcgaattactcctatcgcaatcgactaggtagtagacgcagcagttagggttttgatgtgttatgtagtgatggcaagtactggatactatgtttaggctaccctgtaaagtcgtttgtgctgcggtgctcatcttctgctctagtcctcctgctcttgacacaattggggagaatgtgaacagaagggctgtgtgtatgtatgagcacactttgttatggcgcaacatgcaagccactaaccgacatcttaagaagtaaagttcattactgacgagtggggaagttgtttcacacaagctgctcatatacaaatgctggcatacaaattacacattgaaatcaatcagatggggacatgacgcccgtatttcatttacatgaaagagcatagaatcttatcaaaataccgaaagcgaatgggagggtagtatgtatatgtgtgtgcgtatgggtatggtattggcctcaagttgaagggccttgggtgcagtaggcatcatcatgcatctcaggactttgttatgcgcgccttggatttgtcatactcttcctggctctcgccggcctcttcaaacctgatgtcctcatcctccgaaaggac

SEQ ID NO: 466 - DNA, 1943 bp, Zea mays
gctgatcaccatattcattactttgatttacgtaatccaagtgcgcctgtccatgttttggggggcacaagaaagcagtatcgtatgtcaaattcttatctaacaatgagcttgcatctgcatcaacagatagcacgttacgtttatgggatgtcaaggataatttgccggtacggacattcagagggcacaaaaatgaaaagaacttcgttggattgtctgtgaacaatgagtatattgcttgtggaagtgaaacaaatgaggtttttgtttatcacaaggctatctcaaaaccagcagcaagccatagatttgtatcctctgacctggatgatgccgatgatgatcctggttcttatttcattagtgctgtctgctggaagagtgatagccccaccatgttagctgctaacagtcagggaaccataaaagttcatgtacttgctccttgatctcgtggagggcgttcaagagatttacagccagcgcgtgtatgtcgtactgtccaggtgttccctttcgtgccattatattccccaaaagcgagaatggaggcattattgatctccggttagggcatgaatttttgtagacgatggccagctgacgtagggttttgaggtaccagaatgtgcataatcatgtttatgttgtacaggtgtaaatcagccaagttattgattacaagtgtgacatgagaaatacacattaataaaaactccagctcggttgtacagagattgtgtttgaacccagaaattcatgtggttatgtcgtttgataatatatgtacctggcaggggtgaagctaggccttttttttgtcagctggccttgataattttctggatatctaatgaaaaaacgatgtcaataacaagagttgtataatgaagatctagtagataatactagataataccgatgacccagataaaatatttgctagcttcgctattgctacctggtatgatcaaacggatgccgcaaacagtattcagcagctgtttctttcaggcgtgtttaaagtttttcccctgctttttatggggcaattttcaaggatttttttgagcattctggcgtgttgtttcaagaattatgttctatacgttcaatcaggcgatcatacaaagtggacgtacgccatatattttacttgtcatttgcgtttctcgtgatctgatacctaaaatttgcttgcacaacggtgctgttcttttttattcttgactaaaaacagtgttcttttgtttatgaacacaaaatagtacggtcggtggatattagctgcactaaagcggttgcacaggagaactctaaaaagtgcccaccaattcctgagatacgtagttttgtagctcacgagaccgactgaagcgtcaacagtcgcggcatttgttctgtcggccgagtccgcaggtcgtccggcgagcgagatgctcgttggcccatgacccttccagcgcccaacggcctatacgatacggtttccgcaggcgcaaccgatcgagcgacccacccctcacccgtgcacgcacacgcacagatgcacggcacggccggtcgaccgccccagcacaagccgcgtcgccgatgtgatgggtgggcgagttgcgacggggccgtgccgctaccgcccgcggaccgcggaagcaggacggacgtgccgacgtgcgcccggaaagaggtcactcgtcgggtgtcggctagtcgacttcacggggcgttgtttccgcatcttttaccccgcgaccagagtcgcccatgttgtgctcggtaatctgctgggggtgatcagcgtctaatccatgtggttaactgggcacgcatgggcgtaactgcataagcttctatgacaattgttactcgtgagtatttactccattagggctagtttagaaataatattttttaggcttgttcggttagctctcaatcca

SEQ ID NO: 467 - DNA, 2710 bp, Zea mays
  misc_feature (465)..(465): n is a, c, g, or t
atcacacatccaccgccgccgccaccaccaccacccgccctatacccgtatataattactcgtacccggacgccaccgccgcctgcgccatgggcgactcctcggtggccggcgcgctcgtgccgtccgtgcccaagccggagcccgcgccgtccggtgacacctccgcggcggccgcggcgactacagcggcgctggcgatgccggaggaggcgggtatgcgcgcggcgtcggcgtcgcctcaggggcctgcggaggagggggagggccccgccgatagggaccttctctgcccgatctgcatggccgtcatcaaggacgccttcctcaccgcatgcggccacagcttctgctacatgtgcatcgtcacgcatctcagcaacaagagcgactgcccctgctgcggccactaccttaccaaggcccagctctaccccaactttctccttgacaaggttctgaagnaaaatatcagcccaacaaatagcaaaaacagcatcgccaatcgatcaatttcgatgtgcattgcaacagggaaatgaaatgggggttaaagagttggatagccttatgactttgattgctgagaagaagcggcaaatggaacaacaagaatcagagacaaatatgcaaatattgctagtcttcttacactgccttagaaagcaaaagctagaagagttgaatgagattcaaactgatctacaatacatcaaagaggatataagttctgtggagagacatagggcagaattatatcgcacaaaagaaaggtactccatgaagctgcgcatgcttttagatgagcctactgcacaaaaaatgtggccctcttctatagacaaagctagctgtcgctttcttcccaactctcggacaccacttagtggatcatgtccaggaactttacagaataagaagcttgatttgaaagctcaagtaagccatcaaggatttcaaaggagagatgctctaacttcttctgatcctcctaactcccctatacaatcgggtaatgttattgctaggaagaggcgagttcaagcacagttcaatgagcttcaagaatactacctgcaaagacgtcgtactggagcacaggcacgcagacaggaagaaagagatatagttgcaatgaatagagaaggctatcatgcaggtcttcaggatttccagtctgtgctaacaacgttcactcgatacagtcgtctacgtgtcattgcggaactaagacatggagacttgtttcactctgccaatattgtatccagtattgaatttgatcgtgatgatgaactatttgctaccgctggagtctcgaaacgtattaaagtcttcgaattttccactgttgttaatgaaccatcagatgtgcattgcccagttgttgaaatggctaccagatctaaacttagctgcctaagctggaacaagtactcaaaaaatattattgcaagcagtgactatgagggtatagtaactgtgtgggatgttcagacccgtcagagtgtgatggaatatgaagagcatgagaagagagcatggagtgttgatttttctcgcacagactcttcaatgctagtatctgggagtgatgattgcaaggtgaaagtgtggtgcacaaatcaagaagcaagtgtgatcaatattgatatgaaagcaaatatttgctcggttaaatataatcctggatcaagcttctacgttgcagtcggatctgctgatcaccatattcattactttgatttacgtaatccaagttcgcctgtccatattttcggggggcacaagaaagcagtatcatatgtgaaattcttatctaacaatgagcttgcgtctgcatcaacagatagcacattacgcttatgggatgtcaaggataactgcccggtacggacattcagaggacacaaaaatgaaaagaactttgttggcttgtctgtgaacaatgaatatattgcttgtggaagtgagacaaatgaggtttttgtttatcacaaggctatctcgaaaccggcagcaagccatagatttgtatcttctgacccggatgatgccgatgatgatcctggttcttatttcattagtgctgtctgctggaagagtgatagccctacgatgttaactgctaacagtcaggggaccataaaagttcttgtacttgctccttgatgttatggagggcgttcaagaggttcacagtactgtccagttgtttcctttcgtgtcattatattcccccaaaattgggaacgggggcataattgatctccggttagggaatgaagttttgcagatggtcagctgacgtagggttttgaggtatcagaatgtgcatagtcatgtttatgttgtataggtgtaattgtgtaaagcagccaagttattggttacaagtgtaacacgagaaatacacattaatataaaaaaaacctccagctcgtttgtacagagattgtgtttgaacccagaaccttatgtggtaattgcgattagtaatatatctacctgatatgatcagcaaaaaaaaaaaaaaaaaaaaaaaaaaaaaaaaaaaaaaaaaaaaaaaaaaaaaaaaaaaaggggggaagaaaataaaggaaaaaaaataagggaggcgggcatgcaaagaaataaattttttataagggggggggggcctttttaaatggccaaatttttaccccgtgggtacggaaaaaaccttttt

SEQ ID NO: 468 - DNA, 622 bp, Zea mays
tcgtttcgcgtcctagcccaggacaagttccctttttcttctcccaagtctgcgactaggaggcgacgggccgacgggcaagtttcctttctcttctcagtctgcgactggcggcggcgaccatcacgcacaagccttcgttgctacctgcgctccgccaattcggtgaattgcagtctaagcaaagggaaaaggaaggatcttttctccagacttggtaattttggacgacaaggttttgtattatctgatttttcgggatggatgccaaaaggttcctgcatctggtcgaggagaagaaaagaagggtcctcgagaagaaagaagccccactaaagtgggagcagaagctagaaacagcagctaaggccaaggttgatgcagaagcaaaggtgaagaagctaaattcaagaaagcacaggaggagaggagatttgtcctcagactctgatagtgactatggcagcgatgttgatcgaaaacacttgaagaggaagaaccgcagaaggaacaagaagcatgagcattctgactctgatgatgccaggagatgcaatcgtagatctagaaagagcaccgactcaagtgatgacagcgacagtgaatatgagaccaggtctga

SEQ ID NO: 469 - DNA, 4729 bp, Zea mays
taagatttagtgtggcggcttttaaaccgatacacgagtagcctaaaccaaatttaggtcctatttagaagcaaacctgtttttattttttaactacaagagtttttttagtatttaagaatctgtaaatctaatttttttataaattaagtataaattggtttatttagaatcatctcaatttttataaaacagttttttttaaaaattaggtcgttcaaaacagatatttaatctctcagctcacaatgcgatcgctcgtttcgcgtcctagcccaggacaagttccctttttcttctcccaagtctgcgactaggaggcgacgggccgacgggccaagtttcctttctcttctcagtctgcgactggcggcggcgaccatcacgcacaagccttcgttgctacctgcgctccgccaattcggtgagtcgcgctcttgctcgcttgttttgcatttcctttcaacctgtcttaaaaccgacgaattttgtactgcgttttctcccgatttcctccctgaaaaaatcatcgaattttgaactatgttggtagcgcgcttgggctcagatcgcgtcttgggctccagaagcggtgattggagtcagatctgtgagctgcaaggtctagaggttttaaagcgcagttggtttgggggcggtgattctcgggtgttggttctgtcgcggtttgttgtgttttccagaatctcgggtgcgtcgaattctgcgagctctctgttttgcgacgtaccagtactgagaattggtattggatgcggctgggattcgagaatgccccttccaaattgccaactgttttctgtcgaattcatatccgtttttttttatggctgctgttgcaggtgaattgcagtctaagcaaagggaaaaggaaggatcttttctccagacttggtaattttggacgacaaggtaacaaagtgtataatcgtgcatagtctgtgttcgtttcttggtagcggctgtcttagcttctcctattgttaaccttctcagtgtggtacggtgattttataaacatgtaactacagctagttccgagctcttattactgtcacttggagatataaagataacataaaaagggcagacctcccgaggagtggtgtttgggaaagggataaaccaaggcatgcctccccgcagatgcggattagctgctttgaacccgcgacccagttacctattgagacaactctcatacaccaggcccaccctttttatataagataagatgttgggagttaaattaatttggaagtctgtgtctcttttgctgcgcccagattcataaccataatcatgtttaaacaagtgctgtgtgaagagccatatttctcacataagttttttaggatattgtgtatagttgtgatataattgtgatatctgtgagatcccttttgttaacatagttttatgagcttggaagcttagaagccatctagctttgaacatgattgattgatcactctccatagaaagttgacttgaacattaagtgaactgcgtgagtattatctgagaatactttgattacatttgatgcttaaactagctcaaagtgtctccaagtaatttgtcgttaggaattaattcactgcattttgttatgtctatacatggaagtttgttgtataaatcttttaatctatctgattagatgtacatctctactgatgtgctatataactttagatgttcaaaaaactaacagtgtttttctctcttctatgagatgcgcttccttgcatcatttcatgtccctacaggttttgtattatctgatttttcgggatggatgccaaaaggttcctgcatctggtcgaggagaagaaaagaaggatcctcgagaagaaagaagccccactaaagtgggagcagaagctagaaacagcagctaaggccaaggttgatgcagaagcaaaggtgaagaagctaaattcaagaaagcacaggaggagaggagatttgtcctcagactctgatagtgactatggcagcgatgttgatcgaaaacacttgaagaggaagaaccgcagaaggaacaagaagcatgagcattctgactctgatgatgccaggagacgcaatcgtagatctagaaggagcaccgactcaagtgatgagagcgacagtgaatacgagaccaggtctgaagaagaacgtccaaggaagaagcgctcgcacagaagaaggcatcaccggcactcttcaaagtcagactctgaaaactacagcagtgatgaggaacaacggagacctgccaaggaccattctcagagccgcaggcggcaccatcggtcgtctgatgatgactcaggcaaggacaaggtcaagtcaagacatgggaagggtctgagatctcgtgacgaggatgcaagggcagatttcaacagccataagcatctcaggagccaatccttggaggagtcatcagatgatagagatgctgatgaatctgagaagatgaggaatggcaaaaggtctcacaagaatggcggccaccgtcaccatcgacaccaccatgaatgacatagtaactctgcagaacctaatgacaggaggcaagtactgaaagatggccagagggcccttgaaggtgacagcgcatactgaagatatcccagcaaggtcgagttaattgtccttattaaggacatgaagatcatttttttttcgttcctgatgttctcagataattattgtattgctgacaacatttctttgatttgtgaatatactaaacatgttgcctatgcaaaatttgctgtagatgtccgatctccgaaggctgaagtcgataaaagggctagaacggagacatttgtgtcactgtagtggtgcaatttaagtattagatcattaagacaccatagtgcaacagactctttgaacacgtctcaattaaacaccatgcatcgatatgctccattccactcaattaattcagaattctgacgacatacaccgaaatctcaacgctgcaaaaggcacacggcgctcacatcttaacacatacgaactgaacataatgctatcccctttttaaggtaatttcttagtacatcagcgcactacatctgtatcccctgattgatgtgtcagatgctagaaaacaatagcgccttacatctatatcccctgattggtgtctcagctgctacaaaacaacctcaactgcccagcgtcctgttgacatttacatcaggtattcagcaataaggcaatatggtaattgtggtcacattacgtggaaatcaactgcccttatttgtaagcatgcaactgtctccctgttgcacttgcactgctttaaagagttgctgctcaatgggctcggtcagaagttagttaagatcctatcttttgacttctcttcctgttttcttagttaacttttcaagattcaaatatatcttttggaataataaaaatatagttttatcatttatttattttaaaagaatatcttcaaaggcatgaaaatccatataaacagccatcgtaattaaaaaaattggtgaattttatcaaatccccaaaaaataagattttaggttgttacatctgcacccacatatacccacatataatacgccggccgaaaaatatcgtatctgacccgccagcgtcgcgcgagcggcgagcctgggcttccgcgcacaaccatccaatcactcccactagatgcagggtggcttcttgattttaaatacaatgaatttctagcattgtcacgcaagggaataaacgggaataaaacggctgcatttttttatggcacttgttgtggagttcacaaacgatcactgtggtgtttctaacaagaagttgtttcatcaggatttatttggtaaaaaaccaaaaaaaaaaagaaacgttataaataaaaccggtgcaaaaacaaaaaaaaacagctctggtaggtatatctgtagcgtgacatgagctagagccgtctacgcaccatttcttttaagcgactccacctaacgaaccaactgccacactagccgaactctctacgatcgccccatttacaattgcattgcaataatactatttgtagttctattattatctgctactggtgtactattaaatatgaaaaagaaaacccggtctcagactcatgcatctgacgcaactgatggtctgaccgtttcttgccatggcttcccttccctgaaggttattacgcgaagaagagcagcgattggcaacaagattcccagaagcaatgccgtccgtaatccactgctggcctccatggcgtgatgcgtgactggtaaacgcgtcctctgtttgcgtcgcgtgcacagccagcgccgagccaaaaagaaaaaaaaaggaggaccatacgcaacgcatgcatgtccaaactgcagcagcgcccaaaacacagtgaatatgcagggcttagttacagacaaggagcaaaatgataaacacccacccaagcggagcggtaacagccaagcgataatgcaagattgcgcttgcgctccgtgccatacataaatacgcttcgacatgacagggcagggcagggcaggacacgcacgtagtacatacaggtcacccgtttcgatctcaattcgtgtactagtataatagtagtagctaggattaagttagcaagacaggagctgtgaggggacctgccggtatactactatctaaccttggctgcaggggtaccgag

SEQ ID NO: 470 - DNA, 1293 bp, Zea mays
cattgggtacctcgaggccggccgggtcgtttcgcgtcctagcccaggacaagttccctttttcttctcccaagtctgcgactaggaggcgacgggccgacgggccaagtttcctttctcttctcagtctgcgactggcggcggcgaccatcacgcacaagccttcgttgctacctgcgctccgccaattcggtgaattgcagtctaagcaaagggaaaaggaaggatcttttctccagacttggtaattttggacgacaagatgcacttccttgcatcatttcatgtccctacaggttttgtattatctgatttttcgggatggatgccaaaaggttcctgcatctggtcgaggagaagaaaagaagggtcctcgagaagaaagaagccccactaaagtgggagcagaagctagaaacagcagctaaggccaaggttgatgcagaagcaaaggtgaagaagctaaattcaagaaagcacaggaggagaggagatttgtcctcagactctgatagtgactatggcagcgatgttgatcgaaaacacttgaagaggaagaaccgcagaaggaacaagaagcatgagcattctgactctgatgatgccaggagacgcaatcgtagatctagaaggagcaccgactcaagtgatgagagcaacagtgaatacgagaccaggtctgaagaagaacgtccaaggaagaagcgctcgcacagaagaaggcatcaccggcactcttcaaagtcagactctgaaaactacagcagtgatgaggaacaacggagacctgccaaggaccattctcagagccgcaggcggcaccatcggtcatctgatgatgactcagacaaggacaaggtcaagtcaagacatgggaagggtctgagatctcgtgacgaggatgcaagagcagatttcaacagcaataagcatctcaggagccaatccttggaggagtcatcagatgatagagatgctgatgaatctgagaagatgaggaatggcaaaaggtctcacaagaatggcggccaccgtcaccatcaccatcgacaccaccatgaatgacatagtaactctgcagaacctaatgacaggaggcaagtactgaaagatggccagaggggcccttgaaggtgacagcgcatactgaagatatcccagcaaggtcgagttaattgtccttattaaggacatgaagatcatttttttttcgttcctgatgttctcagataattattgtattgctgacaacatttctttgatttgtgaatatactaaacatgttgcctatgc

SEQ ID NO: 471 - DNA, 2550 bp, Zea mays
ctcgaggccggccgggaacgcctactgcagccgccggccaccgcgcggccgccccgcactcccatccctgggactactcttggtggggtgggagactggagagagccacagaaggcaactggaggttcgaggacggcgcgataggcgagccggcgagttcgggtgcttttcctggggtcggagatgcgaccgttgggacctgggaaacagcgcacttcgagttcgggggcggctcccgcgacggcggcagccacctgagcaggatgtttaattggaacgacgagcagcagcaggcaggggatgcaatatgggctgagttcaatgacagtggggaccatattgtgccatatcctaaaggtgtagaagatagtacaatagttagtgccagggacctcaagaacaatgaggaagaggtggctagtattgctggcatcagtgaacattctacaggtgttcaaactggacttcaagtgatggaaaagcagactgcaaaccagacatgtgcacatttttcagccacacaaattgacatggaatcctggcctgaccttccttccctcaatcctacacttgacagaaactatagtgatgacaacatagcatccacatatctggctttcagtgctgaacccagtttacagaaagtgacaggaaatgctacagggcaaatagatggtgaatcagaagtgtttggtaatgatcaagaagaaaagagtaacagttttccttgatttgtgattgggggcaatattgggagatttttgatgattttgaccgcctatttagcaatagtgactccatatttggtaatgggatagttgccagcgacaatgattttctttcagcatcttctaatttgatggataatgctgtgcagtcaatcccaattccgcaactaccattgaataaacgaccatcatctgatcgtgggccttctttggttctgactaaagaaatttccagtggtgtcaccattaccaaacaagaaaataaggtcgaagtacacaagaggccagcgaggtcacgcagaaaaccagaggaaagaggtaaaagtaaaatatccagtagtgcaagtggcttctccccgagcaaattagagaattcatcatcaaatttgcaagctcctatgcaacatgtacagactcctcaatatgcactgttccaggatagcaagaagataggaaaggttcagcatgctaatcagtttatgtttcccgaatatgggtatcctgcatatccatttcctaccattccgttagtgtcaaacattcaagctgatggctatcagacaaaatcagctggcacaagttgccgaacttcagaagattccccaaaacagtcaagttcaatagaaatgtcacaagacataccatcgagaccactgtcaatgacaccacaagaaaagatagaaaagcttaggcgccggcagcaaatgcaagcgctgatagctattcagcgacagcagcaacagtttggtcaacagggttctggcagtgatccaatggtgtctcaagcatactctcttaggaacaaaaatctggattccttaggtagttcaattgtcatagatgaaaacacaaatgagattttttcgcctgagatgattccgacataccatggcccggttcacaagagttctgcaatttcagatgatccctttatagaggaaaaaatatattatcaactacaagatgctcttgacaagttgggataccaaaactcgactatgcattcgagatagtttacttcgtttggcccatagtgcaacagagagacaaattgatggtgataggagcagcactaacaagacaaataaagatgaagatgaagcttcagaagatgcatttactaggagaacaaggtagagtacaccaaaaatggttttgttaacgtgtttctgtattactctcaggtaactgatgatatgcaacgtgacctcaaatcatgtcttacttaccatcatggctcagtttatatttttatgatctcaggtctcccactaaggaagaagaaacaatcactaatccaactgatcgtatagtggcctatttgctgtttcatagacattgctcccaggttgcagcagcaacaaaagaagaaatcatatcctcaacccccttgacactagaacctgagctgaaggtaccattgggaactactatggtactatcagaagatcaactgctttcagaggatcaacgagatgagcaaaaaaatgtgttgcagccgtcacaataaggtgagatgtgctagaagataaggctttacttaatttgagtaagattatttgcatttaattagcctatgaatctattgtcgtccttctaatgagcatacagatgctgattgatcaactgttcagaatcaatatgatagcaaaccccgtgatgatgacagtctgctgatcacctgtggctccggagatcccttgtgtaatatgtaaccatttcaacattgtagcattctttttttttcatcatgtaataacatctcagactgtatacgaacctacaattgtgtgtcgagccctaaaaagagcaaaccttggac

SEQ ID NO: 472 - DNA, 2286 bp, Zea mays
acgcattctcccggccctggactattcttggtgggtggagagagccgcagaaggcagctggaagaggagaggaccgcgcgaggctccgtgccggcgagttcgggtgcttttcctgcggtccgagatgcgatcgttgggacccgggagacagcgcagctcgggttcgggttcgggggggcggtagccacctgagcaggatgtttaactggaacgacgagcagcaccaggtaagggatgcaatatgggctgaattcaatgagtgtgatgaccatattgtgccttgtcctaaaggtgcacaagatagcacgatagttagttccagggttcgcaagaacaatgaggaagaggtggctagtattgctgccatcactgaacagtctgcaggtgttcaaaatggacatcaagggatggaaaagcagactgcaagtcacacaagtgcacatatttcagccacacaaattgacatggaatcctggcctgatcttccttccctgaatcctacacttgatagaaattatagtgatgacaacatagcatccacatatctggatttttgtgctgcaaccagtttacaagaagtgaccggaaattctacagagcaactagatggtaaatcagaagtgtttggtaatgatcaagaagaaaagagtaacagtttccttgattgcgactggggcaatattggagattttgatgattttgaccgtctatttagccatagtgactccatatttggtaatgagatagttgccaacgacagtgattttctttctgcatcttcgaatttgatggatactgctgtgctatcaatcccaattccggtcgaagcacataagaggccagtgtggtcacgtagaaaaccagaggaaagaggtaaaagtaaaatatccagcagtacaagtggcttctcccacagcaaagtagagagttcatcgacgaatttgcaaactcctatggaacctgtacagactcctcaatatgcactgttccaggatagcaagaagataggagaagttcagcatgctaatcagtttatgtttcctggatatgggtatcctgcatatccatttcctaccattccgttagtgtcaaacattcaagctgaaggctatcagacaaaaccagctggcacaagctaccgaacttcggaagattacctaaaacagtcaagttccacagaaatgtcacaagatataccatcaagaccactaacaatgacaccacaagaaaagatagaaaagcttaggcgccggcaacaaatgcaagcactgatagctattcagcaacaacagcaacagtttggtcaacagggtcctggcagtgacacaatggtgtctcaagcatacacccctggtaacaaaaatccggattccttagggagttcaattgtcatagatgaaaacacaaataaggttatttcgcctgagatgattccaactgaccatgaccgggttcacaagagttctgcaatttcagatgatccctttatagaggaaaaaatatattatcagctacaagatgctcttggcaagttggataccaaaactcgactatgcattcgagatagtttgcttcgtttggtccatagtgcaacagagagaaagattgatggtgataggagcactaacaagactaataaagatgaagatgaagcttcggaagacgcatctactaggaaaacaaggtctccaaacaaggaagcagaaacaaccactaatccaattgatcgtatagtggcccatttgctgttccacagacattgctccaaggttgcaaaagcaacaaaagaaataatatcgtcaatccccttgactctagaacctgagccgaaggtaccctttggaactcctagggttccatcaaaagatcaacgagatgagcaagaaattgtgttgcaaccatcacaataatgtgagatgtgctagaagataaggttttactcaatttgagtaaacttatttgcatttagttagcctatgaatctaatgtcgtccttctaatgagtatagtacacatgctgattaatcaactgttcaggataaaaaattatgcaaatccagtgatgatggcagtcttatgatcacctgtggccccggagatcgcttgtgtaatatgtagccatttcaacattgtaggatccttttattttcatcctgtaagaacatctcagattgtataggaacctacgattttgtgccgagccgtaaaaagagcaaaccttggctctggacataaggcgtgtttaggagcaagaggattaaagcaaaccttggctcttggctctgg

SEQ ID NO: 473 - DNA, 1077 bp, Zea mays
gcacgagaccattacctagaacatcctaatcgaaaacaagttcaatagaaatgtcacaagacataccatcgagaccactgtcaatgacaccacaagaaaagatagaaaagcttaggcgccggcagcaaatgcaagcgctgatagctattcagcgacagcagcaacagtttggtcaacagggttctggcagtgatccaatggtgtctcaagcatactctcttaggaacaaaaatctggattccttaggtagttcaattgtcatagatgaaaacacaaatgagattttttcgcctgagatgattccgacataccatggcccggttcacaagagttctgcaatttcagatgatccctttatagaggaaaaaatatattatcaactacaagatgctcttgacaagttggataccaaaactcgactatgcattcgagatagtttacttcgtttggcccatagtgcaacagagagacaaattgatggtgataggagcagcactaacaagacaaataaagatgaagatgaagcttcagaagatgcatttactaggagaacaaggtctcccactaaggaagaagaaacaatcactaatccaactgatcgtatagtggcctatttgctgtttcatagacattgctcccaggttgcagcagcaacaaaagaagaaatcatatcctcaacccccttgacactagaacctgagctgaaggtaccattgggaactactatggtactatcagaagatcaactgctttcagaggatcaacgagatgagcaaaaaaatgtgttgcagccgtcacaataagatgctgattgatcaactgttcagaatcaatatgatagcaaaccccgtgatgatgacagtctgctgatcacctgtggctccggagatcccttgtgtaatatgtaaccatttcaacattgtagcattctttttttttcatcatgtaataacatctcagactgtatacgaacctacaattgtgtgtcgagccctaaaaagagcaaaccttggacatcgttatgattaaaaaaaaaaaaaaaactctctcatttctccgccgaaaataccctttttc

SEQ ID NO: 474 - DNA, 1740 bp, Zea mays
aattagaagcctcttcaaaagctcaaagaaagctctccgccccgtgggctggctcaggcttcatttctggctttacatccatctcaggccgatcattgatagacaaaatttcatcaactcgtggttccccttttggcccaagctcatatttatcagcacaggcaagagtagtcgatgattataccatgtcccagacaataatgaaagaaattggtaatggagatccttcaggaatgctcgttgttgtaactggtgcgagtcatgtaatgtatgggccacgaggaattggcgttcctgctaggatatctaaaaagatgcaaaagaaaaatcaagttgtgatacttcttgatcctgagaggcaaagtataaggagagaaggtgaaatccctgtagctgatttcttatggtactctgctgccaagccatgcagtcggaattgctttgatcgtgctgaaattgctagagttatgaatgctgctggcaggaggcgtgaagctttacctcaggatcttcagaaaggaatagatcttggtgtagtttctcctgagatattgcagaacttctttgacctcgagaaataccctgtcatggctgaactgattcaccgtttccaaggttttcgtgaaaggttgctagcagaccccaagtttctgaatagattagctattgaagaggccatatcaataactaccactcttctagcacaatatgaaaaacgaaaaggacgtttttttgaagagatcgactatgttctcactgatacaattaggggttctgttgttgacttctttacagtgtggcttcctgcacctacaatttcactcttatcttttgccgacgatggctctggtgagagtgtggagcttctgaaaggaattttaggatcactgccagataatgcatttcaaaagggtattgttgggcagaactggaacattaaccagaggtttgcatcggtgcttatgggtggtctaaaacttgctggagttggattcatttctagtattggagctggagttgcttcagatgtcttatatggtgcccgtcggattcttaaaccttctgcaaatatggaagtggggcgcaaaagatctccgatctggaaatcagcagctgtttatagttgcttccttggaacatcagcaaacctgcgatatcaggtcatagctggtctgattgagcatcggctaggagagaatctgatggcctactatgaccagccacttattgctaacctgttgtcctttgtttcaaggacagttaactcatactggggaacacagcaatggatcgatcttgcacgagttacaggcgtgcaaagaactaacaaagagctgccttctcctgaggtttcgagcgcatctgaaatgccactgctagaatgtggcacggcagaggtacctcggccgcgaccacgctataaccagtcaaatgacttgacataagttatcgcgcagtggccatacaaaacacagagcagcttccttccatggcacaccgtatactagacaaaccgtacatgcatataaatgggactgtcttcttagagccaggctgtgaagcttagccatcgcgtcatgtggagagacgaatctgaaatcctgaagagtaaagcttttgaagactttcgacttgttatgatcacagccatttttacacaccatcatggggtgaataccgtttgtacattcatagaggagacggccgaagaattctttggagcacgtacagcattttaca

SEQ ID NO: 475 - DNA, 3740 bp, Zea mays
  misc_feature (3305)..(3305): n is a, c, g, or t
gtctatcttgctattataagtactcatattttcttacatcggagctgatgaaatttattgtatttctgtatcaggatcttcagaaaggaatagatcttggtgtagtttctcctgagatattgcagaacttctttgacctcgagaaataccctgtcatggctgaactgattcaccgtttccaagtaagcagctcctgtactctttatctcgcactctttccccttttggaaatgccaatcaaagatgttgcttagtagtttaggtaggaagagattattatatatttgaaacttaaagctgccccttgcatgccctgcagggttttcgtgaaaggttgctagcagaccccaagtttctgaatagattagctattgaagaggccatatcaataactaccactcttctagcacaatatgaaaaacgaaaaggacgtttttttgaagagatcgactatgttctcactgatacaattaggggttctgttgttgacttctttacagtgtggcttcctgcacctacaatttcactcttatcttttgccgacgatggctctggtgagagtgtggagcttctgaaaggaattttaggatcactgccagataatgcatttcaaaagggtattgttgggcagaactggaacattaaccagaggtttgcatcggtgcttatgggtggtctaaaacttgctggagttggattcatttctagtattggagctggagttgcttcagatgtcttatatggtgcccgtcggattcttaaaccttctgcaaatatggaagtggggcgcaaaagatctccgatctggaaatcagcagctgtttatagttgcttccttggaacatcagcaaacctgcgatatcaggtagtttgccaagagcatctttctgtttactcaaatgatattagttatgcgaagctattttgtgggtggttgcatgtatcggggcatatgtcggtaatggtcaaaatttgttgtaataatactacatgctgagaatggaaagtcgttaacatcaagattaggccttgcaactgcagataatgtgcaaccagtaactcactgatgcaataggttattctagtaaatgcagcttataatttgctctattttacacaggagtgttaaccttttccaatgaacatgtttcaggtcatagctggtctgattgagcatcggctaggagagaatctgatggcctactatgaccagccacttattgctaacctgttgtcctttgtttcaaggacagttaactcatactggggaacacaggtttaacacttttgcactttacattaacttgataatgttttggtatttaaatctgcacttttgaagttggctgaacaccaaaaaatagtgttctctttctttgaacagaagaatttacagactctttcttatagcataggaccaaagactgtagaataaggtatgcaagtgggcaaccctctacttctaatgattggttgttcaatttgtaggcatagttagaatgcaactcagtccgctaggtgctagcgttgagcgttggactctggaactgtttgcttaatatctggcatttttattttgcctgttcaaattagctgcacgaacttcagcatatatgattttaggctggtcctggtttaatggagataaaaggaacaatcaacactcattaagtttattgttgcttcttgagtgggcttttctttcagtccccatttggatccttggaactgaaatctattctaataatcacaatttagtcaaaatcaatgaaattaataatccgctgcaggctcgcaacgagcgagcgtacgtgcatactttttacaagttatatagcagaaacatatcatgaggaatcaatttttatctctcacatcctatgaatttaagacaaacttatatcttaacttcagaaagttgtggaatgtcaaattccaagccaaataacctagtctataaagtaaattctaatttctccaaaatgaggatccaaacaggccctattgataaaattctattgaatatcttgggaaggaaataaaacattacaatagaaggacttgatgaaattccatgattcatggtagtatttgtgatgcatcttgctgtactgacaccatgtttcttgcagcaatggatcgatcttgcacgagttacaggcgtgcaaagaactaacaaagagctgccttctcctgaggtttcgagcgcatctgaaatgccactgctagaatgtggcacggcagaggtacagaatgcggacgacagcagtaaccagtcaaatgacttgacataagttatcgcgcagtggccatacaaaacacagagcagcttccttccatggcacaccgtatactagacaaaccgtacatgcatataaatgggactgtcttcttagagccaggctgtgaagcttagccatcgcgtcatgtggagagacgaatctgaaatcctgaagagtaaagcttttgaagactttcgacttgttatgatcacagccatttttacacaccatcatggggtgaataccgtttgtacattcatagaggagacggccgaagaattctttggagcacgtacagcattttacacgtgaaatttgttcagaaaacattactggagattgtcacatggcaaaaaggatcaggatcgttgcttgtgaattgtgatgcaccttgtatgcaatgcacttgaatccagagtgcacgtgtgattttattgtctgaacgaaccgtgcgacggcctgatgtttcctgtggtattgctgtggtgtgatcaaactagtccctatgtttccagtattccacgtttgcctttccaacgctggtgagtcagtgagtggtgaaccatgaagtcggtttttttcttgacagattaccagcatgtatcctctccgcctctcctgtttggattgaatcccgggccacgcaaagtttacccggcactccggctgcggcaggcagatctgatcccaggaagtcaaaatccaacgcgtgggaatcttatggctgcctgcctgcctgccagtgccaggcaagcagcatgcctgatgtcaaaccaaataggctggcttcacgtggcatttcttcctcgtaaccgcgtgtcaaaaaaggtacagagcactgcaggcacgaagaattcatggcatgacagaagtgatattgttggttcgtgctagaatcatcagatcgctctctgctcaaaaagtctgaaacaaggagacaatgcttagtgggcatctatcacctcgtgcacaggttctacctgttccttcaagtacggcgagcgcagcgcagggatccatcangctgtcacgctcgtgcaaccaaaccccatgcggtagcctcgtgccgttgtcgcacgaatccagttcccgagtgagtctcatcaaccgtccaacggagcaactgcttgaatcgtcttctttatcacaggagcctataaaatttgctgcgctgcctgctcacactcccacggacagagccatctttggtttggaccacttatccaaatcccaacagtgacagcatatatgatgggacagaaccagagatgaatgcaccgtcaaagctggtattagatcacgatcgaaatgattcttaggacgctaaataaaatttagttcaaaaataaataaaaatagagcttgattttaatctgattcgatctttaaatcttatagtgtaaaatttagagtttcgttaccaacctaaccaccatacgctatatatataaacataaa

SEQ ID NO: 476 - DNA, 2545 bp, Zea mays
  misc_feature (537)..(537): n is a, c, g, or t
tgcaggtgcaggccggctgtgtctgtgcgagctgcatttgcatcattaggattagggacgtgcgtttggtagaattgagtagtggcgcgcagtacgaaggatatgcttcaccaatcacatgggccattggtagatggcagtagtagcaacccaaacccaaacccaaacccatgggccatgctgaattgctgatctgcatcgcagttttgcagggacacgacacgagtcaacgaggatagtcgtcgcaatcaagcgaaggagaggagaggagaggagacaaggcaaggcaaggaaaggagtcaaggacggttgcgattacgattatgattacgattacgacggcggacgtccatcaataagagaaacgggcccgtgcgcccacccaaacccaacaactccaaacccgaagcccccacggcgcaggcctaggtgtaggcggcgcggaccagggtcgggccgccggaggcgcgctacttgggcggcggcgcaggggagatgtgcgaggggaggcggccagtggacgcgagccgggcgggngtgggcggcggcggcggagctgcggcggagagaggcggcggcgcgggcgcgcctggcggaggcgctggcggagctggagcgcgcgcgggcgcgcgccgccgagctgcagcggcgcatcgtagcagacatacggcaagcgccggcgcctcctctgaggagacccgcggccggatccacgagatccacgcgcgcctccaccaggaccaggaccgggatcaggagcaggagcaggagccctccgccagcggcacttcctctccgtcctcgtcctcgtaggtgcgtgcggctctctatcgacaaactctgcctatcctgccgctttgctcagcacacgcttggaataggaatctggatgagcacttgctggcagtgatttgactgctgcccgtctccgatcgagcagcagtaccttgccgattccttttcttgtttagttcccctgtgtgtctgctcctgatcctgatcgaacagtaatggctattaacaaattccgattattttatgcagggaacaagcgagttggcgctggatcatcgatggtttctactgctacgccgcgcgcttctttcccgtttcctcttgtcttatcgttagcttgcaagcttgactttggacatgtaccgtagctgtagtatacacgactctctctgacctacagaacgtcagaaaattgatcagtgactgaattggattgggagttagttctagaaacactctaatcagactaataaaattcgttcactgctgtgttggctcgtgactgaattcgtcacgagataattctcactctctttacaatcgcttttcttcacggtgagtaatcgctctcacgaagaaagaatagtaagcgacgtgacacaaccattagggctaaaaaaagcactctcacgacctggctcgagttggagaggttaacgagaccgagcctacttttatagctcgttcaaacacgagcctaagtcggagaggttaacgagaccgaaccgagcctacttttataactcgttcaaacacgagccgagacgagtctgagaaaatccgagtcagcgcatgagccgaatagatcatatagtgctatgtcgtgacattattacattactatgttattgatttttttttatttttacggacataatagtatagatatagtttaaaatatatttctaaatttttgatacatatttttaaaattttatttataataaaaatatacaatttaccttccaaagagatttagtgcggccattcgtgaaccttaaggagcccgagcctgaaattcgagtgaccgagccgcacttccagccctaccaaaccatcgcaccgaagcgcagtcagttgtcatgctgaaaggcaagatgacctcaatcccaaggaaaggatatccgggatgccaccagccaactcgcagtcttcactttggcaaaccaaagctcagtgctgagttgcgcaaaggctaaggctgcccacagtggggcactgcacgtagcaccctatcgagatagcgtaagaaaatattctgcagcgggcagcggcgtactgtaaaggctactctattttaacgttcgggtttggcaacggtaaatctagcgctcatacggcccgcacgctgtgcactgtgtcggggttaaatcgagcgctcgttagggtttggcaacttacacgctcactggcagcagtgaagtgaaaaaaatattgataaaaaatgtggtggtttgtatagggttaagatatagagtagttatggatgcgggagtttggctactgtattttaaaatgttgatgactaggacaaaatattctttttagagtagaaatttagagtaggatgagtgcggatagccttagacggggaaagaaactgtacagtattttttttcttaaaaaaaggagatgcggatgcggcttctttttttttcgttacaagatgcggcttcttttctaagaaaaatagagctgataaaagtgcctgtactttgtgttgttaataatagcaccgtcgccccccccc

SEQ ID NO: 477 - DNA, 735 bp, Zea mays
cccgcccggaacaactccaaacccgaagcccccacggcgcaggcctaggtgtaggcggcgcggaccagggtcgggccgccggaggcgcgctacttggcggcggcgcaggggagatgtgcgaggggaggcggccggtggacgcgagccgggcggggtgggcggcggcggcggagctgcggcggagagaggcggcggcgcgggcgcgcctggcggaggcgctggcggagctggagcgcgcgcgggcgcgcgccgccgagctgcagcggcgcatcgagcagacatacggcaagcgccggcgcctcctcgaggagacccgcggccggatccacgagatccacgcgcgcctccaccaggaccaggaccgggatcaggagcaggagcaggagccctccgccagcggcacttcctctccgtcctcgtcctcgtagggaacaagcgagttggcgctggatcatcgatggtttctactgctacgccgcgcgcttctttcccgtttcctcttgtcttatcgttagcttgcaagcttgactttggccatgtaccgtagctgtagtatacacgactctctctgacctacagaacgtcagaaaattgctcagtgactgaattggattgggagttagttctagaaacactctaatcagactaataaaattcgttcactgctgtgttggctcgtgactgaattcgtcacgagataattctcagaaaaaaaaaaaaaaaaaacccgcgggc

SEQ ID NO: 478 - DNA, 987 bp, Zea mays
cgcgtacgtgtcgtcgcagggagaaggtgaccgtctcggcgatgcgcgcgttcatcaccctggagggcgccggcgcggacaagacggtcgtgcagtggggcgacaccgcggactcgccgaccgggcccaagggccggcccctcggcacgttcaactcggcgtccttcgccgtgaacgcgcagtacttcctggcaaggaacatcactttcaaggtacgtacgtagccggcaccacgcacccgtgtcgtgtgttccctagtactatatatatgtgctccttagttctggcgttggcgcgcgggacagaacacgtcgccggtgccgaagcctggggcggcggggaagcaggcggtggcgctgcgggtgtcggcggacaacgcggcgttcgtggggtgcaggttcctgggcgcgcaggacacgctgtacgaccactcgggccgccactactacaaggactgctacatccaagggtccgtggacttcatcttcggcaacgcgctgtcgctgtacgaggactgccacgtgcacgcgaacgcggggggctacggggcgctgacggcgcagaaccggcagagcatgctggaggacacggggttctcgttcgtcaactgccgggtgacggggtccggcgcgctctacctgggccgcgcctggggcaccttctcccgcgtcgtcttcgcctacacccacatggacgacatcatcgtccccaacgggtggttcaactggggcgaccccaaccgcgagctgacggtgttctacgggcagtacaagtgcacgggcccgggcgcgacctatgccggccgggtggcgtggtcgcacgagctcaccgacgacgaggccaagcccttcatctcgctcagcttcatcgatggcaccgagtgggtcaggctgtagctgtaaatctcgcagccgctcacgccaccacgccgcacactgtaaagaaacagagcaagacagtatatacagattttatactttccgttcg

SEQ ID NO: 479 - DNA, 1255 bp, Zea mays
  misc_feature (617)..(617): n is a, c, g, or t
attggtacctcgagccggccggaaattccggaatgggcatgccgcgagcacgatccttggcctgcattgccgtggcggccattgcgctcctcgcgccgacgcgtggagcggagatggtcgagcggcagttcgtggagtgggtgcgctacatgggcggcctccggcacagcacgttccagcagcacgcgctgctggaccgtgcgtccccctcgtactcgctcgtcgtcgacgcgaacccggcgttcggcgacttcacgaccatccaggccgccgtcgactcgctcccggacatcaacctcgtccgcgtcgtcatcagggtcaaccccggcacctacacggagaaggtgagcatctcggcgatgcgcgcgttcatcaccctggagggcgccggcgcggacagcacgatcgtgcagtggggcgacaccgcggactcgccgacgggggccaagggacggcccctcggcacgttcaactccgcgtccttcgccgtgaacgcgcagtacttcctggcgaggaacatcactttcaagaacacgtcgccggtgccgaggcccggggcgacgggggaagcaggcggtgccggctgctgggtgtcggcggacaacgcggcggatcgnggggggtgcaggttccctgggcgcgcaggacacgctgtacggaccactcgggccggactaactacaaggaggctacatccaagggtccgtggacttcatcttcggcaacgcgctgtcgctgtacgaggactgccacgtgcacgcgatcgcgctggactacggggcgctgacggcgcagaaccggcagagcatgctggaggacacggggttctccttcgtcaactgccgggtgacgggctccggcgcgctctacctgggccgcgcctggggcaccttctcccgcgtcgtcttcgcctacacctacatggacgacatcatcatccccaaaggatggtacaactggggcgaccccaaccgcgagctgacggtgttctacgggcagtacaagtgcacggggccgggcgcgacctacgccggccgggtggcgtggtcgcacgagctcaccgacgacgaggccaggcccttcgtctcgctcaacttcatcgacggcaacgagtggatcatgctgtagttgtatattatcgtaaatctcccagtcgctcacacggcagcacgtcgccacaccatgtaaagaagcagaggaacaaaacaatatacaagatttacatttttctgttgctcccaaaaaaaaaaaaaaa

SEQ ID NO: 480 - DNA, 897 bp, Zea mays
  misc_feature (10)..(10): n is a, c, g, or t
gggtaccctnccggcctggccgggaattccggaatgggcatgccgcgagcacgatccttggcctgcattgccgtggcggccattgcgctcctcgcgccgacgcgcggagcggagatggtcgagcggcagttcgtggagtgggtgcggtacatgggcggcctccggcacagcacgttccagcagcacgcgctgctggaccgtgcgtccccctcgtactcgctcgtcgtcgacgcgaacccggcgttcggcgacttcacgaccatccaggccgccgtcgactcgctcccggacatcaacctcgtccgcgtcgtcatcagggtcaaccccggcacctacacggagaaggtgagcatctcggcgatgcgcgcgttcatcaccctggagggcgccggcgcggacagcacgatcgtgcagtggggcgacaccgcggactcgccgacgggggccaagggacggcccctcggcacgttcaactccgcgtccttcgccgtgaacgcgcagtacttcctggcgaggaacatcactttcaagaacacgtcgccggtgccgaggcccggggcgacggggaagcaggcggtggcgctgcgggtgtcggcggacaacgcggcgttcgtggggtgcagtttcctgggcgcgcaggacacgctgtacgaccactcgggccggcactactacaaggagtgctacatccaagggtccgtggacttcatcttcggcaacgcgctgtcgctgtacgaggactgccacgtgcacgcgatcgcgctggactacggggcgctgacggcgcagaaccggcagagcatgctggaggacacggggttctccttcgtcaactgccgggtgacgggctccggcgcgctctacctgggccgcgcctggggcaccttctcccgcgtc

SEQ ID NO: 481 - DNA, 1191 bp, Zea mays
  misc_feature (1)..(1): n is a, c, g, or t
ntaatcgaaaatcacactgtggcaactacggccacaactccaggacctgcgggagagaaaccatgctctgcgaagctggcgacaacggcggccatggcggcctaaggctcttcggagtgcaggtccgtatcggcggcggcggcgcaggctcggcgtccatgaagaagagctacagcatggactgcctgcagctcgcggctcctggttgttccctcgtctcgccgtcgacgtcctcctcgttgtcgtcgctgctgctgatgtcgattgaggagggatcggagaggggggcgccaaatgggtacctttctgacggacctcatggcagagctgtgcaggagaggaaaaaaggagttccatgaagcgaggaggagcacaggcagttcctttccggcctggagaagctgggcaagggcgactggcgaggcatctccaggagctacgtgccgacgaggaccccgacgcaggtcgccagccatgcacagaagttcttcctcaggcagagcagcttggggaagaagaagcgccgctccagcctctttgacatggtgccgatttgcgagaacagtgcgagcatctccgatccgctgggcagcgaaggggcctcaacctctctgtcgctgaacgtgccacgccacggcgtcacctccgtctccgagggggcggccttggacctgaattcgacggaggaagacgacagcagggcggacgcgtcgtcggcatcggcatcaggtgcagggaccagaccaccgttcccggcagcgcagacggagccgctgctgcagccttcgtcgcttggccatgggcgcggtcaccactgctctcctttggacctggagctggccatgtcgctgcctgccccatccatcggaacatgacgcgccgccgccgccgtacttatcgccatggaatcccacgcaggtcgcgccataattcgtcagcgcaggttgccaaggccgaggccgtgcgtgcctcgcacaaacgtctcacgtgtaatcagaatcgggttcctgagtatgactatgccatgttccaggttacgctagttgctagctagcttttttttttaagctctgttaatgatattgttacgaaaaatagattctaacataggttcactgttatatatgttatgtagaccatatatttactttgatattaaatttgttttttatggcaaaaaaaaaaaaaaaa

SEQ ID NO: 482 - DNA, 1841 bp, Zea mays
agctagctagctatttgagacagacgttgcggacgccattagtcactctaaaaacttgtatcagcttctatttaattaccccttctaagctgtccttctttttaggggtctatgattaaccaatcaagttaccactaaagtccaagctacacgatccagaaatgggcacagcaagtaataccactttttgtgtggtttcccatcccataacatgtccacatcgacagccaagcatcatgacacatagaagcatatttatagtgggctctcccgtaagtttcattgcctgaccctgaagctgggtagctcctgctcctatcccggctgctggcgcgccgtggttttgtgctcttgtggacacactggcctccacccatccctctcacgtctctggccatccgcagccaaggcgcgcggcccatcgtcgatttatagccacaccatggccaggaagtgctcccactgtggcaactacggccacaactccaggacctgcggactaggactaggactaggacacagagaaataatgctctgcgaaggtggcgacgacaataatggccgcagcggcctaaggctcttcggagtgcaggtccgtatcggcggcggcggtggcgcagggtcggcgtccatgaagaagagctacagcatggactgcctgcagctcgcggctcctcatgcttgttcgtccctcgtctcgtccccgtcgtcgtcgtcgttgtgctcgtcctcgtccccgtcgtcgctgctgctgtcgattgatgatgggttgcagagaggggcggccgatggatacctgtctgatggacctcatggcagagctgtgcaggagaggaagaaagcagctgagactgagagatactagtgcttcccttgctttgactaaaccacctcgccgcctgtgagttccatggagcgaggaggagcacaggcagttccttgccggcctggacaagctgggcaagggcgactggcgaggcatcgccaggagctacgtgccgacgaggaccccgacgcaggtcgccagccacgcgcagaagttcttcctccggcagagcagcatggggaagaagaagcgccggtccagcctcttcgacatggtgccgatttgcgagaacagtgcgagcatctccgatccgctggacgtggcacgccatggcgtcgcctcggcagactccgagagggcggccgtggacgtggacctgatgaattcgacgacggagggtgacgacggcaggagcagggacgtcgtgtcgtcggcgtcaggtgcagggaccgcactgcggttcccggcagcggcagctcagacggagccgctgcatccttcgtcgtcgcatggccatgggcgcggccaccactgctctccgttggacctggagctgggcatgtccctgcccgccccatccgtcggaacgtgatggagatgaggcgaggccgaggccgtgcgtgactgctgtctccctcagctgtgtgtgtcagccagatggagatgatgcgctagccaatacagtactgttcgtctgttcgtgatcgtgaaaacggtgtgcaaacactagcacagcggcactaaactaggatgtcgctcctcgcaccattgggtactgtaaccgcgttgatccacgtcatctctatctcttcagcacgatcataggctgtcagtttcatctatccgtccatgtgtcatactcattcgcaatacggtgacttagcgagtgtttgggatgggatggctccagattccagcttcagcgtggagctgtagtttataatcccaatttaaatagttttcaacctactttcaatcgaaataataaataaaatgacttatctaaatgtctttt

SEQ ID NO: 483 - DNA, 1387 bp, Zea mays
agaggaagatttgttctttggaaattcagaaacttcaccttacacgaatttcttttcttattggtaatacgtactgtccatcagtcgtctgacctaaaaaaaaagttgcattatgctctacttttttttggcctaaaaaaagagagtaatatagctttatcttccactgatgctgcaacccttcaactgcaagtaacaatgaagcagctgagactgagagatactagtgcttccctgcacattattgagtccttgttgggttggtcggtagcagctgatgtttctaaacaaaaacaatactctggatatataccgacgacgccaggagttccatggagcgaggaggagcacaggcagttccttgccggcctggacaagctgggcaagggcgactggcgaggcatcgccaggagctacgtgccgacgaggaccccgacgcaggtcgccagccacgcgcagaagttcttcctccggcagagcagcatggggaagaagaagcgccggtccagcctcttcgacatggtatgcgcatgcaggcaccaacatctctctcttttttttctgtacgtaattgcttgagttttgataaccgggtccagcggcaggtgccgatctgcgagaacagtgcgagcatctccgatccgctggacgtggcacgccatggcgtcgcctcggcagactccgagagggcggccgtggacgtggacctgatgaattcgacgacggagggtgacgacggcaggagcagggacgtcgtgtcgtcggcgtcaggtgcagggaccgcactgcggttcccggcagcggcagctcagacggagccgctgcatccttcgtcatcgcatggccatgggcgcggccaccactgctctccgttggacctggagctgggcatgtccctgcccgccccatccgtcggaacgtgatggagatgaggcgaggccgaggccgtgcgtgactgctgtctccctcagctgtgtgtgtcagccagatggagatgatgcgctagccaatacagtactgttcgtgatcgtgaaaacggtgtgcaaacactagcacagcggcactaaactaggatgtcgctcctcgcaccatattgtgtactgtaaccacgttgatccacatcatctctatctcttcaccaccgttggatcataggctgtcagtttcatctatccgtccatgtgtcatactcattcacgatgcggtggcttaatgatccagcagtaatttttcttctttcgtgacttaagggtatatacggtggtatttaatgtagaggcttttgatgtatttaaaggggtatttgcaaaaaaattatggagccgtctctgcatgaagaaacgcatctgtctcgtaagtcaagtctatactatacttaaagcaccag

SEQ ID NO: 484 - DNA, 6331 bp, Zea mays
acccctggccactttatgccaaagcgagatcggataggtcacttaattacacccctgatatcctccctctttccaactcattttaacataaaaccattgcttcatccatgaacctagccatttctgtcgaaaggttgggactagacgcctagcatccgatcggtacacaaaggtataacaaccaaagttgttatgatactcctcttttacagtaccttttgtttgataaaaaaagctcgtgaatgttacaaaaacagttagcatctggcttcaaaccctgactccttactacccagataaaaatcccaaccttaatcatagctttagggtaagctaatgatggtatattttgaatctttttagaacccgaccaacattttgtggagaggaaagcacagctcagccttcaaaaagttccgataaacaactactttgtctttttcgggaagaggaacattactctccccaaatgatttcccaaggttaacacggcttggtctccagggtcgttattcggcatcatcagcatcactctcaaaatcaaaatcttcgctatccttggaatcatccaacagtctagccagtatctcgttagtgatcttcgcaatgttgcttctctccatggcctcgtaaaacccggcaagtgcaagctcttcactcttactccccattagtcatattaactcaaaccaaaaacaactgctttatgagctagcactgtcattacatctaaggtttgcctgcagtaaatatgatttcaattgttgttatacgacttttcaattgtccatgaatattggagagggatgccatccaaattatctgatctcagtttttttcttgaatactcatgagatgtgtatcattgcattaaggagataaataaatcacaacacacccaccattgtgtgtgtgtctctctccctcccacacaccacattctctcaggatgtattcattgtagtattatctatttctgaactagagaggccagttacatcacagcatctaaaaaatggatatcaaatagcagttctgtttgtgtaattctctgggtcatcatgttactggagattgaatctagacaatattttccttttatagggagcctaagaattctcatatgcctagaagctctcgtctaagggacaagaagaagaatgaaggtgaaagaatgatcaaagaaacatttgttggaagtgtgatagaaaacaacagttttctgagcacccttcttgacaagagttcttgtataattatcccggagattgaatttccccttccatctgttcctacaacgagggcacctgaagtctctgataagcaaggcttgattgctggtccctgtagtattagccagcaaaaagctgaggaaactcttgtttatggtgatgaaattgatgaaatcaaagaggttgagaacatgagtgaatcaaccacttcctctgcatgtaaccaaagaaagttctacgaaacaaaatttggaatagttagtagtactgcattttgcttatcaacttcagatattcagattggagtaattggaaaaggtagatcacatcaaggaggtgggctcttagatcaagggcggttgccatgtgttcagtgtggcatattaagctatgcttgtgtagctatcattcaacctaaagaagcggcagtccaatatgtcatttctagggagtgcatgtcatcaagtgcaatacacagagaaataatggaatcggatgatacctcaaatcgaatggtgatagctcatcaacaaggttagcaagacatggatcaacttgcactattaatgcccggtcctcaagattttccttttacttgatatcattatctagcctccaccatttcacatattggttttaaatagtgacagcgataatgtttctcttagatctggtatatgcattctaatattagtcctattttatgcttctggtcaaatggttggtaaaagcagaaatttcataaatctacagctatgtcattcacttgtgcatcataaaaggtgatcgatcttccattttttcttgttagtaacccttccagtcacaactcaatatctagtcaattttgacattgaagctgctgacaaaacataacttttatatggatgaacctaccagataataattcatattctcaataaacagtgtactgtttaagtactttctgatatacctcatattgacaatcgaaatgtccatagaatattgatggccgaagtttcaattgtttggctgaattatgtttctaattttaacaaggaattttttcttttgaaatgaactcttgggtgaatgttttagtgaactatattaattgtttctgaatcatttatcgttttagttagtttaattcaggtggctacacttttctctgtgatgctcaagggctcaacaagcatattttctattttgtttcctgttgacgtcttcacgctttcgtgattgaacggtatcaaagtgtcattgattgtaatactatttttttttattgtaatgaaattattcttctagtgcatagtttggaggccatcgtgtaaatatatcgttttttttccaacaggatatgctcatcaaactgatgataatacaatacaaaatgtgagtgcagcccaagtttctgataggtgtagacagctatacagcagcagcacccatggatgcacttccgctcttgggcttctggcttctgcttatgaatcatcagaatctgatgaagaagcagatgcacctaacaatatatcaaacaattgtgaaaacaataatgcggcaaatggagccacaaatattcagtcctccagaacatcagttcaggatgaaaatacgaatttgcaattgtatgaagaggaaaataactccagagcaatagcatctctgatgcaaccagtggaggataagagtactgctatgactcctgttagtatggaaacaaatattatccatctagcagatcagggagagtcactaaccttccatgagcagtggcatgcgtatcttgactttgatgatctaactgcatcaggtgtaaaagcctctccgaatactagtttgggcacggctaaagctgcaatgaaaacagatgcactgactttgttcaagtacagcaaggattcctgcagaatgcacgtgttttgtctagaacatgctttggaaacttggacacgacttgaacaaattggtggtgctaatatcatgctcttatgccatccaggtagttgcactttccataatatccacaaaattattttgccattgctcgttagtatttctctttgtgtcctgtttacttagaatgattagtggcagtacagttttaaataaaaaactcgaccagagggaaggatgtcctctgattttggtcttatcaagtttgtgccagccttcaaacctggacgggtaatgggggtttcattgtctcctggacctcaacgctctaaggccggctccagcagtgtgcggatgaggccgcagatgcatattttgtgcgaccgtattcaactattcacgcttccagcagagcgcagatgaagacatgcgaaatgagcgctcggccgtctagtaccgcatttctacgtgtttctctctcttatgtgggtgtagatactcatctgtatgcgcgctctactggatgcactcaatttttccacgctcgcatgcagccgccgccgacgccacatgctccacatccgcatgtgtatactactggagtcagcctaaccagtgtaacacaggagatgttggcctattgcattttgatgattatggcaatgacaaagtcctaatcctgcaatcttttgcaacttggaaatttttcatactaattcacaatgcatttgcagaataccctagagcagagtcagcagcaaaagttatagcagaagaacttggtatgaatcatgcctggaaagatatcactttcaaaaaagcaacacgtgaagacactggaagaattcaattggctcttcaggatgaagatgcagaacctacgagcagtgactgggcagtaaaaatgggtatcaacatatattacagtgccaaacaaagcaaatctccactttacagcaagcaggtaccatacaattctatcatttacaaggcatttgctcaggaaaatccagacagcttcgcagatggacagcgatcaagcacaacaaagaaaaaggtagctcgatggtggtgtggcaaaaaatggatgtcaaaccaagttcatccacttttagcttgtgaacaggtagaacagaatcatgaaacagtttacagcaaaacgatgttatctgctagttgtgacaggatgcaagaacaatcaacaagatctactaccctgatcaaccaaaattcttcaaaaaagataaccagaagaaaagagggggactctgttgagaaatctagaggcaaaaagaagagatgcagtgccagtgcttctgatgaagctgctttgcactgcaggctggctgatcagcctgtaaattctgataatcatgccaaatatgaagatggagatgaaagtgaaagtgtggaagcacggaacacccgacatcatcaacaatatgaatcgctaaataaaaaatcaagtttgaagaggcgaaaggataataatagaagcaacagctttcatgagctacacaaggacaatgttgacattgactgcaggtttgatacagacggcactgaaaacacctcaataggtgactgggataatagtccaccacaagggggtgatgtcaaagcagtgaaatctggtgctcgattgctaggcactaagaggtttagcaaggagaagggaagtaatggtttgtcaaatgtaaacaagaaattggtaaagatgggtaagaaaattagtactaagaagcaaaagaatgacaaaacaaataggcagtttcaagaaaatcacaaaaaagctgacattgtggatttgcttcatgaagatgatggagatgaaggcacatacatagactgtaatgaaattcgaaaacaaaaaacagatgacgtgagagtaaaatctagaggcaaaatgcaaagtggcaagaaaaaagtcagcagatgtcaggcaagtgatggttcgcacaatggaggcaaggaaatgaaattatcaagtgacatagaagtgtgcaacagaagaggagatggaacaacggcagccaattttgaagaaattccaaaagaaaaggccgatgctgtgaaagtgaaacccaagatgcaaggtgacaagaaaaaaaccagtaaacatcaggcaggcgatggagataaaggagcaaaattttcttgcgatatagaagggtgtgacatgagtttcagcacccagcatgacctgtcgctgcacaagagagacatctgtcctgtcaaaggatgcaagaagaagttcttctgccataaatacttgctccagcaccgcaaagtgcacctggatgaaaggccgctcatgtgctcattcccaggctgcgcgaagacattcaagtggccatgggcgaggacagagcacatgagggtgcatacaggggtgcgcccgtacgcatgcacggaacctggctgcacccagacgttccggtttgtgtcggacttcagccgccacaagaggaagactggccactcgtgtgacaagaaaaagaaacgcggcctttgactgctcgtgcacaagtacaggtttcttctctgacggcgagcgatcagaaggggatggatgctaatcgaataattgcgccaggttccattgtttgcagaattaatctgcattaggagtctaattcatttcattgtttattaccgctgcaacataacagctcattcactgtcgctttaggtccaactgacctgctggtgactgagattgtaccatgtcaattgtatcgttctttcgttcatacttagaaatcgggaagtttctgttgacaggaacgttggatttagtgtacggcgcctgttattaacatgcgtgtaattctgtactgaagtgctcctttcttatttttacattttttaaaatctggaaggaattagtgtacggcgcctgctagttttgatgtaggattcatttggcagttcttgaaacgattatcgcaaaaatagaatcacttgttcgaaaaaaaaaaaaaaaagatttggattccatcatggctggatactgataagaagctacctacatgagtattgtgttacagtattgagtatttttcaggaaattatatccttaactttcatgcaaatacacaaccaatctcatggtcgtttccaaggaaaaacatgacccatgtcattaaaaatacacttcacacaaaatcaatcaagatcgctttcgaggaaatatatgatccatcttataaaaa

SEQ ID NO: 485 - DNA, 2895 bp, Zea mays
ctccctcctcttcgatccgaccccggggttccccccgcgggcccgccggaaaatttcaatgcctctctagatctttcaagctatccttgcttcctagctccctttggcgtgctgtaccggacgacaggggtaggtaggtaggtaggtgtagctagctcggcgagcgagggagcaatccggccaacagcacacgcgtcgatcgccatgccgagaagcggcggcggcggcaatggcggtggcattagtagtagtagtagggtgatgcccaacctcccggccgggttccgcttccaccccacggacgaggagctcatggtgcactacctcatgaggcaggccgcctccatgccgtgccccgtccccatcatcgccgaggtcaacatctaccagtgcaacccctgggatctccctgccaaggcattgttcggcgacaaggagtggtttttcttcagcccccgggaccgcaagtaccccaacggcgcccgccccaaccgcgccgccgggtccgggtactggaaggccaccggcaccgacaaggccatcctgtcgtcgtccacgcccacgagccacggcggcgccaacatcgtcgtcggcgtcaagaaggcgctcgtcttctacggcggcaggccgcccaagggcaccaagacggactggatcatgcacgagtaccgcctctcgggcgcggcggacgacgactgcaagggcagcaccaggcgcagagtgtcttcctcctcgtcgtcctccatgaggctggacgactgggtgctgtgcaggatccacaagaagagcaacgatttccagttgtcgtcgtcgtcggagcatgagcacgagcaggaggagccggcggcgggcggctcagcgacgactgtggaggaactagacgctctcgtcgtcgtcgacacagcagcagcagcgacaccaccaccaccaccaccaccaccaacgacaacaactctactgaaacagctgcgactcatcacgatcctcagacgatgatgatgctgagcaagtcgtgctcgctcaccgacctcctcgacagcatcgactacgcggcgctctcctcgcagatgctcctcctcgacgcgccccacccccacgctgatgacccgccgccacacatggtctactacccaccggcggcgtcggcgacgcaccagcaagcaataatagctaataacaccaacagtaatgacgactactatgacgacgacaacttgttgccgactgctgctgctactgcggtagacgcggcggcggcggcggtgctactcagctcgtcgcctgcagacaccaacggtgtgaacaagaggaagcgagtgacggccgtggactactacggcgccgctgaaccgccgaccttcttccaccaccacctcgatgatggcggcaacagcttcttcagtacgaccaagaagctcaagccgccgccgccaagtgattcgaggcatggcggccatttcggcaccgccacagcgagcagctaccgcgacagccagcagctcgtggacagcgcgagcagcagcggcgtcttcttccatcagtatgggtacggctacagcagcagcaacccgttcttgaacttgaaccagcagcagcagctgctactcaacagccacatcgggatgcagtagagctcgagagatcgagagagagagagagagagagatgatatatcattggaaggatcagcacgcgtacgtgcagattaattgcagcgagttctatcttgtttgctttcattattatatactccgtatgtgtcgttcatgtaaaattagtttaaattgtaaattagtgtgctgaaattcatgtgcctgctctctgctcatcaatgaatggatgatgacgacccatgcacgttaaaaaaaaaaatgcgtagatgtgctgcatatggagactgacagagagtgacaagatggctagattaattacattccagcaggtagctggaatcggaatatacctaacctaatactctagtttgcttcctgctgaattctgatgcctttttttcccccacgtagacatggacggttccgtccgtacttaatacagtacgtagacctgagagttcatctattttttaagtgtcccgtgacgattaacttaaggctccaaagtactccgtctatattgaaatagaactcgttctggagacggacaaagcaagtcattttggatgctagtactttatttatatatacggctttgccctctccaaccctttgtttttctgtgcagcacgccggaaaaaacatatgttaatagagagggagttcatcccaagacctcttgtcctcaatgcattgaatcacctgtgacaaccaatcaagacagttttttgtccataatatacagccgcaaagctatttaatatgggcaaacatgacaaatgccatcctaattaaccacatcttagtatacacaatcatgtcctaaacgacttctgttccaacatggagggagtacagtaacatgtaattaagatgccatatatcacaacaacaggtggatcacagattcacactccacatgataaattccactgtagaccccgaattattttcttcttcttagaattggagatgccttaaaaacagacatttgtctctcctgcaaaggacagtccataatgcaaagagacaaaatactccaggacaaacaagctaagtagctacccaactcaactttgatctccccgagaagtccaaccaaatgacgacgggccattaatcgtcggctactactagcttgttcataaattcaacgttgacagacagacgcgggcctgccgaattagctgaaccacgcgcgcgctggtacggtggaccaatgccacggcaaaacgtcgtcaccggccggaggagcttcatatctactggctgcaggcatgca

SEQ ID NO: 486 - DNA, 627 bp, Zea mays
  misc_feature (7)..(10): n is a, c, g, or t
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (45)..(45): n is a, c, g, or t
  misc_feature (60)..(60): n is a, c, g, or t
  misc_feature (623)..(624): n is a, c, g, or t
tcccccnnnngnggngcnctctcnaaattatgggatccccccggnctggaggaattcggnacgaggagagctcactagtccccccccccccccccccagttatcgtggtggggtgcaagctggacctgagggacgaacaacaagttagccttgagcaggttatggcgcccatcatgcagtccttccgcgagattgagacctgcattgagtgctccgctcttcgccagatacaggtgcctgaggttttctactatgcccagaaggcagtacttcaccctactgcccccctttttgatcaagaattacaatctctgaagcctcgatgtgtgagagcgttgaagcggatattcattatatgtgataatgacaaggatggtgctctcagtgacgtggagctcaatgaattccaggtccggtgttttagtgctcctctccagcctactgaaatttcaggagttaagagagttgttcaggagaagatgcctgaaggcgtaaatgaaactggccttactttgactgggttcctttttctgcatgccctatttattgaaaaaaggtcgtttggaaactacatggactgtattgaggaaattttggttacgacaatgacatcatgcctgccnngag

SEQ ID NO: 487 - DNA, 2501 bp, Zea mays
ccggccgctcccgcattaccctaagccaagcagggagggagaagacgcgacgagagagagagagaggaggtgcgcggcatggcgggtgcgacgtccctggcggcggccgctaatctggcgggcaagtcgagcgtgcgggtcgtcgtgatcggcgaccccggcaccggcaagtccagcctcatcgtcgccctcgccaccgagcagttccccgagaacgtaccacgcgtcatgccccccacccgcctccccgccgactacttccccgatcgcgtccccatcactatcatcgacacgtcgtccagcccggagcagaagccgaagttgatcgccgagtgccaggcagccgatgcggtcgtgctcacctacgcctgcgaccggcccgccacactggagcggctcagttcgttctggcttcccgagctccggcgacttcagttgaaggctccagttatcgtggtggggtgcaagctggacctgagggacgaacaacaggttagccttgagcaggttatggcgcccatcatgcagtccttccgcgagattgagacatgcattgagtgctccgctcttcggcagatccaggtgcctgaggtcttctattatgcccagaaggcagtacttcacccaactgctccgctcttcgatcaagagttacaagctctgaagcctcgatgtgtgagagcgttgaagcggatatttattatatgtgataatgacaaggatggtgctctcagtgatgtggagctcaatgaattccaggtccgatgctttaatgctccactccagcctactgaaatttcaggagttaagagagttgttcaggagaagatgcctgaaggcgtaaatgaaagcggccttaccttgactgggttcctttttctgcatgccctctttattgaaaaaggtcgtttggaaactacttggactgtattgaggaaatttggttacgacaatgacatcaagcttagggatgatctcattgcaatgccaattaaaagagctcctgatcaaactctggaaatgacaagcgaagtggtcgatttcttgagagggatattcaacatgtttgacattgataatgatgcagctttactacctactgagctggaggaccttttctcaacagcacctgaaaacccatggatttctgatccctataaagactgtgctgaaaagaatgtgttgggtggtctgtcacttgaaggttttctctcaaagtgggctcttatgacacttctagatccaacaaatagttatgccaaccttgcatatgttggttatcctggtgagttcagttctgcatttactgtcacaaggagaagacgagtggatcgtaaaaagcaacatacgcagagaaacgttttccagtgttatgtttttggtgccagaggctctggaaagacgtcgttgctacaatcattcattggaaggcaaccttctgacgctctgccatctaacagcgaacgctttgcaacaaattctgttgaaatggctgatggaactagaaagacgctaatactgcgagagatacctgaaggtgacgtgagatcgttactttctgacagggaatcgttggcgccatgtgatgtagcagtatttgtttacgatagctgcgatgaatattcatggcaaagagctagagacttgcttgtgcaagtggctacacacggagaaaatactggctacgaagttccttgcttgatagttgctgcaaaagatgatcttgaccaatcttcacaagctctacaagaatcgactagagtgagccaagacatgggaattgaaacaccaattccgatcagcgtgaagctgagagatttgaacaacattttctgcagaatcgtgcatgctgcgcagcagcctcatttgagcattccagagactgaaactggaaaagcacgtcggcaatatcggcaacttctaaaccgttcgctaatggttgtctctgttggagctgctgttgcagttgttggattagctgcttatcgggtttatgcagctcggaagaactcgtcctcttgaagcctcccctactggacaagtggggaaataaggcccttccttcctgcgacctcagctggatccatgctggttgaagttcgtcgcttgggtttttacccggcaggaaaccaacgtttttgtacagacatgtcatcagctatgaattatccggccaattggggtttcagattcagacatcacctggctccgtaaaaatgccgtatctgatgatctgttggctaaattagctcagctaattattgttactactagcctaagttcttattattcgaatttcttttcgttggcgaacatgctgagacatttagttgaacaagcatgagtttgtgttgtaccttgatttctttcgggatttatcaaatcggaattacctagtcaaaaaaaaaaaaaaaccccgggcgcgccccggtaccctgtatgaataatttgataaacatgtaaatgcatgcagtcacactttgctaaaaaaaaaaaaaaaa

SEQ ID NO: 488 - DNA, 2365 bp, Zea mays
gatccgcaaccgaacaaggcattaggatgcgtatggcttctagggactagttttcactctctctattttagtttcttttagttcctaagttgccaaacacatggacttaagaaggattatccctctttagtccatgtgtttggcaatttaggaactaaaagggactaaaacggagggactaaaaattactccctagaaaccaaacagccccttgtattgtgaatttgtggatcagccctcttaaaataacatataatagaagacttacttatctaggtgaaggataacttactatttgttgacaatcgtgaattattgtggctatagaatggaagttctcttatttatctgctaggagaagtaactgtgaaaatatctactttccaggtgagccaagacatgggaattgaaacaccaattccgatcagcgtgaagctgagagatttgaacaacattttctgcagaatcgtgcatgctgcgcagcagcctcatttgagcattccagagactgaaactggaaaagcacgtcggcaatatcggcaacttctaaaccgttcgctaatggttgtctctggtgagttgcatgcacccttgagtttgtgaatggttgaattaacatcatactgaacatagaactataagagtacaggtgcaatgattagaaatctatctgtctgctgatgctaatatataatagtccttaaatattcagtcaatgtgaaagttcgtcggcaggatcggcaacttatgctgataccgttcgctaatggttgtctctgttggagctgctgttgcagttgttggattagctgcttatcgggtttatgcagctcggaagaactcgtcctcttgaagcctcccctactggacaagtggggaaataaggcccttccttcctgcgacctcagctggatccatgctggttgaagttcgtcgcttgggtttttacccggcaggaaaccaacgtttttgtacagacatgtcatcagctatgaattatccggccaattggggtttcagattcagacatcacctggctccgtaaaaatgccgtatctgatgatctgttggctaaattggctcagctaattattgttactactagcctaagttcttattattcgaatttcttttcgttggcaaacatgctgagacatttagttgaacaagcatgagtttgtgttgtaccttgatttctttcgggatttatcaaatcggaattacctagtcacactgccactgaggcctcgtgcacacggttatactttgtatgaataatttgatatacatgtaaatgcatgcagtcacactttgcgctttgcggattgcgctggtagccggtagcaccacaaaatatacccaacccttcctgtttcgatcactgctccaattaagtcataataaatgtacgtccgaacaagtttatattcattatatatgatgaatgaatgcatttgttagtttgtaacacagcacagatttatattcattatatgacttaacaattaaggtatttgtaacacagactatctgttacctctatatttcttatcctgtatcccactgtcctaccactgatcaatttttctctatatctctaccctctacaacgagtttctctaagttcttcctctatattatactaaaaccataaaatatcgttttatacttattcatcatctattatcatttttttcttaactaaaaacagcgtgcactgaaaacgaggataggggttgcctcctatgcccccatatctagaggaataccatgcacactcctatcactttagcacggagaggacgttaggaagaggaacgctaaatatgtacaggaaaagtggaggagtggctcacgacagccgttgaacacagtcttacgcgaggaagtagggtgggtgtgaaagcaagtttaatgacaagctgtatgtcgacgaatgtctacgtggatgagagagaaactagaagtcgcgagtcgtctattctcggcacatatacatgagcgacattattggtcaaagagactgcatcatattaaattctagtggggactaccagtgtcacgcagcgtgtcgccaaggtttgcacttgacgaccgacaaaattattatgagactaaaccactccctgtgatggggccactccatgttagacaaataggcattttcagttttaatttaatccaaaaaatcgcagtgatgtatatgacgacatgtacgtgcatatgtgtatcactactcacataaacagtaaacaacaataaaatatgcacaaatacaaagaacagattgtaccctacggagggaccaatgcttaaggcatcagtggctctattcacacgagacatctcgtgtgtatgttcgatg

SEQ ID NO: 489 - DNA, 675 bp, Zea mays
ttattttccgactatgttttgattgttttcttttcgtccactccaaggacgaagcaaccggaccagcccacccttccgaccccacccgctgacatccgacgccgacgccggcgcagacagccgcaccagcgccacccaaatcccgcaaaaccctagagacagaagacgcgaggggggagagagaggcgcccggcatggcgagcgcgacgtccccagcgatggccgcgaatctggcgggcaagtcgggcgtgcgggtcgtcgtgatcggcgaccccggcaccggcaagtccagcctcatcgtcgccctcgccaccgagcagtttcccgagaacgtgcctcgcgtcatgccccccacccgcctccccgccgattacttccccgaccgcgtccccatcaccatcgatcgacacgtcgtccagcccggagcagaagccgaagttgatcgccgagtgtcaggccgccgatgcggtcgtgctcacctacgcctgcgaccggcccgccacgctggagcggctcagttcgttctggcttcccgagctccggcgactccagctgaaggccccagtaatcgtggtgcggcgcacgctggacctgagggacgaactaccagctacccttgagcacgatatggcggccatcatgtacgccttccgcgaagattgagacctgccttga

SEQ ID NO: 490 - DNA, 4020 bp, Zea mays
  misc_feature (1269)..(1269): n is a, c, g, or t
  misc_feature (1377)..(1377): n is a, c, g, or t
  misc_feature (2758)..(2758): n is a, c, g, or t
ttctattatagaaacacaaaacttggaagaacttctaggaagtccacaaaatagcctctgaacctgttgtattggcagctgtgatgaatattcatggcaaagagctagagacttgcttgtgcaagtggctacacatggagaaaatactggctacgaagttccgtgcttgatagttgctgcgaaagatgatcttgaccaatcttcacaagctctacaagaatcaactagagtaagtttttttagcatttaattctgtaaacatagtggaaccaagataatatatcaggatgaagtttccgatcaaatttatacatacgttactctaggttgctgtattgcctcataattttgtcccaggttttgttgctcctagtgttctcataggttttgccttgccaaaaaaaactatataaattgtactattgtagaaaaaagaaacacaatgaaaaccaaaattgaataaagtatgtgctagttcaatcctgcaactgccattgggtagtatgaagaagtggagagaagtgcagaacgctttattggttgaaatgttttgctctaagtatttgtatttgttgaattattttcctcagtaaggtttctttctggcgttttatctcttcctaatttatgaagggatgctgggttgttcaatgagtctgcatagagtccatcatagaagcaccagtttttatgcaacccacttagaatgcgggtttgcagaccctcttaaaatggcatatatctggatacatatatatatagaccaactcacttgcacccctaaattaatctcttactatactgctggaaatactatgcaaaaggtgttagtaactttttctgttgtccatgcgtctctgtggtatcagtagaagacctacttatctaggtgaagggtaacttattatttgttgacaaccgtgaattattgttcccatagaatggaagtcctcttatttttgtttgccagaagtaactgtgaacacatctacttttcaggtgagccaagacatgggaattgaaacaccaattccgatcagtgtgaagctgagagatttgaacaacattttctgcagaatagtacatgctgcgcaactgccccatttgagcattccagagactgaagctggaaaaacacgccggcaatatcggcaacttctaaaccgttcgctaatggttgtctctggtgagttgtatgcacccttgtgtttgtgaatggttgatttaacactatacctatactgaacatagaacagagactacatgtgnattgattagagatctacctgtctgctgatgctagtatatagtttctgtaaatattcagtcaatgtggaagttctaggaggtctgacttatgctgatactgcattaatnatttgcagttggagctgctgttgcagttgttggactagctgcttaccgggtttatgcagctcggaaaaactcttcctcttgaagcctcctggacaagtgggaaaataagttgctttcttcctggagattactttgcaacatcagctggatccatgctggctgaatttcgcagctggggtttttacccggaaggaaaccaacgtttttgtacagacatgtcatcagccataatttatccggtcaattggtgtttcagattctatataaatggcagacaccactcggctccattaaatgccgtatctgataatctgttgcctaaattagctcagctaaatattgtcgttactaccctatgtttttgctctcttggagtcttggcccttgcagtagtttggtattggaatttcttttcgttagcaaacatgctgagacatttagttgaacgaacctgagttgttccgagatttctgtcgggattattcaattggaatttttgaagcttggtattctattggatctgagaaaagtgcatgctagctcgctatctttgcgtgttattgtcactgaggcctcgtgcatatgtttatatactttgtatggatcattgtgtatatactgttccaactccaagcaggcactattgctttgagccggtagcacactaaaatatattacttccattttgcaaatacttgatgttattagctcggtctttaaaacatagcttggatcactatttatagctagaatatagattgaagtgatcatcacttatcgagttatcgtaacgtgaggaagtagggtgttcgtgatctaacgtgaagaaagctcagatgaccacttaataagttttttttataatctttatataaaagattttaaacaactatgataactaattatattgaaagactaacatattaatgaatttgttgttatatagatacatataaacatcaatatataatatttttttatcacgccgcacgtacatttaatatgaaatagaagagacgaacagttttatatttgtaattgtaaggttagacagaaaaatatgaatacaaaatacgtgagagtaatattggctctttaatatgtagccatttaaactgtctaaaataatacacaaaaaatatgcagctgcattccagccggagcctagtggaggaacagtagactactagacggtgttatttggggatacgggggcagagcgagaaaccaggagacatatagaggcaccggtcgctagctagatagtagagacggacgaggagctcatgcagacagcaggaaggcaaagcggcccatcacgccggtccggggggagcgggtgacggcggtggcggcggagaggcacgccgacaccccacgnccgcgcgacgccgcgaacaccgtgtcgacgacggacacggtcagcgcccatgacattggcatcctgccctgccgccggcgccggatcctggcaggcagcgcagctcgtttacgtgtgggcgcccgcccgggaggcaaccgatcgccggaaacacctgccgctgccgtgcgtgtccggaggcgggagggggagctcacgggttccgcgagggcggatggtttgggaagaaaaaaaaagatcgggcgatcgtcacggcggtcgctgtgcttgcgatgggacgggatttatcccggccggtgagaccgccgcgtatttatttcatgtatatcaagtcattagcaacgcaattttgagacgatttaataaacaaatatatatacagtttgttgtctttttttttgagtcgtctaaggtaactcatattttttttttcaaaaagaaatacatataaaataagaagaatctatgggttactatgtaagataacatacttgctcaaggtatagagtttgtttcaattgttcacttcaattttgtcacaaggcttgcttctttattcttgacgaaatctacagaaaagtccaccgatatctatagcatcattagatcgttactagtttcacctttttctgtgacatatgctttgaaaagattttttttggggagagggagtaggtgacgatatattccattgtagctagtttggaaaccatgaaaatgagattttagtctttttattctgattttgtggatctcaaattagcccctcaataatatggtggttgcagatcgtgaggaaaaaaaaaaggggcggaggggattattcatatcataaacattgcacgtacggtacgggaactcgggaagaggtggttgtgggcgtgaggctcctcgatgggccgatgatcccggcctgggcgcaaaatcaaactgggaatcaaactgggaggccagtttgcaggacttaggctcattaggatatctccatcagtctctatattatcatttctattttactctttattttaaactatattctataacagtatatctatagtacaaaacaaggtgtaaatgtagaatttcccatagggtttccacaacccatactcatcctcgtaaagcgatatccatactcatccacatacccatatccatcatgagtataagatttataccatacacatccctatttatatatcaggtctccaatggatcccatcccctacaagaaaatattattacattatattttatatgac

SEQ ID NO: 491 - DNA, 2609 bp, Zea mays
tattgttttctttgcccccgccccgagtacgaagcgaccggcccggccacccgcctacccttccgaccccacccgctgacatccgacgccgacgccggcgcagacagccgcaccagcgccacccaaatcccgcaaaaccctagagacagaagacgcgaggggagagagagaggcgcccggcatggcgagcgcgacgtccccagcgatggccgcgaatctggcgggcaagtcgggcgtgcgggtcgtcgtgatcggcgaccccggcaccggcaagtccagcctcatcgtcgccctcgccaccgagcagtttcccgagaacgtgcctcgcgtcatgccccccacccgcctccccgccgattatttccccgaccgcgtccccatcaccatcatcgacacgtcgtccagcccggagcagaagccgaagttgatcgccgagtgtcaggccgccgatgcggtcgtgctcacctacgcctgcgaccggcccgccacgctggagcggctcagttcgttctggcttcccgagctccggcgactccagctgaaggccccagttatcgtggtggggtgcaagctggacctgagggacgaacaacaagttagccttgagcaggttatggcgcccatcatgcagtccttccgcgagattgagacctgcattgagtgctccgctcttcgccagatacaggtgcctgaggttttctactatgcccagaaggcagtacttcaccctactgcccccctttttgatcaagaattacaatctctgaagcctcgatgtgtgagagcgttgaagcggatattcattatatgtgataatgacaaggatggtgctctcagtgacgtggagctcaatgaattccaggtccggtgttttagtgctcctctccagcctactgaaatttcaggagttaagagagttgttcaggagaagatgcctgaaggcgtaaatgaaactggccttactttgactgggttcctttttctgcatgccctatttattgaaaaaggtcgtttggaaactacatggactgtattgaggaaatttggttacgacaatgacatcaagcttagggatgatctcattgcagtgccaattaaaagagctcctgatcaaactctggaattgacaagtgaagtggtcgatttcttgagagggatattcaacatgtttgacattgataacgatggagctttactacctgctgagctggaggacctattctcaacagcacctgaaaacccatggtcttgcgatccatataaagactgtgctgaaaagaatgtgttgggtggtctgtcacttgaagggtttctctcaaagtgggctcttatgacactgctagacccgacaaatagttatgccaaccttgtatacgttggctatcctggcgagttcagttctgcatttactgtcacaaggaaaagacgtgtggatcgtaaaaagcaacagacacagagaaacattttccagtgttttgttttcggtgccagaggctctggaaagacatcgttgctacaatcattcatcggaaggcaaccttctgatgccctgccatctaacagcgaacgctttgcaacaaattctgtcgaaatggctgatggaactagaaagacactaatattgcgagagattcctgaaggtgatgtgagatcgatactttctgacagagaatcattggcgccgtgtgatgtagcagtatttgtttacgatagctgtgatgaatattcatggcaaagagctagagacttgcttgtgcaagtggctacacatggagaaaatactggctacgaagttccgtgcttgatagttgctgcgaaagatgatcttgaccaatcttcacaagctctacaagaatcaactagagtgagccaagacatgggaattgaaacaccaattccgatcagtgtgaagctgagagatttgaacaacattttctgcagaatagtacatgctgcgcaactgccccatttgagcattccagagactgaagctggaaaaacacgccggcaatatcggcaacttctaaaccgttcgctaatggttgtctctgttggagctgctgttgcagttgttggactagctgcttaccgggtttatgcagctcggaaaaactcttcctcttgaagcctcctggacaagtgggaaaataagttgctttcttcctggagattactttgcaacatcagctggatccatgctggctgattttcgcagctggggtttttacccggaaggaaaccaacgtttttgtacagacatgtcatcagccataatttatccggtcaattggtgtttcagattctatataaatggcagacaccactcggctccattaaatgccgtatctgataatctgttgcctaaattagctcagctaaatattgtcgttactaccctatgtttttgctctcttggagtcttggcccttgcagtagtttggtattggaatttcttttcgttagcaaacatgctgagacatttagttgaacgaacctgagttgttccgagatttctgtcgggattattcaattggaatttttgaagcttggtattctattggatcacacaaaagggcaccctagctcgctatctttgcgtgttattgtcc

SEQ ID NO: 492 - DNA, 1637 bp, Zea mays
gcacgagaccattacctagaacatcctaatcgaaaaaaccatttgtcggcgatcgccgtgctattgcttgggccttggactgagtaggtttggaggtagcgatacgagacactcgcccccgattcccctcccgttgccgaagcctgtgttgcagggatcgttcgcggaagcggtttttgatcggagagagagaaagagagagcgagggagggaggtggggatggacgcggcggcagcggcggcggcgcagatggagaggcactcgtcggcggcggcgcagatggagaggcactcgtcggcggcggccttcgtggagggcggcgttcaggacggctgcgatgacacctgcagcatctgcctcgagaccttctccgacagtgacccctccgcggtgaccagctgcaagcacgagttccacctccagtgcatcctcgagtggtgccagaggagctcccagtgccccatgtgttggcaggcaatcagcatgaaggaccctacgagccaagagctccttgaggccgtcgaggaaaagagcggaacgacgtgcaggaaaaaccacgcgcgcacaacccaccgtttttccgtcacccgctgctcggagatttcgaggtaccggtggatgcagacgacgccgagatcgaggagcggatcatgcagcacctggccgccgccgcagccattcgccggtcgcaccgccacgccagaagagaaggccgccgcagcagcagggcggcggcagctcatggccatggccacccacaaccacaagtcctgttctttccgtctgctggcgaggccactcctggtggttctggttccccgtctccgcatccgccgcggcaagaacatgctgcttcttctgtggtttctcctccgccattgcctgccgtggcctccgcagaaggaacggatgttgacagtactgcctcggctgatggcgctgtcgggccagatgacagtgtttccaggaggcagtcttcgcctgtcaaccacgatgaagctggaccatctgctgacgcgcagtcattctcagacacgatcaaatctaggctgcagtcaggtctctacaaagtacaaggactcccataacgaagagcacgcgcgggtggaaggagaggtggttcgcgcagagcagcgccatgtcgaatcttggctcggagatgaggagggaggtcggtgctgggatcgccgccgtttcccgcatgatcgagaagcagctggagacacgggatgggagtgggacagcaccgtcgtctgctaccgcttcgtctccagctcacgcccaccctggtccggatgcaagtagtagtcagggagctgctgttcccgctacaccacctgcagccgctctgaacaacgctacgcctgcagcagcgtgcgtgctctgaatgacgcctcgtcgtcttcgacagcttgaacgcgcgccaggatcatgttcagtgagtttacactaggtgtggttttcaagtgctttagatatgatgcttgcaatacaatgtgtgtcgcgtgtatagtcagtttgccaattagcctcattgttagccagtgaaacagatagtggatgccaagctactgttcgatcagtgaatgtttcagaataaagttggatacttggatgcgcaaaaaaaaaaaaaaaa

SEQ ID NO: 493 - DNA, 1459 bp, Zea mays
  misc_feature (1420)..(1421): n is a, c, g, or t
acaagagctccaaagtttttcgcggttgggtcggacaatcgtcaaccctgcttctcgagaacaggtcgttttcactctgcgtctccgcatcaaaacccttagctgcctcgcaattttttttcccgttcaccggagaaagaatggcgctgccgacagctaacccgggcttccgtctcggctgccaggagtctcccgcgatgggattgaggtcggcgccgcggttggcactgcgtcgtcccggcgcggtctccgggcacaggagtaggactggcagagggaagtttccagtagcatccacaagtctagatgactatcttccaatgcgaagcactgaagtgaaaaatcggacattaactggtgatatcacaagtctcagactaatcactgcagtgaaaacaccttatttgccagatggaagattcgatcttgaagcatatgattctttgataaacatgcagatagagggtggttctgaaggcgtaattgttggtggaacaacaggagagggtcacctaatgagctgggatgaacacattatgcttattgggcataccgttaactgctttggcactagaattaaagtgataggcaacacaggaagtaattctaccagagaggctgttcacgcaacagagcagggatttgctgttggcatgcatgcagctctccacatcaacccctactatgggaaggtatcaactgaaggattgatctctcattttgaggctgttctgccgatgggtccaaccatcatttacaatgtgccatccaggagtggccaggatattcctcctcaagttatcgagacactctcaggttatccaaacatggcaggagtgaaagaatgtgtcggacatgagagggtcaagtgctacaccgacaaaggtataacagtatggagcggtaatgatgatgagtgccatgattctaggtggaaatatggcgccactggagttatttctgtagcaagcaaccttgttcctggcctcatgcgtagtctcatgtatgaaggggagaatgcgttgctaaatgagaagctgttgcctctgacgaaatggttgttctgtctgccgaatcccatcgcactcaacactgctctggctcagcttggggtggcaaggcctgttttcaggttgccgtatgttcctcttcctcttgagaagaggattgagtttgtccggatagttgaagctattggacggggaaactttgtaggacagcaagaggcacgtgttctcgacgatgatgattttgttttgatcagtaggtattagtaagcgagcttgtttactttggtgaataaaatataatagcatcatgttatgaggatttttcagtcttttgtaaagaaataaaacagctaatcctgattttgctgacagtttcctgtaaaaaaaaaaaaaaaaaaaaaaaaaaaaannaaaaaaaaaaaaaaaaaaaaaaaaaaccctcgaggggg

SEQ ID NO: 494 - DNA, 5808 bp, Zea mays
  misc_feature (561)..(561): n is a, c, g, or t
taaattttcaagaatgatccgaaaatttctatttgttgcttcactcctatttcgaacataggtccgacaagtaaatttgtgtgtgcgtattggaattgggacagtgtgtgctgtgggcgcaagatttattgtggttcggacagaacgttcctacatccagtctttggtggcctgcgctacggcacctttgctgatcaatgcttatagtaagggttacaagtggatgagagagaggagaggttcctcagtctcttgtgcggaggtggtggagctaagggtaagtcttggcttagcggcgggctccagtctcaatgtccttgctccctttgttggctcgtcgtctctccgaccacgcgtttgggtgtccatgttcgttcccttatggaccgacctccttttatagggcaaggagatggtcgactaccgatgacttcctaaaaaaggagtcacggggcgatggtaagaccgagtgttctatcctggtgaagctacatgcgtcattgatccttgaggtcacttgattgtctcatattctttatggcgaatggggcggacatcgtngggcccaagcgccatcattcgagctatgtcgacctctagcctttgtagcatgtccttcgatgtgacttctcttgttgtgccttgcacgcggtgtgcgcattcagatctagtaccgataggccatgagcgagccgcagggcggggggagagcgcgggctataaatgcgccgtgaccgaggagttcgtaggttatgagtgcgctgcagcacatggggctcgctcgtaggccatgagtggtaggcagaccgacatctctactgtgactcaatgtcgagcgcgcggtgtgcgcattcagatctagtaccgataggccatgagcgagccgcagggcggggggagagcgcgggctataaatgcgccgtgaccgaggagttcgtaggttatgagtgcgctgcagcacatggggctcgctcgtagaccataagtggtaggcagaccgacatctctactgtgactcaatgtcgagcgcagttaatatgttcacgcccgacctctggcctaccgcggggttcgtccgaagacagaaacttggaggacatacggtctctttcttctcccgttgaccaatagatcttagttgccagatgttttttcctagcactttggctgagcgatggtcctagagaccgaggatcttaagccgacacctacggacctacctacgacccttctccgttggagctaccaccggcttcgccaccatccttcgagttgaaaagtcgcagacattgggactcaggaaatgtcgtttgtgcatagatcaagtacgggagagtcattattcttcctcatgcgtccatactccatagtattcagctgaatcagacagttggaggtgcttgtaaccgcatttcttttcggaggtcgaaggactgcttttgctaaacatgtcatacctccctccccttgtaagtaccacagaaagatctgctttcccacatgcataactttcttcaattgtttgctctgtcaagtggcgcaaaaactatagatataagttgttgattcagactttcagaatttagagggaatttagaggcgtgtcttgttcagccttattggatctcatccgtctccatctctctcgtcctcttaaactgtctctagcaatatcctttatatttcatccactgaagaaatgttttctgttatttacagaacactttaaaaaattatactctctgtaactttactatttcagcagcgttctctaaactttgttctctatatctcattcgctttaattttcaaaaaaattcaaacacgtatacttttcacaaaatatatgagtcatttgtagattgcaaattatttttatattcttattaataaatatgttttgcaatgaaacttcacattgtgggaaataggatttcttttataaacctattttttatgtccgtgtgggcttccaaaagttaaaagtattcacgtgaatttcttcgtctgctctaccgcatcccagtttcttttgtgccgtcgcatcctagctcctctgcctcgtcgcattccagctcgtcggtgttggtgctctttccctgtcgaggttctccacgcgcgtcgtagccgggcttcatcgtggcgtcctagcgaagggcctccgcgcaggtgctcctcctctccggcagaggccgggcttcaccgcaccgccacagcccagggcctccacgccgccggcctcggtgctggcgctcgtcctcccggcagagctccttcgctccacaggcttagcatatggtacgagggaggcccggtataatacagcggaggctctagcgtccgttgttggactagcagatgcatacattcgctatacttagggtagacgacgttttacagtctattgctatgatagttttataaggtataactattttggttgtggacagtggtgatactaagctctaaattttacaatatataaatttaagtatcagaacaaattaggattatgttttatttctacctatttttgaattaaaattaattaaaagctcaaataaattataaaaaatatttggatcatgatctattgtaccactagttgtcgcgctcttggacaccacaaaacataaaataaataggaaagagaaccaatacacgaattacctcctcattttgtcatctatatatatctaacgagacctcatttctgcgtgaaatttaagagacgtccgtagccgctatcagcacacaccaccaatcttaatctcaaattaaatttttaaaaagtttttatacttagaatttattttgttttcaaattaaattgaattaagcatgtagatttaattttaagaatattatagtatgttggtgctaatactatttgaaaaggttttgttctatccttattatggccgaaattaatttagaatgcataattatagtatgcccgatggtgggatgtcgatggttccacgaccccgtatagtgcataataacagttccaacaactacttggcccttcaaaccttataaatagagtttatgcaggttcgggatcaacattttggcttccccacttggtatacaccctattagacctaagaaaacatcaaccactcatatctagtgacataaaataagattggaagtgatttctaatgattctcatagagttttttatctagtagcactactaatcatattgagttgtagggttctttttactcttggtggctatctccactagactgtttggaggcaataatgagggatcgttgtgcagctttggaggttattgctgacttcggtcatcatactgtaaggagatcttatggttatccatgcgggagatccacaatgaccaacaatgatgatattgcggcttgttacattggagtgtcttgttagagtgattactatggcgtcctatgggtttggcttgttacgccaaataagcacatgaatcttctagtttgggatcactacaatgagtatgtaggttggtagcaagcaaccaaaccacgtcgtctgtccatatggtttgcactccaagctatccttgctaatacatatacttattgcaagatcattaattatcatatatctattttttagcacatatatagcttgttatatacttatatattattcacagtctactggtttggttagggaaatagccttgattaaacataacacaagtaattatttccacatatcaaatatattggccccatttgtaactattaggtttataagaaaaaaattatagcctattcaacctacttctatccatctagatctttttgattagtaatgaaacgatttaacattataggataggagtttacacatacctaataaggcctagtttatctctacacagaagtggagaatagactgccacggcgccactgttacctctatcggcaccaaccatcggattttgatctcctacaacgattttccctcaaaccataagacacatatctaaaatttataaggtatagttgttagagttacatgttaagatcatataacattaacagcgattaaaataaatgttacccggcgccggccttggcagcctacgaccgttttctgttcttgaacaccaatcgagccgcacgccggaaaccaacgaagcagaagcttctctggccggtgagtagtgtacaaaagcaaaacgcattttttttctattctaaaaccctctcagtctcacttcacgccgatcgcagccgtggtacgacagcaactcgcaacagacacaaggccacatcctctcttgccgcccttgagtcttgaccaaaggagctcactgaaccacacgcacagagctgcgacgtctcgactcgaaagaaagggctctgttcccgttagccacccggacccggctccgcgtacctgccggccggctgaccacgctgcccgtgagctatcgggtagcgagccttaaagcttgggtgcctccaggccggccggtgtgttctctgcgcggtcggcccggcgaacttcctctggttcctgatgatggatgtatcgcaagttgccgcagccgtggcgctgatggcgttcgcggtcgcgtttccggcgtcggccttcccgtccggcttcccgcctgggacaccatcagcgttcccgaatccgtgggcggcattccagaacctgtctggctgtcacatgggggaggagcggcagggcctggccgggctcaaggactacctcagccacttcggctacctcccgccggcgccgccgtcgtcccccttcagcgacgcgttcgaccagaacctggaggcggccatcgcgacgtaccagcgcaacttcggtctcaacgccaccggcgctctggacccgtccaccgtctcgcagatggtcgcgcctcgctgcggcgtggccgacgtcatcaacggcacgtccaccatggcgaggagctcctccgccgacgcccacgcccacggcaggcacctgtacgcctacttccccggcgggccgacgtggccgccgttccggcgggacctcaagtacgcgatcaccgcgacctcggccgcgtccatcgaccggtccacgctgagcgacgtcttcgcgcgcgccttctcccggtgggccgccgccaccaacctgcggttcgcggagaccgcgtcggagtccgacgccgacatcaccatcggcttctactcgggctcgcacggcgacggcgagccgttcgacgggccgctgggaacgctggcgcacgccttctcgcccacggacggccggttccacctggacgccgcggaggcgtgggtggccggcagcgacgtgtcacgctcgtcggcgaccggggcggtggacctagagtccgtggcggtgcacgagatcggccacctcctggggctcggccactcctcggtgccggacgccatcatgtacccgacgatccggacggggacgaggaaggtggagctggaggccgacgacgtccaggggatacagagcctgtacgggagcaaccccaacttcaagggcgcgaccccgacttcgccggcgacgagcagccgcgagatggacagtagcgccggcgcgggatgccgaccagatagagtcttcgtcggagtagttgcggcagttggcctgctcctcctagtcctctagtgccgtagacctctagtgtttgccattttttttcggccacgtccttccttgtatcgatttgttgctcgattagctgattcttggatagattcttgtgtacataatatggttatcactattacagaataatataatatctgatacctaaaaaaaaaaaaaaaa

SEQ ID NO: 495 - DNA, 4855 bp, Zea mays
gggcagcctcatctcccgcagcgtgtacaccgtctccggcccgttccacccgttcagcggcgcggtcgacatagtcgttgtgcagcagcaggacggcagcttcaagagctcgccgtggtacgtgcggttcggcaagttccagggggttctcaagtcgagggagaaggttgtcgacatctccgtcaatggcgtcgacgcagggttccacatgtacctggacagcaacggcgaggcttacttcctcaggaacgcggacccgaatggtgaggaaggggagttcattgtctcccccgcctcgtcgggagatgagcgagaggtgccgatccaggaagctcagctgaggaagtcgaagagcacttcgtgtgatagctcgacgatggaagccgacgtcggtgagggcaagattcttgcgaggacaacctcgaggcggataaccatacttgaaaggatgtttggccggaaatcgattaagaacaatgcccatgctgtggatagggtgagttcattggagcgtgcagaggtcgctgcagaactcctagataccaagtggtcaacaaatctcccacgtagttcaaaacctaatggttcaaatgatgagccttccaagagcaacaatgatcagatggaaacctcaaaaacctgtattttcggaacatagtttggatcatgggaaagagatggactctaactgtgacaatgctcactgcaattcatgcagccctcgtggaggaagaaacagttcagcagatgaaaccgatccgtgtttacaagccactattgtgaagaaagaggtggttgagatacacgcgcgtgagagcagcgacttcactgataatatcacttcaatcacacatcaacaagggtcagaatcttcgtcaaatgatctgggaacagataaacttatgcagcagtctgtcgatactcaagatgagttgctgcatgatgttgaagatgtaactgaaagggagacacatgcagaggaggttatttccaatgacatttttgaaatccatgttgttgagacagacattacaagtggtaagagcgaggtggattctgagattgttactgtggatccagaaccagatcgagctaaccagaattttacagatacaaattaccaaaattatggcaccacagatatttcatctgaaagacatgaggtttcattgatcccttctgcacaggatgcagttcaagagaaaatagttatcctcagcagttctgaggctgtggagggctcactagatgcagttccagagaaagtagtcattctcagcagttctgagactgtggatagctcatatgctgtgtcctgtattttggatgacacagttcatgatgcttctgatatctcacaggctgacggtgtacaacatgaggagcactctagtatctctgatgggagtacagaaaagctaatttctgaggaaagttcattagtatgctatggtgttcccagcaacaaaaaagacttggttaatatagctgttcaagaaagtaaagcctttatcttaaaaaatcctgcctcccaaatcttggaagagagtggtccaggtttggatgtatctacagacagtgtttccctttcacatgcagactcagctcctgatttagcttgtcagcatgtttctcctaatgttgaagatacaacaagttatgagcctggcattggtcctgaagatgtaacaaaaaactcagttgtggaaaatggagcatgcagcggggaacttgttgtttctgttattcagacctcagcgggagatggactgacaaaatgcattgctcatccagctgttttttctaataaaatagaagtagaaggctcaccaacttctgctggattttccagtttgatcagtgttgaagtgcaaaacacaaaactagaagatgacacaaacaaatctagttctgtgattggagatgaagctggttttgtgcctgaggctacagctgagcttgatgaagaagcagaaccagttatatcattatctgaatatacagaagaaattcagtttcaatttagtgatgctgaaaattttgcagatagaaaggccacggatgacatggtggctaacaaaacaacaggtgaagtagaacatgatgaatctgattgtgacacagagaaacaggaagaaggtgatgtaggtcttgtaaatgacttggagaactgttctgcgtcattaaagcctgtgagtagccctgtttctattcctgcaattgacttccagtcaggaaatagtaacagagaggctaaatctctaccaaatctccgttctcatatacatgatcttgaaaggtcttatagttttcagctaagccgctcactgcaatcaactgctgaaaataatggaattgatctagtcaagagcatgaattatgcttttcttgagcagaaatcagaagctattggtgatttttcagaagaaaataacagccctcctgaggttaccaacactgtagcacttgatggcaaccatgctgatgatctgaaagttgatgcgttcattccttttgcagaattatcactatgcagacacctgttatctgaaggcatgggggaggatgctgcttgcagtgcatttgattctgagaaggtaaccttagaggagttccgtaacatgaagcaatcactgatgcgaaacaacaaactagttgttaggattgctggccgctactttccctgggatgctgctgcacctatagtactcggtatgatttctttcagtgaggaacaagtttttgaacccaaaggaatgataaatgtggagcgagttgagcaaagtgcagctccaggtggcagctggagcatctggccatttagtttcagacgaacaaggactattactgctatccagccagtttgtgaaagtattgttgagacttctgtatccactcctaaagaattgacacattttaaagaactagatagagaaaggaataaatccagggtaaagaggattgagaggaaggtgcgatcactcactccaacatctgacgagcttgcatctcttgatctcagagagggcaggaacgtggtaacatttacgttctcaactgcaattgttgggaaacagcaggttgattgccacatatatttatggagatggaatacacgcattgtaatatctgatgtggatggaactatcaccaagtctgatgttcttgggcagttcatgccactagttggagttgattggtcccaaaacggagttgctcatttattttctgcaataaaggaaaatggataccagcttctatttctgagtgcacgcgctatttcacaagcccacatcacaagacagtttcttttcaacctaaagcaggacggcaaagcacttcctgatggccctgttgttatatctccagatggtctcttcccgtcactttacagagaagtcatcagaagagctccgcatgaattcaagatttcgtgtctagaggccatcaaagatttatttccacacgactcaaatccgttttatgctggatttggaaatagagacacagacgagcttagctacctcaaggttggtattcctatgggcaagatcttcataataaaccccaagggtgaagtcgcagtgaaccgacgggtcgatacaaagtcgtacacatccttgcatgctcttgtccacgggatgttccctccaatattgtcgtcatctgagcaggaggactacaatgcttggaattactggaagatgccattgcctgatgttgatttgtgaggtacaagtcgagtctgcacaacagcactgcactaattttatgatgtgccgtagtgatcatgagaaggccattacttggttggctacatgtggatgctcctgctcctgatataagttcctgcaagatggaattttgtatatataggatcataatagatgtagtagctatttcttgtgtctcctgttgttgttgttgttgtcgtcgtaggactggaaatcatacctccgtgtgtcctgtaactgaaggtacaaaatttactggatggagggatctgatagtatgttgcagccccccctttttcgtttcatccttgatgtaattgtggtaccgatgtattttgtacaagaacaaatcaataataatgcaatcgaaagcgagctgttcatacgcagaaaaaacaaaagaaaaaaaaaaaaaaaaaagttgcattgaccctaggtgcattcggtaactgaaaatcggagctgtgtatactgtggacatgtcatctttggtatgcctgcgacttttagctgcagagcctgacactaaagttcaacactaaccaagtgctaagatgggcatgtcatcagattggatacaatagtaatgagtagaagaagcttctagcttcaattgagcatctgcgttgctgaaagcttataatttcaattggttggcacatttaaacctacaaagccaagaccaatccatcaaccatcaagaaacacctgcgtgcctggccaactgaccaccagcaggtgccgaatcagtgtgaagcttagaatctacaacaaacatgaacaccatcccattgcaaaaaccctatacgtgagatcagatagaaacaaaaaagatgctatgtgcttattggcaagaaacaaaagtcactacccaaggggatggctgctgcgtcactgtcactgctgaccttatcttgttgcttctgttggttgcgccgccaccccgacacttcctattgcagcggcatcgtcatcctgggccatgggtttgcttccacgggtcacacataggggtgagttcctgggccagggtgaggaaaattctgggattggctaggttacaatccccattgggctcaaccgtgcacctcttcgtgggccaggtttctatccaggctgca

SEQ ID NO: 496 - DNA, 3089 bp, Zea mays
  misc_feature (132)..(132): n is a, c, g, or t
aaccccttccttttgctctcccgttgcgcgccgccccgcctcctcctcacacccctctctttctgtcggcggcgactgggcggccgtcgctgccgtcctacgccagctgcccaggtcttcctcgcccccttncgccggcggcaaccaccgccagggtaagccagccatcagccatggctttgaaggcgagctccggcgacaaccggaccaggagcacggtatccctgtgcatagtgattggcatgtggctgcttcttcttcggccccgcggcgccgcccgtgagcgggttcggcaagggggacagcatcgcgttggaggtcaccaagcgcaccgactgcaccgtcgtgccgaaccttagcttcgatacccatcattctaaagccagtggcaactctagcggcctggtctctccgtcgaagaagttcaagccgtgccctgatctctacacggactacaccccctgccaagaccagaacagggcgatgaagttccctagggagaacatgaattacagagagcggcattgcccggcgcagaaggagaagctgcactgtttggttccacccccaaaaggctatgtggctccgttcccgtggccgaagagccgggactatgtccctttcgcgaattgcccatataagagcttgacagtcgagaaagccatccagaactgggtccaatatgagggtaatgtattcagattccctggtggagggacgcaattcccgcagggagcagacaagtatattgatcagcttgcatcagtcgttccgatcgccaatggaactgtcaggactgcacttgacactgggtgcggggtggctagctggggagcttatttgttgaagaggaatgtcttggccatgtcgtttgccccgagagattcacacgaggcacaagtgcagtttgctctggagagaggtgtccctgctgttattggcgtccttggtacaataaaacttccctatccatcgagggccttcgacatggcccattgttccaggtgcttgattccatggggagcaaatgatggaatgtacatgatggaagttgatagggttctaaggccgggtggctactgggttctgtctggccctccaattaactggaaggtgaactacaagggctggcaacgcacaaagaaggatcttgaggcggagcagaacagaatagaggaaattgctgaccttctatgctgggaaaaagtctcagagaagggcgagatggcgatatggaggaaaagggtgaataccgagtcttgcccttctaggcaagaagaatcagctgtgcagatgtgtgaatcaacaaacccagatgatgtctggtacaagaagatgaaggcctgtgtgacaccccttccagatgtaaaagatgaaaacgacgtagctggaggtgcaatcaaacccttcccagccaggctcaacgcagttcctccaagaatcgctaatggtttggtcccaggcgtttcatcccaggccttccagaaagacaataaaatgtggaagaagcatgtgaagtcttacagcagtgtgaacaagtatctgcttactggtagatacaggaacattatggacatgaatgcacagtacgggggattcgccgcagcaatagagtccccgaaatcttgggtgatgaatgttgtgccgaccatcgcgaagatgcccaccctgggggctgtgtatgagcgaggattgatcggcatatatcatgactggtttgacatttcacgctttaatcgtgtgctcaaaaaagtagtgtgctagtgaccatgaacttacagtgttttacacactactctattgcaggtgtgaggctttctctacttatccaaggacgtatgatcttatccacgctagcggtcttttcaccttgtataaaaccaagtaagctactctttgtcctttgtagtgaatccatagcttgcattgcctgtgctgatctgttttatctactgaaactaccaacaggtgcagcatggaagatgttctcctggagatggaccgcatcttgaggcccgaaggcgccgtcataatacgggacgacgtagacgtcctgaccaaggtgaacagcctcgctctgggtatgaggtgggacacgaagatggttgatcacgaggatggccccctcgtgcgcgagaagatcttgtatgccgtgaagcaatactgggttggtggtaagcagacggctgtagcttgaagcaagcacgtttcatgaggctctaacatgaggaattctgcaaccaaaccttacccgacaaacaaggattagcttaaatgatcaacccttgtagggcttgttcggttacaacaattcagaagcggattggaggggattaaatccttttctagttaaaaatgactagaagaggatttaaacctcaccaatccccttatggattggtgtaaccgaatatgcccgtagggggtagcactgaagcagccaggataccgtgctcgctggtgatcactgcaaccacataatcttctttggtcgtgtactcttttcaaaaagcttgtatctttggaaatttctttacggtcctcgtacagattcgggtgtaacgtattaagtagactagctttatgtaagcgagaaatacatgttttctttggacaaccccaggtctatttgtgtactcccgaatgatcctgaagaaaagggctccttacggctccactgttgcaacttgaaatctcctgcccccaggcacaatttcgaagccagaatttatttgggtgtccgtgtacctttctgtaagcaagaaaagaagtacagataaaaaaaaacaaacttgcgcaccatgtgcgaactatcatgcagtcatggagcattttgtaaagaaccaccagaagacaagaggcacaaagatcatggcagccacagggacaggggcatcggacacgaatatgcatagcaacgcttcgaccctcagaggattttcacctagatatagagggtacttcatcctctctattctctcctctcatttatcccttctataagcaggatcacatgatacggcatcacacactagatatggaaagctgcagaatttatcaaacgtactggcaactgtacctttgcgact

SEQ ID NO: 497 - DNA, 857 bp, Zea mays
cctcgaggccggccggggtgagttcatgccggccgggaaccccttccttttgctctcccgttgcgcgcttctcctcacacccctctctttctgtcggcggcgactgggcggccgtcgctgccgtcctacgccagctgcccaggtcttcctcgcccccttcgccggcggcaaccaccgccagggtaagccagccatggctttgaaggcgagctccggcgacaaccggaccaggagcacggtatccctgtgcatagtgattggcatgtgctgcttcttctacatcctcggggcgtggcagaagagcgggttcggcaagggggacagcatcgcgttggaggtcaccaagcgcaccgactgcaccgtcgtgccgaaccttagcttcgatacccatcattctaaagccagtggcaactctagcggcctggtctctccgtcgaagaagttcaagccgtgccctgatctctacacggactacaccccctgccaagaccagaacagggcgatgaagttccctagggagaacatgaattacagagagcggcattgcccggcgcagaaggagaagctgcactgtttggttccacccccaaaaggctatgtggctccgttcccgtggccgaagagccgggactatgtccctttcgcgaattgcccatataagagcttgacagtcgagaaagccatccagaactgggtccaatatgagggtaatgtattcagattccctggtggagggacgcaattcccgcagggagcagacaagtatattgatcagcttgcatcagtcgttccgatcgccaatggaactgtcaggactgcacttgacactgggtgcggggtgtggctagctggggagc

SEQ ID NO: 498 - DNA, 816 bp, Zea mays
gtttgtgccatcatctcccgcgccgcgcgcgagtgcaacctctatcctcgaggcccccgtgccgggccggggccgcgaagcagcgagatctcgatcaaacagcttctctgatctcgctcagaagcgaggacatcagacattattgcaattgtatttgcacagcagcgagatctcgctcagaagagactctgaagagataacgagctgcgcttcttcgtcctcgatcaactagcttctctggtcgcttccatatggagagagctgcgtcaagctgcgctagcctcctagcacaaaggaggtgctactccgtggccgcggtcgtggtgaagggatgcgggcggaaggccgtggagaaggtggccaagcgcatcatgggcaaggaggtgaacaccgcggctgcctccggggagaagacgccgtgggtgccggacccagtcactggctactaccgcccggcgggtggcgccaaggaggtggacgcggcggagcttcgcgccaggctgctcaccaagaggatcgccaactgaatcaatctagctgcagagcagtgcggctgagattatttagcgccagttcatctcttgggcctagagcatgacggtgctgtatctttttgaggcataactaggtgagtgcccgtgcgttgcaacggaaacacataataacctaacgtagtctgaaacaaatattatggtctgaaacatatatagagttgcaaagatgggtccaggaattgaggcgaacacagatccgaatttcccaggacagtgaaaaaaaaaaaagattagtagccccaacataagtattcacattctg

SEQ ID NO: 499 - DNA, 1173 bp, Zea mays
gacgattcatctcccagtgtttgacattcagatcggcgtaaacagattcaagtaaaataatatacaacaacaacatgttcacccttctagtcaagttcgttgttgaccaacagtaatagcagtacccacatgtgcagagaaagagatgaaatgccgcgacgcggatgtgctgcacgcacagcgagaaaaacagcggcaacatcagactaaacacccgcaacactaaagagagatggcgagaacatctctgctaatgtgcttagtcggtgacttgattccacagatgacgtaaaactaagcacttattcccttgcagttcttggagaagaacaaggagagagagtggttttaagtttaatttatatatcagtttgtaggactcaagttttgtaggaattcaatagcgcttcttcccactattcaacaacaagggatggtgcaattcaagttgtgatagcttgctaggatcttgagtcagtgtagcagataaaaccatcttccccaatcttggatagcatttacctttaaatccacgctccacaccccttggctaattgagtgtgtaagttggatcactgttggcaaccaggattgataagcctctcttaccattcgatctgtttcatcaatgaccaggtactgaagatgctccagactgaaaccatttgtcatgttaatgtgatccattagtctttcaggggttgccaccaatatatcaattttagtctgtggttccatttggacatattcttcgtcaatagttgggtaaaactcttgtttgggcttcgggacaagactagaaacttcatctgctattgatgattgaccaactgctgaacctactgacaagcccaccataggagcaatatcatcaaaaacctctctaacctcgggtcgaggcgggggagctgtgtgacggggcagccagagaaggtgtcgatatcgacggggtaccgcatccacggcaggtgcggcacgcggtccgcggccccctcttcctcgtccttcctcaccgtggccactctcagcgactgagcccacctcaggcgaatatgacaaatccgaggagtcggcgaggtgcacaggtgagaagcggcacgcgcgggggacagaccgacagaaaaatggctgcgactgcgacggcgacgagccgagcgccggccggccgcgggg

SEQ ID NO: 500 - DNA, 10291 bp, Zea mays
  misc_feature (2778)..(2778): n is a, c, g, or t
  misc_feature (5001)..(5001): n is a, c, g, or t
ggccgcgccgccgcggcagcagcggccgcgggccaagagggggcaggccactgaccctcacagcatcgccgaacgtgtacgccacctttcgcttctcctttccacccattcttttaacgcctctgcaatctgcatcactgtatcctctgtggtgtgctgtggtgttcttgcacctagctggagctccgcagcttttggaccttgtagttgtttgacctgccagtgccagccacagtcctcaaattccactgcctgctccaaatttgaactgcatgcttaattgaactgtggtccagtgttcagaaacagcagagattaggatcatcagcgatgagctccctgacgaactgttttcgttctttgccgatcagtttcacatgccttgtcgctcacgctggccgcgcgttcgttgcagctccggagggagaggatagcggagaggatgaaggcgttgcaggagctggtccctaacgccaacaaggtacgccagatttcctcctgtctctctctttttctccctttgcccattctttccagcaaagtagaaggaagctttcccagaaatgtggtgaggatgcattcctttttttttgcactgttttctgttgcatttccccccttaaatccagtcttttgctgtcttggcttgcttgtcttcttttactatgacgtgctaatgctctcctatgtgtaagtgagataagattggtaggatgatgggtgcctcgtaaaataggaaaacatctgctgctgatgaacagctagtgcaacacacgacatttatctgggggaggatgtcggggacagagatggtcactggtctacttgattagtttagctcatgagagctggacaggttgttccggaagcctcccgccggcgcatcccatatccttttcggcacaaacttgcagtcactgttagagtatcacgaagccacaaaccaacaagcgttgtttttgctgctctgcccatggctcgtcacgtctttgatcgacagagcttccatggcacaaactaataagactcattgtcgctgaaaacgatcgtgccgtgtgtcatcgtatggaattttgttttgcagaccgacaaggcatcgatgcttgatgagattattgactacgtgaagttcctccagctccaagtcaaggtactccttctgcagttcttctcttcctacacctagctagcagctaggcaatgctgctgtgggacgtgttcctaaacccttctcatcattcgggcaccaaaaaaaatttcttcagaattcatgagccctcatacgttcgttccccggtcttttgcaggttctcagcatgagcagacttggtggagctgcagccgtcggccctctcgtcgccagcatggcatcagaggtacgtaccatatgctctctcttctgtttttttttttaactaaagaggcaccaaagacccagactgatacagctaaaacttcgtgggccaaatatgatgctgaacccatacttttgacgtatttaatgcttggtattccgagcaatttaacaaccgttcggcccatcgaaaatcgtctattatgttggtccaaagttggtccccgatcaggtctatccaatagcacataaattatgtagagatcttgtttcagattctagctatagcgttcgatgacaaaaaaaaaagtcacctaaaagagctactgccaaaagcaagcagcatgcttacagacatctgcacgaaatcgaaaaggagatggcccatatataactttgcttaggggacttatcgagcattagtggccaacacagctgaaaagaaagtgtgtaggaatctttgttgccaaggactcgagccaaaaaggaagaagaaaaaaaacacgcctgaaaagtagaagtggttacatggtatactgatcaagcattcagggtcaaaattcccacgagtgatcgttattatcttgatgagtggcgatcagttcttgttctcttgttgttgtgtgtaagccaatggaatcagactcagagccttgttgcagggcgacgacagagccggaaacggcacaagcgacgacggcggcgatggtgccaccaacggtgataacggtggtggcggcagcagcctgcgggtgacggagcaacaggtggccaggctgatggaggaggacatgggcactgccatgcagtacctgcagggcaaggggctgtgcctgatgccgatctccttggcctcggccatctcctcctccacgtcgtcgtcgccgccgccgtccctcctgccccgcccctccgtgggctcagtggaaggcgctagaggtcccttgcacgacgacagtggtggtgccggtggcgacgatggttctaggaccatcaagtatgccggtgccggcggtaagcagtgatcttgtcttgagaggtcgtgtgttcagaagggagggagggagatcttgtagggttggaattgccaagtggcctagcagggctacctttcctgccctctctccctccttttgtttgtttataagaaatgatgtttaatcatgcagcaacctttagctcccatctttccatgttcttgtaaaataggagtagcttttctgtgcctctttacctcctctccttttgggccaagctgctcctgcgtcctcagcttttcttctctgctaaatttgtcgcgaagctgtcgtgtctgctctttgttaggtgaggaggaatcgaaattattggtccaaagggatcatattcatatcacataccagcccgagtacacattttatggaatgagattaggatagtgccangtgcaaagctggtcaacgggacgaaagataatgcgagaattaacaccaaatgagatgcacctatgttggtgaagtaaatgaacgaaggggcatctctttcatcgtggtttcagagaacttctggtgaagaggtcatagaagagaaggtacaaggtagtctggtagaattggaccgcaggaatgcaataatgcatgcagatgagatcttctcccccaggggaaacaaaagaaaagaaaagatttgttggaagctggaaaaaaaaggaaacgggggctttcagttgagtttatccgctactctgaaatttcccaatcagtgtcgctgaataattgagtgaaaaccgccgggcctgacgaagacaggaaagggatattccaagcgtaaagcataactgaaaggtgacgggagtgccgatatattgaggtgaacgtagctaagccttttcttttgggtggcctccttccagccataaacgcacagtgaatgatggacgccacacaaggaagataagggcacttctccaactgtaccattcatcaagatggatcggcctgttgcaggaatggcgaaagctgtttggagaggggagcacacataacgaaacatgtacgctacgcagttgttgagcaccacttttggttgcggctgtcttcggtggtggtacggacggtcagcgtaacggttcctcgtttgcagaatttgtgagtaaaaacggcagaattaaattgaggaccggcttgcaacgggtctagaactttccctttatatagatggagggttacggccgattgaactccacaatcgattcaatcaatcatatttatcatttttaccttatacattaggagtagtcctaatttagctttactctatctcgaatcttaacctcttcggctctacatcgactagatacgtcttgaatgacctaccgaccaaggtccttccttgaagtgagatctaagcctgctgcaaagaagatgaccctctgcgccattgcggaccgtccgagccccaggcgtagattgtccgaacgtacgcagaggagtcattcctgcgtccaggtcgcggaccgtccgcgtctccatagagcaccgacagacgattcatctcccagtgtttgacattcagatcggcgtaaacagattcaagtaaaataatatacaacaacaacatgttcacccttctagtcaagttcgttgttgaccaacagtaatagcagtacccacatgtgcagagaaagagatgaaatgccgcgacgcggatgtgctgcacgcacagcgagaaaaacagcggcaacatcagactaaacacccgcaacactaaagagagatggcgagaacatctctgctaatgtgcttagtcggtgacttgattccacagatgacgtaaaactaagcacttattcccttgcagttcttggagaagaacaaggagagagagtggttttaagtttaatttatatatctgcaataacagcatagaccaaatctgagtgagtatgcacaacagagtttccactttccaatagtaattttacacctaaggtaaatgagctacaaagacataagagccaaaccagtttgtaggactcaagttttgtaggaattcaatagcgcttcttcccactattcaacaacaagggatggtgcaattcaagttgtgatagcttgctaggatcttgagtcagtgtagcagataaaaccatcttccccaatcttggatagcatttacctttaaatacacgctccacacccctacatgatacatagtaggttagctaaatcctacaccaaagtatagtgcattatattaaactataaatatggcaaagaaggacaatattgcgactatgagtatgaaatgtgatgattactaaaagaagaaaatacacgagaatgtaactgggataggaattacgatcttctaatagaagtcaatggatgaagtagagtttggctatcaatgtcatgccaggaatgaccttggctaattgagtgtgtaagttggatcactgttggcaaccaggattgataagcctctcttaccattcgatctgtttcatcaatgacctgaatccataacaagtgaaatatgacaagctagtaagttggaaaagtaagtcatgataaggttaaagcagtctaataaatgccaaaaaaaatatgtttaggcagatactacagactgcagcattccaagtccaaaaaaaatccatgggagcngcatatgttaaattgtgttgcaagttgcatggttccaaaagacatacacagcaaggatctagagtaagaggatctgggaactttgcattgctacaaattagcccaggataaatcatgtattaatgacatcatatcatatgcagtactgtatcataaatggatatataaaccaggcacaaaggaaagtgtaaataatctggtcgaaattctgtttcagggcataatctcactaaatatctatatggcatatacctttcacatttttagtgtgcagtgcagtctactaagcatgcacataccacagcagttcttcgaggcttaaacaaacaatttcatggagaacagtagattcagaggaaataagcagtatccacaatgtaagcaggcaagcattaaggagatctagaacgaattatgtaacaaagttccataggcctaccaggtactgaagatgctccagactgaaaccatttgtcatgttaatgtgatccattagtctttcaggggttgccaccaatatatcaattttagtctgtggttccatttggacatattcttcgtcaatagttgggtaaaactcttgtttgggcttcgggacaagactagaaacttcatctgctattgatgattgaccaactgctgaacctactgacaagcccaccataggagcaatatcatcaaaaacctctctaacctgaaattgagataagcaaaatgcagtacatgaactacaacaaaatggataagtatcactcaaatggataagtgacatgttcctttcatatggataactggactctaaatttgattgtttcaaccactcttctagagacaaacatactgtgtcataattttggcatgctcaatgcagtaactctatatagtaaatagggactgattatacctacatatatttgtaggataatcctcaaaacaatgtttccatggtgaagccatatggatccacaatttctgatttacagaaccaagccctccacagaatactctactggctcatcatccttttgggggtcaccttgcaccagcactgattcaattttccatcaacacgcgaagtaatgacccctgtgttttgttcatgctcacttcatttttatcattgtagtttatttacgcccttttatcatgctatagatcatacagacaattgattttgtcactactagttgaaacttgaaagcgtccctcagacttaacgaattacagaagcaatagccaccatccaacactacagtttctgagtgcaaccaagtaatttcccacccgcttacgaacagcaacgaaaaaaggggcgatatcaacaaccaaaactagttagtcgccagttgaaatgcacctcgggtcgaggcgggggagctgtgtgacggggcagccagagaaggtgtcgatatcgacggggtaccgcatccacggcaggtgcggcacgcggtccgcggccccctcttcctcgtccttcctcaccgtggccactctcagcgactgagcccacctcaggcgaatatgacaaatccgaggagtcggcgaggtgcacaggtgagaagcggcacgcgcgggggacagaccgacagaaaaatggctgcgactgcgacggcgacgagccgtttggtggagctgcgaattggtggcagcgttgcggcaaacttagggcgtggaacgggccgtggtggcgtgggccggtaggctgctttggattgggcctcaacggttccacgcctccacgcgatggatggcagttagccagttaccaggtacaaaaccaggaacgacgacgctccgacccgcgcccatttcattttgccaccgctcaccgaccacctccccaaccaccgctcgccgggagaatcccgccgccgccgccatgagcgagatggatcaaaagcaaggagaaaaaaacgacgacatcccgctctgccccccacatcttgggttcatcggcgggctctgcttcctttgcggggcgaaggaggaggacgcggaaggaggtactcccagagtcgccgttggtcaaggagtagaaggaagcgacagcagcgatgacgacgcgcgctgcgtggaggcgaaaacggaaggatgtgctcccggagtctccgttgggcacagaatgaaggtggaagaaggcgacgacgacgcgctctttcccctggaccccgagttcgccctggctgaactctactaccagtgcggggtgccgggggagatgatagaggaggaggacgcggagggaagcgcatcaggagtcacggtagcgaacattgacggggggctggtgaggccagctttggcggcggcgatgagcatcgggagcgcgtccgacatggcgaccctcatgcgcgagaggaagttgatcctcgtcctggacctggacagcacgctggtcaactcggcgaggctctgcgacttctccgcacaggagaaacgcaacgggttcacgcgctacaccggggacaagccccacatggacctcttccggctgaagtactccaacaaagctcgcaagctcaccaagctgcggccgttcgtgcgaggcttcctggagcaggcgagctccatgttcgagatgcacgtgtacacgttggcaaaacgggcctacgcgaaggcggtcatcgaccttctggacccgaacggcgtctacttcggcggcagggtcgtgtccagaaaggactcgacgcggcgggatatgaagagcctcgacgtcatcccgggtgccgaccccgtcgcggtggtgatcctcgacgacacggacgtctggccagcgcaccaggacaacctcatcctcatggacagataccactacttcgcctccacctgtcgcaagttccgctacgacatcccctccctggcggagcagggccgggacgagagggagcaggacaactcgctggccgtggtgctgaacgtgctgaggcgcatccaccaggacttcttcgacggcgaccaagcggacgtcagggaggtgatcagggaggtgcggcgacaggtgctgcccgagtgcacggttgcgttcagctatctggacgattgtatggaggacttccccgagaacaccctcatgtggacgttggccgagcggctcggcgccgtgtgcaggaaagacgtcgacgagacggtcacccatgtcgttgcggaggatccggggacccagaaggcgcagtgggcgcgggaccacggcaagtttctcgtcaacccagagtggatcaaggcgtcgggtttccggtggtgccgggtagacgagcaagggttcccggtgaccgccggcccgtgcgagttgaacattgtcagcctacagctggcggtacgtaatggcattgtcagccttcgtgctgcagattgtccatgctaatctttgtcgttgattcactccggacgatctttgttggaaaaatcactagttccaggatttcagcggaacgtcattctgttcagctatactgtcaggtgttcgatctcaatccgcagcaccgagtttgaaaagacgagatcattactgttagtgatgtagccagtgcactagttatctccgttaaaaatgcaaaaactctgatgacattgccttctagtagtagaggcatatgtgacatgctgacatgatgtacgtgttctcaagttttctcatcaggatgtgcttcagatttcttcgagtagtgcataactgaagttgtacttgcaaattgcaatgcaaatctgggatatctgttgctccatcgactgatttcagtgttaaccatacattttaaatctaactgtggcaatgttaatcacgttaaattcaagcagtaaatatacgcatttcaccaacgaatacacgtttagaggaggtcaccgtaacggaagatattactcataagagtagcatgcatgtgaggatcttggagatggcacaaagagttactaggaacagaaggatgtgcaaggtacagtagtgaaattgttcagaatatacatagctctttaaatcaccaacatcacctcaatttggaggacgaggttcaacttaaggagtatgtttgtagacaaaaaatgcatcagtttctaaatgtgccaatttaattttggttatatagtaaaaaatattttttatgaaattaaaagcaaccataaggctaaataaatgttttggattggtgttgctgcatttgagttttttactgtgtgggttcgaccaaaattcaaatggaagtcaaaactatctgaatggatttgaaaatataagtagaaaatgagaaagagaaataaaaaacttttctcccacctcggccgcaggcccacctaaagcctacctatcgacgctcgttgcttgcaacgttcttcattgagacgttgatatactagactcacctggtagtgtttgtcttcttcccacatcagatgtggtctctttttcccgtcttcctattctgatctgtatccaaacaattcatttattatgtatgtttccttcctttcttgtcgcacaacatcaatgtcattgcaccctttttgacgtgttttcatatcccaaagagcaatctatgccctaacaacacgagctccccaaatcgacgttgagctcaagctctacccgacgtcgtcgtcgttgctcttaaaagcttctctgttgaccctaattcgtcgttggtacttagaaatgatacaacagcttcaccaaacaaggttgtcaactaaatcaccctatgttgctcatgattcatcatcgaacttgtgcagtccactttcgcctgttggagctagccctacaacgtcgtcattgctccactgacttttagaaccctcagggtgagttcaccatcaccctatataccttctttgctcttgtttgacctagttgagctctgaagcccctaaatcgtacgcgcgagtaagagaactcgatggcgaccatggatgacattgtgtcggcattgttcgttgccgctagtcgatttctcgttttaatctctacaactcgtcttagacctaacatatagcaacaaataataccccttcattgtgctattttgcaaataagctcttattgttttaaacattacaacctacaatccttggcatactcccagtttacactttcttagttaaaactcatatacagacttcgatcagttaggaaatacaccttcactgttttgagaatacatttcaactctaaaaaaattatagtgttgcaatccaacttcaaatgctcacatttttctgttttaactccatttggacccattcaacttgtgttagattcgttttaagtaatatatgtagtggtaacacttttagatat

SEQ ID NO: 501 - DNA, 1304 bp, Zea mays
ctgcctatacagatgtggcgccgtgcagagaagatccacacgcggaaaaaagaagcctgcttcattcatcgatctccacgcatgcatgtcccctacctaaacaggcgcgcgccaccactgctttagacgccatcataatccacttctcaaatcaaatgatattttttagaacatttggtggcctccacccagccgcacgaacatcgcaatcacgccctggcacccacaaactccggaattccagatgcttcgtccacatgcatggtagccgacgagacgattagctactagctaccggccggcagggcgccgcgcgcccggccgccgtcagacacaaagaagcgtgtgcggctctggttctccgtgtgcagtagtgctgcgcctacacgtatcaagcaaaggcagctagcttttgatttgtggccatctggcatgtgccccttggacatgttccaagagccttcttccctgattccgtggccaccatcatttggtcccttattccgtgcccgtttgtgccatcatctcccgcgccgcgcgcgcgcgagtgcaacctctataaaaggggcctcgagtgcggccggcgaaccccacaagctcctcatcagacattgcaattgtatttgcacagcagcgagatctcgctcagaagagactctgaagagataacgagctgcgcttcttcgtcctcgatcaactagcttctctgatcgcttccatatggagagagccgcgtcaagctgcgctagcctcctagcacaaaggaggtgctactccgtggccgcggtcgtggtgaagggatgcgggcggaaggccgtggagaaggtggccaagcgcatcatgggcaaggaggtgaacaccgccgctgcctccggggagaagacgccgtgggtgccggacccggtcaccggctactaccgcccggcgggtggcgccaaggaggtggacgcggcggagcttcgcgccaggctgctcaccaagaggatcgccaactaaatcaatctagcagcagagcagtgcggctgagattatttagcgccagttgatctcttgggcctagagcatgacggtgctgtaacttttgaggcataatatatatagatagatagatgggaagagctcgaacgtatctccgtttctagaaagaatggcgcaattcttgctttgctttttaacgagtcaatttgtcttgactttaccatattgtatacgaaaatgtactaatatttatggtatatattttcatcatatatctattgggccgccgggcaagctaactcaaaaaaaaaaaaaaataagcggcc

SEQ ID NO: 502 - DNA, 1932 bp, Zea mays
gaattcggcacgacaacaggtcaggcacgcgagtacgcgacgcacccggggggcccctttccgctcccctccctctcccctccgctcctcttctcccccagatctctctcttcttctcttgcgaagtcgccaaggccagtccccaatccccatccagccagaccgccggcgatgacggaccaccgcgacgtgatgttgcccttgtccctccaatacatagccacccgtgccctcctcctgctcgtcatcgcgtccgccgtttcctgctcttccttgccgccggaggacggcatccgggtcgtctctgcagagaaaagaatcgacctcacgggtcccatcgtcaaagtcttcctaacattgaaggttgagaatgctcccacggcctctgaagcatcacgagttctcctcgccttcacgcccacagagtttcaacatctctctattgtcaaggccacaagagcggaggggaagcgcaagaagaaggcattcgtacccctctcggtccaagcctctgagctcgccaccaccgctcccgacgcccctcgcctctactctgttctgctcagcactcctctgaaaccgggcgatgcaaccactctagaagtgctatacatgctcactcactctttagagcccttccccgctgagattagccagtcagagtcccagttggtttactaccgtgacagtgcggtgcttctctcgccctaccatgtcctggagcaggttacctacatcaaaatgccaagcaataggatcgaatccttcacaagggtcgatcctaccacacgagctggttctgaagtgaaatatggcacatacagtaaccagatgccaaactcctatttgccagttcttgtgcattatgagaataaccgcccatttgctgttgttgaggagcttgtacgcaaggtggagatttctcactggggaaacatccaaatcaccgagcagtataaactgaaacacggtggtgctcgtcacaaaggagtcttttccaggcttgagtatcaatctaggccatctatcagtggagcttcgtcctttaagaatcttcttgcaaggctgccacctcgggttcattcagtttactatcgtgatgagattggtaacatctcctcatcccatctgcgcactgattcacacaagtccgatctagaaattgagcccagatatccgttatttggtgggtggcactgcacgttcaccattggctatggtcttccattgcaagattttgtctttgagtcagttgatggccggcgctacatcaaccttacttttggttgccctctattggatactgtggttgacgatcttacagttaaagttgtgcttcctgaaggatcaaaaaatccagagcatgtagttccttttgtgacagagaaacatcttgagactagttattcataccttgacgttgttggaaggacgacggttgtactgaagaagaaaaatgttgtaggggagcacaacgttcctttccaggtgtactatgaattcaatccgatcttcatgctggcggaaccattgatgctgatatctgcagtgttgctgtttttcgttgccttcattgcgtatcttcacatggatctttccatcagaaaatcatcataggcctgttggcaattctgtccaccacagtattttttgaggcacatgttctgctaactgtgattgatgaagtaacaatccttgttctagcgcactagttgaactgtttatcagtgcaccatcctcaatggagaaggacgatgtttttttttttgtgtgtgtgtgggtggaatatgattgcttcatgtagggctcacaacgatcagaaacgatatcatctataggaaaacgattgcctagaaatttagctggtttcataattaatcaacgtggtgactacaatacgatattgatatatgttcaaaaaaaaaaaaaaaa

SEQ ID NO: 503 - DNA, 1593 bp, Zea mays
ttgctagattctcctgagcttgaatcgcttcacgcttctcctcctcgaagaaagatttttccttctctaaatccaatttcatgttctgaatttcctccttttctttttgcagatcaatgtgcagtgtctctctctcagaggagagccttttctcttcctcccttaactcatctgatttctttaccaaagattcttccttgttcgctaactcagcaaacctaaggttgagattctgttccctttgcgccactgcatcctccttctcattgatggtggtttccctctgatcgagcaaggctttccttgcatcaatctcttcctcaaaagaagtgagcttaatttccatgtcagtgtcaaattcctgcctcctcctcaccaaggcaatttcttcctcttgacggagcctttctatttcagccctttctttgcttgcaatggtctcttggagaatcaatagttcactttcacgtttgtcaagtatggattccttctggattatagcttcctccctggatataattgcctgcatgttcagatccagcttatttttctcttccaaaagaacctttctttcatcttcgagatttaacttttcctccttcaaccttttctctgagtgagttatgtacgcaagtctctcaaggatgctgtcatccctctgattaagaagtacttgttctttcagtaaacattgctccttttcatgcaaaatttttttggtagcatcaaatgatttcctcaggaggtcaatctctttctctttcgatgcattctcaagttcaaaagatgtttggtatcttcttagctgatcttcgcgatcttcaatgtcttgcagtcttctcagagaggtgttgcgagttcgaatgcagtctgcttctaatgattttgcagtgagaagtttctcttctgcttcatcaaactttttctgtgccgtctccatcatttgaagggattcagccagctttgcttcatatgaaacttttatttcagctgtttccccgcgcatatcatgaagtgccttttcaagatttgatatgcactccttctgaatggctagattttttttgaggttttcttccctctttcttgtttcagataaagcagactgctgcgaagctctctctcgcttgagtatgatctcagtggcttcaaaagaagctttgagttgttcgtacttggacgtcaactccttccgctccaataaaataagcccaagattgtgctgatattcatagatctcggactcgagccgcgagatgtagccgatgagggccgccttgtcccggcgcctgacggcgtcctcgtcgaacccggcctcgcgcagcttcatccagatcgcctcgtcgccgccggccgagcgcgggctcgccatggccaggaccccgccggcggggaaccctagcagatcctgaatgcgccgcccgcccagccgcaacagcgcgcggcgaggtcacgcgttcctcgcggcgggccgcgcggaagctcagtgctttccggcgggggctgagtccgtgagtggaggtctctcttccccccgtcctgtcacgaccctgcttttctcgacagcaacggcgacagcaacggaattcgagc

SEQ ID NO: 504 - DNA, 617 bp, Zea mays
catccacgctctaccgctcttgaccattacatggaacagtctttttctggcattgggagcagtgcagcatctacaaaggaatgcttcgaagtgccaccgaaagcaacccgtgtagtttctgagagaatggcgtttccattgtcgttgatgcattcccatgattatgtttccaaaaggttagcattagttggagatgctgctcatactgtccaccccttagccggccaaggtgtaaacttgggctttggtgatgctgctgctttagcaaaagttattgctgagggagtttcagtgggctcggatgttggggatctgactttgctacagcggtatgagaaggagaggaaggctgccaatgtggcgatggcagcagtgctagatggttttcagaagatgtactctgttgatttggggccccttaatgtagtgagagctgctgcgttccacggtgcccagtacatatcaccactaaaaaagaacatcatctcttatgcaacgggtgacacgaaatggtcactatttcagtgaacagcactgctttgaaactcttgtcctcacctcgttctttgtttcggcatgtactggaaacaaagaacgcaatcagtaatttcgttcgc

SEQ ID NO: 505 - DNA, 1770 bp, Zea mays
aaaaaacaaatctgtgcaaattctctccctctctctctctctttctatctggaattctggatgcagtctgcaaggatgacacaagaacaagaacaacgccatcaatcaatcaatcaacacacacgagacctactgtatatagagcagagaagggggatactaatttgtcagtaaaactaaaacaaggaagcacttattttgtgcttgtttagttgcgatcaattagcccgccgccgcgccgccgcctcctcctcctatattagcccacttcccttccttcctttgcagcagcaagaactaaggcttgtccctttccctctcctctcctcccccccctccggtctcctctccccatcttctctcctggaagccgcctcggtcggacccggacaagatggccgccttcttcggtgctgcaccgccgccggctctcgcttcgttccgccacgaggaggaggaggagcagcatcaggacgccgccgaggaggtgtaccacgtggacgatgtcgacgagggcagcggtgacggccgtggccacggcggcgccggccaggggaagctgtgcgccaggggccactggcgccccgccgaggacgccaagctcaaggagctcgtcgcgcagttcgggccccagaactggaacctcatcgccgagaggctggacggcagatcagggaagagctgccgcctgcggtggttcaaccagctggacccgcggatcaaccggcgcgccttctcggaggaggaggaggagcggctcctggcggcgcaccgcgcgtacggcaacaagtgggctctcatcgcgcgcctcttcccgggccgcaccgacaacgccgtcaagaaccactggcacgtcctcatggcgcgcaggcagcgggagcactcgggcgcgctccgccgccgcaagccctcctcgacctcgccctcgccggcgccggcgccggcgccgcacctggcgcccgtcgtcgtcctccaccaccaccaccactacgccggcggctcccctcccatgccgccgttgcacgccgccgacgcccacacgcagtacacggcagcggcggcggcagcggacacccgcgcgcacagcggcggcgagtccgacgagaccgcctccacgtgcaccaccgacctctccctcgcttccgccgccccctgcttctaccagagtggctacgacgtggccccgcgcgccgcggcgttcgcaccgagcgcgcgctccgccttctccgcgccgccggcgacggcgcgctccgacgacaaggtctcgctgcccttcttcgacttcctcggcgtcggcgcggcgtgatgggggggccggcccgggccggccaggcggcggtgtacaggagggcggaggcggtcaaaggacgagagccccggcggcggtgaacccgtgcccgcgcgtagtttagctttagagcccgagttaaatcatcgagaacagaacatggcctgagcttgagagaggaggagaatggcgatccaccattgaactggtgcccgtggcattgcagactaacagctccgcatccgttcggctgctgatgttgctagtagtaatggtacggtgattactctctgctttgggttgggagagacgaatctgcaagcaccaccagaccaagcaagggcgacgatgggtatgggtggatgtttgcagaagaagaaaaaaccgcttgtaacacaaactgcaggacaaaggcagatcagagatcctctgctaactctctttttacccaaaaaaaaaaaaaaaacggccactctagagga

SEQ ID NO: 506 - DNA, 643 bp, Zea mays
cgagctggcccccgcgaagccacccgggatcataaacattattcaggcaaataagccatttgtattattagatcttatccatcacctatggtgaagagcctagatcacataaccatccgagggctctttctactttttatgtttcttgtggcatcctttgttggtcatgcacagataataagaggtgaaaccaaggagaataaggacactaacagcatgacgatgacaacaacaagaccaggaagctatgtaattagcatggatgaaaaatctagcttgtgctttctggatccaagaactctatggtacatctgcaaaataacatatcgcctttttaggacattgaaggattgcttggagttttgccacagtatatgatgcaccatgttggaaaaaaagactaataagaggccatgctttctcaagattgtagatggagatggtgaagatgttatacccaatcatccatgcatgtaccaagggataataaactataagacaacttatcagttattattaagtgttccctattttaggaaatgtcattttctcaagagtattttctttgtatgcgattatgaaagtttcaaatttcatagatgagacgataaaaaaagtttgtctgtcttcaatgacattagtc

SEQ ID NO: 507 - DNA, 1349 bp, Zea mays
aaagcaaaatttgacctgggcgtttgttgtttgcagcgacgacgtgccggggctgctcgccgctctcaaggagatgaaggacggactggacctcgtcaggggcaaggtcgaggccatcacccggaaggtcaaggcgaaccagttgccggcgggcaacgggatcgggtacctagaagcgaagaaccacatgcttcttggctactgccaggacatcgtctactacctgctccgcaagaccaaggggctctcggtggatggccaccccgttgtacggagccttgtcgagattaggctgtttctggagaagattcgtccgattgacaagaaggcagagtaccaaatccagaagctcaccaatgccgctgacaatgccactgctcgagagaaggcaggaaatgcagaggcgaaggggaagggcgggcactcggatgaggaagacctcctgaagtataggccaaacccagatatgatggacacaaagcctggtcctgatgggcaggatactgatggtgtttaccgtcctccgaaatttatgcctactagtatggatgatgaagagaaacgtcgtaaaaaagattcaaggagagataaagcgatagcccgagtggcaatagaaaacccttatattaaagagataatcgatgatgctgcggacagacctgaagagtggaaggaaacagtgggcgatgaaagcagagaatttgggaggtacatgcgacagagagaagagcaagagaagcaggaagaggagttgttcactcgggctcctgtaaccaaacgtgataagcagatcgagaagcgcataaggagacaacttcatgggctaggaggcttaactgacggtttcgaccttgggatgaacatgctgttgggaggagacaaggaagatgatggcggttcaagcaagtcgcatggcaagagcggaaaccgaaagaagcacctgaagagcagcaagaagaggaagaggcattagccctggacccacactgctgtagcacttcaacataccgatacagcctagagacggttcaagcaatccacacggaaagttgaagctggagaaaataccaagaaaccaagtagagaaaaaaagctttggttcctgtaggaaagttgaagctggagaaaataccaagaaaccaagtagagaaaaaaagctttggttcctgtaggcgtattatttctgaaacagaaaacttgatctgagcgactgatcctgagccaatggaacagtatgaattatatggcttgaacatggtaggtgtaccaagttttgttcatcgtagagtatcccagatgtgatcggctacgaattgtttccaaaaaaaaaaaaaaaaactcgagggggg

SEQ ID NO: 508 - DNA, 1463 bp, Zea mays
tcggcgaggacagttgttattattatcctccttccccggccgggccggggcttggaccatatacctgaagtagcagcttcccttctccgtggaagaacaacagaagaaaagggggtaggtaatcttaggcgccggcggccgccggtccccgcgatggacacggagaccggagatacccggtctcccctgctgccgcatcaccctcccagccagacgcaggtatcctcagcgaatcagcactataacaaacccttcagctggaaggccccagccattattttggccttcgaattcttggagagcattgcttactctggtatagcactcaacctggtcgtgtaccttggaaccgtcctccatggaaccaccgcctccaatgcagcgaacgtcgatgcgtggaacggcgccacgtttcttacgccggtccttggagcctttcttgctgatacatactgggggaagtacaagaccgcagctatctccataatattctacgttgttggcctgctcataattaccacctctgccgtcataccgtccctacggcctgcctcgtgtgaaggcggttcatgcccacctgcaacagggtttcagtattttgtgctctttggttcattgtacctcatctccattggtacggggggcgtcaagtcagctttacttcccttgggagcagatcagtacaatgatgcgaacgccgaagagagtaaaagcaagcaactgttcttcagttggttcttcatggctgtcaaccttggagtgttcatctccggcactgttcttgtctggatacagcaaaatgtcgcttggtctcttggattcggcatctcctcgatatgccttgttatcgccgcagttgcctttttggttggaacaccgctttacagggttcaacttccaactgggagcccactcaagagtatagtcatggtgtttgttgcctcttataagaagagaggagtggcggttcctgctgatagcacactgttgtttgaagggaatgaatcaagcagcattgtgccgaacaaaattgaacacactgacgaattcaggtgcttagataaggctgctgtcgttgtagaggaccaagagatgaaggacagccatcgcccatggctattatgtacggtaacccaggtggaggaagtgaagattctgatccggatgcttccgatatggttcacctgtgtcttctattcggctgcaatgagccagactgctaccactttcgtccagcaggggaacgcgatgaacactaagatcgggtccttctcggtgccggcggcctccatgaactccgccgaggtgatcttcatgctcgtctgggttgtgttccaggacagcgtcgtcatcccgatagccaggaggtacacggggaacccgatggggctgacgctgctgcagcggatgggcgtcgggcggttgctggcgatcccatctctggcggccgccgcactggtgga

SEQ ID NO: 509 - DNA, 3443 bp, Zea mays
caaatcccaaaacctgatcccagctccgccgccgagcaaaaccctaggggcttcctataacgccgccgccgcgatggacgacagcctctacgacgagttcggaaactacataggcccagagctcgccgactccgacgctgatgatgactccgacgccgccggcgcctcaccgtcctccaccgcgtcccgctcgccgtcccccgcggcgcgctccccgtcgggctccccctcccgccctgcggcgctcatggacgtcgacgaagacgagggcgacccgtcccagcaggccgtggtgctcgccgaggacaagaagtactatcccaccgccgaggaggtgtacgggcctggcgtggaggcgctcgtcatggacgaggacgagcagccgctcgagatgcccatcatcgcgccaccacgcgtcgtgaagttcgaggtcgggacccgcgccgcggccacgtctacctacgcgtccaccgacttcctcctcggtctcgcgggcaaccccgcgctcgtccgcaacgtcactctcgtcggccacctccagcacgggaagacggtgttcatggacatgctcgtagagcagacacacgaagtggacaccttcgactccgagggggagcgtcatgtgcggtttactgacacaagggtggacgagcaggagaggcaggtctccatcaaggctgtgccaatgtcgcttgttctcgaggggggaaacggtaagtcatacctgtgcaatatcatggacacgcccgggcatgtcaacttctctgatgagatgactgcggcacttcgacttgcggatggggctgtgctcattgttgatgctgccgagggagtaatggttaatactgagagggcaattcgtcatgcaatccaagaaaggcttcccatagttgttgtgattaacaaggttgacagattgataacagaactaaagctgcccccaaatgatgcatatttcaagctgcggcatactctagaggcaattaacgatcttatctcatcgtgttctactacagtaggtggcactcagctggtggatcctattgctggaaacgtatgttttgcaagtggtgctgctggctggtcttttaccttacagtcttttgcgcatctttacttaaagattcatggggttcaatttgaccatgagaaatttgcatctcgcctatggggagacctgtattttcaccctgattctagaacctttaaaaagaagccgccaaaggaaggagctaacagatcatttgttgagtttatccttgagcctctgtacaaaatttatagtctggttgttggtgagcaaaaggggaatgtggaatcaaagcttgctgaattgggtgtcacactgagcaatgcagcttataagctaaatgttagacctttgctgcggttagcttgccgctcaatttttggcactggtactggttttactgatatgttagtgaaacatatcccctcggtgaaggatgctgctgcaaggaagatagaccacatatacactggaccacaagattcctctattgtagatgccatgaaaaaatgtgatcccaatggaccccttatggttaacgtaacaaaactatatccaaagtctgattgcagtgtctttgatgtcttcggacgagtttatagtggcacaatacagactggacagaccgtgagggtccttggagaaggctattctccagatgatgaagaggatatgactgtcaaagaggtgaccaaattgtgggtttatcaggcacgataccgtgttgcaattagtaaagcccctgctggctcttgggttctcattgaaggtgtagatgcatcaataatgaaaactgctactatatgtcctatgaatattgatgaagacgtgtacatatttagacctctacgtttcaacaccttgtccgttgtgaaaatagcagctgagcctctcaacccaagtgagcttcctaaaatggttgaaggtcttcgtaaaattagcaagagctatcctcttgctattactaaggttgaggagtctggagagcacactattctggggactggtgaactatatctggattccataatgaaggacctgagagagctttattcagaggtcgaagtgaaggtagcagatcctgttgttacattttgtgaaacagttgttgacacttcttctatgaaatgttttgctgaaacacctaacaagaggaacaaaattactatgcttgctgaaccattagagaagggcttagcagaagatattgagaatggtcttgttagccttgattcaagacagaaagaaattactgacttctttcgccaacgctaccagtgggatgtgcttgcagcaaggtcaatatgggcttttggacctgacaagcagggtcctaacattcttttggatgacacactttcaattgaggttgacaagaacttgctcaatgcagtgaaagattcaattgttcaagggttcctgtggggtgctagagaaggtcctttgtgtgatgaaccaattaggaatgtaaaattcaagatcttaaatgcaaacatagctccagaaccattgcaccgtggtggtggtcagataattcccacagcacgtcgtgttgtctactctgcattccttatggctactcctcgccttatggaacctgtgtattatgttgagatccaaacaccaattgattgtgtctctgcaatttatacggtgctatcccggcggcgtggtcatgtaacagctgatgtacccaagccaggcactccaatatacattgttaaggcatttttacctgttatagagtcttttggatttgagacagatctcagataccatacacagggacaagccttttgtctgtcagtattcgatcactgggctatagttcctggtgatcccttagataagagtattgtccttcgccctctggagccagcacctatgcagcaccttgcccgtgagttcatggtaaagaccaggcgaaggaagggcatgagtgaagatgtgagcatcaataaattcttcgacgaggccatgatgaatgagctggcccaacaggctgctgatatccacttgcaaatgatgtagtcaaaaagcgagatgaagtgcacacgtggaagatgcaaatgccctcagcttcttcataccatacatgctgcagatgggactgccggagttccagtcgcacctttatgctggcatttgcccctacctgtttcgttttgattaacacattatgattgctgggtatcatgtagcgaatgtttaaagtgggtaccgtatgcaaatcatgtatgtactgtactagtttttacaccatctgaccaatcagcacccttgaggacagagactatttttaaatgtctttattgaactctgagcggcaatggcatcttcgccggtgtagatttgtagtaagattttacttatttgatccctttttgcttttcatgctaaaaccccccaaccc

SEQ ID NO: 510 - DNA, 4208 bp, Zea mays
aatgccgcccctcccccaaatcccaaaacctgatcccagctccgccgccgagcaaaaccctaggggcttcctataacgccgccgccgcgatggacgacagcctctacgacgagttcggaaactacataggcccagagctcgccgactccgacgctgatgatgactccgacgccgccggcgcctcaccgtcctccaccgcgtcccgctcgccgtcccccgcggcgcgctccccgtcgggctccccctcccgccctgcggcgctcatggacgtcgacgaagacgagggcgacccgtcccagcaggccgtggtgctcgccgaggacaagaagtactatcccaccgccgaggaggtgtacgggcctggcgtggaggcgctcgtcatggacgaggacgagcagccgctcgagatgcccatcatcgcgccaccacgcgtcgtgaagttcgaggtcgggacccgcgccgcggccacgtctacctacgcgtccaccgacttcctcctcggtctcgcgggcaaccccgcgctcgtccgcaacgtcactctcgtcggccacctccagcacgggaagacggtgttcatggacatgctcgtagagcagacacacgaagtggacaccttcgactccgagggggagcgtcatgtgcggtttactgacacgcccggcgtccggcaggagaggcaggtctccatcaaggctgtgccaatgtcgcttgttctcgaggggggaaacggtaagtcatacctgtgcaatatcatggacacgcccgggcatgtcaacttctctgatgagatgactgcggcacttcgacttgcggatggggctgtgctcattgttgatgctgccgagggagtaatggttaatactgagagggcaattcgtcatgcaatccaagaaaggcttcccatagttgttgtgattaacaaggttgacagattgataacagaactaaagctgcccccaaatgatgcatatttcaagctgcggcatactctagaggcaattaacgatcttatctcatcgtgttctactacagtaggtggcactcagctggtggatcctattgctggaaacgtatgttttgcaagtggtgctgctggctggtcttttaccttacagtcttttgcgcatctttacttaaagattcatggggttcaatttgaccatgagaaatttgcatctcgcctatggggagacctgtattttcaccctgattctagaacctttaaaaagaagccgccaaaggaaggagctaacagatcatttgttgagtttatccttgagcctctgtacaaaatttatagtctggttgttggtgagcaaaaggggaatgtggaatcaaagcttgctgaattgggtgtcacactgagcaatgcagcttataagctaaatgttagacctttgctgcggttagcttgccgctcaatttttggcactggtactggttttactgatatgttagtgaaacatatcccctcggtgaaggatgctgctgcaaggaagatagaccacatatacactggaccacaagattcctctattgtagatgccatgaaaaaatgtgatcccaatggaccccttatggttaacgtaacaaaactatatccaaagtctgattgcagtgtctttgatgtcttcggacgagtttatagtggcacaatacagactggacagaccgtgagggtccttggagaaggctattctccagatgatgaagaggatatgactgtcaaagaggtgaccaaattgtgggtttatcaggcacgataccgtgttgcaattagtaaagcccctgctggctcttgggttcttattgaaggtgtagatgcatcaataatgaaaactgctactatatgtcctatgaatattgatgaagacgtgtacatatttagacctctacgtttcaacaccttgtccgttgtgaaaatagcagctgagcctctcaacccaagtgagcttcctaaaatggttgaaggtcttcgtaaaattagcaagagctatcctcttgctattactaaggttgaggagtctggagagcacactattctggggactggtgaactatatctggattccataatgaaggacctgagagagctttattcagaggtcgaagtgaaggtagcagatcctgttgttacattttgtgaaacagttgttgacacttcttctatgaaatgttttgctgaaacacctaacaagaggaacaaaattactatgcttgctgaaccattagagaagggcttagcagaagatattgagaatggtcttgttagccttgattcaagacagaaagaaattactgacttctttcgccaacgctaccagtgggatgtgcttgcagcaaggtcaatatgggcttttggacctgacaagcagggtcctaacattcttttggatgacacactttcaattgaggttgacaagaacttgctcaatgcagtgaaagattcaattgttcaagggttccagtggggtgctagagaaggtcctttgtgtgatgaaccaattaggaatgtaaaattcaagatcttaaatgcaaacatagctccagaaccattgcaccgtggtggtggtcagataattcccacagcacgtcgtgttgtctactctgcattccttatggctactcctcgccttatggaacctgtgtattatgttgagatccaaacaccaattgattgtgtctctgcaatttatacggtgctatcccggcggcgtggtcatgtaacagctgatgtacccaagccaggcactccaatatacattgttaaggcatttttacctgttatagagtcttttggatttgagacagatctcagataccatacacagggacaagccttttgtctgtcagtattcgatcactgggctatagttcctggtgatcccttagataagagtattgtccctcgccctctggagccagcacctatgcagcaccttgcccgtgagttcatggtaaagaccaggcgaaggaaggtaagggatatagttgatttatggcaaccatatattcgtaacttttatcgtagttgatttataagcaaccatataatttgctcccgtaacttttatcatacagtaaaaatccttgtcagtgttatactagccataatgctaactgtatgcaccatcacacttgcagggcatgagtgaagatgtgagcatcaataaattcttcgacgaggccatgatgaatgagctggcccaacaggctgctgatatccacttgcaaatgatgtagtcaaaaagcgagatgaagtgcacacgtggaagatgcaaatgccctcagcttcttcataccatacatgctgcagatgggactgccggagttccagtcgcacctttatgctggcatttgcccctacctgtttcgttttgattaacacattatgattgctgggtatcatgtagcgaatgtttaaagtgggtaccgtatgcaaatcatgtatgtactgtactagtttttacaccatctgaccaatcagcacccttgaggacagagactatttttaaatgtctttattgaactctgagcggcaatggcatcttcgccggtgtagatttgtagtaagattttacttatttgatccctttttgcttttccgcctaagtttcttgaaatcgcaccactgaaaatattctgaaagtatcatcttagcatgtgttctgttccgagcatggttctacaaaccggttgggggctaaaaaccggtcagcgccgataaataatttatcgtgattaatcggaataaattgatagaaataagccaaatttaaatctcaattaggttttattattattttgagtggtttaggaacggtttatcggtcgatacaatccattaatcggtcaccaatttgataagacgcagtagtgcgtcagaaatcagacctcttgtttttttttacaaataaagcacatttagattatattatagaagctggagtctattttaagaatttcaagtctatttcagtttctatcaggtccaaatctacaagctttagcttcaaaacaaactcaaactagagatcagtttcgtgaaattttcgaaactctttaaagggcgtttcaaaaacactgtttttatacctcctcatgaaattgcatcaaaattatccaccataccattggttacatgacctaccgatttgtgtctttttctccactcgctaatcatcaatagtaattaaggaaactcacac

SEQ ID NO: 511 - DNA, 3408 bp, Zea mays
  misc_feature (2520)..(2520): n is a, c, g, or t
  misc_feature (2698)..(2698): n is a, c, g, or t
aaaaaggtgaggccacgaccctctttgcccaccccgtggctccgcccctagatgtgattgacaccgtgagaagaaaaaaaaaacctatgtagcgagctgactgctgtacgtgggaaagtgctaaaaaaaactgtcgccaagtctcatgcagataatgacgtgattatatgactcactattggagtaaaccaaacttgttaggtcctaaataaaataaatccgatcctattttgtaatttaagacctattttaagactctcttggagatgttaaccccctcaattcatccctaatcgaacaatatgaacggatttagggggtttgtcgcgtttaacaataaaatttataaatcctttagaaaaacactgttaaaattttaaaaaattataatatagtaaagttgacgttgctgacttgacaatatttttggctagattctctactgcggaacaagccctaaagaggaggattccttgaacggtttggcagttaagaacttaagacatgaggatatgagctctgcacgaggttgtatatttaggatttctccgttggagtcttatataaatttgatcaaaatttataataagatctttgttggaagctgtttttgtctctaaaccctttaatttaagataagacctaatttatcatttttattggagttgctataaagcacagaaaaaaaaaccatcttggacttctcactcttccgtagttccaacgctctgcgcggcatttcgccgagcatacaccatgcactccctgcggtgcgcccttcgctaccccatccccagtaccgccgcctctttatccacctccggcctccgccgtctctcctcccaccatcgcactccaccgccgctccgctcagcgaccaccggtgaagacgagtggaacgacgcgtgggagaccgcatggcttccaggcgactcccccgcctcctccccagcgcccgccgcgccatgggagtctcccgcctcggcttcggagtccgccatcccggtcatctccgccgaggtggatccagacactaaggccttcgtggcagacatggacgagcgctgggccgagcgccgcatcgcgtcgaggcggggccagcagcagcgcgcgtctcgcgcggcggaaggcggggaggggggcgtcgtggcgaggaagaaggcgcaagcggatgattacaggaccaggaagcagcgggtgcacgccgcgctttgggtgaaggagatcgagaagatggaggaggcgcgactcggcggtgggggaggtggcgctgacgatatcgaccggctgctcgactcgtgctcagagtgtgtcgctgcttctggcaactctcactctttatatatctgaacaaaattgcgatccttacctgttgttgcttcatgctatcacattccttgcttgaatttgttttgcttggtgaggattatgactattggtggaaggactgccttggattatcccaggttccaaccgacgttaaaaattatattgaaaatgcaagatcagttacattttttatttgtatatatgatcattttgaattgcagtcagaactttctttccaagcagtggcggaggcaagagtaaattttaggtgtggcggggtttataaagatcaaatacgtataatacaattatgcgagagctcactgatacattgtataaatatatattacttgtgattagtgaatataatagaaatccaaaagcaaagcattagccctttaaatacctcactaaatgaagatgcaaactggacaaaaggcaatctacttacaattttaaactgtaaaaatatgtttcatactttcatcatgtatttgatcttctttaatggtggtgccatcgttgatcgttgtataattgtacctggactcggccacgtgcaaatttgcagctgttttctgacgtccattgcaccaagtcgacgtatgacgctacggtttctgtcgttctggactaggatgtggacaggtggaggcacaacgcagctgatcgatagaatgagacccatcgtattccaattgatgtattagcttcctttcatgggttttgctttgaaggccgatcaccacaggcccaccacaccagccaaaactagtagacccagcaggccagctcgtatttatataacatatatatactgtatatacagtcttcaagtccagaatttaggtatggcagctgccaaaccttgccaaattgctggctctgcccttgtttccaaggatcttctcatgattttggcgggactttgaaaatatagtaacccatggactctatactaaaatctatattaagcctttaacataacagttggtttcaaggatcttctcatgaccttcacgggattttgaaaatatagtaatccgtgggctctacacgaaaatctaaactaggcctttaacataacagtcaaaataaaattataataattatttttttaaatgtattgcataatccttttcaaatagaatagggattataaatgttgtttgaacataattatgcaaatcnttaattaccagttcctgactatggattaaggatcaccaaatccttgaaaactgtcattattctaacattcttggaatgtaattattataatattttttgtaaacacgcaagagaattgtgtatgaatcttctcatattcaatctttaccagcaagctattttttgagacaattgcagnagctctgccttttgattaagatgaaatgaattttatatacaagaaagggtagccaaacgtggtgcctaccagcaagctaccctcaaagaatataccatagctgccggacatacatatacataatctagcagtaaaagtgtaaaactcaatctcaccaatcgatcagatgatgatggacataggtgcagaaaatgaagattttggagaaaagatatgtgccatagcactgaagaaatgagttgaatatgagattagagtggggtgtgtcttggaccacttgcaaatttatcaggggaggagaataatgtgaaaataggagacaattgtgtgatcattgcatcaaggagaaattggaaagagactaagaaagatggatagacctagtgccggtggctcccacatgactggggttcgggaaaggaataaccgaggcaagccttacccctaccttttgcagagaggttatgctgaacccagcgcctttgtctcagtggaaaggcttctcaccagtcaccactgtgctagacatgtcctccagactaaaaaagatgaaaggaagagttttatgcccaggtgaaattcttccagggagtttgaagaaggaaattgtgagtggaccgatgtacaatttgctactaagtatagtaataggatatagacacaacttggggccctgtatgggcgcattggttacacatgcccaggaacgg

SEQ ID NO: 512 - DNA, 1464 bp, Zea mays
  misc_feature (1419)..(1420): n is a, c, g, or t
  misc_feature (1429)..(1430): n is a, c, g, or t
cctcgaggccggccgggaccaaattacagccaggcaagggagccgtgagtcgtcggaactcggacgtcagtacgtcacacaaactgccgagccgttgtggggcgagcaggaaacggactgcaggagcaggactgcaggagcaccaggagccttggaggtgcactccgcccctcgaggcccgcccggaagtcctcatcccccattcctcctcgcggctcatagaaacctcaaaacccaaccaggacagcgtccacagaaagaagagagagcacatagagtggagtggtggacagaccatggagctctgcgtctctacacccccatcctccgtccgcgccaccgccgcgcccatatccttcgccccgccccgacgtggcgcgtctgcctccaccgccgttccgccccaccgccgcatcccaactcgaggctggcgctgcgccagcgcggccgtgcctggcccggtgccctccgaagagccggcatccgcctcctacgccgtcgtcgtcacggacaagcccgatacgcctgccgacgacaaggccgaggaggttagcgccgcgcctagtggctccgcggaggcgcctatggcagagctagtgccgtcagaggcgtccccgtccccagatgatggcggcctggatgagattctaagcaagttgaacattgaagtgtctccaactttaatcctcactggatttggtgcttttattgctttatggatcctatcttctgttgttgctgcagttgattcagtccccctgctcccaaaattgctggaattaataggaactgcttacacaatttggttcatcgcacggtatctccttttcaaggaaagcagagatgacctgtttgcaaagttcgaagatctcaaacagaggattatttgatctatcgtcgaccttttgccacgtgtttaggctttacagccagcttattattaggtttttttctccctttcgtttgaaatattactggatgggtaaagaaggtcatgtatctaaattgtctcctcagggcttgttcggttctaccccagtctatatggattgaggggattgagatggtttcaatccctagtaagtcaaaatctccctcaatccgtatcaatcacctccaatccatatagattgaaaataaccgaacaagccctcatggggtctgttatcggaccccaagttcggctagtgcgcttcttcaggtcactatggattttttttttactcaatcctatgtgtatattgtagagtaaagctttaaaatggtgaatacggttagtatcttcccactcctatgcaagtttcggactcctatttgctactgtccagtaaacacttcatatattaagctcgagcctgtctggctgagctgcaactcaaaaaaaaaaaaaaaaaaaaaaaaaaaaaaaaaaaaaaaaannaaaaaaaannaaaaaaaaaaaaaaaaattaaaaaaaaaaaaaaa

SEQ ID NO: 513 - DNA, 1048 bp, Zea mays
  misc_feature (34)..(34): n is a, c, g, or t
gtgcggcgctcaggcggcggggccgctcgaggcncggcccgggctcgcgggaaaaaaaaaaaaaaaaaatagaaacctcaaaacccaaccaggacagcgtccacagaaagaagaaagagcacagagagtggagtagtggacagaccatggagctctgcgtctctacacccccatcctccgtccgcgccaccgccgcgcccatatccttcgccccgccccgacgtggcgcgtctgcctccaccgccgttccgccccaccgccgcatcccaactcgagtctggcgctgcgccagcgcggccgtgcctggcccggtgccctccgaagagccggcatccgcctcctacgccgtcgtcgtcacggacaagcccgatacgcctgccgacgacaaggccgaggaggttagcgccgcgcctagtggctccgcggaggcgcctatggcagagctggtgccgtcagaggcgtcatcatccccagatgatggcggcctggatgagattctaagcaagttgaacattgaagtgactccgactttaatcctcactggatttggtgcttttattgctttatggatcctatcttctgttgttgctgcagttgattcagtccccctgctcccaaaattgctggaattaataggaactgcttacacaatttggttcatcgcacggtatctccttttcaaggaaagcagagatgaactgtttgcaaagttcgaagatctcaaacagaggattatttgatctatcgtcgaccttttgccacgtgtttaggctttacagccagcttattattaggttttctccctttcgtttgaaatatttctgaatgggtaaagaaggtcatgtatctaaattgtctcctcatggggtctgttaattgttatcagaccccaagttcggctagtgcgcttcttcaggtcaatatggattttttttttactcaatcctatgtgtatactgtcgagtaaagctttaaaaaggtgaatacggttagtatcttacttcttcccaaaaaaaaaaaaaaaacgggcccctatttgctactgtcc

SEQ ID NO: 514 - DNA, 2297 bp, Zea mays
attgggaccctcgaggccggccggaccctcctggcctcctgtcctgccctgcctttccccccgcatgctctcgctcgctctctcgttctcgtggttctcccgagtcccgtgccgctcgagtgcgccgtctgcgtctctagtggcgacgactgggcgaccgccgccgccgccctacgcaaggtgcccagctctccattttcggtcccttcgccggacacgagcacccgccaggataatatgttgtccacgcatgaggcaaatgctgatcagtttgatcttctttcttatggtaatctaaggggactagaggctagtagaagttctgaggaatctaattttggaaatgacttaaaggatggttcttcagtttcttctgagaacttcggctcctcttgtctgcctggcgagagctatcaatctgccacagtagatcatgaaaaacgacctctttctgatgtcaagacatgccaaattgcttgcaaacgtccaaagcaaacagatcactgtacctggttatattcctttgaggaacaccctttgaccagtgaagtgggaatatcttctccagctttatatgatggattggttgagatcaaacaaccaaatgacattcctgcaattaatggtgccacaacctgcagtggtagttcagtgatcccttgccgtaatcatgatcaatcaattttagtggaaaacttagacatacctgattgggcgacttccttccctggttattttgaagactgtgggccagttgttacatatagccatgttgatgacattggttcgcctagaaagggtgtgccaattggacctgagcaccaggctgacattccagaatggaggcccctaaactctatgattgtacctggtgcttcagagttttgtgctaatctggattgtagttctgcttccacttcagagtctgttcccagaggtgatgactatgtaagtgacaagtggatcaggtactgtgttgttccggtgacatgctgctcatctcctgttgactgggctggagacagcaaaatagattgcaactgcagtgacgagggttctatgaggtgttccagacagcatattattgaagcaagggataaccttaaaatgatcttgggacaggacaggtttcgtgagttaggtctttgtgaaatgggagaggatgttgctctgagatggactgatgaggaggagaagctattccaaagagttgttttcttaaatcctgtctccttgggcaagaacttttgggaccaccttccggatgcatttcctaataaaactagccaggagcttgttagctactattttaacgttttcatgctcaggaaaagggctcagcagaacaggtctgacgtgttggctgtggacagtgatgatgatgaactgcatggtgaacctctagctgagcgggtggaaggggatcctgcagttgagtcctctacacatgaacattctgtcagcaattctctgcccatggatgatgaccataaagagtttgaaggagcacagtttgatggatctttgtgtgagaagtcagtatacaatgcagtcgagtgcagacatctaccaaatcagatgcctgcagattcaaatacggtgaacactgcactagatgtttgtgaccaagataatggagctcagtgttcagagtttcacatgtcactgccgagcgatacttcaaacagtcttggggatcaaagtgcatctgtataggagatgttgtgtggacaaggctctttggccgtcgagatgtccaaccaagaccatgaacaacaatgaaatggataacacattcagtttggatctgacatctacttcagatgggtgctgttttgccatggcttggagttgtaaattcagcttcatctggagttgatagttcatgaagttgtacattcttcaactactatgtacttttcgcggcattttgttagcacacttggaactcaactgagcttccacggggttttgctgcccccaccccctaccccccatccccattcgagaaatcaaccttgttgtatgtaccatctgttgtattttcatcgctgtatgtccattcgagaaactgaacatgtagattgtaagagttgccactgtctggattacccgcggtggttttcgtttgcagaccgagtgctttcggaatcgattcatgcaaataatgtgctaccgacagactcccagttgaatccatttgaatgtgatacgtttgtcacgaaaaaaaaaaaaaggggcggcccgcccttcttttgttttttttttttttttttttttttttttttttaaagaag

SEQ ID NO: 515 - DNA, 3538 bp, Zea mays
tagaaattcctttaggagatagaatttagggaacgtttctgagacaagctaacccccgtcgtcagccagcgcgaaccaaccggggccgtcggggtatcagttggtccatccgcagggtgggcagccgggcaccggcccgcgcacacgtgacccccgcccggaagccatcgcgtcccgcgggcccgcggccccaggtctgggcagtaggcaccttccctgaagccccagtccggcagcaggagccactgagccagccgtccccgtctcccgcctatttattcttcccttcccacccgcccccgccctcgatccacccatcgcttctcccgctcgtcctcctcctctcctcctggacagcagagcacggcacaacacaccgagaaagaacaagcagccgccaccggagctcagaaccaccatcagcagcagcagcacacccggtcaaccttccacacacgcgcgcacacacacatggcgtcgcagcagaggcaacagcaggcgggagcggcggcggcggcgtcctccgccgtgggcttcgaggactacctgccggtgatggcggagcggctgggcgaggacgggctgatgcgggagctggcgagcgggttccggctgctgatggacccggcgcgcgggctcatcaccttcgacagcctccgccgcaacgcgccgctgctgggcctgggcggcatgtcggacgccgacctccgcgggatgctcgccgagggcgacttcgacggcgacggcgcgctcagcgagacggagttctgcgtcctcatggtgcgcctcagccccgagctcatggacgagcccaggcggtggctcgacgacgccgtcgaccaggcggcccgcttcctcttcaccagctgatgatgacgacgacgatgattgataactaataattaaggctactagatgatcgttgagatgtttcttcttcttcttcttcctcctcctcttgccgctgttcatatagctggatggatcaggacttgtgctgatcggtcgatggattccatccatgtgtactcgtctgctgttctttccttcccaattcccatgttccaatggagtctggattcattaacatgctttctcctttctgaccatcaaaaaaacacggatcacattgcgtgtgtctactgcttcgctgctttttacacaatcgagattagcattgggtactacagggctacagaggaaattgccaggaccaccccccaagtcgttcttgaacagtggcggaagtttcggttgaccttgtgccctgactgagtccctgactgaccctgatgcgcacaaccaaccaagaggaaatggaggcgacacagaagcacttgtctggtcaaagcctcaagcgtgcgttagcagacagtggcagcggcagcgagcgggaccgcgtcaccgcgcagccgcaagagtgcttctcgcgggcgaaaccaagcaggggagacggacgtgtgagtgactcggtgagtgcttctcgcttttctcagtgtgttcactcggtccgcaccgcaccagcgtcgtcgctacgaaaaggaacggaagccggcccctgtttcgtttcgtcgcccttttgttcgcactgacgagatgagtcacgtgtaagtacagtccagcacgtcgtagtaagctggaacgggagcttccggaaaggtggccggaagcttcaaaagcgaggcgcaaggaaagcagcccgaaagcgacgcgccctcgaggcgtttctctctcttttccccctgtcctccgccccgcctgaccgccccttcggttccaggtcagcgtcaggcaggcagccatccggctgctctcgacgtcactgctgcgattcgtcgcccgatctaataaaaacacgcaccgcctcccccgtctggagtctggaccattgcaatgcaacgccgtcggcggcgtcctcaggtccacggtgacactgccgtgccccgatcgcctatccacccaccaactgttggctccggcctgctctgagcttcgcacccagttccccgtgctgactgcgctgatgccgtgtcgttaggtccaacctacagtacagtacgcccggcgtcatcaattgggggcaggcaaaggaagccgtcgggacagactgatctgaatctgacagacagagatgcatgaacctgcaggttcaggtcggcctcgcgcctggttcagtgcacgcgaggaccccataccataacaaaccatttgaggggggcttctcggacgtgtcaaactaacctctgcacgaccaccgagttggttccgctctcggatgtggcagcctaatttccgatgaagactaatcgtagattaaagatttgttttcggtatgcgctgggcgtggtcaggtcacgtcacggccgagctgtaaccttcgtgcgcgcctgcctctcgtagccgtttgaatttgatctgcccgtggcacgccactgcgtatcaatccttaactaacaatcgggtggttgctaccgacaggaagtctcttgcgatcggcaacggcaaagccaaaaccatcggtagtttagcgggcagacgtagcacagccagctgcgcctgaaaaaacaaaccccgccttgtcgcgtgccgcgccatggattcgcagcacgctgtctcccctgccggccgcggcgacggcacgctggcaatggcagcggcacccccgccgggtttccggcggggcgcaggggcatcccgtgtgcgcgtgccaactgccggaccggacacacacacggctggctggtcgatccgatgcgcagtgagcacgctggtctcgtgtctcgtcgtctccaccgctcgctccgctgctactgcaagaatactaatatatattcccgcgaggctgcgagttgaacttgctgcaaattggcagcgggtcgggtgggatccggtgcggtggacgtgacattttcctggagatcctgatgagactagctgtcccctccacacccaccgcgcggtcgcggagggcagggcacagcggtgcagtgcaggtggcaggacgcattattctttgcgcgcgccggcttctcggattcttctcctccctcgacgtctcggcccgtcggccggcgccatgtgtgcttgctgactgcgcatgttgccgttgttttacttatcctgcggtgccgcgatggcgctggatcgcgagctttccaactgcgtgcgtgtggggggctgtcgcttctccgtgttcctggtgctgtcctctgaatccggatccgtagtggcagtacacgaggctgcgttgctgtcgacacatcgagcaacaacacatcagcaagttgagcaccgccgccccccgccggtgacgtttcggtcgcgctgtcaattttgtctcctgatcggtagcgacgggtggtctggcctgcaacttgcgctgcgtgcccttccttgctgctgaccgccaacactgctctccgagctgtgaggatgatgaaaaaacagggcaaaagacagcagcctgctccctgctccgattcggaatcgtgtgttgcgtgtgggataaaagaatcagaatccaggggatcctcaagag

SEQ ID NO: 516 - DNA, 807 bp, Zea mays
cggacctcgatccacccatcgcttctcccgctcgtcctcctcctctcctcctggacagcagagcacagcacaacacaccgagaaagaacaagcagccgccaccggagctcggaaccaccatcagcagcagcacacccggtcaaccttccacacgcgcacacacacacacacatggcgtcgcagcagaggcaacagcaggcgggagcggcggcggcgtcctccgccgtgggcttcgaggactacctgccggtgatggcggagcggctgggcgaggacgggctgatgcgggagctggcgagcgggttccggctgctgatggacccggcgcgcgggctcatcaccttcgacagcctccggcgcaacgcgccgctgctgggcctgggcggcatgtcggacgccgacctccgcgggatgctcgccgagggcgacttcgacggcgacggcgcgctcagcgagacggagttctgcgtcctcatggtgcgcctcagccccgagctcatggacgagcccaggcggtggctcgacgacgccgtcgaccaggcggcccgcttcctcttcaccagctgatgatgacgacgacgatgattgataactaataattaaggctactagatgatcgttgagatgtttcttcttcttcttcttcctcctcctcttgccgctgttcatatagctggatggatcaggacttgtgctaatcggtcgacggattccatccatgtgtactcgtctgctgttctttccttcccaattcccatgttccaatggagtctggattcattaaaaaaaaaaaaccatctgaccatc

SEQ ID NO: 517 - DNA, 959 bp, Zea mays
tgggaccctcgaggccggccgggaacggagtgcgtccctcgcgctctcccgatgcccagttctccctgtccaccggccgccgcacttgctcgaccgccgccgccgccgtgcgcttaatcttacccctgtctgtctcctcatccagtgcaaggagcgcccaccgctgcctgtgtcgtttggtcaccggagatggatggggatgaggagaacgtcgggccgttccgccggactagcgcgcgcacgcgccgcatggccacgcgcatggcgtccgcgctcgccagctcggacaatcgcgcccaggctgcattagctcgccttgaagctcttgagagcgataatggtggggtcgaggtggtagatcttaatgatgatgagtacggatccacggatgaagaagaccctgttctcatgcaaaaaaaacagtccaagatcatgaaacgtaaaacaaggcaagggaaagctttggagaagagggcagcaagatcactcatggatgtgctacaagaagcaaatttggagtccgttcctcctcatgtgccaacatattcaagggctgctgtgggtccaccgagcacttcatctcgacgccactactgctcagtttgcggtagctctgcaacctacacatgcgtgaggtgtgggacgcggttctgttcatgccgctgtcaagtcatacacaatgatacacgctgcctgaagtttgtggcttgatcggctggatatgtataagctacatttgatgtatgtccacatcctaatggctgttcatatgtgctctgatcagtatgatatacttgctgactatgtatcctactctgtaggtgggggtttggtaagttgtagaaaaccattttctcagtagtgtactgcagttgcaccgaccacttttgtttttttttcccagaaatgttgtgcgagctcgcagttatgcagtagagctgaaagtagctcttggttcc

SEQ ID NO: 518 - DNA, 1803 bp, Zea mays
gcgcatgcatccagtgctggccagccggtgagcactgccgctcgccgcatcaggtagtagggcgctagctagccatggctcgcgtcgccgccatggtggtggtgatggtgctcctccagcagttggcctcctcgtactcgtacaccgtcgcggcccacgccgatgctgctggcgtgcttggccgcaaggcgggcgtcgtcgtcgacgagactccggtggagaaatcgccggctgggccggggaggtacgcagtcatcttcgacgccggcagtacggggagtcgggtgtacatcttccggttcggcaggcagatggacctcctccgcatcggcgacgagatcgaattttttgccaagttgaagccaggtctgagctcgtatgctgggcgaccccaggaggccgcaaagtccattctgcctcttctcgagaaggccaagagcattgtcccctcatggcttatgaaaagaacccctgttaagcttggagcgactgctggattacgccttatcggaaaccaacaagcagaccaaatcctcgatgcggtcagagacctggtccacaagaagagcaaattccagtacaagcccaactggatcaatgttcttgaggggtctcaggaagcatcctacctatgggtcgctctgaattacttgctggataaactgggaggggagtattcccagacggtaggcgtgattgatttgggtggcgggtcggtgcaaatggcgtacgctgtctccgcaaacgctgctgcgagagctcccgcggtgcctgacggcgaggatccctacattaccaaggagtattttaaagggaaacagtacaatgtatacgttcacagctacttgcggtatggttcctttgcatcgcgagcggagattctgaagtccaagaacggaccattcagctcctgcatgctgcgcggatttagtggtaaatatacctacaacggacagcagttcgatgcgactgctagaccagaaggagcattgtatgacaaatgcaggggagagattgccaaggcgatgaatctcaaggcaccgtgcaaggcaaagaactgcaccttcggtggtgtgtggaatgggggaggtggagctggccaaaacgacatctacgtcgcgtcaggtttctactaccttgcctcacatgttggattcatagatagcaaagctccgagcgctaaggccgctcctgccgcattcagggtcgcggctaagaaggcctgcaaattcgatgtcaacagagcaaaagtggcctacccagatgtttctgacagtgatgtgccctacttgtgtatggatcttacttacacgtacacattgctagttgacggcttcggtctgcagccaatgaaaaagattacatttgtatccaaggtgaagcatggcgaatactacatcgaagccacatggcctttgggtacggctattgaggccgtgtcaccgacaaagcagatcggaaactaatgggctgctgctcgcactgaactgaactctggatttagcgcatgttatcatggtttcagttagcgctcctgacctataatatttgactctcaaataatttctgtactgctgctcggcagcgtgcatgcaaactgagcattttcgagtcagcctctgcgtgtgtgcgggctaattcaactatgaaattcattcgaatttctttccactttcactttggtatcttccgtgcttaccggaatatgtaaacgtttgatgctttgctttaattctgtgacgtgtctcacacaaagctacatattcagccacgtcactctttagtctaaaaaaaaaaaagaaa

SEQ ID NO: 519 - DNA, 1778 bp, Zea mays
  misc_feature (12)..(12): n is a, c, g, or t
ccccgcgtccgngaagagcgagaaggtttcccattaacctctcttagggaaataaatatcctcttgtctttccacaatccttcaattgtggatgttaaggaagtagtagttggaagtagtctagatagtatttttatggttatggagtacatggaacatgatccgcggggtgtcatggagaccatgaaacaaccatatacccaaagcgaggtaaagtgtttgatgcttcagctgctagatggtgtaaaatatctacatgacaattgggtgcttcatagggatctgaagacctcaaatcttttgttgaataaccgtgggccccagaactgttgttaggaacaaaggagtattctactgctattgatatgtggtctgtgggctgtataatggctgagcttcttgccaaagaaccgttattcaatggaaaaacagagtttgaacagctagataagatttttagaacactcggcacacctaatgagaagatttggcctggctatgctaaattaccaggtgtgaaagtaaattttgttaaacaaccgtataatagactaagggataagttcccagccgcttctttttctgggcgaccaatcctgtctgaagctggttttgatctattgaacagattgctgacttatgaccctgataagcgcatatcagcagacgatgctctgaagcacaaatggttctctgaagttcctctgcctaaatcaaaggacttcatgccaacattccctgctcttaatgaagttgacaggcgttccagaaggtatctgaagagtcctgatcctctggaagagcaacgtttgaaagaactgcaagggaacataggcaaccatggggtttttggctgaactagaagcacttgattgggtctgcaagggaacataggcaaccatgggctttttggctgaactagaagcacttgattgggtcctgtccgtcctaactgttatgcttcgcactgaaatcctgagtttacgaggttagatatcttctgaggtgaggtgccatggacatgaagtatcacatcttctcggtgtctagcagcaactgatagtgttctttagcaggcttggtaccggtttaaatggataaggtttctccttgtggcccatcatagaaattttgttgcaggattaacgcttcatccagatcgatcataaaagcaaatataatctacctgcatcataaggtgtggcgtgttggcttttattggttacaccagtttcacctttggaacttctctatgtaaaatattccagattggtacgttgtaaacaatgtccagtgtgttggatttaaatttaaaacgaaacatcatcattattagttttctttatgctccgtgggccttttcttttgatctttgcgttttgtttgcaagagacaaaagaagcgcaggggaaggatgccttttgctttcatcaggaaatcaatggcattaatacaacttagaagctaagctgtggctgcttcaagataggaagcttgatggctgtcagcttattgtacctaagtgactaaattttgtggagggccttcaaaagtgttcatctcttactagtgaaccatggtgggattgccgagccgttcggctaaccgggctagccgataattggtggtggtcggctccaccttatcactgttttggattttgaatttggtaaagtttgtaaattttgaaaacttttgatgacattttttgtataaatactatatattatttgaagattttctgctgaaaaaaaatttcaaaatacacaacgaatttc

SEQ ID NO: 520 - DNA, 1132 bp, Zea mays
cccacgcgcccgcccccgcgtccgcaactggttgtgactttgtggtacagggccccagaactgtggttaggaacaaaggagtattctactgctattgatatgtggtctgtgggctgtataatggctgagcttcttgccaaagaaccgttattcaatggaaaaacagagtttgaacagctagataagatttttagaacactcggcacacctaatgagaagatttggcctggctatgctaaattaccaggtgtgaaagtaaattttgttaaacaaccgtataatagactaagggataagttcccagccgcttctttttctgggcgaccaatcctgtctgaagctggttttgatctattgaacagactgctgacttatgaccctgataagcgcatatcagcagacgatgctcttaagcacaaatggttctctgaagttcctctgcctaaatcaaaggacttcatgccaacattccctgctcttaatgaacttgacaggcgttccagaaggtatctgaagagtcctgatcctctggaagagcaacgtttgaaagaactgcaagggaacataggcaaccatgggctttttgggtgaactagaagcacttgattgggtctgcaagggaacataggcaaccgtgggctttttggctgaactagaagcacttgattgggtcctgtccgtcctaactgttatgcttcacactgaaatcctgagttcatgaggttagatatcttctgaggcttggtaccggtttaaatggataaggtttctccttgtggcccatcatagaaattttgttgcaggattaacgcttcatccagatcgatcataaaagcaaatataatctacctgcatcataaggtgtggcgtgttggcttttattggttacaccagtttcacctttggaacttctctatgtaaaatattccagattggtacgttgtaaacaatgtccagtgtgtggatttaatttaaacgaaacatcatcattattagttttcaaaaaaaaaaaaaaactgagaaccagattgctgtagtcgatttgcgaggggttctcttttttttttggtacctttcgcgaggaactcgccattggttttgggtactgaagcatgtactcgagcagctttgc

SEQ ID NO: 521 - DNA, 3092 bp, Zea mays
gcacgacgttagcaggtagcagcagtcgcttccgtcccccttcctcctgtattcgcttcgccgcccaacccagcctccaccgctgccttcccgaccgttctcgccgccgctgtctcctcgcccaccaccccgcacggccggcgaccagcgcccacgcggccgctcgatccaaggccagaacgagcccaccacgatccgcatcacgccgatatttttcaggttgttggtacggatctagggttttcctgctgcggattcgttcgattcgctcatggccgctgggcgccatgggggttacagggactacgaggagagggagcgggagctcgacgcggaggcctccaggaggagcaaggagcagcaccaccatctcggcggccgccaccgcgacgtggaccgccgccgcgatggcgggcgcagcaggggtggtagagactttgccaacggccacggtcgccgacgttcgcccccgcccaggagccgcctcgcgggaaggcttggtgaccgtgagcctggcgaggtgctgagcggcagcgcatctgatgactccggtgggaggtcggatagagggagggaaaatggcgtgcgcagttctagcagggagggcgacatggtggcaggcactgggatctcgtcaccgatcaagaagaggaaattctcaccaataatttgggacagggatagcccaaagccaccgcattctggtgcagccagggacaagaaatcggtagaatctgttccttctgagctccctccgccgccgccgctgccacaagaccacatcccactgagcttgtctgtggagaagtcacctatggatgtagaaactactgttggtacagagagtgctgagcagttgccggaacatgaggtcaataaggtgatagagcaggaagaggactatccaagtccaacaatgaggaacatatcgacttcaagatgggcgggtgcaaatgatgatgaggaaggtggggcagctccaatgaagaagagaagtgtttcacctgcagactcctctgtaccaggtcagtggaaacgagcaagcccagaacctggtgaagtctctggaggaagggcaatgtctaggtcatctgattcagggaaaataggtaatgatgagaaagaagattccgaggtcgataaagatgactatatggatgttgacagggagcatgctagtgacagtggtacagaaaactgtatgtcggatactgactcagacaatgaaatgtgcaggcctgaaacccctgaaccagagaggccaccacacaggtgtatcaatatgcttcaaggttgcagaagtgttgatgagtttgagaggctcaacaaaattaatgagggaacatatggtgttgtatacagagcaagggataagaagacaagtgagattgttgcattgaagaaggtaaagatggagagggagcgagaaggtttcccattaacctctcttagggaaataaatatcctcttgtctttccaccatccttcaatcgtggatgttaaggaagtagtagttggaagtagtttagatagcatttttatggttatggagtacatggaacatgatcttaaaggtgtcatggagaccatgaaacaaccatatacacaaagcgaggtcaaatgtttgatgcttcagctgctagagggtgtaaaatatctacatgacaattgggtactccatagggatctgaagacctcaaatcttttgctgaataaccgtggtgagttaaaaatatgtgattttggactgtctcgtcaatatgggagcccattaaaaccttatactcaactggttgtgactttgtggtacagggccccagaactgttgttaggaacaaaggagtattctactgctattgatatgtggtccgtgggctgtataatggctgagctccttgccaaagaaccattatttaatggaaaaacagagtttgaacagctagataagatttttagaacacttggcacacctagcgagaagatttggcctggctatgctaaattaccaggcgtgaaagtaaattttgtcaaacaaccgtataatagtgtttaaacacaataaagtcggaaccggagggggctgggcgaccaatcctgtctgaagctggttttgatctattgaatagactgctaacttatgatcctgataagcgcatatcagcagacgatgctctgaaacacaaatggttctctgaagttcctctgcctaaatcaaaagacttcatgccaacatttcctgctcttaatgaacttgacaggcgtaccaaacgttatctgaagagtcctgatcctctggaagagcaacgtctgaaagaactgcaagggaacataggcaaccgtgggctttttggctgaactaagagtacttgattggattcctgtccgtactaactgttatgcttcaccctgaatccacgaggtcagatgtcttctgaggcttggtgccggtttgagtggataaggtttctccttgtggcccatcatagaaattttgttgcaggattaacactccatccagattgatcataaaagcaaatataaaccgtcttcatcgtaaggtgtgacatgttggctttgaatgggtacaccagtttcacctttggaacttctgtatgtaaaatattccagattggtacgttgtaaacaatccccagtgtgtcggatttaaatttaaataaaacatcatcattattagttttcttcatgctccttgtgccttttcttttgatctttgcattttgtttgcaagagacgaaagaagcgcaggggaaggaagccttttgcttttatcaggaaatcaatgacattaatacaacttagaagctaagctgtggctgcttcaagataggaaagtgacaatttgtggagggccttcaaaagtgttttactagtgaaccatggtggtcagtgtactatccttgtacattaatgtaaccgttcatctaagttatttggagactatttgccttttttttgttgtataggttgttgcttatcttcagctgacagttataacattgctcacagaaaaacatgaagcgattggtttccgcaataaccaaagtgaaagttagcatgtagagtattgcaat

SEQ ID NO: 522 - DNA, 2152 bp, Zea mays
agtatctggaggaaggacaatgtctaggtcatctgactctgggaaaatgagtaatgatgagaaagaagactttgaagcaaatgaagatgactatatggatgtcgacaagggacatgctagtgacagtgatacagaaaaccgtatgtcagatactgactcagacaatgaaatacacagacctgaaacccctgaaagagagaaggcaccacacaggtgtatcaatatgcttcaagattgcagaagtgttgatgagtttgagaggctcaacaaaattaacgagggcacatatggtgttgtatacagagcaagggataagaagacaagtgagattgttgcattgaagaaggtaaagatggagaaggagcgagaaggtttcccattaacctctcttagggaaataaatatcctcttgtctttccacaatccttcaattgtggatgttaaggaagtagtagttggaagtagtctagatagtatttttatggttatggagtacatggaacatgatcttaaaggtgtcatggagaccatgaaacaaccatatacccaaagcgaggtaaagtgtttgatgcttcagctgctagaaggtgtaaaatatctacatgacaattgggtgcttcatagggatctgaagacctcaaatcttttgttgaataaccgtggtgagttaaaaatatgtgattttggactgtctcgtcaatatggaagcccattaaaaccttatactcaactggttgtgactttgtggtacagggccccagaattgttgttaggaacaaaggagtattctactgctattgatatgtggtctgtgggctgtataatggctgagcttcttgccaaagaaccgttattcaatggaaaaacagagtttgaacagctagataagatttttagaacactcggcacacctaatgagaagatttggcctggctatgctaaattaccaggtgtgaaagtaaattttgttaaacaaccgtataatagactaagggataagttcccagccgcttctttttctgggcgaccaatcctgtctgaagctggttttgatctattgaacagactgctgacttatgaccctgataagcgcatatcagcagacgatgctcttaagcacaaatggttctctgaagttcctctgcctaaatcaaaggacttcatgccaacattccctgctcttaatgaacttgacaggcgttccagaaggtatctgaagagtcctgatcctctggaagagcaacgtttgaaagaactgcaagggaacataggcaaccatgggctttttgggtgaactagaagcacttgattgggtctgcaagggaacataggcaaccgtgggctttttggctgaactagaagcacttgattgggtcctgtccgtcctaactgttatgcttcacactgaaatcctgagttcatgaggttagatatcttctgaggtgaggtgccatggacatgaagtatcacatcttctcggtgtctagcagcaactgatagtgttctttagcaggcttggtaccggtttaaatggataaggtttctccttgtggcccatcatagaaattttgttgcaggattaacgcttcatccagatcgatcataaaagcaaatataatctacctgcatcataaggtgtggcgtgttggcttttattggttacaccagtttcacctttggaacttctctatgtaaaatattccagattggtacgttgtaaacaatgtccagtgtgttggatttaaatttaaaacgaaacatcatcattattagttttctttatgctccttgtgccttttcttttgatctttgcgttttgtttgcaagagacaaaagaagcgcaggggaaggatgccttttgctttcatcaggaaatcaatggcattaatacaacttagaagctaagctgtggctgcttcaagataggaagcttgatggctgtcagcttattgtacctaagtgactaaattttgtggagggccttcaaaagtgttcatctcttactagtgaaccatggtggtcagtgtactatccttccttgtacattactataaccatccatctaagtgttttttggagactatttgcctgtatttttgttgtataggttgttctttctcttcagctgacagttatataacattgcttacag

SEQ ID NO: 523 - DNA, 1169 bp, Zea mays
ccggccggggcggcccatgtggcaatatcccagccttccaggacaggagaaggcccgtgcgggtgcgctttgctcctctccccgcgtgctctccctctctctcgcgcgcgcggcgacgactcggctagtcggctaccgccgccgcccctacgccagcttcccagctcttcgtcaggcccttctccgtcaacgagcacccagcacagatcctgagcctccacacctcaacgatggcgggattcagcagccttgcacccaagaccaggaacctggtggtggctgggggcctgtcggccttcgtgctcggggtctactactacaccatgagagccgtgggaggcacggacgagctgcaggtggcgatcgacaagtttgaggagatgaagaagaaggacgctgccagaaactccagcacaggaggatcataaacacggcgcccttcccgtctctgtactgaactgaacctggatctgcaggctgacatgatacggtagtcaagtcgcccagtagaccaagaacatgcgtgcctctactgtgcaataagtaatgtgtggtactctttatcagatagagcttggcagcttgtgttttaaggagagatgtacacttgagtgtttttgtcctaatataatagtggtcgcaaaaaaaaaaaaaaaaaaaaaaaaactcgagcccgggaaattctgtgggataagtatttgcttgtgtaattacctttctccagctctctggagactgtgaccacgtattgcattgcttatttgctgcgttgataagatcatctctctctctctctttgtggaggaaagagctgaacaacggcagaatttcatatggccgtgttcggttggattgaggggattaattgattttcccaaaggaaaatgagaatcatttggggaaatggagttgtcaaactagttctaaaagatttaatttatttaatcttgtgcattagcagctgtgcactcggacacatggtggacaacggatgctcggacaccgaagtgagccatcaaagcctatcagttgcaaattatatagtttactttagaatttaataaaaccaatgtgttcgtacaaataatgttatatgctatctttatactacctctgcttttaaatatttattgttcgctatttcattttttaaaaaacgaactcctttc

SEQ ID NO: 524 - DNA, 2332 bp, Zea mays
  misc_feature (1950)..(1950): n is a, c, g, or t
cagagaaaatggtctctccctctatattcagagaatagaatgatccataacctctcctatattattattatcgcctgtttgtttgaaactgcctttttacttcgcttaatctgaatatgtgctagacgtagtgctgattactccatatggtcgaatagctagttgaatcctgaatccatctcaactctgaaactgcctacggaaacatccactgtatacacacaaagcaaatgactttgatggtcgctgtgctcaagttttgaatctctcggacagtgctctccctcttctgtaatttgtactatacatacgttgtcctttgcttcgatgctattgtcagttaatgtaaaactctttagctgctagtggatcggagtctgttccagaagcacatcatggactccggatcttataccacctctatacaatattatttgacatttcagacgcccaaaattggcctgcggttagttgtattctgctgcaaatatgtcaagcgatagatggctggagggaagccatatactgccagttgtattttgctgtaagaaatgccaagcgatggatggccggactgaatactgccaatctgccatgctatctatctactcatcgttcatgcccaattcatcgacatctatcatgtactagtacaactggctgattttgtccacgtaattaccagctccgcgtcaggcccttctccgtcaacgagcacccagcacatatcctgagcccctccacacctcaacgatggcgggattcagaagccttgcacccaagaccaggaacctggtggtggctgggggcctgtcggccttcgtgctcggggtctactactacaccatgagagccgtgggaggcacggacgagctgcaggtggcgatcgacaagtttgaggagatgaagaagaaggacgctgccagaaactccagcacaggaggatcgtaaacgcggcgcccttctcgtctctgtactgaacctggatctgcaggctgacatgatacggtagtcaagtcgctcagtaggccaagaacatgcgtgcctctactgtgcaataaataatgtgtggtactctttatcagatagagcttggcagcttgtgttttaaggagagatgtacactcgagtgtttttgtcctatgatataatagtggtcgcaatgtctaaatttccctgaaaaaacttggccaggcgcgacctctatgggggaagtatttgcttgtgtaattacctttctccagctccctggagactgtgaccacacattgcattgcttatttgctgcgttgataaagatcatctctctctctctcactctctgtgtgtgaaggaaagggctgaacaacggctgaatttcatatggccttgttcggttggattgaggggattagttcattttcccagaggaaaatgagaatcatttgggggaaatggagttgtcaaattagtcttaaaagatttaatcttctttaatcttgtgcatttgcaactgtgcactcgggacacatggtggacaacggatgctcggacaccgaagtgagccatcaaagcctatcagttgcaaattatatagtttactttagagtttaataaaaccaatgtgttcgtacaaataatgttatatgttatttttatactacctctggttttaaatatttatcggtcgctatttcatttttaaactaaatcatgacaaataaaaaaaaatgaaaggagcatattttttgaaggctaaataagtttgaagtaaaagcgaactcttgccgtctcccagtccgaaaccatcgatctgattggtggagcatatccacgattagggctggacgaaatactcgtgatcgataactcgctcaactcggctcattttaattttgtagcgagccaagctgacattctagctcggttatctaattagccaacttgtgttagctcgtaagctagctcgtnaggcaaatgagctaagccacaatacaagtttgtcgttggtgtcgtctcctctcatagacttgtcttctcgtagttatgatctgtgatatggacatgtgtggatgtgccatgtgcttaaatatttgcattattgcatggctacacccctacattgcatatttaatatttgattattggttagggttttgtaaactttgttttctagttagtgttgtgcaataaaatattacatatttgtgtaatagatgatgaattgctttataatgatacttgttgttatcttattataataaaagagtttgtaaatatgtaagttaatacatatttggttattcaatttaatattgatagtcagaagctaggacgataaaaaataataata

SEQ ID NO: 525 - DNA, 1147 bp, Zea mays
gccccggcctccctccaccttggccgctgttctcctcaccgcgcgtgcgctctctctctctctctctcggcgccgactcggctaccgccgccgccctacggaagcttcccaggtcttcgtcaggcttttctccggcaacgagcaccctgcacagatcgtgaacctccacacctcaacgatagatggcggggttcagaagccttgcacccaagaccaggaacctggtggtggccgggggactgtctgccttcgtgctcggggtctactactacaccatgagagcggtgggaggcacggacgagctccaggtggcgatcgacaagtttgaggagacgaagaagcaggatgccgctagaaactctagctccagcgcaggaggatcataattcataaacacgcggacacgccctggatctgctgcaggctgacatggtagtggtacgacgacagtcacgtcgctcagtaggccatgaccatgcgttctgcttgtactgtggaataaataaatgatgggttatggtactctttatctggtagagcttggcagcttgtgctttgagggatgtaatagtggccccgatgtttgtattttcctggcgagccggaaattttgtggagtatttgcttgtgtgaaaaaaaaaacaaaaaagcaacgactgttatgcaaacagtccttctatgcagacgtgcaagcaaacatttgatccattacattacgatacaaccatggttacaaccatggtttgttagggttttttttataaagattattgagctggtggtggaagggtaagtgttaaatatatctaaaggtggatcacaatctaatagatcagatagtttgcttgtacgcttgtatagaaagactgcttgcatagcagtcgttgcctttctctacctctttgtggccattgcatatttgttgcattggtgtttggtaaggacagctccgtctgtgaagggaagcaatgagccaaccgctgagctctctctcgacaccatcgagcctgacctgatagtgtaccactgtaccgattcgggttcggttaaacccgaaccaaagtgtggtaatctgaaaaacagttcgatcccatccaagattttgacccgatccgacgtacttatcaagtctagcgggcgctgatca

SEQ ID NO: 526 - DNA, 742 bp, Zea mays
  misc_feature (741)..(741): n is a, c, g, or t
catttcgtcgaaaccgtgtctctcgtgtttcataatggcaattgtctctcccacgagacggcccgtgcgggtgcgctttgctcctctccccgcgtgctctccctctctctcgcgcgcgcggcgacgactcggctagtcggctaccgccgccgccccctacgccagcttcccagctcttcgtcaggcccttctccgtcaacgagcacccagcacatatcctgagcccctccacacctcaacgatggcgggattcagaagccttgcacccaagaccaggaacctggtggtggctgggggcctgtcggccttcgtgctcggggtctactactacaccatgagagccgtgggaggcacggacgagctgcaggtggcgatcgacaagtttgaggagatgaagaagaaggacgctgccagaaactccagcacaggaggatcgtaaacgcggcgcccttctcgtctctgtactgaacctggatctgcaggctgacatgatacggtagtcaagtcgctcagtaggccaagaacatgcgtgcctctactgtgcaataaataatgtgtgatactctttatcagatagagcttggcagcttgtgttttaaggagagatgtacactcgagtgtttttgtcctatgatataatagtggtcgcaatgtctaaatttccctgaaaaaaaaaggcgagacggggcctctgtgggataagtatttgcttgcgtagcggccaaaaaaaaaaaaagcggnc

SEQ ID NO: 527 - DNA, 1931 bp, Zea mays
  misc_feature (1628)..(1628): n is a, c, g, or t
tttctgtaacttatccaaccttctcttgcaggaacaacaagggagacaaccttactggagcttactaccacaaggtgagcgaattgacaaacacagctgttggggcagagcttacccacagtttctcgaccaatgaaaacaccctcacctttggcgggcagcacactctggacccactaaccgtcttgaaggcacgcatcaacaactcgggcaaagccagcgtcctgatccagcatgagtggaggccaaagtcgctggtcaccagcccgccgggcggcgatacaaagaccattgagaagagctcgaaggttggaattgctgtggccctcaagccctgattgattatcaagactatttttttcttctaaggtcctagcatgactgtttgggtcatatcaggtcagctggggaaaacaaaactgttggggttaccggcatcttttggtcgttgcagtctgttgatttcatgaactgcgaaatgtttcattgaggaaatttttgggtcatctgcttagcgctctgttaaatgagcaacttccaaaataattcgagcccagtagaattctgaacttgtttacaatggttgatggtgacattgtcaattgaggtaggggtggttcagttttctaactgcgttttttggaccggtttgtttcatcttttttctgacaagcttttctaataatctaagaatttatctgtggagaatatggttgtgagaagaattagagcatcatgagaattatgtgcagagtaagatgaagaagtctatataatttaaatttagaaagtgatggatttctactgtcgcgacttaccgattttgtattcacgttaattttagatagtttttatcaaatcgattctcataaaagtagactgaagccagacgtttgagagtttacaacagctgtggtcagaagtgtaaataagttgaaacaaacaccccataagttgaaacaaacacccctttgtcatcggttgatatattttgtcttgtagtgtcggggttttatccaatcgtttgatgtgtttttttgttggtgttgtacttaattcatgtcataaattccaatcagtttatgcttagatgcgttcacttctgaatgcaattggttgtcaacgttatgtttggtattatatgaattggtactagggcacctttaatagtatgacctagttagagcatctacaccggttccaaaaacttccctaaatttaatttaaggtgtcagtaacaaaaaaattatgctctaacattttcttaaataagattcttaaatatatcaacttcttaaatattcatatttgaggtccattgggcatagctttgatttgccaaaaacagaacttaacttttttctgaaaagaaactttttttatagagttgaaaccattttgtaaatcgtttgccagaaacgccttaccctagagccatagctattttcatgtattaaagtgctagagctgatgaagctactatttgtggctttttcttcgtcgtacaaaaatggctccggcttttaagtgcttttcttagtaagtcattttttaaaaaggtgtttggcagggctctagctttttctagagaaaagccagagccgaagctttgccaaacagacactcanactctaaacttagagagttatttcacacttccaatagcctgttttactcatcaattacaccataaactcacttgtctgccattgagttcgtatatgtatacaagtgatgcattttaaatgatttaagtgatagaaatgatgaatttactatcgagttagtataattttcaaaaagttaataacctaagaattaagaactgttggagacaagtgtgatgctcgttggggaagaagaggacttgtcgaagccggaggcaacaagtccttcatcatcagagtcagatgagcagcagtccgagtccc

SEQ ID NO: 528 - DNA, 1446 bp, Zea mays
gagtaaccggccgagcgaaaaaataagaagagagagaaaaagaaaaaggagaggcccgcgactgtagtgggattgtgggaagatgcctcgggatggcgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccgccggcggagtccggcaagatcaccttcccctcctcgctcaagcagccagggccaagggagagaccaatgcagtgctttatcaagaggaataagaacaactctacattctacctctaccttggcttcacaagttcacctgtggataaagggaagtttctcatggctgctagaagatttaggcgtggtccccataccgagtacattatatctcttgatgcagaagacttatcacaagggagcaatgcatacatggggaaactgagatctgatttctgggggacaaacttcaaaatatatgatagcaagccaccatatgatggtgctaaagcatcaagtagtcgatctagtcgtcgtttcggaagcagaaggattagtccccaggtatcggctggcaattatgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaaggaaattatgtgtaatgaacttttgctctagttccatgcaaaagacatttcaatgtacatctgttcatggtgaagtgatacttctcccttttctataaaaaaaaaaaaaaaaaaaaaa

SEQ ID NO: 529 - DNA, 1522 bp, Zea mays
gcacgagaccattacctagaacatcctaatcgaaaaactcgtcagctacaattctacggtccatacaagtagatcgagggtggtcgagcgtttctttctctcttcggctgaacgcggttttgcacaagcgagcaaagagagggagagagagaaagaaaagaaaagaaaagaaggggagggccgcgactgtagtggggagatgcctcggcatactgcgcccgcggcgccgccatcggagcgcggcgagatggacgaggtggtagaggcggatccggacacggaggcggaggatcaggaggagaggtgggcgacgctgctaccagagttgctctccgacgtgttgctgcgcgtcgaggcctccggcgccgagcagtggccggcgcggaaggacatcgtctctttcgcctgcgtgtgccgctggtggcggaaggccgcagtctccgttgtgcgtcctccggcggagtccgccaagatcaccttcccctcctcgctcaagcagccagggcctagggagaacccaatgcaatgctttatcatgcggaataagaactctacattctacctctaccttggcttcacaagttcacctgtgtataaagggaagtttctcatggctgctagaagattaaggcgtggtccccatactgagtacattatatctcttgatgcagaggacttatcacaagggagcaattcatacatgggaaaactgagatctgatttctgggggacaaacttcaaaatatatgatagcaagccaccatatgacggcgctaaagcatcaagtagtcgatctagtcgtcgtttcggaagcagaaggattagtccccaagtatcgtctggtaactatgaagttggacaggtttcatacaaatacaacttgctcaaatccagaggccccaggagaatgaattgcactcttgaatgcccttcagcgcaagagacctgggaaaactcactcaagacaaagttcaggaggcccttgggtcccacaactttacgaaacaaagcgcctcgctggcatgagcagctgcagtgctggtgcttaaacttccatgggcgggtaacagttgcatcggtcaagaatttccagcttgtggctgctgccggccccagtgaccctactagcaacgtggacgaggaaacggttctgctgcagtttggtaaggtcgacgatgatattttcacaatggattaccggcaaccgctctctgcgttccaagcttttgccatcagccttagcagctttgggaacaagctagcctgtgaatagcgatacggttcgatgctcgtcgcgtggctatatggtttgcggtggtgggtgcttgctcgccgttgttacaatgtgatctgttctttttttttagttgagtatcgacgtactatttgtaccatgctgttgtacaagagatgcactatactgcattactgctgtcttgtcaaaaggacttgttcaagaaggaaatactgtgtcaaaaacataaaaaaaacttcccggcgctaagcattccggtgctaaaaa

SEQ ID NO: 530 - DNA, 4019 bp, Zea mays
  misc_feature (3429)..(3429): n is a, c, g, or t
  misc_feature (3800)..(3800): n is a, c, g, or t
cacttacacagaacatatatttctgacactgagttagcatcattagatacattatgaatatattttcttaatttacctctttgattggtagatgttaatactcttctctataaacttggtcaaactttggacagttttgactaggacagcgcaaaccccattatatttcaggactgagggagtagattattgatctcctgttatgttttaatgcttgtattgaaacttctttccccatcttaaaatacaactctacttctgcaccttgtttagatctgatttctgggggacaaacttcaaaatatatgatagcaagccaccatatgatggtgctaaagcatcaagtagtcgatctagtcgtcgtttcggaagcagaaggattagtccccaggtatcggctggcaattatgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaaggaaattatgtgtaatgaacttttgctctagttccatgcaaaagacatttcaatgtacatctgttcatggtgaagtgatacttctcccttttctatgcggcccgttttgttttgtttggatactactgttactagtactgcctaggagtgtggattctttggaagcataggaacgttagtggcgctcgacctcaaaggaccggagagccgcttgcagatagggtctggctccataaaaaacaaaagggttttttaaggtagtgcctttgattttgctgatgtacttatttttatctttagtcatgttttttatcagttttgttcttctagtactattccagtgctatagaatagaaagacaaaactgagaaaaaacacgattgagagtaaaaatgagcacaccagcaattttgttggagcggctggtctacgtgctcttgatttgtggaattcataggtagttttagtttagttgttgtggtcagggtttctcttgcttgttggtttggttagcctttcttttggtttcctatttggcctctttctttgcctggggttggaggccgtttttatcgggttttcttcttattattgttgtaatgatacacaactctcttgcgtattcagaaaaaaaatgctaagcaacagtaagaaaaatattctatgatatcattttgtgcaagttgtcaacctcaacctaaactcttggggttgctctgcacataagtttatcaggtgtcaatcttgtgaagttgctgttgcaaaggttccagggaccagccactcgatcagctactgtctgaactctgaatacccctagtcaactgagattggctctactactgttcttctagaattcagaaagtccagcatgcatgcttggaacggcattcatttccacgcaggccatacttttccaagtcgccccaaaactgtcgaggtagttttagcgacgacaacatccatgcgtcatcatgtatattgtttaatccacaacagtattttgaacaatttctatcgtaaaggaccacaaaaaatagctaatgggtctttatctcttgcatattaagcaacgaaaactagttattttttggatgaaggatgtaaattatctattttttatcggtcaggtgaaactgatggaaatcacctaatttctatgtgctacggccaaccgataaaaattagctggttagaacttaccagatgcaaattaatcatttatatctgcacatagtgtgtgtatataaatgctattttgctccctagatgtcaaataactatttggttatttggcatcctgtctctcaaccgagacgtctcagcagtccaacagagccggcctaaatttctccatctatttaatatgatccaacctttcgttcgtttacctttccctttctcacgcgacaattccttcgttctctatgggtactcatgccattcatgagaataactgagatagcagttatttagtgagtcagacaatttttttaaaaaaacaggaaatatgaaaggaagtaaataaactcagtcattatatgaatactcagtcattccatcttttagtctagatgttcataagaattattgagtaccaaatacaattcaggagaatcaattagtcattcattatgttcatatagtcaagcattcatcatcttcagtcattgcgtcctagtttatttttattgtttttgtgggtaggcacggttttgatcgatggcgacttacagggtggcactggctaatcagtgatggggtcacgcccgaggaggcacgctggggaggccgccgaacagatcgatcagacgaaattgcgtgtggtgggctctgtccgaactctatataaaagggtacgctagtgtaaaatagctatttgacgcctagagtgccaaatagctatttggcatgttgtgtgtatgtgtgtatacgcaaagggggcatgggcgggcgtgtatacgtttacaatatatatatatatatatatatatatatatattcattcatatcaatcctcatcatacaaatcacaaatcttagaccagagaaaaatccttgctaagttcttgatcaccctatttgaacatgagttaatatatcataattggaaaacttaacaaagtaaaatatgttatacacaaagtagaaatataactggaaaagtaaaaattattatatctcaattatcatcaaggatcaatttgtcctcttctttctcagagctgccatctcacttttttcatcaaatgccctcattttcttttctcagatatcattacatcatcatgatctctgacaaaatctagtaacatgtcaatatatgtgctcggcagatccctattttgggcaatgtcaaatcattcttagactccaagtggcattcacaataaccatcatcactaggtgtgtacatgcattcatgatnattaactttatatactacttactaagatttcaagcctgtacatgaatctgacatataatacacatgctcgacttagtgagcaaggataaaattgtaatgtccacgtaatcgttttgtttgtcgtggttgacttcaaccatgtcatattgattttgttaagttctagggttgggatcaaaccaatcacatagaaaaaataacattttaagatttgtattttttgcaaagctatactcaagtatgttttggattattttataataattaattttttgatattgtgcatcaatgctcctagttacaacttcaatgttacatgcagctagagtatgagtaacttctaatttggttgattggatgtgaaacctatnaacatcacacctactctggcttttgatagttacactttcataagataattggcacatgtcttcatgtacattggcaatttgcacgcactattagtcgtacatgtttataagatccttaaaatataatatggtacaataataagtgttcacatgttctctaaaccaaatgataaaattaggacctcgtattctttcatgttgcatcacatctagtgattg

SEQ ID NO: 531 - DNA, 1077 bp, Zea mays
  misc_feature (1024)..(1024): n is a, c, g, or t
  misc_feature (1064)..(1064): n is a, c, g, or t
  misc_feature (1070)..(1070): n is a, c, g, or t
cattgggtacctcgaggccggccggaccagtcccacacaaggatggggcgcctcccggcggcggcccggtactagtcacacgattggctacacgacacgagctcagagctctcaggtttcccaacgccggctgctggccaatggcgcagcaccacggcagccactccctggaggtcggcggcgtcgagttcgacgacgacggccgcgccgcgcgcaccggcaacctatggacctgcttcgcgcacatcatcaccgccgtgatcggctgcggcgtgctggcgctctcgtggagcgtcgcgcagctgggctgggtgggcggccccgtcgccatgctctgcttcgccttcgtcacctacctctccgccttcctcctgtcccactgctacaggtcccctggctccgatgatggctccctgaaacgccagaggaactacacctacatggacgccgtcaggacgcacctgggggagaagcgcacctggctctgcggcctgttccagtacctcaacatgtacgggaccgcaatcgcctacaccatcaccacggcgacctgcctcagggcgatcgtgagggccaactgctaccacagccagggccacagcgctccctgcggcgccggcggcgaccacctctacatgctgctcttcggggcggcccaggcggtgctgtccctcatacccaacttccacagcatggcctggctctccgccgtcgccgccgtcatgtccttcacctacgccaccattggcctcggcctcggcctcgccaagaccatagaaaatggggcgatcaaaggaagcgtcgccggagttccgatgagcaccgcgccgcagaaagtctggcgagtcgcgcaggccatcggcgacatcgcgttcgcctacccgtacaccattgtcctactggagatacaggacacgctcaaatcgccgccaccagagagcgagacgatgcagaaggggaacgtgctcgcggtcctggccaccacgttcttctacctcgccgtggggtgcttcgggtacgccgncttcggcaacgccgcgccgggcaacctgctcaccggcttnggtttntacgagc

SEQ ID NO: 532 - DNA, 2467 bp, Zea mays
gctcgtcctgcttcgtactaccagtagtagcacgtaaaccagggcgccacgccagccggatcggatcgtcttggatgtgggcatgtggctgtggacgagacaaaagtctccgcccgtcggcggccgcccgcgaaaggtctcttcgatccggcctctccgggccacccagtcggccagtcccacacaaggatggatcgctagcgccgatgagctatactctttgctcactgtactagtcacacgattggctacacgacacgagctcagagctctcaggtttcccaacgccggctgctggccaatggcgcagcaccacggcagccactccctggaggtcggcggcgtcggcgccggcggcgtcgagctcgacgacgacggccacgccgcgcgcaccggcaacctatggacctgcttcgcgcacatcatcaccgccgtgatcggctgcggcgtgctggcgctctcgtggagcgtcgcgcagctgggctgggtgggcggccctgtcgccatgctctgcttcgccttcgtcacctacctctccgccttcctcctgtcccactgctacaggtcccctgcctccgatgatggctccctgaaacgccagaggaactacacctacatggacgccgtcaggacgcacctgggggagaagcgcacctggctctgcggcctgttccagtacctcaacatgtacgggaccgcaatcgcctacaccatcaccacggcgacctgtctcagggcgatcgtgagggccaactgctaccacagccagggccacagcgctccctgcggcgccggcggcgaccacctctacatgctgctcttcggggcggcccaggcggtgctgtccctcatacccaacttccacagcatggcctggctctccgccgtcgccgccgtcatgtccttcacctacgccaccatcggcctcggcctcggcctcgccaagaccatagaaaatggggcgatcaaaggaagcgtcgccggagttccgatgagcaccgcgccgcagaaagtctggcgagtcgcgcaggccatcggcgacatcgcgttcgcctacccgtacaccattgtcctactggagatacaggacacgctcaaatcgccgccaccagagagcgagacgatgcagaaggggaacgtgctcgcggtcctggccaccacgttcttctacctcgccgtggggtgcttcgggtacgccgccttcggcaacgccgcgccgggcaacctgctcaccggcttcggcttctacgagccgtactggctcatcgacttcgccaacgcctgcatcgtgctccacctgcttggtggctaccagatgttcagccagcagatcttcaccttcgcggaccggtccttggcggccaggttcccgaacagcgcgttcgtgaacaaatcctacgccgtgaaggtgcccggcgcgccggcgtcgtggagctacagcctcaacctgcagcggctgtgtttccggacggcgtacgtggcgagcaccacggggctggccctcctcttcccctacttcaacgaggtgctgggcgtgctgggcgccgtcgtcttctggcccctcgccatctacctccccgtcgagatgtactgcgtccagcgcggggtcctgccgtggacgcggacgtgggtcgcgcttcaggcattcagcgtcgtctgcttcgtcgtcggcaccttcgccttcgtcggctccgtcgagggagtcatccgcaagaggctcggctagttgtggtattagcgccttttctgtcgtcaaccatgtcatgaatggtggaagtgtgtaaagagagtgtactgtatctaagttttttttatttccctgtgttcgcttagccatgagcccatgaccatgatgattgatgaatatatctacccgtgcgtgtttagatcccaaaaaaaaaaaaaaaaagcggccctcgagctcctctgcgtttgttgtcgccactccggtgcgacttgacgcggggaggtgactcctccctcttcttgttgccggactcccccgatggagccttcccatggcttgtggcgggcttcttgccggtcaccatctccatcttggcgtgagctcccgacatcacttcgagcggttaggctcttaatgaagtaccaggctctgataccaattgaaagtcgcctagagggggatgaataggcaaatctgaaatttataaaggttatgcacaactacaagccggggttagcattagaaatataatcgagtccgaaagagagggtgaaaaacaaatcacaagcgaataagaacgaatggcatgatgatttgttttaccgaggttcggttcttgcaaacctactccccgttgaggtggtcacaaagaccgggtctctttcaaccctttccctctctcaaacggtcacttagaccgagtgagcttccttccttgatttcccgggtcacttagaccccgcaaggaccaccacacaattggtgtctcttgcttcgccc

SEQ ID NO: 533 - DNA, 915 bp, Zea mays
acatccagtagtagcacgtaaaccagggcgccacgccagccggatcgtcttggatgtgggcatgtggctgtggacgagacaaaagtctccgcccgtcggccaccgcccggcaaaggttctcttcgatccggcctctccgggccacccagtcccacacaaggatggatcgctatactctttgatcactgtactagtcacacgattggctacacgacacgagctcagagctctcaggtttcccaacgccggctgctggccaatggcgcagcaccacggcagccactccctggaggtcggcggcgtcgagttcgacgacgacggccgcgccgcgcgcaccggcaacctatggacctgcttcgcgcacatcatcaccgccgtgatcggctgcggcgtgctggcgctctcgtggagcgtcgcgcagctgggctgggtgggcggccccgtcgccatgctctgcttcgccttcgtcacctacctctccgccttcctcctgtcccactgctacaggtcccctgcctccgatgatggctccctgaaacgccagaggaactacacctacatggacgccgtcaggacgcacctgggggagaagcgcacctggctctgcggcctgttccagtacctcaacatgtacgggaccgcaatcgcctacaccatcaccacggcgacctgcctcagggcgatcgtgagggccaactgctaccacagccagggccacagcgctcccttggcggcgccggcggcgaccacctctacatgctgctcttcgggggcggccccaggcggtgctgtccctcatacccaacttccacagcatggcctggctctccgccgtcgccgccgtcatgtccttcacctacgccaccattggcctcggcctcggcctcgccaagaccatagaaaaatggggcgatc

SEQ ID NO: 534 - DNA, 5143 bp, Zea mays
  misc_feature (345)..(345): n is a, c, g, or t
  misc_feature (502)..(502): n is a, c, g, or t
  misc_feature (614)..(614): n is a, c, g, or t
gcttctgatgtagaaaatatcaaaatagaagttgtgtatcttgaaaagttatgcaactctatagttgacaacattttcaattgaattcatttagtgcctcaaataatcaaattactctcgatttgttataatatatgaggaatgaaaacgtaatataagcacaattgatgtagtagtgtaatggtagaggaagttatgcgcacgtgtgaggttgtgagttcgaatctcacattcacaaaatacgtaaatttgaaatgaaaacgtaatataagcacaattgatgatgtaatagcgtagtggtagagcaggttatgcgcacacgtgaggttgtgagttcgaagttcnaatctcatattcacaaaacacgtaaatttgattaaaaatggtgaaaatgataggaccgatgtgtagagcaatggcggtggttgggggggaagctgtctccctaattttgaaaaatgttttgctgtttttttgggttttttgtgattcttaatttacngagtgttttttgacactcgcccgaaaaaagtactcgaaaaaaaaatcatttaccgataaaatatttgccgagtgtggctttgccgagtgtataatggtctttgccgagtgtntgagacactcgacaaaaaaggcgagttcggtagtgaatatttgatgtatgtgttttatatatgtgtctagatttatcatcatatatttaaatatatataaaaaacaaggctaaaactaatagtaccgtgggacggaaggagtactaggtttgtcttctaaaatcacttataaattatttaatttaaaacatttaaactatatatatatatatttgtattaaaaaatacttataaaatctcatacatttgaaagtgtatttagaaaattgcgttaaagtgaatgcggcacatatttgtgattggagggaatattcggtcgcgtaaatttaaactcgaaacaagctgtcacgtacgtactgttttccagctcaacataccaacctgacgcgacgtcatgcacagcttccgatatcacaacacacggacacggggggaagggcatgggccaacggcccaccattcagtggcaataacaaaaaggcccagcgtcagccgtctcgtacgtcacccggttcatggttgcgagagaggcggcgcggccacgagtccgggaccggctcctcagaaaccggccgcctatctctcccccttccctccgtgttcgtcggccccggccccatattttctctagccttgctcgtgtggctggaagagtggagatcggggaagcgtttgtgttgggtacgtagtacagatcgtgatgctttctttccttgagatcgttgcattgcgtcagggattgatgttaatatagatttgggtttcgttgatcctcacctgcattgccgtgttgcatgcgcgtgcactcagcactctggacgcccgagcccgacatggaccgcgacgaggaggtgggccacggcgaccgctcgctcctattcatcggcgatgaggacgatctcggcgtcgaccgggacggcggatccccgccgacctcctccgacgatggatcattctccgaccggagcgacgccgagacacgcgccggccatgtccgccgtcgcgacggcggcgagcgtgaggacacgcccgaggacggccagaatggcgcgtggccgcagagttacaggttcgtcaaccagccgcctcgccgtccacatctcttccacgattcggagctgacgccgtttcctcggcggcgttctcgtttcgcatgcaggcagtcgatcgacatgctgagcgcggtgccgtcgccgacgatgaactcgatcatggcagcgagcccgagcctgaccagattcggcagctccttcctcaaggccgggagctccttcttcctgaggaaaggcgagggctcggggctgccgctcaccaggccgctgctgccgccctcgctcccgcagcggtcgcagtcgtcgttgcacccgcagccgcggcccgtgaagcagtccacggacagcctcgcccaggcgccgcggtggccggctgcgcacgaggcggagctgcccgagagaccctccaggcaatgcctgaaatccgattatatcgagcttcctccgcctgctagcaagtgcagcaggaaccaatcaatcatcaatggtgcgtgaccagttggatcttgaattctcaggtgttagagtaatcagcttatggaatcaatcatcaatgctggtcgaatttctagggttcaatgtgctgtgcggcgttggaattctcaccacggcttatggaatcaaggaagggggatggctaagcctcctgctgctccccttgctgggtggcagctcgtgctacacgggcttgcttctcaagaggtgcatagacagttcgcccaacattgagacatacccagacattggacaagtcgctttcggaatctttggtcggatctttgtatcggtgtgtataccttgaaaaacacagatttctcttcgaaagtcagctcacctgttgtttacctcactgatcgcatctctttttttcaggttgtcctgtacatggagctttatgtaagtgtgctctctgaactctaaaacttattgtgaatggccttggttgtcgaacacaagtgatttttatgtatatattttttttgcaggcaagctgcgtggagtacattacgctgctaggagacagcttgtcgtcagtgtttccctcagcgcatttagctttcactggcatcgacctgaacgcgcacaatctctttgcaaccacaatggccttggcaatcctcccatcagtctggctcaggaacctcagtctcctctcatatctttctggtatgtaaaaaaatgtggaattgcttcttactccctctgtactgatcataggaatgtagttagaattgactcgtatcactgatagttcagtcagtttatgatcaacaaaagtaatctttgagcgaaagaaggattgttcctggctccggaacctcagtctcctctcatgtactttctgctggaggcgtgatcgcgacgatcacggtcatcgtctgcctatgctgggttggcatcggagaaggaattgggtttcgcttttccggtgctgtagtgaacgtgacccaccttccagtggcactcggcctgtatgggtactgctactcaggacactcggtgttcccaaacatctactcgtccatgaaggagcgctcgcagtttccattcgggctcatgttctgcttcagcggtgctcttaaccttgtggccgccggtgttcctgggccgccttcttgttaacacaaaatgccatcctgcaccgttttcagcttcacggtggtaacgcttgtgtacgccggagttgcggtctcagggttcctgatgttcggcgagtccactatgtcacagttcaccctaaacttgccacagcagtacatcccatccaagattgccatttggatgacggtgcgagggaaaaccacactttaccattctgccatcgcgttcagaatgaagacgacgagatgctaatttcattgcttttgttttttttttgttgcatttttctttctggttccaggttgtgaatccttacacaaagtatgcactgacgatgacgccggtcgccttgtcgatagaggaagccctaccaaagaagatgcagagttacctggtcggaatgctcgttaggacatgcctcgtcctctcaaccgttgcggtggctctgcttttcccttactttggtgagtagtagtagtctttctcggtttaactgaatgatcctcccctccatttttaaattttaagatgctttttttttgactttttcctaccctcctctgggttctcagccctggtgatggcactgcttggatccgtgttcacaatgctcgtggtaggttctggagaacatttcacctacacttctgcggtggatttctctactttggccatttgaaagaagttgataaaaaaaatgtgcttgatgatgatttatacaggccttgatactcccatgcgcatgctacctctccatcaagaagggcgcagtgcccttgtgggaggtaaccaccaactagaaacgcgcggaccaacaaatacaggattggaacctgaaactgctcaacactgagtatctatggtcattttctttgcagatcatcctgtgcataatcatcatagcgattggcgttgtgtgcgcgtgcatcggctcatttacctcgatcaaccagatgattagcagcagatagtgtctgcgtagctgttgcagattctttctttccaatgttgacagagctgaaactagcagtctgtcgttttttttttgtttttttgtttttgcagctacgtttatttgttccttctttttgacagaaaaggccgcctcggtttgtttgtttttgctgtaacagggtgaagttatatttcaggcaatcatgatagtaattcttttgcgtacaattatgaaccacaggatgaagttatactaatttttccgacagctatggacacatatgaaccacaggatggccacacaacaggcacatctccgatctctcaccatgacacttttttttgttttgttttggggttgctgttgttgggaaactagtcagtatatatggcacatgtgatggacatcacgtcctcacctaccagggcgctacagctccaggcccacatgggccgagccacagcccacatccaccgaacggggtgggggggcctacgcgctacggccatggatagatgcgcaccgcttgcacgagctagtccctccagcacacgagcatggtgacgcagcggcgcatgatgtagaacctggccctctgctccttcaccaggcccgccaggcggcccggcaccgacctgcccgcggcggccctggacggccggctcttcagccccgccgccgccgacgccgacgccgacctccggctccccttcttggaaagcggcgtcttgctcttgtcgtccatgtgcatctccatctcttcctgtacgagctctctgcagtggcagttgttcttggaaatggtggaagcttgcaatgtgtggctctctctctctctctctctggagtctggttgcggttggcttgttgcagatggaggcgaaccccaagggccccctcgtcggatttataggccctcc

SEQ ID NO: 535 - DNA, 4192 bp, Zea mays
  misc_feature (4)..(4): n is a, c, g, or t
  misc_feature (2014)..(2014): n is a, c, g, or t
  misc_feature (2033)..(2033): n is a, c, g, or t
  misc_feature (2054)..(2054): n is a, c, g, or t
  misc_feature (2353)..(2353): n is a, c, g, or t
  misc_feature (2894)..(2894): n is a, c, g, or t
  misc_feature (3113)..(3113): n is a, c, g, or t
gcangagaccattacctagaacatcgtaatcgacgaggcgaatccctgactttcttctccacgccgtgctctgcttcgagtgaggcctggttcagattttacaggggttcggttcgatctggtgtccgacggaggcggcggcggcggctcctctgctgttcgattgagggagaggggccatggaaaacccggcgccgccgaccaacccggcctccgccacgccgtcgccgtcgcggcagctgccggacttccagcagtcggttcgtctcaagtacgtgaagctggggtaccattacctcatcacccacggcatgtacctgctgctcaccccgctgatggtgctcgtggccgtgtacctctccacgctctccccgcgcgacgtcgccgacctgtgggcgcacctccgcctcaacctcatctccgtgctcgcctgctccacgctcctcgtcttcctcggcacggcctacttcctcacccgcccgcggcccgtgtacctggtcgacttcgcctgctacaagcccgggccggagcgtcggtgcacgcgcgacaccttcatgcgctgctccaggctcaccggctgcttcactgacgccagcctcgagttccagcgcaagatcctggagcgctcggggctgggcgaggacacgtaccttccccccgccgtcacgcgggtgccgcccaacccgtccatggacgaggcgcgcgcggaggcgcgggaggtcatgttcggcgccgtcgacgagctgctcgccaagacgggggtcaagcccaaggacatcgggatcctcgtggtgaactgcagcctgttcaacccgacgccgtcgctgtcggccatggtggtcaaccactacaagctgcgcgggaacgtggtgagctacaacctcggcgggatggggtgcagcgccgggctgctgtccgtggacctcgccaaggacctgctgcagacgcacccggggtcgtacgcgctggtcatcagcacggagaacatcacgctcaactggtactcggggaacgaccgctccaagctggtgtccaactgcctgttccggatgggcggcgccgcggtgctgctctcgaatcggcggtccgaccggcggcgggccaagtacgagctggtgcacacggtgcgcacgcacaagggcgcggacgaccggtgcttcggctgcgtgacgcaggaggaggacggcgagggcgtcgtgggcgtgtcgctgtcgagggacctgatggcggtggcgggcgacgcgctcaagacgaacataacaacgctgggcccgctggtgctgccgctgtcggagcagctgctgttcatggcgacgctggtcgccaagaagctgctcaagatgaagaaggtgaagccgtacatcccggatttcaaactggcgttcgagcacttctgcatccacgccggcggccgtgccgtgctggacgagctggagagcaacctggcgctcacggattggcacatggagccgtcgcggatgacgctgcaccggttcgggaacacgtccagcagctcgctctggtacgagctggcctacagcgaggccaaggggaggatccggcgccgccaccgggtgtggcagatcgcgttcgggtcagggttcaagtgcaacagcgccgtgtggagggcgctccggtcggtgaacccggcggaggagacgaacccgtggatggacgagatcgacaggtttcccgtggatgttcccaaggtctctaaggtttcaagcgactgaaatgcattgctagttgcgtgaatgatggagcttgcaattgtttggatagaagatctggttggaatttttcatagttcattactatatagttgtaggagataggaaaggcgatcgacttctctaatcttgaattatacatctgttaatgttgtttctgtatggcactcggtccctggcctatctatatagttgactgctcggtgttctgacagttctactatatctgttcattctccaactgttgatcactgttcttccacaaaaaaaaaaaaaaaacgatnttgttggcccttcggcaanttagggaatatatgtgattanaatctcggagtggattcttgccttccctcgtgccgagctgtacctgttcttttttcccccttttggtctgctggtgttctctaatgctcagcagctcatcgtgttcgtctctgaatatcctaaaactgcatgattaggcaaggtgttagccggattcaaggtgttaacctgaaactgaactagaaattaatgttgtgacagcattttggaaacttcactaaatagtttatatcctttttttccacttcggatccgtgttgtcccactaatctgatgaagcttacaatgttgctacactnagttcactgaatctgatagattcatgattctgtatgtgcctgctgaattaagttcatgctatatagtaggtcatcctgttgctacactaagttaactgaatctgatatattcatgattctgtttgtgtcttgaatgtcttgcaaacgggtgtcagtcatactggaactacaactgaaactatagctgaaggcatctgcaactgcaagacacaagccgtcgtcttcttcttcttcatgaaagcctttcaaatcctgacctgaagcattgctcaatcatactggataaagctcacgaacgcagtttaaacatatatggtgatttgtatctgaattacgtctacatacatgctcagcttgactcatgtggctttgtttgggaattatgtctgtaacaatatggttcctgtgttcatcaatagtggcttcattcatgtgcctttgtttgggaatttgtaaggtccatacaggaacaaatagttgggcgagttgcagtgaaatttgtctgccgagaagctaaaagcagatgtactaagccagccgncggccttattcaacggtatttgaatcttgaaccatgaattagatacatctgttgtacagttaggttagctgattgcggattttaacgatgtcgaggccttgttgggacctcttgattgtggattgaaaagtacagttggaaacgaaaagattagtccaaccagaaatgtaacaacgaagttttggcacgtaaagacacgtagatttgtcaggaggcatncatgttagttgtttgcttcagttcttatgctttgttttagggacctgtggcatgtctatgatttcagattttttttctctctcttatcgacaaggctcgaacacttaggtagtatttagacggaggaacgaggaagaataaagaccggcagcggacaggaggttttaggggcccggaacaaatttaaaatagaggtccatcaaactattgttatataaaaatagtatcaatatataaactcaagacacatataaaaatattcataccaagtaacaaataaataaaaagatacatattatagtattatcttaaaagttcttttaatatgtttaaatacgactgagttgtgaacgcttcgtagctgctaattattcgacatttcactattaagctattatgtctgatagtctaattactgaatgtataactaggttcgggggccatatatctatataattgggggtccggggcggcggcccttcgccccaccctcagggccgccactgatgaagagagatgggatgtgatcattctaacttgacccgtgtttagtttggaagttcagagtcagggtgaaggaatattcttcaaaaatagtggatgagaccattcctcaaaaaacaagggacgggatcagccgatggttgatcacattccatctctcgttgacaccgaaccaaacactaccttagaggatgtgagtgttggttctgatcttttgacatagaaccaacaaagtggtttccttgatggagttgcctcttgtatgctttgcagagcacattttcgtctaaaattttgcactcgccatcattgctaattttatggtcattttcaaagggtagaagtttgatgcccttgaggtaatgaatggatttgcttatgcagacaccacaggtggctgaaaatgcagaaggcacgaggacaacgccctccattgttgccaggaatctgaatgatggcctactgatcgatgttactgtgagcctgaagtatcttatcggcaataattaggagtaacacttttgatgagccgcagacccaaaaggagatgaagatgatgacttaggtcatctcta

SEQ ID NO: 536 - DNA, 947 bp, Zea mays
ctcgagtcgagtcttgccgacctggggcctgctgcgccgcacgagaccattacctagaacatcctaatcaaaaagcaccgggtccttgctttgcgcgttgctgttcgcataaacaagagatcctagttctactcccaagcaatgtatccgtcagcccctccggacgcgtataacaagttcagcgccggggctccgccaacggcgccgccgccgccggcagcgtaccaccagcagcagcagcagcacggagcgaacatggacacttcacgccccggcggcgggctgaggaaatggtccaccggcctcttccactgcatggacgacccggggaactgtctcatcacatgcctgtgcccctgcgtcacgttcgggcaggtcgctgacatcgtggacaagggcacctgcccatgtatcgcgagcggactggtgtacgggctcatctgcgcgtcgacggggatggggtgcctgtactcgtgcctctaccggtccaagctgagggccgagtacgacctggacgaaggggagtgcccggacatcctggtgcactgctgctgcgagcacctggctctgtgccaagagtaccgcgagctcaagaaccgcggcttcgacctggggatcggttgggaggctaacatggaccggcagaggcgaggagttgccggcggcggcgcggtgatgggggcgccgccggccataccgctgggcatgattaggtagatgattgattgatgcgaaatggcagaacttgctttcgtggttcttttgtttgactatgtaatgtatcttcgtttccatcgattctatgtaatttaactgtccctttttttttggctctctattgtggaggtcgctgggtgtgaatagcactgttttggatgggtttgtgattggtctagatgacttatataaggtgattgtagagcggagttttaaaaaaaaaaaaaaaa

SEQ ID NO: 537 - DNA, 1925 bp, Zea mays
gcacgacaccgccgccccgtgcggcgcgtgaaaggaacggggccgccggccggactcttctgacttggcaaccgccgcgcagcgcgacgagcgccacctgcttgctgccgcgtgcctgcgtgcgtgtgcgtccaccactgaccccgcgcccgcccgccgcccctgcccctccactccacttgctcactcgtcggctcgtcgcggcccgcttcccccccggccaagggatggacgcgcttcgcctacggccgtccctcctccccgtgcggcccggcgcggcccgcccgcgagatcattttctaccaccatgttgttccatacaacgaaatggtgaaggacgaatttgcttttctagccaaaggacccaaggtcctaccttgcatcaccatcagaaattcttcgaatggaaatcctcctattgtaggatatcacatcggtcattaaatacttctgttaatgcttcggggcaacagctgcagtctgaacctgaaacacatgattctacaaccatctggagggcaatatcatcttctctagatgcattttacagattttcccggccacatactgtcataggaacagcattaagcatagtctcagtttcccttctagctgtccagagcttgtctgatatatcacctttgttcctcactggtttgctggaggcagtggtagctgcccttttcatgaatatctatattgttggactgaaccagttattcgacattgagatagacaaggttaacaagccaactcttccattggcatctggggaatacacccttgcaactggggttgcaatagtttcggtctttgccgctatgagctttggccttggatgggctgttggatcacaacctctgttttgggctcttttcataagctttgttcttgggactgcatattcaatcaatctgccgtaccttcgatggaagagatttgctgttgttgcagcactgtgcatattagcagttcgtgcagtgattgttcagctggccttttttctccacattcagacttttgttttcaggagaccggcagtgttttctaggccattattatttgcaactggatttatgacgttcttctctgttgtaatagcactattcaaggatatacctgacatcgaaggggaccgcatattcgggatccgatccttcagcgtccggttagggcaaaagaaggtcttttggatctgcgttggcttgcttgagatggcctacagcgttgcgatactgatgggagctacctcttcctgtttgtggagcaaaacagcaaccatcgctggccattccatacttgccgcgatcctatggagctgcgcgcgatcggtggacttgacgagcaaagccgcaataacgtccttctacatgttcatctggaagctgttctacgcggagtacctgctcatccctctggtgcggtgagcgcgaggcgaggtggtggcagacggatcggcgtcggcggggcggcaaacaactccacgggagaacttgagtgccggaagtaaactcccgtttgaaagttgaagcgtgcaccaccggcaccgggcagagagagacacggtggctggatggatacggatggcccccccaataaattcccccgtgcatggtaccccacgctgcttgatgatatcccatgtgtccgggtgaccggacctgatcgtctctagagagattggttgcataacgtccaacatagcccgtaggtattgctaccactgctagtatgatactccttcctagtccttgccagcaccagtgacccaaacttggtcggctgagctcagcgctcagcagctttacgtgcatctgcgccttgacttgtgcagtgggcgtcgctagcatgaatgatgtatggtgcgtcacggcctgacggttcgtcagtctgggccgtgttttgtgtcaaaaaaaaaaaaaaaa

SEQ ID NO: 538 - DNA, 1454 bp, Zea mays
aaaataatgttacaaatggaaaagtgagaagcaacttctttggactaaaaaaatccaattttctccgcgacgaaggagaggcatccctcccttccgcgtggtgtgctctctgttcccctttacgccgtttcctctcccgactctctcctcgccggcgacgccgcggagtaggtgcaacagaaactgctcgaggcggaggcggagcctgcggctgcacagacatgggtgatcacgaggcgcgcggtgatgacttcgagaagaaggcggagaagaagctctcgggctggggcctcttcggctccaagtacgaggacgccgccgacctcttcgacaaggctgcgaactccttcaagctcgccaagaactggagcagagctgcatcagtttacatcaagattgctaactgtcatttgaagggagatagcaagcatgaggctgcctcagcgtacgtcgaggcagcaaattgctacaaaaagttttcacctcaggaagctgcgcaagcgctaaaccagtctgttaatcttttcttggaaattggtaggttgaacatggctgcaagatacagcaaggacattggtgagatatatcagcaagaacaagatttagagaaggctacagattacctggaaagggcagctgacctttttgacagtgagggacagtcgtctcaatcaaacaccatcaaacagaaagttgcagaaattgctgctcagttggaacagtacccaaaagcaactgagatatttgaagcgatcgctcgtcagtcaatcaacaacaatcttcttaagtatagtgtcagaggaattcttcttaatgctggcatctgtcaactatgtagaggtgatcctattgccatcacaaattcattggagcgataccaggaaattgacccgactttctctgggacacgtgaatacaagcttttagctgatcttgctgcatctatggatgaaggggatgttgccaaattcactgatgcaatcaaagaatttgatagcatgacacgtctggatccttggaaaaccaccctgctgctcagggcgaagaacgagctgaagaaaaaggaggacgatgaggacgaccttacataagtattgtagtaaaaagaaatggtacgatatgttttggtttgtgcctccattgcattggaggcatcgtgttccttacaaacgagcatgatgaaattaatcgctggtctggttgtacagaacgtcaatttgggttctactgttgatgtgactgccagtttcgttgacttgatgccagagtgaaaattagtaccgagatgcttgtttctggggttctgttcttttcaaatctttagaccttatttcctattgtacttctatacctcgtattaataatctaagcggtttccaatggattgtatcattgttctgctattgtagctttatcaagttaattcaattgttagaataattggatgagtgcat

SEQ ID NO: 539 - DNA, 3480 bp, Zea mays
catcttatccccctccactccactaccacggcggcgcggcctccccctgccgccgctcccccgctcagccgtccccctgctccagccccgccgggcggcgcaccaaaactccgctctcatcccacccccctccactccactaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggcgtagatttccggcggccatggggggcgccgtgatggtcgccatcgcggcctctatcggcaacttgctgcagggctgggacaatgcgacaattgctggagccgtcctgtacataaagaaggaattcaacctgcagagcgagcctctgatcgagggcctcatcgtcgccatgtccctcattggggcaacagtcatcacgacgttctccggggcagcggccgactgcgttggtaggaggcccatgctggtcgcctcggctgtcctctacttcgtcagtgggctggtgatgctctgggcgccaagtgtgtacatcttgctcctcgcaaggctcattgatgggttcggtatcggtttggcggtcacacttgttcctctctacatctccgagactgcgccgacagacattcgtgggctgttgaacacgttgccgcagttcagtgggtcaggagggatgttcctctcctactgcatggtgtttgggatgtccctcatgcccaaacctgattggaggctcatgcttggagttctgtcgatcccgtcacttatttactttggactgactgtcttctacttgcctgaatcaccaaggtggcttgtgagcaaaggaaggatggcggaggcgaagagagtgttgcaaaggctgcggggaagagaagatgtctcaggggagatggctcttctagttgaaggtttgggggtcggtaaagatacacgtattgaagaatacataattggtcccgatgatgaacttgctgatgaagggctggctccagatccagagaagatcaaactatatggacctgaagaaggcctatcttgggttgcccgacctgttcggggacaaagtgctcttggaagcgcgttaggtctcatctctcgtcatgggagtatggcggctagtcagggtaagcccctcgtggatcctatggtcactcttttcggaagtgttcatgaaaagatgcctgagatcatggggagcatgaggagcacattgtttcccaactttggcagcatgtttagtgttgccgaccagcagcaggtgaaagctgactgggacgccgagagtcaaagggaaggtgaagattatgcttcggatcatggtggcgatgacatcgaggataacctccaaagcccacttatttctcgtcaggcaacaagtgtggaaggaaaggagatcgctgcacctcatggtagcatattgggtgctgtgggaaggagcagtagcttgcagggaggggaggcagtaagcagcatgggcattggcggaggatggcagttggcgtggaaatggaccgagagagagggcgaagatgggcaaaaggaaggtggcttccagcgtatttacttgcatgaggagggcgtacaaggcaacaggggttctatattgtcattaccaggcggggatgttcctcctggtggtgagttcatccaggctgcagctcttgtgagccaaccagctctttactctaaggaactgctggagcaacgtgctgctggtcctgcgatgatgcatccatctgaagcagttactaaaggtccaagatgggccgacctatttgagcctggggtgaagcatgcactgtttgttggcataggaatacagatcctgcaacagtttgctggcatcaacggcgttctctactacactcctcaaattcttgagcaagcaggcgtcggtgttcttctgtcgaacctcggccttaacgcttcttcggcatcaatcctcattagcgccctgacgaccttactgatgctcccaagcatcggcattgcgatgaggctcatggatatgtccggaaggaggtttctcctcctcgcgacgatcccagtcctaatagtcgcgctactcgtcctggtggtgtccaacatcgtggacgtgggggacgtggcgcacgcggcgctctccacggccagcgtcatagtctacttctgcttcttcgtcatggggttcgggcccgtccccaacatcctctgcgcagagatcttccccaccacggtccgcggtgtctgcatcgccatctgcgccctggccttctggctcggtgacatcatcgtgacgtacactctccccgtgatgctgaacgtcgtcgggctcgccggcgtctttggggtgtacgccgtcgtgtgcgtcctagccctcgcgttcgtgttcgtcaaggtgcccgagacgaagggcatgcctctcgaggtcatcaccgagttcttctccgttggggcaaagcaagccaaggaagaggaggaggaggaggccagggaaggttgatcacccggacggccggacccagttaccggcaccgcctgtggggatttttgtggtctgcacacttcactgtggttggtcctgtgatgatgtatttgtgaaaaaaaaaactttgggtagggggcagagatgatttggctgtacaatgtgaggcttgattctgccaaaggctggccttcagaactaggaagggtgtctgttatcttcttttgttgcttggagaccttgtgcttgtgttggttggaattttgttgcctatgtaactagtggtgtatgacagttatgctattggtttctttaaaaaacaaaaaaaaaaaaaaaagtcggcgacatcatcgtgacgtacacgctccccgtgatgctgaacgtcgtcgggctcgccggcgtgttcgggatatacgccgtcgtgtgcgtcctagccctcgcgttcgtgttcgtcaaggtgcccgagacgaagggcatgcctctcgaggtcatcaccgagttcttctccgttggggcaaagcaagccaaggaagaggaggaggaggaggaggccagggaaggttgatcacccggacggccggacccagttaccggcaccgcctgtggggatttttgtggtctgcacacttcaccgtggttggtcctgtgatgatgtatttgtgaaaaaaaaaactttgggtagggggcagagatgatttggctgtacaatgtgaggcttgattctgccaaaggctggccttcagaactaggaagggtgtctgttatcttcttttgttgcttggagaccttgtgcttgtgttggttggaattttgttgcctatgtaactagtggtgtatgacagttatgctattggtttctttgtgttaaaaaaaaaaataaaaaaaaaaaggtcggcc

SEQ ID NO: 540 - DNA, 4222 bp, Zea mays
  misc_feature (2963)..(2963): n is a, c, g, or t
  misc_feature (4216)..(4216): n is a, c, g, or t
acccggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggtaagcgagagccctcctgcttggggcgtagatttccggcggccatggggggcgccgtgatggtcgccatcgcggcctctatcggcaacttgctgcagggctgggacaatgcgacaattgctggagccgtcctgtacataaagaaggaattcaacctgcagagcgagcctctgatcgagggcctcatcgtcgccatgtccctcattggggcaacagtcatcacgacgttctctggggcagcggccgactgcgttggtaggaggcccatgctggtcgcctcggctgtcctctacttcgtcagtgggctggtgatgctctgggcgccaagtgtgtacatcttgctcctcgcaaggctcattgatgggttcggtatcggtttggcggtcacacttgttcctctctacatctccgagactgcgccgacagacattcgtgggctgttgaacacgttgccacagttcagtgggtcaggagggatgttcctctcctactgcatggtgtttgggatgtccctcatgcccaaacctgattggaggctcatgcttggagttctgtcgatcccgtcacttatttactttggactgactgtcttctacttgcctgaatcaccaaggtgccttgtgagcaagggaaggatggcggagccgaagagagtgttgcaaaggctgcggggaagagaagatgtctcaggtttgctggctttgcaaaagacaattctaatgcagttgtagtttctttgcagttttgttgatgagtgctcatgctggtctggattgattttacaggggagatggctcttctagttgaaggtttgggggtcggtaaagatacacgtattgaagaatacataattggtcccgatgatgaacttgctgatgaagggctggctccagatccagagaagatcaaactatatggacctgaagaaggcctatcttgggttgcccgacctgttcggggacaaagtgctcttggaagcgcgttaggtctcatctctcgtcatgggagtatggcggctagtcagggtaagcccctcgtggatcctatggtcactcttttcggaagtgttcatgaaaagatgcctgagatcatggggagcatgaggagcacattgtttcccaactttggcagcatgtttagtgttgccgaccagcagcaggtgaaagctgactgggacgccgagagtcaaagggaaggtgaagattatgcttcggatcatggtggcgatgacatcgaggataacctccaaagcccacttatttctcgtcaggcaacaagtgtggaaggaaaggagatcgctgcacctcatggtagcatattgggtgctgtgggaaggagcagtagcttgcagggaggggaggcagtaagcagcatgggcattggcggaggatggcagttggcgtggaaatggaccgagagagagggcgaagatgggcaaaaggaaggtggcttccagcgtatttacttgcatgaggagggcgtacaaggcaacaggggttctatattgtcattaccaggcggggatgttcctcctggtggtgagttcatccaggctgcagccctgctgggccaaccagctctttactctaaggaactgctggagcaacgtgctgctggtcctgcgatgatgcatccatctgaagcagttactaaaggtccaagatgggccgacctatttgagcctggggtgaagcatgcactgtttgttggcataggaatacagatcctgcaacaggtaacaagtctttgcctatatcgaatgtacatgcgcccctttgtgcacttggtattggtacttagaccatgtttgtttccttccaggattatataatccagcttatgtactatatgagcacctattgtcctgtttatggattatcataatctaggtatctagattacataatctacctaataatctgtgttgtttgtttacctctcaacttatttaagctggattatataatctagagggtaaacaaacagggcctataatttagcacttcaaaaatgacaaaataatttcttctagtccctagatgcgttaaagttatctccagaactaaagaggtagattaagcatgttgatgctatgtgctttacttccgctaataacttttttaagctcttacttttggccttaccagcaaagataggaacttgggctttatggtaagcaactcagtggtattttactgctgtttctgaataaacaaacctgatgatacagctgatgctaatctggtagctagttttgctgatcaaactgcaaatcctactaataattcttcagttcctagcacaagtgaagtcagctttgatatcttgtaacagttagccagctaatcatatttttttcctgtggtgtgtaatacataacgaaaccctgttaaataaaaagatactgggaaactgctgtgagagtcagcagtgctgcttctcggtgttatttaggtcacagaacttgagtaatggtatttatcagaagtatggaaacagtatgctaatatcttcacattcatacatttgtcatatggttttaaaatgtttcagcataacatttcacgtttgtttttgtttcgactgttttcccccatcagtgaggtatacaaggtgttattgtgttcattaactatcttttgtgtagtttgctggcatcaacggcgttctctactacactcctcaaattcttgagcaagcaggcgttggtgttcttctgtcgaacctcggccttaacgcttcttcggcatcaatcctcattagcgcnctgacgaccttactgatgctcccaagcatcggcattgcgatgaggctcatggatatgtccggaaggaggtcagacttcgtgctttcttccttacctttgcataaacttaaagacattttctggtcttagaagtaaaaaaaagaacccgtaacaataacaatccctgcaccatgtttctcgtccacggccgggctcctcctcgcgacgatcccagtcctaatagtcgcgctactcgtcctggtggtgtccaacatcgtggacgtgggggacgtggcgcacgcggcgctctccacggccagcgtcatagtctacttctgcttcttcgtcatggggttcgggcccgtccccaacatcctctgcgcagagatcttccccaccacggtccgcggtgtctgcatcgccatctgcgccctggccttctgggtcggcgacatcatcgtgacgtacacgctccccgtgatgctgaacgtcgtcgggctcgccggcgtgttcgggatatacgccgtcgtgtgcgtcctagccctcgcgttcgtgttcgtcaaggtgcccgagacgaagggcatgcctctcgaggtcatcaccgagttcttctccgttggggcaaagcaagccaaggaagaggaggaggaggaggaggaggccagggaaggttgatcacccggacggccggacccagttaccggcaccgcctgtggggatttttgtggtctgcacacttcaccgtggttggtcctgtgatgatgtatttgtgaaaaaaaaaactttgggtagggggcagagatgatttggctgtacaatgtgaggcttgattctgccaaaggctggccttcagaactaggaagggtgtctgttatcttcttttgttgcttggagaccttgtgcttgtgttggttggaattttgttgcctatgtaactagtggtgtatgacagttatgctattggtttcttagcaaaaaaaaaaaaaaaagaggaccccctaactaaaatttttcggcgttttttactacactccttaaattcttgagcaagcaagcgtcggagttcttttgtcgaacctcgggcttaacgcttcttcggcatcaatcctcattagcgccctggcgaccttactgatgctcccaagcatcgggattgcgatgaggctcatggatatgtccggaaggaggtttctcctcctcgcgacgatcccagtcctaatagtcgcgctactcgtcctgggggtgtccaacatcgtggacgtgggggacgtggngcacgc

SEQ ID NO: 541 - DNA, 1589 bp, Zea mays
ccaacttagtcgcctttttcagaatttggatcataaatataatggttataaatgattatgaataaaaaaaagaaaatatgtgacccaccctaatattataacgttgtgttcgccatgggttaccataaaatccaagtgattagtaagtgtaagcttgtaattagaccagatccgaatacgaacagttaaacaacccacgactagggtttgggtgctctgtttccgacagcaagaacggaagagaagtgtggctgtgtgggcgtacctgtcgggtgccttcgtcgacgaaggcacagaagcgtgatctggcccatggtgtaaaagcgcaaaacacaagggggaaaataagatacgagcacaccaaatgaccaaatggcactagaccacggcgccgagcacatctttctctttccctaccgaccgagagggagatgagcggtggcgtgcggagggtcctggaggcgtggaggctcggcgtggtgaagtacggcgaagcgctccagctgcaggagcgtctcgtcgcggaccgcaaggccggccgcgtcggcgacctcgttctgtcgctgcagcacccgccgacctacaccctgggcaagcggcgcgagaaggcggagcggaacctgctcgcgccggaggccgacctgcgcgccctgggcgccgagatccaccgcacggagcgcggcggcgacgccacgttccacggcccccggcaagccgtgctctacccgctcctctcgctccgcaccttggggcttggcgcgcggaggtacgtcgaggggctcgagtccgcgatgatccaggtcgcggcgctgcacggcgtctccgcgaggcccggggaccccggcgagaccggggtgtgggtcggggaccgcaaaatcggcgccatcggggtcaggatctcctccgggttcacgtggcacggtctggcatttaacattgaccccgacctggagtacttcgagcacataatgccatgcggcatcgccggcaagggggtgacgtcgctgcggcgggaggtgggggacggagcggagctcccggccgacggggtcatccacgaccagctcgtggggtgcttggcgacaactttgggttttactgatgtggaattcaaggacgattctgagcgtggagacctgatcggagttacagcttcacagtattgacgcctgattcagttttgcgttagaacgtcctgtaatcaaatttcggaatgttttttttatcttcatcagatacgtcctgtgatccatttttgaagcacagcttgtccaggaaaggcacaacttacattgtttttagaattcaaatcgtcagtgaaaactgaatgcagcaagcaactgtcgatgctgtgatcctcttcagttctctgattttttttgaagcactgaacgtttgtaaagatggggcaacgatgttcaaaaagaaacctcgacgctgtcagatgatctgctgctataggtccacaagaaatcaactatcactctctagaacacaaacatgttactagaaagcacaaatattttgctttcttactgcttttgtgtttcgttgatgggttatttttctcttccctccgttgtggttgt

SEQ ID NO: 542 - DNA, 1067 bp, Zea mays
tccacgcgtccggcgagcaaccccccgcgcaagaaaatatcgcgatttcccctcgcagtctctcgcacgcgccggcatggcgacgctcgcgcggtggcatctacaacctcctactgcccgccccctcgctcaccggcggaggatcccgcgtcgggctgcgaccgtggtttccccgcgcgcgttcagccgcgcggacttcgatggcttcgtgcggcgcgcgtggcagggcgccaacgcgggggccgagcgcttcgccttcgaggcacggcaggccgcgcagcggctggacagcaggttctcgatctcccggaggctcgcggacgcttcccgtgccgcccgcgcccgcgccgttgagatcgacgccgagttcggcatcgggcggcggtggcgctccttctctgtcgacttctcccgcaattggcccaggtatcggagggacatcaatgacttcatgggaactcccatcgggagagcattagctacaatatttttcctgtggttagcactgtcagggtggttgttcagaattttcatttttggcacgtttgtgctgccatttgctgcccctcttctccttgggacctttgctaacagggttgccattgagggaacatgcccagcatgcaaaaggcgtttcgtgggctaccgcaaccaagtgattcggtgcatgagctgccaaaacattgtatggcagccaaataacagcccatctggtggtgctagaagttcacgaagctcggaacctgatgtgattgatgtagaatatgaagagaagtaagaacattctgccccaccctacaccgaaaagcaaaaatcacgtgggcggaagaagaggcaaggcttcagacacaggctgcaccccatgagctatttgtagatttggttgtttgtgtttttctggtgtacatacattacgtgctcctttcgaaataaaatggaaattctggtgttgtgcaaaaaaaaaaaaaaaatggcacctttcgattttaggttctggtgtatccatagcttattgtactgttgcatctggatactaggaaacatcttgtaaagcaagcagcttaggg

SEQ ID NO: 543 - DNA, 5408 bp, Zea mays
  misc_feature (766)..(767): n is a, c, g, or t
  misc_feature (769)..(769): n is a, c, g, or t
ttctccaccaatcccatgcatcatcagcgtatgaaacacgtggagatcgacatccactctgtccgcgagcgtgtcgctgtcggtgatcttcatgttctccgtgtccctaccacttcacattttgttgacatcttcaccaaggggctttcttctacaattttcactgagtttcggtccagtattaaaatctgtacatgatagagttgtgatgacgggggtgttaacgtaattgtgtaactgtttgtgtattctctcctatattaatactatattaatatatttccaaattccaacccacactttcatttctgtcaatagaggggattacatccatgtctaaataaaattatatagaaagagatttaatcttgctgatagtttgtttggagaaaggggattaaaggggctaagatctcttactattcaaatctctttgctctcaaacacgtcctcaaggccttaaggagataatgtagcttggctaatattttttttatttaacatgttactgttttactattttctctcacgtacagttgaccatgtccgtttctgattgctctttctttttcttgtagaacgcatcgcatccagcgaaatggccagagtagaaccaataggatcaacactagctgccacatcttctgttaatacacgtgtgccaatgcagagacctgattctggaggttcattatctcaagcaacggttaaacttttggtgaatcactttattgtcagctaccgaaaggtgacaactatttttcannangacataaacatcaagcttgatgaagcttcgtctaatgcttcgggcaaagagctatccaaggcagaatttctctctgtcaaggatgagctcttcagggaaagcagtttacggcgtctttcctcatgtgttgcttatgatggtggaagaaatctgtatacttctgctgaactgcctgcaggtttatttcgtgtgagagttcgatcaaagacctacattgtatcagtagatttgaagaagcagctgccattaagtcaactctcagatttacctgtgcctagagaggtcttgcagggccttgatgttgttgtgcgtgaggcctcaagatggaacaagattatccttggtagaggattttactcaccaagcagcagtatagacattgggcagggtgctgtagctatgaaaggaacccagcagtcccttaaatccactcagcaagggttgatcctgtgtgttgactattctgtcatgccgttttacaaagctggaccggtgatggatcttgttcagaaattagtgaggtaccttgattatcggacaactttgaacaagaggcaaatggaaaatctggttgatgagcttaaaggccgacgtgtaactgtgattcatcggaggactaatcagaagtacacagtgcaaggtttgacacccttacctgccagccagatgacctttgtggatgctgaatccggccaaacacggaggctcgtggattattatgctcagaaacatggcaaggtgattgagtatcagatgctgccatgcttggatttgagcaagagcaaggacaaaccgaatcatgttccaattgagctctgcactcttcttgaaggacagaggtttccaaaagcaaacttgaatcagaattctgagaggatactaaaaggaagtgctctaatccgtgcatctgaccggaggaaggagattcaaaacttggtgaatgcttcggatggaccgtgcaggtaactccgtaactgttttcccatgtgttcttgttaacctgaaaagttgagctactgctatagtgctatatagctatacttaaactgtatgaaattagatgcaatgtgattgcccgttccccataactcaacttaactgtgtgtgtgttgtgtgtgtatagtgtagtgtatacacactataagttctcttattcattcctaccttttttttctctcctgcaaatgcacaacaacgtaactcttttctaggaaagaaacaaaccgatcattaccttttcttttcaacagattatgcatgtttattattactagctactaattatcatttcatttacagaggagaaattgcacagcaatttgggatttccttggatgtacgaatgacagaagtcacgggtaggatccttcctccaccaaacctcaaacttggggcatccaatgggcagacctccaaattgagtatcgatcatggctgccagtggaatcttgtgaagaagagactagtagagggccgggttcttcagtgctggggcatcgtcgacttcagtgctgagccgtctggctctggcgcccgtcaggagcccctcgatacaaggatgtttgttgagaagattgtgaggaagtgctgtgagcttggtatccgtatgaaccctaatccatgcttcgtgcacataacaaggatggcagtgctcttcgatccacatggactacatgaagagctaaacaaagcaaaacaagctgcagtgagcaagaagcagaggttgcagctccttttctgcccgatgtccgagcagcattcggggtacaagacactgaagctgatttgtgacacacagctggggatcctgacccagtgtttactgagcgaccgcgcaaacaatcgaaagggacaggaccagtacatgacgaatcttgctctaaagatcaacggcaagcttgggggcagcaacgttcagctgtttgactcgctcccacgggtcggtggtggggtacctttcatgttcatcggtgctgacgttaaccacccgtcccccggtaacgtggagagcccatcgatcgcagccgtggtcgcctctgtcaactctggtgtcaacaagtatgtgaccagaatccgtgcccagccgcaccgctgcgaggtgatccagcagcttggtgagatctgccgggagctcattggagtctttgagaagcagaaccgcgtgaagccgcagaagatcatctacttccgtgatggcgtgagcgacgggcagttcgatatggtcctgaacgaggagctggctgacctggagaaggcgatcaaggtgaatggctatgcgccaaccatcaccgtggtcgtggccaagaagcggcaccacactcggctgttccccagggacgaacagcagccgcagacgaagaccgggaacgtgcctcctggcacggtggtggacacgggcgtggtggacccgtccgcgtacgacttctacctgtgcagccacactgggattctggggacgagcaggccgacgcactactacaccctggtggacgagcacggcttcggctccgacgacctgcagaagctgatctacaacctgtgcttcgtgttcgcgcggtgcaccaagccggtgtcgctggcgacgcccgtctactacgccgacctcgcggcctaccgtggcaggctctactacgaggctgccatgatggcgtcccaggcccagcgaggggggtcctttgacgtcactaacttcccgaggctgcacaaggatgtggaggacaacatgttcttcatctgacacaagtttttttttttttttgccggtgtcgtggcgcaagttcgggtcgattttgctgtgtggcaacgtcgcattgtttttatgctgttgcctttttttgcttgctggtcgtagtgccactgtgtgttgttgaagtcgctggtttgaaactgcagtcagttaactgtacgcgtcctgctttgtttttgtttgcgcgcgtgtgaaacagacaaacagtctgatgatttggtgtgttcagggttgtaaacaaactttattagattctcactggattatactgcatgactgtagttgaaggaaaagaagcaggtttgagttgtgaagatacttgttgcagtacaacagacagatattgcaggttctagctgaatttctctgcttcaggatgggtcttgtgccgttgcgcacagagaacaacacacccatgcagatgcagcagccagccccgtcttccaatgctgcttggtgaaatgtgtaccatgttttgtgtttgttccaaagagaaggtcctccaaaagctccctacggacatctcctgtgcccaccgcgaccgacgcctacaagatctctctcgacttggagtggtcttcactctgcaaattcaagttcgttcgccgttcattctcaaagatctgcaatcgaacgcaatacattgtaagattgtttcctgccaagtaggattccggtccagttcccattccgtccgatttagccattgtttggttatttctagtctatgtggattagatggaattagaaaaaaaaaatataagagattttgacttatttaaaatttaaatacactcaaactatggtatccacgtggatcgttacacgccatgacacaacctccctcactttacgacgccatccaactaccgggccagcaaagcaaagtagcaaactaccaacctagtaggttatctgactggcttgccgtgactgcaaatgtcatacgagcccatgaaatcagtccatcaggggaattacataagacccacctgccaacgggagtgttggccttgaaacttttctatctctatttttgcatttccacttttctgtaattgtttatcaaaattctcatccatggaagagaaaaaaaaactaactgcactacaaagctcgcaactagtactaccaggcacccatggatacggtgaaaattccagaccaacaaaatgtccgatgagataataacccaacatttttttatttagccggtgcctcctcagctaagcacctggtactgctttgcacaatgtacgctgaaccccttttcagtttttcaatgaatacctttacagcagaaagacaaacaagaagtcttgaatgccagggaatgattggatgtatgctaaatcaaacgggctaattttccggcagttatgagaatttcattctcaagtcaccgctccaaatcattgagaacggacgcctcggattaagattgccaacatacagatctctacaatgtgatcttgagaacctatgaaagcatttttttttttaaaaaaactatggaagggcctcgtttattgcaacaaattcttccctggaaacaatggcatgaagcagacatgattagctgaccaaaatattagattcctgattccataatcttaagaaacatacttatggacgaacctgcttgatttagagacagaaaataccgcttctgacatatttttcatgactggttgcgactaagcatattctggaaagaaatgtacaagtctttgtgttctgttccaaaaatctcttctgcttttgacagggtgtcctgcacaagtcaccacattgacatgttttccaagtttctgtcgtaaccacgaaaacagtggcagattaggatacctccccgtgattgtttttgagccattgaactcccttgatgtggcc

SEQ ID NO: 544 - DNA, 1156 bp, Zea mays
  misc_feature (231)..(231): n is a, c, g, or t
gtatttttttcctttctactgaaaactaacaattcaaattggattgttttcatttgatagatttaaggtgttacatttttcttttcttttttgttcttttggcaggatctctgcatgtaaaatcctttgagtttgtctcctttcatttttaatataaagatgcactgcgcgttcgataaaaaaacgtgttgctgccatgcaccatggccgccctatccgaaatcttgggancccattcacagcctcaagaagggtagtcgggataaggggataagctgacgtgtcgctctcccagtctcggccctcccctcccaccaaaagctatctcgcccgtccctgtcctcgcttttgctccctgttccgccgagctcacgccagtagagatgagggccacgtcgtcccccgtggctgccgccgtcctcgccgccccttcctccgccgccgccgtagtcgtaaagcctctgcctcgtggcgcagcgaatggcggcagcacgggcaggcgcgacgtgcttgccgggaccgggctgggcgcggcgctgctgctggcgctggggcccgtgtgcggcgcggcgcgtgcggcggacgaggaatacgtgagcgagacgaaggaggtgatcgggaaggtgcggtcgacgatcaacctggacaagtcggacccgagcgtggcggacgcggtggcggagctccgggagctgtccaactcgtgggtggccaagtaccggcgggagaagtcgctgctggggcggccgtcgttccgggagatgtactcggcgctcaacgccgtgtcgggccattacatcagcttcggccccacggcgcccatcccggccaagcgccgcgcgcgcatcctcgaggagatggacaccgccgagaaggcgctcctccgcggcaggtaggccaaatcccagcgaagcccggccatggcgatcgccgtcgccgtggtggcaggaacgcagctctcagcgacaacgctaccattttgtaactactgcggtgtagtatatatatgcatgcattcgtacgtgatgcgagctgtgttttcggtccgatgggagcgcgtcctgtgactgtgactggagtaaaaatttaccgagcttctgagagtaaaaaaaaaaataacgacggccctccgcttctcaggcagctatgcatggat

SEQ ID NO: 545 - DNA, 730 bp, Zea mays
gtgaggcaggaactgctccatgcaaatcaaattttcgcccaacatccaatgtggccagtcattgcggtcactggaagagctatagaggaaacagctgctgtcgttgtgaggattctccaagacaggatacagaagtactccatgccacgcatatcaaaacggtactaagggcacgtttggtttcattagtctctgtttggtttcagggactaaaagtgttaagaactcattaaattactcataagaatactaaaatgtcctttaccattcttccgccattactcttcttccactgcaatagaaataaataaggggcaaaatgtggaattaatatggtttagtcccttttagtcatcccttgagggactagatactaaagcagtttagtctctattttagtcctactgtttagcaatttggggactaaatgagactaaaatgcaggaaataatctttagtctctgaaaccaaacaaatcctaacattgtgttctatctcttctacaacttgtaatgtgtgcatgttttgttgagctctgtgtcaagcaccatagcctttatgtttttttgtcagaccaccttctaggtggcgtttgtatcttaaaggcaacttgagatttagcacaacagaaacatatgtatattgtatttacgacattctattggccttactttatttggtcgttagtgaattgtatatcaggtgaaatagtagggtgagctgcctttgt

SEQ ID NO: 546 - DNA, 885 bp, Zea mays
gttaggtcactgttcaccgagttttgataagtttctgtccgcgtcagcgccagctacgcgcgctcgagaatgctgactattttggctgcaagcatgggataaccatggattttttttcctgcagtgttgctatctgttctttgtttcgtagtggctgtttatcctcgtgtgcctcgcgtgcgtatatacacacacgtcctgcctgcacgcaacgcagctctatatatacctcaacaccggtgcactcgcttaatatatatccaacaaccagcagtgcaacaagcaagatttacctgcccatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttccttgccccagaacttgaaataaatatatatacgatgaaataacgcgggcatgccgaataatggatgtgtgaattctcactaattaagtaatgcataaataaacgtattcaaatgaaaaaaaaaaaaaaaaaaaaaaaaaaatgtgttgacagcaaaaaaaaagtatgaggttaaattcggtacaataaaaaaaaaaaaaatttggatcgtcaaaagaccaaagtttagccgccccttgactaattaagaaattctaatgagttctacccgaaaaaaaaaaaaaaaaaagcggcc

SEQ ID NO: 547 - DNA, 827 bp, Zea mays
gccggccgggtcgtatatgtccacgacccagcagtgcaacaagcaagatttacctgcccgtgagtgtgcctttcaataatataatgtcttattttattattatgtttttgcagtgatagtagtctgtaataaatctctcctttcaatatatataattcacatgccagatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttccttgccccagaacttgaaataaatatatatacgatgaaataacgcgggcatgccgaataatggatgtgtaattctcactaattaagtaatgcataaataaacgtattcaaatgaaaaaaaaaaaaaaaaaaaaaaaaaataatgttgacagcaaaaaaaccctatgaggttaaattcggtacaattaattatgggcctatttggatcgtcaccggacgaaagtttagcctaacgttgactaattaagaaattctaatgagttctactcatcaattagcttctatttgttcttgttaatttatgtttagatcttagagttggcaaccgaagtatgcagtaaagtttagtccaaacatgccccgtactga

SEQ ID NO: 548 - DNA, 1793 bp, Zea mays
  misc_feature (313)..(313): n is a, c, g, or t
  misc_feature (1762)..(1762): n is a, c, g, or t
  misc_feature (1765)..(1765): n is a, c, g, or t
  misc_feature (1768)..(1768): n is a, c, g, or t
  misc_feature (1771)..(1781): n is a, c, g, or t
  misc_feature (1783)..(1784): n is a, c, g, or t
cccacgcgtccgcggacgcgtgggatgaaacactacctggacttacctcagttgcatctggcaaagcagtggagctctttgctaggatgttacatcatcctgacgagatacgggccccaggcgatactgctggtacagaaacagaacatcaacttggtctattgccacatcagctacgaggatcactccccaagtgtgatttatttgtggagctcaacaattcctcagtcaactgtactgcatgttctgttgctgtattgtcggagtatagaagaagaggattggattttgtcatgcaggctatcaactatcncagcatatctgaaagattttacaggcatttctgattcgaaaagaccagatacttgtcctaaaataccgcccaacatctctgtaaattcagacaagatttctgatgtccgatgtctactattgggtgctggaactcttggatgtgatgtcgctcgcattcttatggactgtggtgtacggaagataacagtagttgatagtggtcatgtagttgtgtcaaatttagcgagacaatcactctatacttctgatgaccgtggtgctccaaaagcaactgcaatacttaggcatctagtggagagatgtccttcagtggatgcacaaggcattaaaatggaaatacctatgcctgggcatcctgtgtctcctggtgaagcagcgggtgtgctccaagattgcgagcgccttaaggaattggtgttgtcccacgatgctatcttcttgttgaccgacacaagagaaagcaggtggcttccaactctcctatgcactaacgaaaacaagattgctatcactgcagcattagggtatgatagttaccttgtcatgcgacatggggctggccctggcataagctgtgaagcttccagtgtggtcactgccatagacaagatgtccacggaggatgcccttgggcgtcaaaggctggggtgttatttctgcaatgacgtcattgctcctgtcgactcagtttccaatcggacactggatcaacaatgtacagtgacacgaccggggttggcctctattgcatcaggacgcgctgcagacctcttcagaagaatgttacaccatcctgatgggatacatgctccaggagagattgctggtacaggcagtggtcatgagcacggccttttacctcaccagatgcgtggatcactatcgcagtacaacatattaaccctgttgggctattcctcgagtaattgcacggcatgctcccatgcggtattgtatcaatatcggaggagagggatggatttcgtgatgcaagtaatcaatgaaccaacctatttggaagacctgaccggcctcacggagttgatgaaatccgcgtcttgctcacaggtcgagtgggtagatgaaattgatgaagacgatttcgtcgaggtctgatatgttacatggttttgacgactggtagatagtatcattctttacaacatggtaaagagatgacgaagcaatcaaagcaaccaccctatatatttgtaactcgctgctagctttttactctgtccgtcttaaaatgtaattcgttttaggctaaacctacattcattaatctgctccgtctcaaaatgtaattcattttaggctaaacctacattcattaatcaggtactcgtgaatgtagcttgaatgtatgtctacatttataatcattcaaataatttgaatgtggacttaaacggggggggggtctttgtgggcgtcccaacaaaanaanaanaannnnnnnnnnnannaacaaaaaa

SEQ ID NO: 549 - DNA, 1698 bp, Zea mays
ctatgacattttggtccttggattcgtggtcctgctctgcggtttgcttggtatccctccatctaatggagtgcttcctcagtctcccatgcacacaaaaagtcttgctgtccttaagaggcagttgctaagcaaaaagatggttgatactgccaaggagagcataggaggaagtgctaccagtttggaaatatatggcaagatggaagaagttttcatcaaaatggatagcgaacagaatactgattctgttgacagggagttgaagaacttcaaggatgctgttctgcaagaaggcgacgaagaagggagattggctagagaatttgaccctcgcaaacatatagaagcccacttgcctgtccgagtgaacgaacagagactgagcaatctgctgcagtccatactggttggtgggtgtgttggagctatgccagtcatcaggatgatacccacatcggtcctctggggttactttgcctacatggccatcgacagtctaccagggaatcagttctgggagaggatacagcttctgttcattacagaaagccgacgctacaaggttcttgaaggtccccatgcatcgtttgtggagtcagtggttcccaaaacagtaaccatcttcacgatcttccagttggtttacctcctaatatgcttcggcataacgtggataccgatagccgggatcctgttcccagtgcctttcttcctcatgatcgtcatcaggcagtatctcctcccaaaattttttgatcccgtcgtcttgagggagctcgatgcagctgagtacgaagaacttgacggggtcccccttgaacacaaactggaagatgaagcaccggccgggggaagttgtcctagccgtcctgatgcggagatattggatgaactcacgaccaaccgcggagagctgaagcacagaagttctagcctgcgcgaagaacgaccaattcaagtgacagtgagcacgcatatggtactgcaacaagatatgatttgaagatggctcgtcgatttactctctgaccctttttttttcctgctggccttcaataggagccaaccggttgaatttttttgggctcgtttcttttctctgggagaacaagtagtcaagtacgcaccacgcatgtcagtggctgctttccgcctaacataggaagattttcacaggctagttcgggttaagcacattccacgcctctctctttctttttctttccttggagagagagagagggggctttggatttcgagtttattgtttaacagcttcatctccacactgcaggttgcttcaagtgcggttcagccaagcctgtgaagacggcgaagtgttctttttatccgtagaattatgatcctcaagctgcactccgttgatgtgaatactgttgctatgtaatgtacggatactactagtgttgtacttgggtttttttacccaaacgcgtctgtgggtaaggggtgatttgtaagaacagggacttacgtaaactacgtaggatcgattggtaagaagagagggagagaggagatgcaatacaagtcttcttgcaaaaaaaaaaaaaaaaaccggcccggcatggagtagaataatatcatatattgtcattagttcaaatagactgtagtaaccaagtttgcactctttgactgcaatcgcgtcagtgaagctgacggtgaacggtt

SEQ ID NO: 550 - DNA, 1890 bp, Zea mays
cattgggtacctcgaggccggccgggccagttactgaggtgattgtgtgaagcgctcacctccgtcacccccacccggccgcacgtagatagcagcagcagcagcggagctgttcgacaaaatgccgccatggccgccgtgcctccagcctaccctcaccaccgctcgccgcgctaccgtcttctccaggacgagatgtctctcttctacccccgcctctcctacctacaagaaggggcaacacgaggaggagccatcgttggtcgttgtggggggcggcgcggcgggcgtgtacgcctccataagggccaagacccttgctccgcacctcaacgtcgcggttgtggagagaggcaggttcttgtccaaggtcaagatctccggcggtggccgctgcaacgtaaccaatggccatcatcttgagcccatgggactggcgagaaattatccaagggggaacaaggagctccgaggatccttctttaccgctcacggtccgcaggataccatgcgctggttcacagatcacggtgtaaagcttaagacggaggacgatggcagagtcttccctgtcactgacaattcagcttcagttgtagactgtctactgaacgaagcaagaaggcttggggtttctctgcaggccggcaaaactgtgtctagtgcatctgttgctcaagacgggaagtttgttctcaaggtggagaagcgtactgccgatcttgttgagtatatcaacgctaattacgtcttggttgctacaggtagcagccaaaatggctactcaatcgctgcacaactcggtcattccattattgcaccagttcccagcttgttcacatttaaaatcagataagcggctggctgatctcgccggggttacatttccaatagtcaaagcaaaactgaagctagatggtgttcaaaaaagtgttcccgagttaactcagactgggcctatgttagtaacacactgggggcttagtgggcctgttgtgctgcgattgtcggcatggggagcacgtgagctacatcagtgcaactaccaaggaaatcttatggttgactttgcacctgatattcatatcgaggacgtgaaacgcatcctattccactacaaagatcagcatgcgaagcacaaagtgagtaacacgttccccacggagtttggcctggtgaagagattttggagattcctgctagaacaggagagtttaaatggtgatacacactgggcctccatgccaaataatcatctaaacgcagtggccttccggttgaaacaatggacgtttgaggttgttggaaagggccaatttaaagatgaatttgtgactgcaggaggtgttccaattacagagatatcgcttggcactatggaaagcaagaaacagccaaacctgttctttgcaggagaggttcttaatgttgatggggtcacaggcggattcaattttcagaatgcatggaccggtgggtatatagctgggacaagcataggcacattggcatcgactagcaatctcccagagcagcagtcatgtttccagttgtaactgggagtttcagagaaggaaatggattgagttatgaaagagactccttagatcatctgggaatgattcagggataccaacaagtttgcaatcaagataaggatattccaagatgaccaggatcagggagctacaattgctactgaattgtaacactaacctaagatggggtacatataacaagactgcacgatagtggttacaatctaggtgtacaaagtgcaatctggaacgacaatagttgcaatcgagttaaacaagttgtgatttgtacttgacccatcagagtgtgcatccagctatgattcttctgtctcgaaaaaaaaaaaaaaaa

SEQ ID NO: 551 - DNA, 1779 bp, Zea mays
ctgatatggtgacctgcgaaaatgtcatggctgcctgtggtcacggtggcctccatggggatgccagagaagttcttgaatatatgaccagagaaggaatggtgcctactgcagatgcctacactggcctggttgaggcccttggccacgcagctatgtatgaggaagcctatgttgctttcaacatgatgactgaaatcggtagcttgccaactcttgagacctacaatgctcttgcatttgcatatgctaggggtgggctcttccaggaggctgaggccatcttttctcggatgagtaacaatgctggcattcagaaaagcaaagactcatttgacgccctcatcgaagcatattgccagggctcccgctcgcgggatgcagtgaaggcgtacatggagatgcgtaaatccacgtttaatccagatgagcggtcccttgagggagtacttaatgcctactgcatagcaggggtcatagatgagagtaaagaacagtttgaagaacttcaatctagtgtgactatgcccagcgttattgcctattgcatgatgctgtcactatatgccaggaatgacaggtggagtgacgcctacgatctgttggaagaaatgaaaacaaatcgtgctagtagtacacatcaagtaattgcttccctaatcaaaggggaatatgatgatagctccaactggcaaatggttgaatatgtcctcgaaaacagtaccatggaaggctgtgactatagtttccgattctttaatgctctccttggtgtgctttggtggtttggtcagaagggccgagctgctagagttctggatcaagcagtaaaatttgggctgttccctgagttatatcgtgacaccaaactggtttggtcactagatgtacataggatgtcgatgggtggagcactggtggctgtgtcagtatggctcaataagctttatgacagactagtagaagatgaagatcttccacagttagcatctgttgttgtattgagaggagaaatggagaaaagcacagttacaagaggactgccaatcgccaaagtcgtctactcctttctaaacgatacactatcagcgtccttccattttccaaaatggaacaagggacgaatcatatgcttgaagtcccaactaaaaaggctgcagtcggccgtagactcctcaaatgggtctcttgcagctggttttgtcgacatgacaaactcccgtctgccggctcccggttccaagatatacacaagcgaggaccaattggataatggttcacgccatttgcctgacgaaccgttggcggaggaaaaggagtcggagcttctcgcactgtgagctgctgcccttcgcatctacagttgtgatgccattggtctgaacaaggggagacgagatgcaggataccaagcgtattttcggagttcgtccattcagatctccgtctcggtctcagttatccagggtgggtgctacatactgcagattcacatcttgcctggaatttatttggctggggcttgacagtcaatgctgaacttgagttgcatttcaggcaggattttagctcgttgtagggagaacgagcttatggatgttgttgactgtgtatggcatccttgtgcgtccagctcaagtgctcaactctgtaaaacatgatagcctgataagtctgttgatacgatctgaatcctgatgatggtaataatacaaatcacactacaggcactatccccatcatcaggattcagatcgtagtgtgatttgtattattacc

SEQ ID NO: 552 - DNA, 1533 bp, Zea mays
tccacgttcccaactttcctgagttttacctagaacatcctaatcgaaaagtggagcgcagtactcggcggcaggcactctatggctttatcgtcatcatcaccagtggttgccccgtccccgtgccggttcctgtgcccccgcgccactaccgcctctcacgacctcctctctttcgcgaccacagcaacaaggaggcggctgctcctctccaccgccaccaccaccattgccgccgccatggccgcttcttcctcctgcaaggtcatcgactcccacctgcacgtctgggccacgccacagcaggccaaggaggagtacccgtacttcccaggccaggaacccacgctgcgtggcgacgccgacttcttactcgagtgtatgagtgaagctggagtggacggggctgttattgttcaacctattaatcatatgtttgatcattcgttggtaactagtgtgttgaagaaatacccatccaagttcgttggttgctgtcttgcgaatcctgcagacgatgggactgggattaaacagcttgaacatctgattgtacaagaaaaataccgtgctgtgaggttcaacccaaacttatggccatctggtcaaaagatgaccaatgaggttggaaggtcattattttcgaaggcaggggaacttggagtaccacttggaataatgacgatgaagggagttggtccatatattcaagaaatagaggaactgtgtagggattatcctgcaactaccgttattcttgaccatatggctttctgcaagccaccaacgaacgatgaagaagagaaggcattctcttcatttctaagcttatccagattcccacaggtttatgtcaaatacagtgctcttttccgcataacaagagaagcatatccatatgaagacactgctcagcttctttccagtgtgatatctcactatggagccagtcgagtaatgtggggaagtgacttcccctatgttgttcctgaatgtggttacaaaggaggaagggaggcgatttctcatgtcgccagcaagataccagtttcccagtcagatttggaatggatcttgggaaaaacagtgagccaattattccaaggtgcatgggttactccatgatcactgtagtgtattccagagcaactatatcaacaggaatatatgtcctattttccagtgtttacatgtattctctctgtttcaaataatgtttttatctagatacatatatctaggtgtgtagcaaaatctttaacttcagttcttgattacgcgacctaccccataacttcaatatcgaataaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaggtttttcgaaaccgccaccctctcggaggggggccccggaccccatttcccccatatagggagccaaataacgcgggccccggtggccgccttttaacaaggcggggaggggaaaaccccgggggttc

SEQ ID NO: 553 - DNA, 2119 bp, Zea mays
catatgctttcagcagttatcctctccatactttgctgcctagtgtttatcgtaggcaccataactagtacaccagaggtgtgtccttcccgatcctctcgtactaaggaaaggtcatctcaatgctctaacgcccacaccggatatggaccgaactgtctcacgatgttctgaaccagctcacgtaccatactaggtcttgttcatttacatctagactgaagtgaattgaggggattctattaaattttgactagagactgatttaatcttctccaatctctctcaattcacgcataaccgaacaagtctttaatgggcgaacagtccaacccttgaaaccgcatacagctctaggcggcaaagagccgacatcgacgtgacaaaccttttcgtcgatgcagactcttggggaagatatctgcttgagatcagttcatgtttattcgtaccacggtttggttggtatatggacaacatgagatggtgccaaagggcaaactgcaaagcacggtgatgagtcacctttggatgtcggtgggaggaggcccttgtcgcagagcgccgggaacgccaagtaggcgacgaggcatgcggcggcgccggtgcgcagcacgagcgtgggcacgccgagctcctcggccaccagctgcattccgcgcaggttggagtccaccaccaggcatgccggcggcgcgccgccctcgccgtcgtcctcggggagggcgagagcctggcgcaggcggtcccggaacggctcccgcaggcgacggttgatccgcagcagcgccccagggatgtcggcgtcgacgccagaagggacgaggtcggccgacggcacgccctcgccgacggggacgaagcggtaccccggagggtggcgcgcggggtcgggtgcgttgaaggtggcgtggaagacggtgatgtccaggccaccacgcgcgtgcagcgccccggccagctgtagcatcgggttcaggtggccctggaacggcagcgggaacatcagcacgcgccgccgccgccgccgcacgacgccgccggagcctgtccgagaggccggcaccgccgccgtcgccatggcgctgctcgatcaagaacaattttttttagctctgacgattgatgactgagattctgagacgagtgacgcgaatgttgctgaaatcaaggagcctgtccgagaggcttcgaatttgcaatcaataattgcgcaggaagggaaaggaagggaagggagcaagcaaggtacgcgaggctgatttgatctgtttggaggcattgtcgtcgccgtcttgcactcttgcttctattttatacaacatactagtgggcaacaatcgcggttggcgcattcacgttctacaaccacctgtgcggctacgctgtagcctgtagctagttgtacgcctgtattacgcaaatggttttgcatgtagaattgcagtgagagtaaaaatcatttgcttttaattttgctcacatgttattaagatatagcagatcagtggtcacgtttattttgcatgcaaaattgcagtgggtgggactacatgatttatttcgcaagggactacgtatcttcaaatccttatcttccgctatcagaaataaatactgtggcctcattcgatcttgagatatctagctgatgtagaggtgttaatggggaattccccactggacccatcctcatgaagccatactcgtccgcatccttatctccacacctattttcgttttcatatttctccttagaaacgagatcgaaaacggtagctccggaaacgaaaacgacaggtaattcggaaacatcgaaaacgaaagttcggtacgaaaattacaccgggtttgatcggaatctaaaattcgatcggtaaaaactgtaacatgtactctcaattgacttcaaaaattcacgcaagtcatatattcatataaaattagtaataataatatataaagtaggaggtcacattaagtatacaaggtaagaagtatacaataataaaatcattattatgtatttaaataaagtagaatgaagatgtataatgaaatgacacttatattctatttgtactcctacttgacataggtcatataaattagtgtcctc

SEQ ID NO: 554 - DNA, 955 bp, Zea mays
ccaaaacctggcctgctttttttatttatattacttagtttctttttgcgtatataagctagtacagcagtatagcacacggtacactgaatcgctactctacttgcgtgcgtgagtgtatcactgtacccgcgtagtacatgccacgtactgagaatggattgcatcagaacgggaggtagctccggcggaacacggcggcgttggcgaacaacccgacgaggtcctgcttgtacggcaggaacgacctctggcgccgcgcgccaccgccctcactagtgttgttggcgtaatgcctccaggcgtggtgggcaccaccctccacgtccacggcgctgcctactagccccttctggctccggcgcccggacccgccggaggaggcgctcaggaagacgaacttctccttgccgtcgctctggctgcgcccgacggcgagccggggccgccaccggagcacggaccccgtggagccgctcttcttgcaccgcgcctgggaggacgccgctgcggctgcggtcgaccacccacgggaccacgggcagaacatctccgccggcaccgagtcgaggtcgccgtcgtcgtcgtccgcgggagcaggcggcggcggctgcgacggatccctgtccaccagcaggaaccgtcctagcggcacccgcgcggtggccgtctccggagcagcccgcggaggggatctcggccggccgaagactgggtacagcagcggcgggcctatgaaaccgccgcctcctgcagatactagactaggaggcggctgggcggcggcgaaggtgaagtcgtcgccgccgtcgtccatcgccatgctcctgcgctccgggatgctgctactgctcgcgttcggtccccgtgctcggacgacgaccacgacgcagaagcaggtcactgccgcgtcccatggccgggactcgggagggaggtgtgcgctcgagccgaa

SEQ ID NO: 555 - DNA, 3002 bp, Zea mays
  misc_feature (100)..(100): n is a, c, g, or t
caggtgttatcagtggattgcgtcgagaaatcagttcagccgccacaggacgtcctatacaagatgtgatacagaccgacgctgctatcaaccctggtancagcggtggtccactccttgatagttctggaaacttgataggtgtaaacactgctatatgctcgccctcaggagcatcatctggtgttgggttttccattccagttgacacagtcgggggcattgtggaccaactcataaaatttggcagggtgacaagacctattctgggaataaaatttgccccagatcaatccgtagagcagcttgggttaagtggagtgcttgtcttggatgctcctccaaacggaccagctggaaaagcgggtctgcaagcaaccaaacgagatccctatggccggcttatcctgggcgatataattacctctgtgaatggtacaaaggtgacaaacggaagcgacttgtataggatactggaccagtgcaaagttggagacacggtgaccgtggaggtcttgcgtggcgaccataaagagaagatccctgtggtcctggaaccgaaggctgacgaatcctagtactagtaaacccagcttcttcttctgtaccatagcatcagtttctcgctttggtgcagaggcgcaaacacacaaggcgtcttagcattttcgccctccacggggttcattcgctgtacataattcatgcatgtagatgttgttaccatctcttgtctggtggaaaaggggtatccagactccattccaggttgccgtcgtgccgtcgtgtattattaatacgatgctcatcagatgaccatccaggccggtcaagggacctgcaggccgacgattgaactcgctgatgtcacagatcaccaaacccgttttttgacgaaaaaaaaagattaattgtgtacgtaccactctgcttttacgaaattggctggttagttcaatttgatgccatgtggtggcatgaaaatgtactagtttcatgacatagttctaataaaaaattggaaactttaaacttcgtgcccttagttcagtatcacttctcagttctatctatctctgtagtaattgataagatatttttagtgctacacaaggatagaatcgaggagtggtaataagacaacagatttttaaaaaaccagtgctgactttttggctggagccgttggcgtcgttgcaatcctaggcgcgatcccggaacacgacagggatcaatgtggtagctacgcaatgccgtgcccatacatcgctgggggttactatctatcctaccgcttgcctttgaattcaaaaaaaaaatccaaacagttgcgaaaaaacgagaggactgaatctattttccacgatcgtaggcggtttcctccgacgtcccactcccacccaagcctgtagcaggcgccatcgttttccgtgtcgcgtgacgggtccgcgtctagcattaacgccttacgcccgcgggtgctacgtcacgtgtgctgaagacgtgtacgtgcaaagctgaaggggtactgccgcatgaccgcttcgctcgaccttgacgagacgacgacgacgacgactggtcgacggcatcttccaaaaagaaagaaaatgacgacttggatgacgaggacgacgaaacaacacgctgccggcgggctgcgtcgctgaaggacgacggagacgatcggcatggtgacgcgcacagcagcagcatggcagacgaagcaccagcttgggacatagcaacgcaacgcatgcacgtgcgcagggccatgcaaaacgattccagctttatttatttatattacttagtttctttttgcgtatataagtacagcagtatagcacacggtacactgaatcgctactctacttgcgtgcgtgagtgtatcactgtacccgcgtagtacatgccacgtactgataatggattgcatcagaacgggaggtagctccggcggaacacggcggcgttggcgaacagcccgacgaggtcctgcttgtacggcaggaacgacctccggcgccgcgcgccaccgccctcactagtgttgttggcgtaatgcctccaggcgtggtgggcggcgtggtgggcaccaccctccacgtccacggcgctgcctcgccccttctggctccggcgcccggacccgccggaggaggcgctcaggaagacgaacttctccttgccgtcgctctggctgcgcccgacggcgagccggggccgccaccggagcacggaccccgtggagccgctcttcttgcaccgcgcctgggactgggaggacgccgctgcggctgcggccgaccacccgggagaccacgggcagaacatctccgccggcaccgagtcgaggtcgccgtcgtcgtcgtccgcgggagcaggcggcggcgacggatccctgtccaccagcaggaaccgtcctagcggcacccgcgcggtggccgtctccggagcagcccgcggaggggatctcggccggccgaagactgggtacagcagcggctggcctatgaaaccgccgcctcctgcagatactagactaggaggcggctgggcggcggcgaaggtgaagtcgtcgccgccgtcgtccatcgtcatgctccgggatgctgctactgctcgcgttcggtccccgtgctcggacgacgaccacgacgcagaagcaggccactgccgcgtcccatggccgggactcgggagggaggtgtgcggtggctggactgacgctccttggcgccgggactcagctttttatacgccgcgcgcggcactggatgcggatgcgatcagctgttgagataatcttggccgctggatcgctgatcgcagcatcgggcagcgagcaaccttgggtgcgagaacgttaagctttccgtgggatggacgtggacgcgctttggctagtaccgactgccgacgagagtgcatcaacggaacggatctggggtgtgttcgtttgttccggaatcgtgacctaaaaccaatccaaccaggaa

SEQ ID NO: 556 - DNA, 6058 bp, Zea mays
  misc_feature (5048)..(5048): n is a, c, g, or t
gcacgagaccattacctagaacatcctaatcgaaaaaagttccaggatatctagaagtccactttatgatggtcatgtgatttcctttgatgcagccgtgctatcagtctcgcaagatgcagactgcctcaaggaagaccctgaagaagaaaattttgagaatgggcggagagctcatttcaggcaggttagtgaaattcaagaggagccagaggccgaagaggtggcatgccaacgtgctatgaatggtggcgcggagcacaaagaaagcgcaataagaagggagactgaaggggagttccggctactgggaggtagggatggcaacaacagatttaccggggggcgactcttcggtgttgaagagattgatggaggtttaagcatggggcgcagagtttctttcagcacagaagctaatatcattgctgacaggctgaatcgggcctcagatgctgctgaagcttctggatatacattccctggtgatgatggttgtgcaagtgatggatatgatgatgctcaggactggggcaggagggagccagagataatttgcaggcacattgatcatgttgatatgatgggactcaacagaactactcttaggttgagatacttgatcaattggctcgtaacttcacttttgcaactgaagttatcagactcaaaaggtggcgatggagtccctcttgtacacatctatggccccaagattaagtatgaaaggggagcagctgttgcttttaatgtgaagcaaaatgatggaacatttgtgaatgctgaagttgttcaaaagatcgctgagaaaaatggcatatctgttggcattggttttctcagtcatataaaagtagacatgaagcagaaacagttaaatggcacgctcgatataccggaggcttcattttataagaatggacgcagagacaataaaaaggtgaccataagagttgaagtcgtgactgcttcacttggcttccttactaactttgaagatgtttacaagatgtgggcttttgttgccaagttccttgatccttcatttcttgaaagtgaacgccttaccattgctgctgaccactcagaagggcaaacttgagcatgacatgtagcatagcaacaaaaaatgagagggaggtgatttctcctgttgaagcatatgttgtcttttatgctttcaaggggtaatcagtagtggatttagcagatttgtttattctttgcctagttccttgatatgggtcatatgacttgtttttgttcatctagagtttgcgcaactcaactatgtaccagcagctcatcagtagagctctttcccacggaacaatgtgtgtaaagcagctcaatggaaatgaaatagtttgagtgattttgtccaaaaaaaaaaaaaaaaaatactcaacctcagatgtgtgttcgtaatgtggtttttacatcttcagctaacatttcattttggtcaacttagcatctcacttaaaattcgtgatctgaaattttgaatatgttatgtggatcctttcaacatattgatgttgctgaatacttcctatctgttaataaagcaaaaccagaaaaatgctgtgactttaggttccaatattcttccaatttgcatctatggctacttaatctgcgcagtacacgtttaggtttcataatagtaaaaccattcagttgggtttgatgttcgagtgcagtaccattgttttctttatgagcactgagcaaatatcaaccacatattgcctgtattgtattatgccatttatgtttcttgtgatcacatagaaacatgatggtttttaatgttatttgttttatcactaaggcagttgaataccttgataattatattgtaggatgtatagtcagatgctgctgtttctgcagcctgggaccacctttgttcaatgtagccctgaactctattctattcctatcctactgtcagtccacactccacacacactcctatgtcctatgatcctctgtgaagtggagacagtctcttgaattcatgatgtaacatggagaaggtccaatccaaccttaatgctccctttgtgctaataaaccaaatcaggttagcagactacaaatttgctttaatctggctgcggcttttatagtattttgtctctatggactgcaggttgcagctgcagcagtccgaacagctaactagccgaacaagcaggatctcatttgtgatctcatgggttttcctttacaaatggagtactacttaaggtcagtttggtagagctccttaaggccagtttggtagagttccacgagtgaaaaaaaaaaatctagattccataagatacactgtagagcagctccgccgtggatctagaattcatcaaagccgtttgatacaactccatctctcccagtcttactgccacctgggctccccaagccaagaggaaaaaaagatagactcaatgttacttgctccaaaaaaaatgagaataagatttcttccatagtttggacaggaccatggctcgtgcggccatggcagcggtcaggtgcggcgccatagaagtcaatctcatttgcttcagaattcaataatggcagtccttgaatttaattttttatttttttttcaaacaattagtcatcaactcatcatattcgagtatattgagcaacaactttacatagctgattgttttgattaggataatcgcccactgtgcagtgagatttaaaccacctaccacaaagctgtaatataaaacatagaattttctacgaaacttgccaaggcatcaccgatgtatcctccttcaaataatcaagactctgcagtatttgaaacagttcaggacgagactggtcggccgttacaaaaacatgaacgccatcacacagctcaacccagctacacccaggctctttcttcacacactctctgctcatgctctccctgattgtccaggtctcgtgccagtcattccctgatgcatgcacacttgacagagcaacccagttgctgtggttctcagggtcaagcttgagcaaacaggaagctgcgaactgacttagcctggcattcccgtgtattcgagatgagttgagcagcgcactccaggcagcgacgctcgagtcaaacggcatgttcttgatgaactcaagagcttcttctaggtaacctctcctgcacaggagatccgccatgcatccgtagtgctcagctcgcatctcaaccgagctcgaaccatcagaaatcgaactgaagtagtgccaggcttctctgacgagtccgccatggctacaagctgacagaaccgcaagatacgctatgccatcttgttatatccccatgcgcgccatcctgtcaaacaagctgacggcgtcctgtgcacggccagacttcccgtaagctgagaccattgtggtccaaagaacagcgtcgtttgacgatactgcttcgaagacgagctcggccgaatcgacacagccacacttggcgtacatgtccactaaggagttcctgacgacgacatctgcctcgaatccattgccagcaacctgtgcgtgcgcctgcatcccctgcttcagcagcgccagctccccgcacgcatccacggctatagagagtgagaaaccatccacaccgacgccagaagaaaccatggaaacgaacagcctcagcgcgtcctcggcctgcccgctcccaagaagcgctgccatcatcgagttccaagcaactatgttcctgacaggcatcgccctgaacactctcagcgcgtactccatgcttccgcacctcgagtacatgccaagaaccccgttctccacgaccgggtccactagtccacgcgagctcatcttgaccacgctggcatggatctccttcccgtgaacaagcgcgctctgcccgacaccggcgcaggccagcagcccaccggacaaggagtagccgttgggctggacgccagaacccgccatgcgccggagcagcgcgagggaatcgcggtgtagcccctggtgcgcgtggccggtgacgagtgacgtccaagagaccacgtccgggcggggcatctcgtcgaacagctcccgcgcgtaccgcgcgagcccggcccgcagcgccacgtgcgccagggaggtggcgtggatggcggaggcggagaggcccagcttgaggagcacggcgtgcaatggaccgacgtgggccgcggagcggcgggcggccgccgccttcagggaggaggcgagggacgtggcgtcccacgccgccggggtcgggctctgccatgagacggcgcatgcagctgacatgcccgcggccgcgtcagactacgctagaagcagtggcacggtcgcacggagatggctacaggcctacagcgagcgggcgaggtgtgtgtgtctgtcacggcgggcgcgccggtgttctggccgtggattcccagagttgcaggaggtcgggtcctgctaaaaattcagttagctgggttttagttttcgatggttattgcatatattttacattaaatttatagtatacatttgatatagtttttgaaatataatctgtaatttttagttctaaaaataagactcttattaaatccctacttatctattaagatgataacgtagaccgtcctccctcgtcgcgagagccacctccccgcacaagccgcgcaatgcgtcctacccgacactgtcgttccgcaaacaacctccgcgcagtcgtcgtccacacttgcccgcctggataaggatacgaagtccaaatcctcatccgaccggttccctacttccctcaaaccacgtcctctgcaacgagcgcgccctacgcgacggcgttccctcggctacctctacctcctggacatgccaccctcctcccggcctccttcgcctcaaccctaaccccgcaccttcgaacccattgctgctcccctctctccccggctctaatccgctcctaacttccgccttgtttgctgcaaggaggcgtgcgcgacctccagttccaatctgagcgactttggtggcatggacttcctgttcancatcgccggcttcctcaccatcatcagctttggtggcggacatgagaggagagaagaatccttcgaggtgagctgactattcattacgctgatagtgtttctattaattccaatgtcgttcagttggatgcaattccaactagggtttggatttgaggttctgttctgctacatgtgtatgtgtctatattttttcttcctctacaacttgccccttttgatccgacctacaagaagaaaacgaagaaaattgtcatccaaaaactttctgttggagtggacaggcttgcagagaagacaaacactggtagtcgtagaacccaatgaaattaacttcactagaataaagaagaaaaggaagaaaacgaagaaggtatgacagatacactccttagtgttaggctagacaagtttaagaataaaaaatggattagtgctagactggacaagtttaagaataaaaaatgaattgaggctttaaatttagtcactgcacaggcttaagaagcggacattgaattgaggtttacgtttgttcattttgcaaaaatttaggtggatcttgatttaactcttaatgagcttggagatggggaggacactcaaggtgcatttcatttgtctgaatgtaatccttgctcttatcccattaagaacctattgttcctcctatgttttcctgtctttgatcttaaatgatccatgatccacatgtatcaagtcaccagactcatcactcatgttctcctttttttctgaaatgttattttgatacccaaagtttcggactaaattccataccaagtgctcaaagaatataaaagtctgccattagggaaaaatgaagagaagaaagttgactttgtttctattagatcagactcagttcatctgcgaaagggtctctagccgagttggttaggtggtctgagtagtactacttaggtcctgggttcgactcccccggccctggtcgcggtcattctcacatgggctacggtgacgctgtg

SEQ ID NO: 557 - DNA, 2091 bp, Zea mays
attgggacctcgagccggcgggaacctctcccaccgataacggacacatacacgcgctctccctcctcctcctcctcctccagtcccggcaacggaaggtccactgcggcgccggcctcactggcatcaccatattgccaaccgcgcatattttcagtttgtagaagccatcttttaaagaacattttgggcagagattgccagtactattacttgtggttaacatggacttctcagctggttcctacttcacatcatggcctgtcaattctgcttctgagagctacagtttggctgatggttcagttgaatcctatggaggagaaggaatcatgccaccttcaagctacttcatgacagccagatcagatcacaatttaaaattcagtgtgcatgaacaggattccactatgcttccaaacgaccaattgacctatgctggcgctaggcagactgatctattacctggcgagactccatctagggataagctttgtgagaatcttctggagcttcaacgactgcagaataacagcagcctaccgagtaatttagtgcccccaggggtacttcagcacaattcaacacctggggcctttcatccgcagttgaatactcctggactttcagaactgcctcatgccttatctagttcaattgatagtaatggaagtgaagtttctgcttttctcgctgatctaaatgctgtttcttcagcctcagctttgtgttccacattccaaaatgcttcttcattcatggaaccagtaaatctagaagctttcagttttcaaggggcacaaagtgattctgttttgaacaaaacaacccatccagatgggaatatctcagtatttgacagtgctgccttggcatcactacatgatagcaaagagtttatcagtggtaggctcccctcatttgctagtgtccaggaaacaaacgtagctgctagtggtttcaagactcagaagcaggagcaaaatgcagtgtgcaacgttcctatccctacgttcactgcacgtaatcaaattgcagttgctgcaatgcccggatcactgatccctcaaaagattccttcatggatcaatgaaaacaaaagtgagggtcctgttagccatccttctgatgtacaaatccaaccaaattcagttggaaatggtgttggtgtgaagccacgagtaagggctcgtcgtggacaggcaactgatcctcatagcattgctgaacgacttcgcagagaaaaaatttcagataggatgaaaaatctacaagatcttgtcccgaattctaataaggcagacaaggcatccatgctggatgaaatcattgattatgtgaaatttcttcagcttcaggtcaaggtgttgagcatgagtaggctaggagctcccggagcagttcttccccttctcgcagaatctcagactgagggttaccgcggtcaacttctgtcagctccaaccaacgcacaaggattactggacacggaagaatcggaagacaccttcgccttcgaggaagaggttgtgaagctaatggaaaccagcatcacaagcgcaatgcagtaccttcagaacaagggactctgcctgatgccagttgcccttgcttccgccatatccacccagaagggcgtctccgccgcgtcaatccctcccgaacagtgaaataaagacatgctgctgctcccatgagtacgaggaaacaactgcagaagacagaaaactcaagatggctgaagaatgcagcaaagcccgtatagagtacagggtaggaagttagtctgaccagtgttcatgacctcatctactaatttgcttttcagaatcagctttttggtatctattgcgcataagttggtttttccttttcccttgctctgtctctctctctccctggggccgtatccgggtgctccgtggatagttgcgtttcagaaacttgaactgtatctggatgatctatctggtttctcttttgtgcatagaaaaaactgtaaaatcttctggttctgttctgctagatgagatctttgccccgaccgggctctcctcccccccaatccccaattccccattgtcttcgtcc

SEQ ID NO: 558 - DNA, 2519 bp, Zea mays
gtgcttgtacccacctcaggtgagctccataggaggtgcagtaattattaaaaaactactaaaagcatcatggtaactatcacagcatcgatctaacagcaggtaaagagtggtgtgatggcttgggaggagggggcaaaaatataaaaggaggagcagatgaaaaagaaagttcaaatagcagagtaaatccagaaagtgggtgtggtatctttccctagattttcttattccccccttctctctcttctcttctattctctttctctctctccttcccccgccccctcgcctcccctctcccacccccaccaagcaccgccggtcactatccctccttggtcttctccctcctcagagcagggaggggaagcggaagagggaggcgagagcacgggaaacctgatctgatttgcttttggtcgccacaagagaagggagttggtgcagtttgtaggcgtgcctctgtgtctccgtgtgtgtggagatggaccccaagttccccacacccctagcgctaaacaaaacggagcccaccaccgcgacgaccaccaccacctcgaccgcgcagcatcatcagctggatcctaaggactaccagcagcagacggcgcagcaccaggagcagcagcagcaccaccatcacccccacctgcaaatccaaatccaccagccgccgccgccgccgcaggacgggggcggcggagtgaaggagcagcagcagctgctgcaggtggtggcgcagcccggggatcggaggcagcaggcgctcgcccccaagcggagctccaacaaggaccgccacaccaaggtcgacggcaggggccgccggatccggatgccggcgctctgcgccgcgcggatcttccagctcacgcgggagctcggccacaagtccgacggcgagactgtgcagtggctgctgcagcaggccgagccggccatcgtcgccgccaccggcacgggcaccataccggcgtccgcgctcgcctccgtcgcgccctcgctcccgtcgcctacctccgggctcgccaggccgcaccaccaccacccgcaccacatgtgggcgccgtccgccggcttctcctcgccctccttcctgaattccgcgggcgcgggcgacggcaccggtatcggcggcatcatgcagcggatgggggtccccgcgggcctggagctgccgggaggcggcgccgccggcggccacatcggctttgcgcccatgttcgctggacacgccgcggccatgccggggctcgagctcggcctctcgcaggacggtcacatcggcgtgctcgccgcgcagtcgatcagccagttctaccaccaggtgggtgccgctgccggcggcagtggccagatgcagcacccgcacgggcaccagcatcaccatcatcagcagcaggaggacggggaggacgaccgcgaggacggcgagtctgatgacgagtctgggcagtagtgtagtcgttcaaccttgcgttttctgggtcttccctcaagtggaggaggagagaaaagtgtatgcgtgcagccacggaatgcttctgctactcctggattcttgttggtcgatggatttttatggtttttttttctctcgtgtggtatccaaactcggcggaggcctctcttgctgtgaagacttgcgggctcaagatcatcctcacttcttcctacaatctcatggggtggatgatcgccacagccttctctccgacttccaggtatttttttttttcatcttttgcgttcagtaggtcacatctaggtacgtttttaaggaattatagtttggttgactgtgatcctatatgtgggtccgctcaccctgcaggtgtataatagctgaaaacttgatggattggaccaatcacccttgagtgagtgccttatttgttatattgcaaagtgtgtagatattcaggtaattttgcagttagagaggtgttctttttattggagtaaacatgccagcgttttagaaacaatcaaggtattcgccggcaattcgaccatcctccacaggctgtctatgcatcataaacatgatacgtatacaattctagtccatgatcactcagacctcctttttcctcctctgatacgtctggtctgtttctgacgagatttcttcttcttttgtgtgatgaaacatgcacgtcctagttgtttgcttgaatcatcagttattgtttcagtatatttgtttacctaggagagttgtttgctactacattttactagggaaaggttcagtaggttttattggtaaccatagatggtgacacacacagctatatatgcttgtgcagaaacagagcacaatagaaggctgcatgacacctgattcagaaacaagaatataaggattagacttggtccagcatagaaactagtgcttcattgccagcgaatattttctggacagtttgcattcttgagttcgattttctggacacttttgggatgttttgccgtgataagatgtgttctctaactgaaaatcacaaagatta

SEQ ID NO: 559 - DNA, 2698 bp, Zea mays
  misc_feature (369)..(369): n is a, c, g, or t
  misc_feature (373)..(373): n is a, c, g, or t
  misc_feature (743)..(743): n is a, c, g, or t
tgcgtttttttataaacttactaaacaaagtttataaacaaagagagttttttttaaaaagggggggggtgtagggatataaaatactgtactaccttgtttccattttgactctgctcaattgttttttagtcggtccaatttatcactcaacaagattttcttctctttaaaaacatgtagtattaataaagaaatgggtggtcaatgacttagagggtgttcaaatgcaatagagctaataattagttggctaaaatgtactagtaaaattatctagctaactattaggtatttttgctaaaaatagctaataactgaactattagttagactgttggatgtacctcagaaatctggacataaacnttgntttctcgagacgatttccgtatgcagaaaaaaagaggaaaatgttttgtgagtatttttgcaaagctctcgagttacctctagctaatagaatttttgcaaagctctcgagttacctctagctaatagaaatttcccgtgttattagtttatttatcaaatatacatgcatcatggaagaaaaaggccatggaatcgtgaaactttttttacctcttctacgtggtattagaattatttaacgtattgcgaacaataatccgctgcatctagtgataatgatagcacagccgcggcggcgtcgttccaagtggacgtaaacataacaaattcctcgtttatcttgctgtgtctgccaactttcactttcntctttttttttctctacaccttccgctccaacatcaggtgaactccatgagaacaaccaaagtgaaaggtcaaaccatctcaactttaaccgcaggtaaaagtgaaacctcaacaatgatgtgatgacctgagactgaaaatacgaaaggaggaggagcaagatgaaaaaggaaaaatccaaataaacagagtaaaaatctagaaagtgggtgcggaaacctttccatagattttcttattcgccccttctctctccttctattttcagagagtcccctcgcctctgcctgcctgtcccatccccagtccaccaagcagcgcccgtcaccatctctccccatcccctttgccactctcggtcttctccctcctcagggcaggcaggggaagcagaagaaggaagcgagagcacggagcctgatttggtttgctttttgttgcccagactcggagggagttggtgtctctgtgtgtgtggagatggaccccaagttccccccacccccaccgctaaacaaaacggagcccaccaccgcgacgaccaccaccacctcgaccgcgcagcagcagcagcagctggatcctaaggactaccaccagcagcagccggcgcagcaccaggagcaccaccaccacctgcaaatccaaactcaccagccgccgcagcaggacgggggcggcggagggaaggagcagcagcagctgcaggtggtggcgcagcccggggagaggaggcagcaggcgctcgcgcccaagcggagctccaacaaggaccgacacaccaaggtcgacggcaggggccggcggatccggatgcccgcgctctgcgccgcgcggatcttccagctcacgcgggaactcggccacaagtccgacggcgagaccgtccagtggctgctgcagcaggccgagccggccatcgtcgccgccaccggcacgggcaccataccggcgtccgcgctcgcctccgtcgcgccctcgctcccgtcgcccacctccgggctcgccaggccgcaccaccacatgtgggcgccgtccgccggcttctcctcgccctccttcctgaactctgccgccgcgggcacgggcgatgccgccggtatcatgcagcggatggggatccccgcgggcttcgagctgccgggagcctccgccgccggagccaccctcggcgccggcggccacatcggttttgcgcccatgttcgctggacacgccgccgccatgccggggctcgagctcgggctatcgcaggacggccacatcggcgtgctcgccgcgcagtcgatcagccagttctaccaccaggtgggtgctgccgccgccggcggcggccagatgcagcacgcgcacgggcaccatcatcaccatcaccagcagcaggaggacggggaggacgaccgcgaggacggcgagtccgatgacgagtctgggcagtagtagtgtaaccgttcaaccttttgcgttgctgaatcttccctcaagttggaaggagagaaaagtgtatgcgtgcagccacgggatgcttctgctactcttggactgttgttggtcgagttctgatggatttttgtgtccatttttttctcgtgtggtatccaaactcaacggaggcctctcttgctgtgaagacttgcggattcgagatcatcctcagttcttcccacaatctcatggagtggatgatcgccacagccttctctccgacttccaggtgtatactagctgagaaaatgatggattggatcgatcacccttgagtgagtgccttatttgttattgcacagtgtgtagatattcaggtaattttgcagttagagaggtgttccttttattgtagtagtgatcaacgttttaaaacaatcaaggtattctcctccacaggctgtctatgcaacgcaagtatagtacaattctagttcatgaccacgcataccgaaaaaaaaaaaaaaaa

SEQ ID NO: 560 - DNA, 1210 bp, Zea mays
ggtggcttctcattcattgttgattgattgatcctccccgcctcactcctttgtctcctcgcctcgtgctcgctcgctcccctcgccctggcgaggagggcagcagaaaccctagcggctcaggccgggcgggggttagatgctccaaggttcgagagggaagggtaggttagtggtgcgccatcgactatgggctgcgtcttcggccgggcggctgcgtcgtcctctgcagcgccgaagaagaagtggggcaaggggaggtcgtccccgcagcccgaagcggggtcgccctccgcagtcgccgccaccgacggggacgggaggccgcggcggcggctcgggggccgcagggcgtcgggacccaggcagggttgcgtccccgcggctgccgcggcggagcagctcgccgccggttggccaccgtggctcgttgcagtcgctggggaggccctccgcggctgggcgccgcgccgcgccgacacgttcgagaagcttaataagataggatcgggcacgtacagcaacgtgtaccgggcgagggacaccgtctctggccggatcgtcgctcttaaaaaggtccgcttcgataacctcgagccagaaagcgtcaagtttatggcccgggaaatactgatcctaaggagactcgaccaccccaacatcatcaaattagagggcttggtcacctccaggatgtcatgcagcctttaccttgtcttcgagtacatggagcatgatcttgctggtcttgcggcaagttgtgatgtcaagttcacgttgcctcagataaaatgttacatacagcagctgttgtcagggcttgagcattgtcatgacaataatgtattgcaccgggatatcaaggggtcaaacttgttgttggataataatgggattcttaagattgcggattttgggctggcaacattctttgatccacgacataaacgaccaatgacgagccgagtggtcacgctatggtaccgtccaccagaattgttacttggtgccactgagtatagtgtaggtgttgatttgtggagtgctggatgcattcttgcagagctcctgtatggaaagcccataatgcctgggcgcactgaggtggaacagttgcacggggttgccctgtactctaccatattattttttcagtaatccttggggctatgctgttaatatcagaactatggttaaatcttcccttctc

SEQ ID NO: 561 - DNA, 5827 bp, Zea mays
  misc_feature (3666)..(3666): n is a, c, g, or t
  misc_feature (3686)..(3686): n is a, c, g, or t
aacaaaatgtattttgaaattgcagtcgggtcactataataaatagtggcatggtatacaaacttcactaggtggggtactaggttccttatcttactgtacaattcccctcagtgccaccgggacccaagccacaactgcatttcgcttgttcgcactgagccttttctggtgcttactcccagaaagatggtgagcaagcatcttttcgctgttgcacttcaaattgcagacctcgcagaaatcccgcaacttctgtttctccatatgttcctcctccttacaatggcctgcaagcatactctcgctgttgcactgcacattgcaaaccccgcacgaccacaatgctgtctgatcctccaccttctctgaactcgaactgctgcagtcaggaccatttgaagctgctttgtgcactgtcgtcagattacttgatttggcatccacgcctccttgtagtgcctccaccttcttttggtgtttcttgcctctgcagtgctgagcgaattgaggtgcggagtaacattttgcctgacagataacacaaccccattcagagggcggttgctggtccttggcaatttctggtggaaaatctcccgttttcttggcttcttcaagtaggtcctggacattcagttggtgtatcttcgctccaaattggtgctccaagtctaatttgcaatcagaatcagcttgaagtatgctacaatttgatcctggagtctgctctgtatgttgcggcgcaatgttcggaagcaccgtggcttctcgcgactcagaattccttgacaggttactgatttcgtccagtagagcttgaggcttagctaaaaggtgccctcgtaactccaattcatgagtagagttcgctaggcaatgggtagaactcatcggaggtggcttctctgaatgttgtggtgcattgttcttagggcactctggttcctgcagctcattagtcttagcaatgccatcactctccatgagttgcgctttaatgttttgtcggtgtgttcttccatttagatgctccttcatgtctgattcgcttgtactgttggcctggcctggcctgcagctccattttatcgaggatgttttctgctctgtgctggaagaggattcctctgttaattgtaccttctgatcaattgcttcttttaattggtgcttacgccctgcacggtgttcttgtaagctgtgctcactagttgcttgcacctggcagatttcacaactcagtttctggtgtcgtttctttttcttaactggtattgttattcctgtcagttcccatttcactgaaggcaaagtcgtcttgggctgtatggtctgtttgtttgacatgcagcatgcagtttgattagaacgttgatagctgacatggtaaaaacatctactaaacttgctactaaattctatgaactttaatgagaacattaccaaatggttgcaaagaaacctaaactttcagtagaatccccatacataaatcctaccaaactgttgatgtgtcacagcttaacatcgttctgaagatataatagcaaatattgccgaaagataactaacgggcgagggtaaaaaacagaaaggataaagcacccacctcactggattcttgtgatttctgatcttcgacttttgaattctcctgacttgccttaccattacaacaaggtctcaagcattcaccatcttccatggcaggcttctcagacttcaacactacactcctgtgccttccctccttttgctttcgatcatggacctcatccacatcgacataacattcttgactgactgaccatcgccaaggtcgcatggactgctccctgaaggtgaagggagcaggcttagtccattccacatcatcagcggcaataccatgatgtgagctgttgcacttgcacaggaccatggcacgctctatcttagccaactcaacctggatgatctcctggcgaagacgatccttctgaagctgtgacagcagcgcttccctaatcaccagcaatgggtccactgcacaaggcacagtcatcttgccgtaaaaaaaagcataaccaattcagcagttgaccagtcgtgagcgtctgatgctctgactatgccaaggttagacctaagatgacagtcaaagacgaacaggttttcttaaaaaatactctctccgtcgcaaaatatagctttttctaacctttttgtagatatacatataaactacattcgaagaataattaatgaatatttgtttagtctaaaacgaattatattttcagacagagattatcaaaaggcaaacaagctaagttgatggattgatgctctaaattacctatttaggagtatttccttatcaggtgcagtagaaccttcctatgcaggtgattatgccaagagccgtagagtagcatatagcaactgaattttagaaccttcctatcctggtgattatgccaagagccgcagagtagcatagcaacggaactttagatccttcctatgctggtgattatgccaacgcacaagaaccttgcttccttaatggaaatcggggtttcgctttccaaaggaacaggcaggcaggcagcaagccagcttggaatgttggtacggaccaaaagaatagcttgcatctgcacgaaaggaatcttcaaaagattcctcctttgcctttttgctgttccctcccaatccaaacacacacacacaagcatggaggtcgactacggcggcggtgtaccgtgaggcggcggaaggtcgatgaagcggtgcatgtcgtcgatgtcctcgtcgccgtggcctcggcgagcgaattccatcgaccggaagcagcgcggggaaacagcacggttttgctgttccggggacaaatggccggcggtggagcgccgaggggaaagtgtacttagggaaagcaaatggcaggccgctggttcgtgcagctcattattcttagccgtgggcagaatgaaatgattttttttagaaacggcataagggatgacaagttgaagatggttggcgattttttttttgtttattactaatccttaacaacgaaccggtaccagttttaaatctatcagaaggtttagggaggtaccgagtacggcaggaatgactgccgcagtgagaagagagcaagaggcacaagctcggtgaggcctccaaattattcaggtttagtgttagtttgggaactgcatttttcatgtgattcctattttatcaggagaaaataaactatttttttggaaaaatagagttttcaaactagctcttagagtttaattattctaagatttttaattagaatattccataataaagagatgacttagcaatctcaatatatgtcatgtttggcagagattcaagtgttctagacttgtaggtttattaaaatcaatcctatatttatttatttttatccaaacatttgttctacagaattcggatctataaaaaaaccagatctgtgggttaggtccatgaatttcatggagaatattagaaggtgatttcgtaccttctggtaaagtcgagtagtagtgagtaattatcaatgtaatccctcatctattatacaacttagaccttatttggaaacataatatattcttagttcgaagacaatatcatatcatgatattttanactaaaagacgtttgagagnacatataagaactttatattttaaaccatggtgttaccaatacttcaatatttttaggtttagactaaagtttttttcttgcacataactacaatattctcttcttttatactacaactaaaataatatgtcttcagacatgtgttaaattgtactcatgtaaaatatatcatagttatgttatagaatacattaaatcgtgatattataagttgtgttttttgagaaacaaagttaacaaacaggctctgtattcgttccccccccccccttctgtttgcgttttccacgacgttgttgacccctcctcccgtctttcttttattttagtctttttttaaaagttattcgtaatacatctcgacgctagtttattttacactaggatctcggattcacgtgctaagataacgctcacgtggcagcaatcttggcgttaaggatctcgacgtcgaggtcggtgccatagacgtggacgccgaagagttcggtgtcacggatgtttgtagcctgcagcgggtggaggtagccaggcgacggcttgccttcattgcgtttcatgcagcggcaacgcgttggaaaacgaatcgtgctgcatggaaactcgaagaggctccgccacgcgtgcagtgcatgtgcaatttcccaagctgaaagcaccgagagcgcattgatttcaagaaacgtctcatttaattagtttaattagattgtgtttaatgtacagtggtgtttcttgataagtcttgaagctctgccgaagtttttttttgtttttatatcttccttatatttcagctttctccttacccttttggctaataatcaccatcttgcaggttttacagcaatataaacatttcgatagtttattttatgaaacctaattcaatgttttacgtggaaaatattgagttactattagctacatgaagtgcgtgttcaactatgacatgctctctcgtcgatatagatatattggttgtttacttatctaggttgtttcgtttctagaggctaatttttagtccctccattttatttcttttttatccctaaattgttaaatacagaaactaaaattatattttagtttttgtatttaacaattttaggctaaaatagaataaaataaatggactaaaaatttagtccctagaaatcaaacacctcctagtgtagattctttaactgtaaattaattttgtgttaatatatattagatttttactaagtttgtgggtcgtttattagattttttctaaaatctaaaagctataaattatttctacagaaattgcaaggaaacaaagttatacttgtaatgtgaaatatatacaacagccgttacgtataaaatgttaaaatttagagctacaaattttagcaactcatatataagtaatacttgctccattacaaaatatagttctttgtagcccattatttttctatctacattcattcaaataatagtaaatatcgagatacatacaatcttcagtcatatgttacttagagtgtatgattagtttaaaacgaattatattttgagacggatggagtagtataggagtggctttaggttattgtaggtagcatgcagccttgcacaataagactgaccgtcagctaccgcactgggcactgttagactaactctaacaaaaacctctaaacattttttaaaatttagaggatgtggtcatcctctacgtatctagcagcgtcctctttatcaaatccattttgtttggttaaaaaagatacccaccatattcattacaaaaatggctttaattaaccccctcctaaacctatatctagagattcacctctgtcattctaacatattatatccaaaataagtcataaactttatataaattatctatcattgcaataaaaagctaaagtatgtgcatgaattgccctcctctgttggtacttaaaacactaaataacccctagatccatatctatattatccacccacaacatttaaatattaaacagtccaaattaacctctaaatttacataggttagaaaagtatacaaaataattgatgaataaagtttatcgtaaataaacaaaggtaagaaagtatctgtagatctatacatcggatataaacttag

SEQ ID NO: 562 - DNA, 1046 bp, Zea mays
gcccggcccggaaataatataaccacagaaatccatcgacgaacaactgagaagagctgcgcctgcgcctgcgcctgcgggaaagggagaacatggtggggaagaagaggggtgttatctccccgctggaccatctcgctgggctgctggaggtgcgcgtggtgaggggagtggacctcgccatccgcgacctccgatccagcgacccctacgtcgtccttcgcatcggcaaggcgcagaaagtgaagacgcgagtggtcaagaagagcatcaatccggaatggaacgaaaaactcaccctctctattgaagaccctgccgttcctattagactggaagtatttgacaaggacactttcgttgatgatacaatgggtaacgcggaggtggacatccgcccgttagtcgagattgtgaagatgaagctccagggtgtcgctgacaaaacggtggtaaagaagctggtgcccaacagacagaactgcctagccgaggagagctccatatacatatcggaggggaaggtgaagcaagacctggtcgtacggctaaggaacgtagagtgtggcgaaatcgagctccaacttcagtgggtccacctccctggctctaagggtgtatgagaagagttatgagcgctgcctagcttgcactgctcaggttcttcgcttcacattaaagtaatctatttgaactgtagttgtaatctatagagataaaagcagtgtaaaaatagtagaaatcgttatggattaaagacagtcgacccagctcttgctagttgaaaagaacccagctcttgccatttgacatgttgatcatgtagccgtagccgaagaggatgcaatcctattggaaatcgtgactgtaaaatgtgtgcaatgcatttactaaggggatgtttggtttgagtaattactccatccaaaatgatgtgtgtattatgtgtatattttttaaatttagtgggatgacccatttttcatattagtaataactaactataatgaataaagtggtgatcatatcaactcattccattccac

SEQ ID NO: 563 - DNA, 1121 bp, Zea mays
  misc_feature (10)..(10): n is a, c, g, or t
ggtacccccnggtctgccggtaaaaacgtgtagtgcaggaggaggggtgggagaagaagaagaaatcaactgggggctgccggacgacaaccactacggcaaggcagtagagatacggcgtctcctcttctgacttggccagcgcaacggcagctagttcaattgaaccagagcgctttatagatagaacaaaaatatatactgtagaaatccatcgagaaacaaccgagaagacctgcggctgcggtgaagagagaactcagtggtgaagaagagggaaaaatcaccatgctggaccatctcgtcggactgctgaagctgcgcgtggtgaggggggtgaacctcgccgtccgcgacctccgatccagcgatccctacgtcgtcgttcgcatcggcaaacagaaattgaagacacgggtggtaaagaagagtgtcaatccggaatgggacgacgaactcaccctctctatcgaagaccctgctgttcctattagactggaagtttttgacaaggacactttcgtcgatgatacaatgggtaatgcagaggtggacatccgcccattagtcgagattgtgaagatgaaactccaggacgttgccgacagaaccgtggtaaagaaactggtgcccaacagacagaactgcctagccgaggagagctcgatatatatatcggaggggaaggtgaagcaagacatggttgtacggctgaggaacgtagagagcggggaaatagagctccagcttcagtggatcgacctccctggctctaagggtgtatgagtggggggcggctatgagctctgccttgccctgctgttttcgcggatctccaactctttttctacttgaaaagaagaactagtggtttgcgtgcgctcgctcgcgtagagctgtcagttgtatgtaagaagttatgattgcgttggcgtttagtaaaatatcgtcagggagatgtatgtgcatgaacatctgagaatcaagactataaaaatgtgtacaatgcatgtactaaaggagtgtttggtttctatagattaatttttagtccctaaaaaaaaaaaaaaaaaaaaaaaaaaaaaaaaaaaaaaaaaaaaaaaagaaataaaaaaaaaaaa

SEQ ID NO: 564 - DNA, 1769 bp, Zea mays
  misc_feature (408)..(408): n is a, c, g, or t
cctcagttgatgaactgatagggatggctgatgtgagttcactctcaaaaatcatgagttactctcaccatctctgaatgaaggatgctaatgatgtgaacccaattatcaattggacgaggtttgggttcatgtgaggggagtacctcacgcttggaggcattatttgggtttttgggccctaagatcggtaatcggcgccactcttgatgtagacatgtacacctatagaaagatgggcgtcatcagactgcttgttggtgtgatgagcagagatccactacccctgaccaccgatattgtttttgacaagaagggatacgagatcacctattctatagaggataagtacttcattcctgcatctccggtgatttttagggaggagtctcgtaatgatggtggggngtggtattggacaaggagtttctgaacaagagggtaaaagtccagaacatgcttccaaaaagcataaattagatgggaaggggggtggtgctggttctatggcagggggttttggtgatggggaagattctccaatgcttggggctgctgccatttcacccttggagaaggctaatgaacctgtgcctgctgtgatgaagggttttcctttgctcaacttgtctgccctgcattctgtacgtccctctttgaatggccgaactggggcagatctgaagctgcataagaatggaatgtcatctgctgctgggtttctttctggtggcaaaaggagctctgttgttgggtcatatgatactaatggctgcaacttaatgctacagagtattcttgatgagcagatagtgagtaacatgaaaggggctgacccgactggtgtgattaactctgtacacacgaccaggattgtgcctgacgcaagcagctggtccaagaatattcctgatgagcagttagtaagtaacaagaagggggttggtccgtctgttgtgcttacttcggcacacacggccatgaatatgccagcggcatgttgctggtccatgcctgcattccagggacagaggagttctgcatttgaaagagagggccagccgatggatgatgtaaggaagattgaatgcagtttgcatattggggcggggcaagtaaaattgcccatcccaccggagaagaatctgatgcctccggtgaaagatgaggattctactttgaacgctatgaagagggcttctcgtcgcaatcttgatggcgatttgagtggattcaagccggctggtcaagcgctacgcacggtgtccacttcatctcttccgattgggccatttcagtcaggttatccatttggtgtcacagaagctatcagcgagaggagctgcgaccgttggttgtggagggttcgcgactcttggtgcgaacggccacggtcttttttcctgggtgtatgggtggcgatctagtcttcggattgactgtcactagtttggggaagctgctgtgtttatgttttttttaggttggctatgtgcattaggcagaggccgggagtttgtgtaccaagactatgtatcctctcgatgtatcgctcttggtaacctttaatataaagcttcctttatcgaaaaaagcaatgtaaaatttgcattgcaatttatgtaaaacttaaatgcttctcttaaatgattgatcattgttcctgcttttgttttttaatcgaaggtataataacacgctggttaggagctggatagcgtgattgcgtcgagcttccagcaaccaaggtccctcaaccaattctagcc

SEQ ID NO: 565 - DNA, 1026 bp, Zea mays
  misc_feature (1012)..(1013): n is a, c, g, or t
  misc_feature (1020)..(1021): n is a, c, g, or t
gactggggacgacaaccactacggcagggcagggcaggggagggcagtagagatacggcgtctcctctcctacagtttctgacttggccagcgcaacggcagctagttcaattgaactagagcgctttatagatagaaaagaatatatatactgtagaatagaaccacagaaatccatccagaaacaaccgagaagacctgcggtgctgcggggaagagagaactcagtggtgaagaagaaggaggaaaaatcaccatgctggaccatctcgtcgggctgctgaagctgcgcgtggtgaggggggtgaacctcgccgtccgcgacctccgatccagcgatccctacgtcgtcgttcgcatcggcaaacagaaattgaagacacgggtggtaaagaagagtgtcaatccggaatgggacgacgaactcaccctctctatcgaagaccctgctgttcctattagactggaagtttttgacaaggacactttcgtcgatgatacaatgggtaatgcagaggtggacatccgcccattagtcgagattgtgaagatgaaactccaggacgttgccgacagaaccgtggtaaagaaactggtgcccaacagacagaactgcctagccgaggagagctcgatatatatatcggaggggaaggtgaagcaagacatggttgtacggctgaggaacgtagagagcggggaaatagagctccagcttcagtggatcgacctccctggctctaagggtgtatgagtggggggcggcttgagcctctgccttgccctgctgttttcgcggatctccaactctttttctacttgaaaagaagaactagtggtttgcgtgcgctcgctcgcgtagagctgtcagttgtatgtaagaagttatgattgcgttggcgtttagtaaaatatcgtcagggagatgtatgtgcatgaacatctgagaatcaagactataaaaatgtgtacaatgcatgtactaaaatgggtgtttggtttctatagattnnaaaaaannaaaag

SEQ ID NO: 566 - DNA, 2472 bp, Zea mays
gccgggataaacatgctgcaaatgatgcaagatgcagcagctgccccaatttcctatgcacgtttcttgccatagacagattggcaccagaccagagcatccagcaacatgtacttaaaattcagtgggagggtcagagagtttcgttcagtgctgacaatatacgtgcatgccattcgttgtgacgacgactgtcagagctacctagctttgctttgcttgctcggactgagtggatcgagatggggagggtgcacccttgctgctccgaggagaagaaggtgaggaaggggctgtggtcgccggaggaggacgagaggctcgcctcccacatcgcgcgcttccgcggcccctgctggagctccatccccgaactcgcaggtgatgaacatatgcatgcattcttgacgctgtcgcaaatttgcaatgccgtcaccactgagacctgtttgctcatagtagtaatggatgggatcggacggagtgagtgaactggtggtatctgtttgcaggcttgcagaggtgcggcaagagctgccggctgcggtggatgaactacctgcgcccggacctcaagcggggccgcttctcccagcaggaagaagacctcatcatagctctccacaaagcacttggaaataggtaactgacctccgctctgctgaacagcagatgtgcctcccgccattgcctcagcttaattacgcatggccatctcatagtaacccgaccgacccggccgtcgtcgtcgattgtgaactaatttgatggtcattatctgtattagctggtcccaaatcgcggcgaggctgccggggaggtcggacaacgagatcaagaacttctggaacgcgcggctgcgcaagaagatccggcagaaggaggcctcgtcgtcggcgtcttccacagccgggagcaaagaacccgccgcgagacgcaaccgaccgaacagcaccgaaaacggcgacgaccggataaaaccggcgccgccgccggtgttcaccccctaccccttcgtcccgccgtctcctcgggaccatgtcgccgcggccgcttccggcgcaagcaggggcgatcgactattccgccgctgccggcagtttcgtcgccgacccagccgcggcggcggcatgtgccgctgttcatgtagggtacgccactgaccggagtgccgcggccgccgagtcgggggttacgccgacgccgccgtcaatgacgacgagcacgagcgcgtgcactgacgacgcgcggggcagctgcgacgacggcttcttacgggcgatggtcgacgaccccagcttcctgttcggggatttctacctcgacagcgatggcggtcaccatgggcagatcatgagcttctgggaaagccatgcgttcagttgatttgtttctttttcgcggtgttacttggccggtctacacaaatttattacgacttcacttcattgttgtgtaagcgtatgcatgcggaatcaaatgtgaaagttcaaccggaataaataaaagctacgaactgtactttttgtgtttccaagttttgcaaagaaaaatggcaattgatttcagttctgtgaggatgtctgtctggatagattctctttaaaagaccaatatctagctctatgtaacattatgaggcacaaattaatatcaatagcacaagctatgaatgtttttcctcctaattttttctggcggagacaattatttgaagccaatttggttggttggctttctctattatcacacatctaaggtatggagttgtcccaagactaagatacctctcttgtggaacctttcacagaatggtagattctcggttaaatcggttaaatgtgaaacctttcacagaatgctcagaaatatccctaatgtcaataaagagctttggaagctaaaggcctcccgaaatttaaaattttcctatggtatttgtgaaagggtgtaattctcacaaaagataatttaactaaacgaatttggtaaggaagcttaacatgcaactcttatcacaaggagaagaccattaaccatcttttctttgagtatcggttaacccgatcagcttggagtgtgatacacatttccactagaatcaatcaaccacaaaatgtggaccactatatgtttggagattgacttcatggttttaacaatgtgttgaaacctgagtttctatttggagtgatggtgttgtgttgggggacactctagatctgtagaaatgacttagtttttttagagaaaaaactcttctgttctcctttgcaagttatatgttttgcgacacagaagctttcaaattgggttattctacagcgagaagatgtgtggttgctggttgtggtgggatcccgactcatggtgcgaatggccatgcactaccagactggcattctttggcgagtgtctcaaacactcggcaaagactttgccaagtgtaacactcggcaaaagactttgcca

SEQ ID NO: 567 - DNA, 2655 bp, Zea mays
cacaccacgtctcctccgcctgcgtctgcgtcccttcctccgcggacgccctcctaaaatccccagaggcccgccttgggaacatcccctccggccagcaaaccctaaccccatcccgcactcccccctcccccaacacgcgcgcgctttcttagccgctaagcatatccctccccgccacgatctcgatggtggagatgtctgtggtggagctcaggacgctgccgctcggcttccgcttccaccccaccgacgaggagctcgtcacccactacctcaagggcaagatcaccggcaggatcaactccgagtccgaggtcatccccgagatcgacgtctgcaagtgcgagccgtgggacctcccagataagtccctgatccggtccgacgatcccgagtggttcttcttcgcccccaaggaccgcaagtaccccaacggtagcaggtcgaacagggccaccgaggcgggatactggaaggctactggcaaggacaggataatcaagtccaagggcgacaagcgcaagcagcataccatcggtatgaagaagaccctcgtcttccaccgtggtcgtgcccccaagggcgagcgcacggggtggattatgcacgagtaccgcaccaccgagcctgagttcgagtccggcgagcagggtggttatgttctttatcgcctcttccgtaagcaagaggagaaaactgagcgctccagcccagaggaagtggatagaagtggctactcacctactccttctcgttcttcacctgacaacctagaggcgaatgaggaagctaatacaccattaaataaggaatctccagaatctgctctgcatgaaagcccgattgagctgccaaaatctgttgaaaccaatggtggttcaatgacaaggtggctggcggacagaaatggtaacttgatggctaatgcaccagatgtttcccatatacctttccatggacatgctgctggtgtagctaaggttgatccttctgttggtgcttcaggccacttagttaatccccacaatggaaatgatgattataacaaatttgtgtctgatttcacccccattctaccacttgaaaatgcattcttcactgatatacaacaaggagcttttggttttgatggcatcatgaatcctcttgatccccttgatgctttcttgaatcaaacacttgttgatcctgatgaacattcatcaacaacatcaaaagttcagtatgattctgacattccaacagaatttgagaaccattggaatatgaaggttgagcctcaagatgatcaatgctggtgggcaaacataggatttgagccagacgaaccaaatcctctgcttccttgtgacaccactgaccaagacatactttctgttgactctggtgctgattccttcaatgagcttttcaatagcatggaagagactggaattactgttaggcctcaacagttggactccactgtgcaaccaaaccatgtgttcgctagccagggcaatgcaacacggaggctgcggctacaggttgagtgtagggagatcataactaaagatgagagtgaagatgaagtatcatgtgttctaactccagactgtttgaacgattctgttgaggagtccactgcagagaaggatgtggcttctgatggggatgaggctgagtcaacagggattgttattagaagccatcaccctgctccaagatcaagctcagagaggtcattcactcaacagggaactgctatgcaaaggctgcggctacagtcaggccttaacaaaggccagcgtcctagtactgatgattcatcaagctgcattatagacgaaccaggaagtcagcacaaagcagaaaaagcagagattgaagaggatgcgagtacaaacctcgctggaagtgctgatgatctacctggtaatatccatgatgatgagcaaaagaacatccctgaacatggtgctgaaatgacttctccagaagccaaatctgttctgaggttgcggaagacttctgaggaaggcaacaaggatgtcaagcaggagagttgtctcgagccacacgtgagagcaccaatgcagaagggaggcttccaatcatacatcatctggctggttcttccggtggctctgctcctgcttctctgtgttgggacatatggatgggtatgaaatctatcctggtgcggtgcaaggcatgacattttgcgcacatgggttcctggcgtcaacctggtgtgcggtcttctgtacataacctgtggcatcctttcaacagccgtaccctgcagtaagacatcccggcattgccaaggcagctgaaaaataaataaaaaaacaagtggtagaaatgacaaggtggaaaagagcgaggtgtgttattgttggttttagtacatcgtagtcttcttttgctgttgttgtagatgtcttgctaatgttgtcgctgttgtgtagttgcaattcaagcccagggctgccagttttatttcctaatgtaatgtagcaagagcgagaccctgttagacgggtgcgctgaaattctgaacctctgtaatatctgatgttcttgtggatacctgtttcagaattttcggttcctgaacccagttactgatggcttgttgatcaaagaaaaaaaacggccaaaaaaaaa

SEQ ID NO: 568 - DNA, 1363 bp, Zea mays
tctacggtgggggccgccacgcccctcgtatgggaccacgtcaccggcgccgctcgcctgccgttccgcctccccgcctccgtcgaatccctgcccgcggggctgccgcggcttgactccccgcgccggatcgccgccgcagccttcggatcggacgacgagctggtggatctggaactgcgggtcgagatctcgtccatcgccggtatcgaggacgcgcttctcctgaagcccgcctctggtaaggccgccgagacgcggctccgcgccgggtgggcacgctggctggaggggaaggccgactacctacggcgcgatcggatgctccgctccaacctggaatccctcaatccgcgcaaccacccgcttctccaggatccggacagccccggcctcacttctctcacccgcggcgaccgcatggtgcagcgaatgctactagccgagctcgacaagcccgcgtccaagagctttgagcggcgtaggcttctatcttacgagaacaagcagagcatgacaacaactgtgaaggagaagccgcagacgggaaggaggtggggatatttcccggggatcgatccacatttgggattctcagagttcatggagaggttcttcgagcatgggaagtgttccatgagagtgttcatggtgtggaacagcccgcagtgggcgtatggcatcaggcaccagaggggactggagagtctactcaagcagcacccagatgcctgtgtagtcatgctatcggagacactggaactagagtccttccaccaattcgtcaaggaaggatataaagttgctgttgcagtgccgaatcttgatgagcttttagaaagcactccaactcacgtatttgcatcagtgtggtatgaatggcggcagacaaaatattaccatttgcactacagtgaactagtacgccttgctgccctttacaaatatggtggaatataccttgactctgatgttattattcttaaacctttaacatcgctccggaattctattggtgccacaaatcatgtctctggaaattcccgttttggtggggctgtgttagcatttgaaaaacagagccctttattggaggagtgccttagggaattttattcgacatatgatgataccctcgtgcagtggaatggggctgaacttatgacaagagtgataagcaatatttctagcagagcagatgaaaacagggggcatcttgacattaagttggagccctttgttaaattttaccctataagctctactgatattatacgatatttctcagagcccgataacatggtccaaaaagcacatcatgatgcatcttttctaggatcgtgaatgactctaccactttcca

SEQ ID NO: 569 - DNA, 1305 bp, Zea mays
ctcgaggccggccggtccgcctttccgcgagaaccgaccggctcgacccgatgagcttttagaaagcactccaactcatgtatttgcatcagtgtggtatgaatggcggcagacaaaatattaccatttgcactacagtgaactagtacgccttgctgccctttacaaatatggtggaatataccttgactctgatgttattattcttaaacctttaacatcgctccggaattctattggtgccacaaatcatgtctctggaaattcccgttttggtggggctgtgttagcatttgaaaaacagagccctttattggaggagtgccttagggaattttattcgacatatgatgataccctcgtgcagtggaatggggctgaacttatgacaagagtgataagcaatatttctagcagagcagatgaaaacagggggcatcttgacattaagttggagccctttgttaaattttaccctataagctctactgatattatacgatatttctcagagcccgataacatggtccaaaaagcacatcatgatgcaatcttttctaggatcagctacgtaggcccccccccccctttttggaatggcatcacatctgctctagttcctgaacccggcagtcttgtttcgaaaatccttaaccgttactgtctccattgccttgatgttttatagttgcaacagtctgaagctcctgctaagagctttattttggtttagaacaggtacacagaagaaatctttcaatgaggtactcagaatggctagtattgctgaatcttgcaaaacattgtgatggggggaaaattaccggcagcactgtgtatatattcttttcactaaggtttgtgccggagctgcgcctgcaaagtccaagcatgttgacttgactagttattgtcgatagcaaaagtcttcctcctggcaatacagaatgcaacaactgaagacacttggaactagagagttttgactagttcggtaccccttctatatttgcacatatactgataattttcacaatttgatattttgaaaataacatgattcgtgtaagacagtagaaactgaaggaccatataccgaattcactgggtttatctagatgtttggtaaacttttatttctcagagcatgattttgtctgaattaacgacttgggaacgagaatgtcagcgttgtaagcatctgcataaaattatagtgcaggtcttggcatcctcgaagctgaattgtttgctatgtaatgtaaattatgcatttttcaaacgttaaaaaaaaaaaaaaaaaag

SEQ ID NO: 570 - DNA, 2555 bp, Zea mays
  misc_feature (37)..(37): n is a, c, g, or t
accaatcctctgcttccttgtgacaccactgaccaanactactttctgttgactctggtgctgattccttcaatgagcttttcaatagcatggaagagactggaattactgttaggcctcaacagttggactccactgtgcaaccaaaccatgtgttcgctagccagggcaatgcaacacggaggctgcggctacaggttgagtgtagggagatcataactaaagatgagagtgaagatgaagtatcatgtgttctaactccagactgtttgaacgattctgttgaggagtccactgcagagaaggatgtggcttctgatggggatgaggctgagtcaacagggattgttattagaagccatcaccctgctccaagatcaagctcagagaggtcattcactcaacagggaactgctatgcaaaggctgcggctacagtcaggccttaacaaaggccagcgtcctagtactgatgattcatcaagctgcattatagacgaaccaggaagtcagcacaaagcagaaaaagcggaggtggttgttctttttgttacccagaagctaaatttacatctgttttttatgctagtgatgatcggtatctaggatattccatagatactagttctgttagtgtactgctactattttgcagtgttttcttaaatcttcattgatcctggccctgggtgatctattttagtaaatgataccatctgaccttttttatgttatgtcagattgaagaggatgcgagtacaaacctcgctggaagtgctgatgatctacctggtaatatccatgatgatgagcaaaagaacatccctgaacatggtaatatgctttggaacttctgtatattgtgtctcttgtgatgacttctgtttttgctaaactagttaaatatgttgttgaactgaaggtgctgaaatgacttctccagaagccaaatctgttctgaggttgcggaagacttctgaggaaggcaacaaggatgtcaagcaggagagttgtctcgagccacacgtgagagcaccaatgcagaagggaggcttccaatcatacatcatctggctggttcttccggtggctctgctcctgcttctctgtgttgggacatatggatgggtatgaaatctatcctggtgcggtgcaaggcatgactttttgcgcacatgggttcttggcgtcaacctggtgtgctgtcttctgtacataacctgtggcatcctttcaacagccgtaccctgcagtaagacatcccggcattgccaaggcagctgaaaaataaataaaaaaaacaagaggtagaaatgacaaggtggaaaagagcgaggtgtgttattgttggttttagtacatcgtagtcttcttttactgttgttgtaaatgtcttgctaatgttgtcgctgttgtgtagttgcaattcaagcccagggctgccagttttatttcctaatgtaatgtagcaagagcgagaccctgttagacgggtgcgctgaaattctgaacctctgtaatatctgatgttcttgtggatacctgtttcagaattttcggttcaagaaaaaaaaaaaaaaaagcttgttgatctgttggcgtgttcgaattcgtttggacatgccacagcatggtctgaggggatacaaggactgaatgcgttggtttataattttataatgaaatactgccgttgctttgtgcacgtatacgtatggtgaggatttgacggggttgcggctgaggctgaagtttcgtggctatcaatcacttactttgtttggatatactagtagtattgatcccagtccacgtccacgtgtgatctggattagggtataaattattttaagttatatcctagatgtgaattggattggggtataaattagtttaagttatattctaggtgtgaattattagattggggtataaattagtttaagttacattctaatctaacttaatacatctggaccctaaggtggattagggtataaattagtttaagttacatcctagatgtgaagtggattggggtataaattagtttaacttacactctaatctaacttaatatatatggcttgagctcaatactagagtttttaaactaggtctaacttcatgagtactaatttggcaccgatctatcggatcactcgctggagggattataatctctatgaggagggtgaattagtcaatttcaaaatctatttttaaactaaaacatctgactcacacccaatcaaacctacgaaagatgtaattacaatttttctggtgtgttactatatcacaaaatagttatgcaaccaagttttaattgtatcactagcctagcaatctacactaacaaagtaagcacaacaaacgtaataaataaagtacgaaagcttaattgagataaaaggatagagatataaacttatgtcgatgactttggtatttttactgaggtacagagaagctcacgtagagaagctcacgcttttctctagtccttgttatagcctctcgtaagagtcaaactcttgatcaggtgatagactc

SEQ ID NO: 571 - DNA, 1914 bp, Zea mays
tgaacagtcaccatgcaccccatttgcctgcattctcaggcgcatattcatcagcgcaagtgagggaggtcattgagagtgaaatggatcaggacagttcagatagagatggtgccagcaccatatatgaagagagcgagagtgtttctgttggagaggtgatgaagagccctgtgttcagtgaggatgagtcatcggagaactccttctgggttgatttgggacagagtccacttggttcagaccattcagagcaatcaagcaagggaaaattgggctctccattgccagcatcctggttttctggcaggaagagtgctaagaaggcgtcaccaaaggtgccatccaaactgtcaaggagtcctattcatgataaccatgttatgtcatttgatgcagccgtgaggtcggtatcacaagagccagggccggagaaaggggatctggatgaagataattcacatattaacatcaagaatactcctatcagcgagattgaagaagataataaagatgctaaagtaaataagaggtttgtaaaattttcttgtgccaacgacactgctgaaggtgaaggcaatgcaacttctgtttttgggagctgtaccgcccgtgagaatggctccacatccgagatttgctcagaaagtcaaggggaaaccaaagatagtgcaatcagaagagaaaatgaaggtgacttccgtctactgggaaggagagaagcatataatggcagattcaatggtggaagattctttggagtagaagaatcggaacgagtgccaagtatggggcacaatgtatcattcactttggatgatagcaagctttgtcgtaatgcagatgctggggaaacatctgggtatggaatggcagatgacgatgacgacgatgcatacagtgactatgatgaggctctggatggcaggaaagaacctgaaattatctgcaaacatcttgatcatgtgaatatgcttggacttagcaagaccacacttagattacgatacctaatcaattggttggtgacctcattactgcagctccggttgcctgattcaggggatggcgagggggtaccccttgtttatatatatggtccaaagatcaaatatgaccgtggagcagcagttgcattcaatataaaggactgcaacactggaacctccctgataaatcctgaaactgtacagaaactggcagaaaaagaaggcctctccttgggcgtcgggttcctaagtcatatacgcctcatagacaaccagaaacatggtgcggttgatgtggggttaagttcttccttgccagcggcaaatggccgtcgtgaaaagaaaaatagcaagaatgctattattgggaccgaagtggtcactgcatctcttgggttccttacaaattttgaggatgtctacaggttgtgggcatttgctgcaaaatttcttgattcatcatttcttgagcaagagaggctatcatctattcctgaggatacagaaagatagtattagatggttccagtttatggctattgcagctacttcataatagaggagggtggcaccagtgtaattgaaacgaggatagtagaagagatgtcatgttgcttctgcgtattgttttttaacgtctcagcatggagtcaaggggcaatacttggtagtgcggcttttatatttcttcattcttatttccatccttttctaggcatgcaacgtttttgtttgtagatttttttttggagatctatatgtaccagctaattattttgagcatcctttccatgtacttgcttgtaagttgtaaattggctccattggacatgaaatagatttgctcgcttgtatgattcttgcaaaaaaaaaaaaaaagggcggcagctcgcgatctagaaccaaaaaaaaaactcgaaagggg

SEQ ID NO: 572 - DNA, 1339 bp, Zea mays
cctgataacttcaaatttacggagtcagcattgattctgctgcttcttgcatggaactgattggctcaagttgttctctacgtcctcaatgtttcttcattttggtcttttccaactcttttatggctggtctacatctactgatgtacgtgaaaaatgttgtcatgctgctgaattctttcgatgttgtgtgtactataggtgtaatttggtacaaattcaaagaaattcatgagttagcctcttttttccctttcgcataaaaagatttagccctttgcagctttgcttacggactaaacgcagccgagccactgagcgctcggccccacataatctaaatgttccgtagacccagtccacgtctcgcaacagataagcccctttcactcgtctttctacttcgtgcggactccgttcgtccctcccagtcccagcgcgcaacccaacccgccgttcctccgcctcctcccgcacagcaaaatggagacctccttcctccccaccacgctccccaccgcaaagcccctcccggcattccgaacccacgctgtagccgcatcgaaacttccccaacagcgccctcgccgctgcaccatacgcgcggccatcacccgtggccgcaaggaggagacggtgaccaccgtccgggagcagctggagggctgctacctcctggctggtatcaagtacgagggcctgacggtgaagcagctgcagggaatccgcgacgcgctcccagagacctgcagactgctggtggcgaagaacactctggtggggaaagccatcgagggcaccccctgggaagcgctcaagccgtgcatgaagggtatgaatgcctggctcttcgtccacaccgaggaggtaccagccgcgctcaagccctaccgcgccttccagaaagaggagcgcgtcgaggagaccaacgacttcgtcggggccgtctttgagggcaagttttacgggcccggagacttcaaggcgctcgagactatgcccagccgcgccgaggtgtacgccacgctgctcggcgcgctgcagggacccgctacgtcgctcgtcgccacgctgcaggcgccagccagggatgtcgttgcggtgctctccgcgtacgtacgcaagctcgaagaggaggctggagccgcctagtggggttgtgaaatggttgtcatctccctttcactccctactttctgtttgtagaattctgtgtaccttaactggctcccagtcacatttgaattgaatcacactttccagtttaaaaaaaaaaaaaaaaaaaagcggccctaaacccggtacattcgtgcttcttaccggttctttctaccatggc

SEQ ID NO: 573 - DNA, 1474 bp, Zea mays
gccggccgggccggcgcgccccgcccggccggcgtccgttcgtccctcccagcggagaagcgcccaacccaacccgccgttcctcctccaaagcgccctcctgccccgcaaaatggagacctccttcctgcccaccacactccccaacacaaggcctctccccgcgctccgaacctacgccccagccgcctcgatccttccccaacagcgccctcgtcgctccaccatacgcgcagccatcacccggggccggaaggaggagacggtgaccaccgtccgggagcaactggaggggtgctacctcctggcgggtatcaagtacgagggcctgacggtgaagcagctgcagggaatccgcgacgcgctccccgacacctgcaggctgctggtggcgaagaacacgctggtggggaaagccatcgagggtaccccctgggaggcgctcaagccgtgcatgaagggtatgaatgcctggctcttcgtccacactgaggaggtacccgccgcgctcaagccctaccgcgccttccagaaggaggagcgtgtcgaggagaccaacgacttcgtcggcgccgtcttcgagggcaagttttacgggcccggcgacttcaaggcgctcgagactatgcccagccgcgcagaggtgtacgccacgctgctcggcgcgctgcagggacccgctacgtccctcgtcgccacgctgcaggcgccagccagagatgttgttgcggtgctctccgcctacgtgcgcaagctcgaggaggaggctggagccgcctagtggtgttgcgaaatggttgtcatttccctctcactccctatctgctgtttgtacaattctgtgtacctttactggcacccaatcacatttgaatgggtcaaatcacagctttccattttacaatgcctgcccttacctggaaaaaaaaaaaaaaaaaagccgcggccaaaaaaccaaaaaaaaaaaaaaaaaaggcccctgaaaaaaaaaaaaaaaaaaaaaaaaaaaaaaaaaaaaaaaaaaaaaaaaaaaaaaaaaaaaaaaaaaaaggggagggggggggggggcgcccgatttaaggttcacgtgcaggggagggggaaaggcaattttttgttgttccgaaaattgaattcaaagtcccttggctgtgccattcctttgacgggaaaaggaaaggggaatacccctgcttaatcccatttgtaatacgccccccctctctccttccctgggggagaagggaaaaaaaaaaggacccagccccctctcccccttccctttcccctcctttaatgggaaaggggaaagggcccccggccccggcccccttaaccctccccgtggggggggggggggggtggtaaggataaaccgtaaaccttatatcatttcccctttagcccccccccttccttttccttttttctttttttttttttttttccctttcttttcgcccgcggttttgcc

SEQ ID NO: 574 - DNA, 3139 bp, Zea mays
gtgggcatattttaaattctatgatacattttttatcctcctgttcttaataattttaatgtggcttgcttaatgaatgttataattcaggtacagcacacaatgactttgtagatactgttactgccaatacattttcttctaatgatatgcgggcgtcagaggtcacagccaactctggtagtggtgcaatttattctggtattgttcaacaagatgatgataataagaagtcagatccactgatgaaagtcgaggcgcttcaaatcaagtttctgcggttagtatacaggactggagtgtctcccagtgctgatgtagttgcacaggttctgtacagattgcagcttgcaaatttgattaaagccagtgaatcagatgcaaggagaacaaacctagctatcaacaaagctagggttatagcagcacagcaggaagcaccgggtgggcctgatctggatgtctcaatgcaaatccttcttctggggaagtctggtgtgggaaagagtgccacaataaattcaatttttgatgagaggaaggttgctactgatgctctggttcctgctactcataggataaagaaaattgaaggaacaattaaaggaataagagtcacagtcatcgacacacctggcctggtgtctcattaccatggccaaaggaggaacatgaagattctgaattctgtcaagcacttcattaagcgatccccacctgatatcatcttatactttgagcgtttggaccatattaacagcagatacagtgattacccactgctgaagcttatgactgacatattggggtctccaatgtggttcaatactgtccttgtaatgactcactgttcctcatctcctcctgaaggaccagatggttacccattggaatatgatacttatacgcgttactgcaagaatgtggtgcagcgtcacatccaggctgcagtttccaacacgcagttggataatccatttgtgctcatagacaatcatccaatgtgcagacgaaacaccaagggtgaaagggttttaccaaatgggcaggtatgggtatcagaactgctgctgctgtgtggggcaaccaagttgctgacagaagcaaattccttgcttaagtttcaagatagcttcctactgtcacaagcaaacaccaggctgccttcgctgcctcatcttctttcttcacttcttaagcctcactcttcatccagttcagatgccattgacagtcaattgacagaaatgtcagatgaggaggatgaatatgatcaactaccacccttccgcattctaaagaaatctgaatatgaaaatttgaccaatgaacagaagtctgcatatcttgacgaactggactaccgtgagactttgtacctaaagaaacagtggaaagaaggaatcagaaggaaaaagcttactgaagctcagagtgatgaagttggtgatgattatgatgagagtgcatccccagagattgtgcacatgtcagatatggacattccactaagttttgactctgattatcctgtgcatcgttaccgtcacattataactgatgatcagttgtttagaccagttttggatccccaaggatgggaccatgatattgggttcgatgccatcaattttgaagcatctcaagagttgaaaaagaatgtctctgcggcaattacaggacagatgagaaaggacaaggaagacatgtatatccattcagaatgttcagtaagttacaatgctcagagaggctgctccttgatggggggtatggatatgcagacggcaagcaaagatttggtctgtactgttcatggggatgccaagttccacaatctgccttggaacagtattggaggtggcatttctgttactaagtttggcaacaagtactttgctggggctaagttagaagactctgttaccattgggagacgagttaaactggtagccaacgccggtaggatgtctggctgtgggcaggtggcacatggaggtggtgtggagattacagcaagggggaaagattaccctgtgagggaagggagtgtcactgccgcggtctctgctttgtcatttgaaaaggaaaccgtaattggggccaaccttcagtcagacttccgagtgggccgtggatcaaaaatatcagtcagcgctaacctaaatagtagaaatttgggcaatctcagcgtcagaactagcacatcagaccacgctgagatagctttgataacagttgtctccttgatccagttcattcttaggagaagatcagcagcagataataaagatgagcaacagattggcaccaatttggatgactaaataacaggtacaaggaaaagacaatgattgcatgctttagatgctcatcgtcatcaggatttgctgcaattatgttaacctaaggcgcctgtcaatctagagttccaatttgtacagaattcttgtatatcaattatgagtataaataatgtatgaaggaggcattttccatgagaagagctccttctgcccataagcgatttttttaggttttaaggatgtaatcagacgccgttttgagttttaacatcacacaaagtttatttagttcaaaaaaaaaaaagaaaaagctcgcgacttaccaagcttctgttttccaattttaaaaggtctcagtgatgagatttcactgctcagagacggatacaacctttatctgtataaatgaggaaactataacatcacatggtttttgttttgcaatagaagtatcatatagttgattcttggtttccatcagtgttcttatggtggtaaggcgagcaagcaaatgggatcaccgccttagcgcctaggcaacgtctatgcgggcaagacaccaagtattctctgagcgcctgaacgcctaggcgatgccttaagaacattggtttccatacaaggtgtgaaaacaatggagagcatgcttatgaaggaaaaagacctttgattctttgaagtccatgtgttggtgtagtgattgtcacctcattcggaccacataaacctatttactttataacttgtgtcgtctcaaattcaaactccacttgccaaaaaaaaaacccaaaaactttgttaagtacaatttggtcttataacttagctttttg

SEQ ID NO: 575 - DNA, 837 bp, Zea mays
cattgggtacctcgaggccggccggggtcccagttcccattcggtcactcggaccggacatggcgatgagtttcttctcgcccactaccaccccttcatccgccgcatccctcctccccatccgccgccagtgtgccaccggcccctccgtgtccttccccctcaagccccaccgcttccgagttcatctcaaacctccgcgctcctcccgaatccgacaccctctccacctcctccttgaagatccccaccgagagcattctctcttccgtggtctccacctcgaggaccctcctttttgtgctcgtcgcaggcctcctctccctctccggcgtccgctcactccccgccctcgcctgcgctccggcgccgacccagcaaccgcaagaaaccgaagaacaagaatccaaagagaagaagcagcaagaagaggctggtgagaggaaagaggacgtgctgccgcagctggatgaagaggacgaggaggatgacgaggtgcggatgtattcggcgattctgagccgcaactctggcgacgtggacgcgctcaagtgcgctctatacgctaagatgaggcgcgcggattggggcggggcgctgcggtacgcgcgacggctgcgcgacgccgagcccagcgagttggagtggcgcctgatggtggcgcagctgcacgagctcaagggggacctcgccgaggctgagcgtcacttcagggagctcctggcagaggagcccctcctcgttcgggctctccatggacttgcactgtgtatgcagaagaaacactgagggccctgctgtttttgaatgcttgagatggctttgcagcttgcaact

SEQ ID NO: 576 - DNA, 1891 bp, Zea mays
cattgggtacctcgccgcccgccggccccaattcggttactcttactcggaccggacatggcgatgagtttcttctcgcccactaccaccccttcatcctccgcatccctcctccccacccgccgccagtgtgccaccggcccctccgtgtccttccccctcaagccccaccgcttccgagttcatctcaaacctctgcgctcctcccgaatccgcaccctctccacctcctccttgaagatccccaccgagagcattctctcttccgtggtctccacctcgaggaccctcctttttgtgctcgtcgcaggcctcctctccctctccggcgtccgctcactccccgccctcgcctgcgctccggcgccgacccagcaaccgcaagaaaccgaagaacaagaatccaaagagaagaagcagcaagaagaggctgatgagaggaaagaggacgtgttgccgcagctggatgaagaggacgaggaggatgacgaggtgcggatgtattcggcgattctgagccgcaactctggcgacgtggacgcgctcaagtgcgctctatacgctaagatgaggcgcgcagattggggcggggcgctgcggtacgcgcgacggctgcgcgatgccgagcccagcgagttggagtggcgcctgatggtggcgcagctgcacgagctcaagggggacctcgccgaggctgagcgtcacttcagggagctcctggcagaggagcccctcctcgttcgggctctccatggacttgcactgtgtatgcagaagaaacctgagggccctgctgtttttgaaatgcttgagaatgctttgcagcttgcaacttcagagagaagggtcccggaggagcgcaacataaagcttttgatcgcacaaatgcatgttgtcatgggtcagttagatgttgcgtctgagaaactacaaaatcttataaatgaggatcctcgggattttcggtctcatctttgccagggcattgtgtatgcacttttagacagaaaagaagacgcagatatgcagtttgatgtatacagaagccttgtgccggatgaattcccagataagagttttatcagtgatgttatactggcggctaggacggagtcacatgatcggctacaaaaggaatttgactctgagtttcaagcgaagaaatgatacattaagttttgtatagatgaggcccaaatactcctggtaggctaaatggttgcatggtaccaatcttacaaatgaaacataacacagtaaaagcatagtgaaaagaggcgtctcttatcaggctatcaccaattttcctcatttcctctccctcttagtctctgcagacatttctcagtgaaatataatatagcgaagacaaaattctgcttgaagttaaaagctgtagtatccaaccagatggattgatttgttgatgttcaaatgtagaatttgtggagcttatgttccatcccttctttttgcgctggccctgcactccagcatcacacccagcatggataaccttagccgttgtcaccccattcgtcgtccccttatgcgaacctgggacttgagattccaggtaccaggatgatcttcaggtgacacgtgtcctcacgcagcagactacgacggcgcaagggtcggcacgcagtggtgcggatctgccactcccgccaaactccggtgagcaattcacatgccaccggaggatcttcttgcctggaacgtcttcggacatgcgcaggtactcttagtggccttttattcccccgagcagaggtagaatcaacggcgaaatctccaatcggtggtggcggcttcaactctcccccctggtttccatcctgcgcaccctggtagttctccgctcacggtggtacggccacgttccaat

SEQ ID NO: 577 - DNA, 1803 bp, Zea mays
tgatcgccgccgacaaataaccgccgacgcgttggcggaccgaaggtgaggtgcgtggcgaccgagaagcacgacgagacggcggcggtcggggcggcagtgggcgtggatttcgcggacgaggaggactaccgcaagggcggcggcggcgagctgctctacgtgcaaatgcagtcaaccaagcccatggaaagccagtccaagatcgcttccaagctatcgcccatatctgatgaaaatacagtgcttgatttggttatcattggttgtggtccagctggtctttctctagcttcagagtcggctaagaaaggtctcactgtaggtctcattgggcctgaccttccattcacaaataactatggtgtgtgggaggatgaatttaaagatctcggtctagagagctgtatcgagcatgtctggaaggatactattgtctacctagacaataacaagccgatactgattggccgttcttatggcagggtgcaccgtgacttgctccatgaggagctgctgaaaagatgctatgaagctggcgtgacatacctgaactccaaagtggacaagatcatagaatctccagatggacacagagtagtctgttgtgacaagggtcgcgagataatttgcaggcttgccattgttgcttcgggggcagcatctggtaggcttctagagtatgaggttgggggtccccgtgtttgcgtgcagactgcatacggagtagaagttgaggtggaaaataacccatatgatcctagcttaatggttttcatggactacagagattgtttcaaagaggaattctcacacattgaacaagaaaatcccactttcctgtatgctatgcccatgtcatccacacgagttttctttgaggaaacatgcttagcttctaaagatgctatgtcttttgatctacttaagaagaggctgatgtatcggttgaacgcgatgggaattcgtatcctgaaagtttatgaggaggaatggtcctacattcctgttggagggtccttaccaaacacagatcagaaaaaccttgcatttggtgctgcagcaagtatggtgcatcctgcaacagggtactcagtggtcagatctttgtctgaggctccaagatatgcttctgtgatatcggacatcttaggaaatcgagttcctgcagaatatatgctcggaaattcgcaaaattacagtccatcaatgcttgcatggagaacactgtggcctcaagagaggaaacgccaacgatccttcttccttttcggattagcgttgataatccaactgaataatgaaggcatacaaacattcttcgaagcctttttcagggtgccgagatggatgtggcgaggatttcttggctcgaccctttcatccgtcgatctcatactattctcattctacatgtttgcgatagccccaaatcaattgcgaatgaaccttgtcaggcatctcctctctgacccaactggctcatccatgatcaagacctacctgaccttataaaaccatttgcaccaggctgcaagcctgcaagaactcttagaaactgtacagttttgtagttgtacataagttagagaggatctggggggttacttggcggcggatctaggggttagcagcaatgctataatacactgtaaatcttttatggttgctatggtgattggatagagaagcacaccgtgttgtgcatgatggaagaataataagagagatcaggtgatggtcaatggttcctgcattggccaattttaggttgcatttgctgttttaaaaaaaaaaaaaaaa

SEQ ID NO: 578 - DNA, 2575 bp, Zea mays
tcggcccccctgcagggagcaccattctatttagtcaactctggcatactgtacactttgatcatatgcctggggcaggctgctttccatatgggcctgtactgcacatttgtaattcctctttgcaaggtcaaaattagaaaaggttacctgttctcagcttttcaaagttcaaaccagattttgttggcattgcaaaaaccaggaacagcaatatgaaggctaattgtcttacatgactattttcagtttccagagtgtctatccatcatgtgagccaaatgctgatggcaaacaattcttatctaacctccaaaagttcaaagaaaggcaagtacgtcaacaagctcttgcacaatatcaagcactggaggcttcaggctttgtggcaggcactagaggtcaaagggatgataccttccaacaactccatagcgatattcatggccacgctgaggccaccctgcctcctgtttataacttgagccccttgggattgcttgacacagaccaaagaatgcatccatatatcctggactggtattacacatgtcatccaccacactcggatagagctgagggcccccaatttgaccaagcattccctgagaccggtgtgagcacgagtccaccagcaagggaaacatctgaaattgaagaagtcggagactgggacaacgagttgtatgaaagggttcaaagtcatctgggggcatcaacatcaagtgctttgttctggaacactccagggaaggaccatggtacagaagaaaacactaacagcaattggtgggcacatgcccctgcatatccttctggtccccagggtagcttcatcgagcctccagattttggaaatcgatacatgacaaatcctcattccagtaatcacagtggcggtacatcggagggaagcacgtcggatctagagcagagcaatagcagaagcagaagttcctggaggagccctcaagcgttgtccaagacaagatatatggacgactctgatattgaggaagggctaagcctgcactttgctgatgtccatcagaaggatgaagacgatagacacctggtcagggatcatcaagatcccgcaccatctggtcttccagtaagaataatacctagaagcagtgaccctgtgtaagctggttaaactccacaggattatcacataaaaaaaaactccacaggattagttgatgcatgttaacggttgtattttgttgtttgaaccacatcaaaatcaaatgctgcgtctcgcccgtgaactggcaaaacagccacagattcttttgtacaggccagtaatgatagaaacattcttttacaagcgtgcttggtaggtgcaacacaagtcacaagtgctgtaaaacttggataaagtagcaattgctatcctttttcttttcctggcgtggcttctagtccgtcgtggaccccgagttttgcagacacggatcggctgcagggttccgttgccgggcatcctgttgccctaggcagttaggcaaacctctgcgcctctgtctttctgccatggagtttcctgttttagggcacaggaagccgttggcacggtaattctgctctcttaaagccatacaaagagcttccagccttagctttcttgtcgctctcgatatcgttgtccttccaaaacgaggccgttttggataggtgtgaaagtagatcttggtacgcacgcgacatgtgccaaactgtcgcagctatagaagcaggctgaggcagggctggtggtggtggggcagtatggctctggaattccagggcaggctggagagcgctggctgcagtggttgccaaggagcactccagcgtgtcctctcgccctgctgtcaacttggcgttgattaattgtgatggcggtcgtagccgcacaggcgcaccgaacccattcactgaactgaaggatggtttcccgcacgttttgctccccatggacggactccaccacaaccgcccgtagttttcgcggcttcaaaaccggcaacgaatgcaacggctcagcacagcacgaacatgctcttcccggacctgatctctcctccccatccctctcgcagcaacgggaggaaggagcccgcggcgagatggcggaaataggaattaggaaaaggttgggcggtcattttcctccctgtcgatctaccgaaaccgcagctgccccgaaagcaatggcgatccgcaccgcaccgcaccgcacgtctcgtgccaggtctggttggtccgattcgcggcagttgggcggtaggtcagcggtggttgcgggacgggctcttctcgtttcttgccgccaagggcggcgtgcatgagacccggttaataaactagcgacgtcggcgtcgacccttccgtcgtcacacctcacaaggaaaccacagcctgccaggccccggacaaccgagagccgagaggaggtcggcgaaagctcccgtgaaagcgtggcgccggccagagtattacgcgccgctgcatgcgtggatcttttcccggtttctcatcgaggggacagagctaggcgtgagcacatgtgtcactgcaggcatgc

SEQ ID NO: 579 - DNA, 7521 bp, Zea mays
ggtcttcaattgtgctgtctgggccacggaacgacaatgtcacagcttggattagccgcagctgcctcaaaggccttgccactactccctaatcgccagagaagttcagctgggactacattctcatcatcttcattatcgaggcccttaaacagaaggaaaagccgtactcgttcactccgtgatggcggagatggggtatcagatgccaaaaagcacagccagtctgttcgtcaaggtcttgctggcattatcgacctcccaagtgaggcaccttccgaagtggatatttcacatggatctgaggatcctagggggccaacagattcttatcaaatgaatgggattatcaatgaaacacataatggaagacatgcctcagtgtccaaggttgttgaattttgtgcggcactaggtggcaaaacaccaattcacagtatattagtggccaacaatggaatggcagcagcaaaatttatgaggagtgtccggacatgggctaatgatacttttggatctgagaaggcaattcaactcatagctatggcaactccggaagacatgaggataaatgcagaacacattagaattgctgaccaattcgtagaggtgcctggtggaacaaacaataataactacgccaatgttcaactcatagtggggatggcacaaaaactaggtgtttctgctgtttggcctggttggggtcatgcttctgagaatcctgaactgccagatgcattgaccgcaaaagggatcgtttttcttggcccacctgcatcatcaatgaatgctttgggagataaggtcggctcagctctcattgctcaagcagccggggtcccaactcttgcttggagtggatcacatgttgaagttccattagagtgctgcttagacgcgatacctgaggagatgtatagaaaagcttgcgttactaccacagaggaagcagttgcaagttgtcaagtggttggttatcctgccatgattaaggcatcctggggaggtggtggtaaaggaataagaaaggttcataatgatgatgaggttagagcgctgtttaagcaagtacaaggtgaagtccctggctccccaatatttgtcatgaggcttgcatcccagagtcggcatcttgaagttcagttgctttgtgatcaatatggtaatgtagcagcacttcacagtcgtgattgcagtgtgcaacggcgacaccagaagattattgaagaaggtccagttactgttgctcctcgtgagacagttaaagcacttgagcaggcagcaaggaggcttgctaaggctgtgggttatgttggtgctgctactgttgagtatctttacagcatggaaactggagactactattttctggaacttaatccccgactacaggttgagcatccagtcaccgagtggatagctgaagtgaatctgcctgcagctcaagttgctgttggaatgggcatacctctttggcagattccagaaatcagacgtttctatggaatggactatggaggagggtatgacatttggaggaaaacagcagctcttgctacaccatttaattttgatgaagtagattctcaatggccaaagggccattgtgtagcagttagaattactagtgaggacccagatgatggtttcaaacctactggtgggaaagtgaaggagataagttttaaaagcaagcctaatgtttgggcctacttctcagtaaagtctggtggaggcattcatgaatttgctgattctcagttcggacatgtttttgcatatgggctctctagatcagcagcaataacaaacatgactcttgcattaaaagagattcaaattcgtggagaaattcattcaaatgttgattacacagttgacctcttaaatgcttcagactttagagaaaacaagattcatactggttggctcgacaccagaatagctatgcgtgttcaagctgagaggcccccatggtatatttcagtggttggaggtgctttatataaaacagtaaccaccaatgcagccactgtttctgaatatgttagttatctcaccaagggccagattccaccaaagcatatatcccttgtcaattctacagttaatttgaatatagaagggagcaaatacacaattgaaactgtaaggactggacatggtagctacaggttgagaatgaatgattcaacagttgaagcgaatgtacaatctttatgtgatggtggcctcttaatgcagttggatggaaacagccatgtaatttatgcagaagaagaagctggtggtacacggcttcagattgatggaaagacatgtttattgcagaatgaccatgatccatcaaagttattagctgagacaccctgcaaacttcttcgtttcttggttgctgatggtgctcatgttgatgcggatgtaccatacgcggaagttgaggttatgaagatgtgcatgcctctcttgtcacctgcttctggtgtcattcattgtatgatgtctgagggccaggcattgcaggctggtgatcttatagcaaggttggatcttgatgacccttctgctgtgaaaagagctgagccatttgatggaatatttccacaaatggagctccctgttgctgtctctagtcaagtacacaaaagatatgctgcaagtttgaatgctgctcgaatggtccttgcaggatatgagcacaatattaatgaagtcgttcaagatttggtatgctgcctggacaaccctgagcttcctttcctacagtgggatgaacttatgtctgttctagcaacgaggcttccaagaaatctcaagagtgagttagaggataaatacaaggaatacaagttgaatttttaccatggaaaaaacgaggactttccatccaagttgctaagagacatcattgaggaaaatctttcttatggttcagagaaggaaaaggctacaaatgagaggcttgttgagcctcttatgaacctactgaagtcatatgagggtgggagagagagccatgcacattttgttgtcaagtctcttttcgaggagtatcttacagtggaagaactttttagtgatggcattcagtctgacgtgattgaaacattgcggcatcagcacagtaaagacctgcagaaggttgtagacattgtgttgtctcaccagggtgtgaggaacaaagctaagcttgtaacggcacttatggaaaagctggtttatccaaatcctggtggttacagggatctgttagttcgcttttcttccctcaatcataaaagatattataagttggcccttaaagcaagtgaacttcttgaacaaaccaaactaagtgaactccgtgcaagcgttgcaagaagcctttcggatctggggatgcataagggagaaatgagtattaaggataacatggaagatttagtctctgccccattacctgttgaagatgctctgatttctttgtttgattacagtgatcgaactgttcagcagaaagtgattgagacatacatatcacgattgtaccagcctcatcttgtaaaggatagcatccaaatgaaattcaaggaatctggtgctattactttttgggaattttatgaagggcatgttgatactagaaatggacatggggctattattggtgggaagcgatggggtgccatggtcgttctcaaatcacttgaatctgcgtcaacagccattgtggctgcattaaaggattcggcacagttcaacagctctgagggcaacatgatgcacattgcattattgagtgctgaaaatgaaagtaatataagtggaataagcagtgatgatcaagctcaacataagatggaaaagcttagcaagatactgaaggatactagcgttgcaagtgatctccaagctgctggtttgaaggttataagttgcattgttcaaagagatgaagctcgcatgccaatgcgccacacattcctctggttggatgacaagagttgttatgaagaagagcagattctccggcatgtggagcctcccctctctacacttcttgaattggataagttgaaggtgaaaggatacaatgaaatgaagtatactccttcgcgtgaccgccaatggcatatctacacactaagaaatactgaaaaccccaaaatgttgcatagggtgtttttccgaactattgtcaggcaacccaatgcaggcaacaagtttacatcggctcagatcagcgacgctgaagtaggatgtcccgaagaatctctttcatttacatcaaatagcatcttaagatcattgatgactgctattgaagaattagagcttcatgcaattaggacaggtcattctcacatgtatttgtgcatactgaaagagcaaaagcttcttgacctcattccattttcagggagtacaattgttgatgttggccaagatgaagctaccgcttgttcacttttaaaatcaatggctttgaagatacatgagcttgttggtgcaaggatgcatcatctgtctgtatgccagtgggaggtgaaactcaagttggactgtgatggccctgcaagtggtacctggagagttgtaactacaaatgttactggtcacacctgcaccattgatatataccgagaagtggaggaaatagaatcgcagaagttagtgtaccattcagccacttcgtcagctggaccattgcatggtgttgcactgaataatccatatcaacctttgagtgtgattgatctaaagcgctgctctgctaggaacaacagaacaacatattgctatgattttccgctggcctttgaaactgcactgcagaagtcatggcagtccaatggctctactgtttctgaaggcaatgaaaatagtaaatcctacgtgaaggcaactgagctagtgtttgctgaaaaacatgggtcctggggcactcctataattccgatggaacgccctgctgggctcaacgacattggtatggtcgcttggatcatggagatgtcaacacctgaatttcccaatggcaggcagattattgttgtagcaaatgatatcactttcagagctggatcatttggcccaagggaagatgcattttttgaaactgtcactaacctggcttgcgaaaggaaacttcctcttatatacttggcagcaaactctggtgctaggattggcatagctgatgaagtaaaatcttgcttccgtgttggatggtctgacgaaggcagtcctgaacgagggtttcagtacatctatctgactgaagaagactatgctcgcattagctcttctgttatagcacataagctggagctagatagtggtgaaattaggtggattattgactctgttgtgggcaaggaggatgggcttggtgtcgagaacatacatggaagtgctgctattgccagtgcttattctagggcatatgaggagacatttacacttacatttgtgactgggcggactgtaggaataggagcttatcttgctcgacttggtatacggtgcatacagcgtcttgaccagcctattattttaacagggttttctgccctgaacaagctccttgggcgggaagtgtacagctcccacatgcagcttggtggtcctaagatcatggcgaccaatggtgttgtccacctcactgttccagatgaccttgaaggtgtttccaatatattgaggtggctcagctatgttcctgcaaacattggtggacctcttcctattaccaaacctctggaccctccagacagacctgttgcttacatccctgagaacacatgcgatccacgtgcagctatctgtggtgtagatgacagccaagggaaatggttgggtggtatgtttgacaaagacagctttgtggagacatttgaaggatgggcaaaaacagtggttactggcagagcaaagcttggaggaattcctgtgggcgtcatagctgtggagacacagaccatgatgcagatcatccctgctgatccaggtcagcttgattcccatgagcgatctgtccctcgtgctggacaagtgtggttcccagattctgcaaccaagaccgctcaggcattattagacttcaaccgtgaaggattgcctctgttcatcctggctaattggagaggcttctctggtggacaaagagatctctttgaaggaattcttcaggctgggtcaacaattgtcgagaaccttaggacatataatcagcctgcttttgtgtacattcctatggctggagagcttcgtggaggagcttgggttgtggtcgatagcaaaataaatccagaccgcattgagtgttatgctgaaaggactgccaaaggtaatgttctcgaacctcaagggttaattgaaatcaagttcaggtcagaggaactccaagactgtatgggtaggcttgacccagagttgataaatctgaaagcaaaactccaagatgtaaatcatggaaatggaagtctaccagacatagaagggattcggaagagtatagaagcacgtacgaaacagttgctgcctttatatacccagattgcaatacggtttgctgaattgcatgatacttccctaagaatggcagctaaaggtgtgattaagaaagttgtagactgggaagaatcacgctcgttcttctataaaaggctacggaggaggatcgcagaagatgttcttgcaaaagaaataaggcagatagtcggtgataaatttacgcaccaattagcaatggagctcatcaaggaatggtaccttgcttctcaggccacaacaggaagcactggatgggatgacgatgatgcttttgttgcctggaaggacagtcctgaaaactacaaggggcatatccaaaagcttagggctcaaaaagtgtctcattcgctctctgatcttgctgactccagttcagatctgcaagcattctcgcagggtctttctacgctattagataagatggatccctctcagagagcgaagtttgttcaggaagtcaagaaggtccttgattgatgataccaacacatccaacacaatgtgtgcatgtcacatctttttgttctagtacatacatagaaggatattgcttggtcttgattgatcatgtctgatttaagtcgactattatttcttggaattttcttttggacctggtgctatggttgatggatgtatattggatatgtgcgttctgccaggtgtaagcacaaaggtttagacagaccgagagcaagagcgagtgaacctgttctggttttgcagtggttcagtaaggcagaaagttgttaaaccgtagttctgagatgtattaccagtggcgccatgctgtacttttagggtgtataatgcggatacaaataaacaatttagcggttcattaaagtttgaactcaaataacatgttctttgtaagcatatgtaccgtacctctacgtgaaataaagttgttgaattagcattcgaaaaaaaaaaaaaaaaaaaaaaaaaaaaaaaaaaagagaggcccagaacccgacccac

SEQ ID NO: 580 - DNA, 5870 bp, Zea mays
attgtgtagcagttagaattactagtgaggacccagatgatggtttcaaacctactggcgggaaagtgaaggagataagttttaaaagcaagcctaatgtttgggcctacttctcagtaaagtctggtggaggcattcatgaatttgctgattctcagtttggacatgtttttgcatatggactctctagaccagcagctataacaaacatgtctcttgcattaaaagggattcagattcgtggagaaattcattcaaatgttgattacacagttgacctcttaaacgcttcagacttcagagaaaacaagatccacactggttggctggatacaagaatagctatgcgtgttcaagctgagaggcccccatggtatatctcagtggttggaggtgctttatataaaacagtaaccaccaatgcagccactgtttctgaatatgttagttatctcaccaaaggccagattccaccaaagcatatatcccttgtcaattcaacagttaatttgaatatagaagggagcaaatacacaattgaaactgtcaggactgggcatggtaggtacaagttgcgaatgaatgattcaacagttgaggcgaatgtacaatctttatgtgatggtggcctcttaatgcagttggatggaaacagccatgtgatttatgcagaagaagaagctggcggtacacggcttcagattaatggaaagacatgcttgttgcagaatgaccatgatccatcaaagttattagctgagactccctgcaaacttcttcgctttttggttgctgatggtgctcatgttggtgcggatgtgccatatgcggaagttgaggttatgaagatgtgcatgcctctcttgtcacctgcttctggtgtcattcattgtatgatgtctgagggccaggcgttgcaggctggtgatcttatagcaaggctggatcttgatgacccttctgctgtgaaaagagctgaaccatttgatggaatgtttccactaatggacctccctgttgctgcctctagtcaagtacacaaaagatatgctgcaagtttgaatgctgctcgaatggtccttgcaggatatgagcacaatatcaatgaagtcgttcaagatttggtatgctgcctggacaatcctgagcttccttttctacagtgggatgaactaatgtctgttctagcaacgaggcttccaagaaatctcaagagtgagttagaggataaatacaaggaatacaagttgaatttttaccatgggaaaaacaaggacttcccatccaagttgctaagagacatcgtcgaggaaaatcttgcatatggttcagagaaggaaaaggctacaaatgagcgacttgttgagcctcttatgaacctactgaagtcatatgagggtgggagagaaagccatgcacattttgttgtcaagtctctttttgaggagtatcttaccgtggaagaacttttcagtgatggcattcagtctgacgtgattgaaaccttgcgtcatcagcacagtaaagacctgcagaaggttgtagacatcgtgctgtctcaccagggtgtgaggaacaaagctaagcttgtaacagcacttatggaaaagctggtttatccaaatcctggtgcgtacagggatctgttggttcgcttttcgtccctcaatcataaaagatattataagttggcccttaaagcaagtgaacttcttgaacaaaccaaactaagtgaactctgttccagcattgcaagaagcctttcagatctggggatgcataagggagaaatgactattaaggatagcatggaagatttagtctctgccccattgcctgttgaagatgctcttatttctttgtttgattacagtgatccaactgttcagcagaaagtgattgtgacatacatatcacgattgtaccagcctcatcttgtaaaggatagcatccaaatgaaattcaaggaatctggtgctattactttttgggaattttatgaagggcatgttgatactagaaatggacatggggctattattggtgggaagcgatggggtgccatggtcgttctcaaatcacttgaatctgcgtcaacagccattgtggctgcattaaaggattcggcacagttcaacagctctgagggcaacacaatgcacattgtgttattgaacgctgaaactgaaagtaatatatgtgggacaagtgatgaccaagctcaacataggatggaaaagcttaccaagatactgaaggatagtagtgttgcaagtgatctccaagctgctggtttgaaggttataagttgcattgttcaaagagatgcaggtcgcatgccaatgcgccacacattcctctggtttgatgaaaagaactgttatgaagaagagcatattctccggcatgtggagcctcccctctctgcacttcttgaattgggtaagttgaaagtgaaaggatacaacgaaatgaagtatactccatcacgtgatcgtcaatggcatatctacacactaagaaatactgaaaaccccaaaatgttgcatagggtatttttccgaactattgtcaggcaacccaatgcaggcaacaagtttacgtcggcacaggtcagcgacactggattaggatgtcctgaagaatctctgtcatttacatcgaatagcatcttaagatcactgatgactgctatagaagaattagagcttcatgcgattaggacaggtcattctcacatgtttttgtgcatactgaaagaacaaaagcttcttgatctcgtcccattttcagggagtacaattgttgacgttggccaagatgaagctactgcttgttcacttttaagatcaatggctttgaagatacatgaacttgttggtgcaaggatgcatcatctttctgtatgccagtgggaggtgaaactcaagttggactggcgtggtcccgcccgtggtacctggagagtcgtaactacaaatgtcactagtcacacctgcaccattgatatctaccgagaagtggaagatacagaatcgcagaagttactataccattcagctacttcgtcagctggtccaatgcatggtgttgcactgaataatccttatcaacctttgagtgtgattgatctaaagcgctgctctgctaggaacaacagaacaacatattgctacgattttccgctggcatttgaaactgcactgcagaagtcatggcaatccaactgttctagtgttcctgaaggcagtgaaaatagtaaatcctacgtgaaatcaactgagctggtgtttgctgaaaaacatgggtcctggggcactcctataattcccatggaacgtcctgctgggctcaatgacattggtatggtcgcttggatcttggaaatgtcaacacctgaatttcccaatggcaggcagattattgttgtagcaaatgatattactttcagagctggatcattcggcccaagggaagatgcattttttgaagctgtcaccaacctggcttgcgaaaggaagcttccccttatatacttggcagcaaactctggtgctaggattggcatagctgatgaagtgaaatcttgcttccgtgttgggtggtctgatgaacgcagccctgaacgagggtttcagtacatctatctgactgaagaagactatgctcgtattagctcttctgttatagcacataagctgcagctagataatggtgaaattaggtggattattgactctgttgtgggcaaggaggatgggcttggtgttgagaacatacatggaagtgctgctattgccagtgcttattctagggcatatgaggagacatttacacttacatttgtgactgggcggactgtaggaataggagcctatcttgctcgacttggtatacggtgcatacagcgccttgaccagcctattattttaacagggttttctgccctgaacaagctccttgggcgagaagtgtacagctcccacatgcagctgggtggtcctaagatcatggcgaccaatggtgttgtccacttgaccgtttcagatgatcttgaaggtgtttccaatatattgaggtggctcagctatgttcctgcaaacattggtggacctcttcctattaccaaacctttggaccctccagatagacctgtcgcatacatccctgagaacacatgcgatccgcgtgcagccatccgtggtgtagatgacagccaagggaaatggttgggtggtatgtttgacaaagacagctttgtggagacatttgaaggatgggcaaaaacagtggttactggcagagcaaagcttggaggaattcctgtgggtgttatagctgtggagacacagaccatgatgcagctcatccctgctgatccaggtcaacttgattcccatgagcgatctgttcctcgggctggacaagtgtggttcccagattctgcaaccaagacagctcaggcattattagacttcaaccgtgaaggattgcctctgttcatcctggctaactggagaggcttttctgggggacagagagatctctttgaaggtattcttcaggctgggtcagcaattgttgagaaccttaggacatataatcagcctgcgtttgtctacattcctatggctggagagcttcgtggaggagcttgggttgtgatcgatagcaaaataaatccagaccgcattgagtgttatgctgagaggactgccaaaggtaatgtgctcgaacctcaagggttaattgaaattaagttcaggtcagaggaactccaagactgtatgggcaggcttgacccagagttgataaatctgaaagcaaaacttcaagatgcaaagcatggaaatggaagtctaccagacatagaatcgcttcagaagagtatagaagcgcgtacaaaacagttgttacctttatatacccagattgcagtacgctttgctgaattgcatgatacttccctgagaatggcagctaaaggcgtgattaagaaagttgtagactgggaagaatcacgctctttcttctataaaaggctacggaggaggatctctgaagatcttcttgcaaaagaaataagacgaataattggtgacaacttcacgcaccaatcggcgatggagcttatcaatgaatggtacctggcttctcaggccacaacaggaagcactgctggatgggatgatgatgatgcttttgttgcctggaaggacagtcctgaaaactacaagggatatatccaagagctaagggctcaaaaagtatctcagtcgctctctgatcttgctgactccagttcagatctacaagcattctcgcagggtctttctacactattagataagatggatccttctcagagagtgaagtttgttcaggaagtcaagaaggttcttggatgatgatatgataccaacacatccaacacaatatgcgcatgctacatgttatttttcaagtacatacatagaaggatattgcttggccttgattgatcatgtctgatctaagtcgatcattattttcttgaaacttcctttcggacgtggtgctatggttgatgaatttggatgtgtgcgttctgccaggtgtaagcccaaaggtttatacagaccgagttaaggttaggaagagcacgagtgaacttgttctggttttgcagtggttaaggcagaaagttgtttcactgtagttctgagatgtattaccagcggcgctgtaattttagggtgtataatgcggatgctagtaaacaattgagtggttcattaaattttgaactcgaataatatgtttctgtaggcacatgtgacgtaccactacatgaaataaatgtcgctgaactagggcaccagagttttggt

SEQ ID NO: 581 - DNA, 826 bp, Zea mays
  misc_feature (15)..(32): n is a, c, g, or t
ttttttttttttttnnnnnnnnnnnnnnnnnnaaatcagcaatccttgatgaccacacacagcaaggttttcacatcataccgcaaaaaaacactccaaatagttaaataacactgttaggtccacaatggcgatagttactcctcaaagcaccatgttacctttagtcttccattcaagacactagcaacaactatgcgaatgtgcagcttggatccctagtagggcgaagttctcagaccaacgcgggatactgcttcgcctgcagtttaacacgcctcttatattctgtaggatcctggataaaaaggtgatagccatccgtttgagcaggatcagcaggatttggctgatctagcaagtcctggatcccgacgagaatctgcttaacagtaatagctggtctccaaccactatcttcattaaggatcgaaagacagactgttccagaaggatagacatttgggtggaagaaaccctgagggaacttgcacttgggaggcttgctagggtaatcctcactgaaatgaagggtgagtgggaagtatccaccttcccaatcagtcccttgcttgccggggatggtgcagtgccaaatcataaggttcaccgtcccgtcgggcagcgactccggctttgcgacgaaaccgtgcgggtggttcttgcgccaggccttgcgctcctcggcaaggcggccgcgggcgattcccccagacatggaagcggtggcggcggcggcgacctcttcttcctcggctcgcccccgctgtagagtttgaggactggacctttttttttttctacgggttggcgcaaataaactttt

SEQ ID NO: 582 - DNA, 880 bp, Zea mays
  misc_feature (6)..(6): n is a, c, g, or t
  misc_feature (18)..(18): n is a, c, g, or t
  misc_feature (30)..(30): n is a, c, g, or t
  misc_feature (43)..(43): n is a, c, g, or t
  misc_feature (48)..(48): n is a, c, g, or t
  misc_feature (63)..(63): n is a, c, g, or t
  misc_feature (78)..(78): n is a, c, g, or t
  misc_feature (80)..(80): n is a, c, g, or t
  misc_feature (108)..(108): n is a, c, g, or t
  misc_feature (110)..(110): n is a, c, g, or t
  misc_feature (138)..(138): n is a, c, g, or t
  misc_feature (150)..(150): n is a, c, g, or t
  misc_feature (185)..(185): n is a, c, g, or t
  misc_feature (212)..(212): n is a, c, g, or t
  misc_feature (222)..(222): n is a, c, g, or t
  misc_feature (243)..(243): n is a, c, g, or t
  misc_feature (255)..(255): n is a, c, g, or t
  misc_feature (262)..(263): n is a, c, g, or t
  misc_feature (277)..(277): n is a, c, g, or t
tttttnttttttttttgncagcaacacccngcaatttttaaancaagnccagaaggtttgaancatccggaaaacacnantccaaacagtaaaaaagttgttaaaagncnccagtccccaatgcgaaagtacttctcnaagcaccatgtnacattgggtctttcattcaagccactagcaacaantatgggaatgtgcagcatggatccccntagtagggcnaagctttcagaccaatgcagnatattgttcgcntgcagtnnaacgcgcctcttgnattctgtgggatcctggataaaaaggtgatatccgtctgtttgagcagggtcagcaggatttggctgatctagcaagtcctggatcccgacgagaatctgcttaacagtaatagctggtctccaaccactgtcctcattaagaatcgaaaggcagactgttccagaaggatacacatttgggtggaagaaaccctgagggaacttgcacttgggaggcttgctagggtaatcctcactaaaatgaagggtgagagggaaatatccaccttcccagtcagtcccttgcttgccggggatggtgcactgccagatcatcaggttcaccgtcccgtcgggcagcgactccggcttcgcgacgaaaccgtgcgggtggttcttgcgccaggccttgcgctcctcggcgaggcggccgcgggcgattcccccagacatggcggcggcggcggcggcggcggcggcggcggcgactcttcctcctctactcgcccccgctggggagtttggggactggtctttctagtttctacgctgctgcgcgaattgtgtgccgcttcgcccgttctaattccttgcctttttcgtgtttcttcccccgtattttc

SEQ ID NO: 583 - DNA, 1141 bp, Zea mays
  misc_feature (24)..(24): n is a, c, g, or t
  misc_feature (26)..(26): n is a, c, g, or t
tttttttttttttttttttttgcnanactcaaggtcaaagttgcacatcaaccaagaaatgaagctaacaatgcactctactcatgccaatgtttaagcatgttcaagtaggctacataatacagctcatctgaagcaagcaacagcggcgtgtgcggggtaatcatgtgcattggcgttaggaatgactgttgaatcaaaaaccacaggctaccttcccttcatatctgtcaaagtacagaaccaggagtgccctcagctgaaacgtcatgggcgtttcttcccatatttagatttgtcagacaacacacagcaattcttgataacaagacacagcaaggttttgacatcatcccgcaaatcacacactccaaacagttaataaggctgttaaaagacacacagtccacaatggcgatagttacttctccaagcaccatgttacatttggtctttcattcaagacactagcaacaactatgcggatgtgcagcatggatccctagtagggcgaagctctcagaccaatgcaggatactgcttcgcctgcagtctaacgcgcctcttgtattctgtgggatcctggataaaaaggtgatatccgtctgtttgagcagggtcagcaggatttggctgatctagcaagtcctggatcccgacgagaatctgcttaacagtaatagctggtctccaaccactgtcctcattaaggatcgaaaggcagactgttccagaaggatacacatttgggtggaagaaaccctgagggaacttgcacttgggaggcttgctagggtaatcctcactaaaatgaagggtgagagggaaatatccaccttcccagtcagtcccttgcttgccggggatggtgcactgccagatcatcaggttcaccgtcccgtcgggcagcgactccggcttcgcgacgaaaccgtgcgggtggttcttgcgccaggccttgcgctcctcggcgaggcggccgcgggcgattcccccagacatggcggcggctactcttcctcctctgctcgcccccgctctgcctcctctactcgcccccgctggggagtttggggactggtctttctagtttctacgctgctgcgcgaattgtgtgccgcttcgcccgttctaattcctt

SEQ ID NO: 584 - DNA, 878 bp, Zea mays
tagggcccttttttttttttttggggccagacttctctttgcttttcttgataacaagacacagcaaggttttgacatcatcccgcaaatcacacactccaaacagttaataaggctgttaaaagacacacagtccacaatggcgatagttacttctccaagcaccatgttacatttggtctttcattcaagacactagcaacaactatgcggatgtgcagcatggatccctagtagggcgaagctctcagaccaatgcaggatactgcttcgcctgcagtctaacgcgcctcttgtattctgtgggatcctggataaaaaggtgatatccgtctgtttgagcagggtcagcaggatttggctgatctagcaagtcctggatcccgacgagaatctgcttaacagtaatagctggtctccaaccactgtcctcattaaggatcgaaaggcagactgttccagaaggatacacatttgggtggaagaaaccctgagggaacttgcacttgggaggcttgctagggtaatcctcactaaaatgaagggtgagagggaaatatccaccctcccagtcagtcccttgcttgccggggatggtgcactgccagatcatcaggttcaccgtcccgtcgggcagcgactccggcttcgcgacgaaaccgtgcgggtggttcttgcgccaggccttgcgctcctcggcgaggcggccgcgggcgattcccccagacatggcggcggctactcttcctcctctgctcgcccccgctggggagtttggggactggactttctagtttctacgctgctggcgaattgtgtgccgcttcggccgttctaattccttgcctttttcgtgtttcttcccccgtattttcagc

SEQ ID NO: 585 - DNA, 2177 bp, Zea mays
  misc_feature (2160)..(2160): n is a, c, g, or t
  misc_feature (2170)..(2171): n is a, c, g, or t
tcgctttgcttccggacgggtgtcgccgagggcagccgccttttaaaacccccaccgatgtcccgggccgggaaagagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcggagaagaagcgccagaagcagcacgacgagaacgtgcagaaggtcgtgaagcggctcaagcagaggaacccgaagaaggacggtcttgtttgcacggccaggaagccctggatcgctgttggcatgcgcaacgtggactacaagcgtgcgaggcatttcgaggtcgacctttcttccttcaggaacatccttgagatcgacaaagagaggatggttgccaaggtcgagccccttgtcaacatgggtcagataaccagagctacctgcccaatgaaccttgcccttgcggtcgtcgccgagctcgacgacctcactgttggtgggctgatcaacggttacggcatcgaggggagctctcacctctatggccttttctccgacacggttgtcgcgatggaggttgttctcgcagatggccgggtcgtcagagccaccaaggacaacgagtactctgaccttttctatggcattccctggtcccagggaacactggggttccttgtctctgcggagatcaagctgatccccatcaaggagtacatgaagctcacctacactccagtcaaggggggtctaaaggagatcgcgcaggcctacgcggattctttcgcgccgagggacggtgacccggcaaaggtccctgactttgttgaagggatggtgtacacagagagcgagggtgtcatgatgacgggcgtgtacgcttccaaagaagaggcgaagaagaagggcaacaagatcaactgcgtggggtggtggtttaagccctggttctaccagcacgctcagacggcgctgaagaggggcgagtttgtggagtacatcccgacgagggagtactaccaccggcacacccggtgcctgtactgggaggggaagctgatcctgcccttcggcgaccagttctggttcaggttcctgctgggctggctgatgccaccgaaggtgtccctgctgaaggcgacccagggcgaggctatcaggaactactaccacgacaaccatgtgatccaggacatgctggtgccgctgtacaaggttggggatgcgctggagttcgtgcaccgcgagatggaggtgtatcctctgtggctgtgccctcaccggctgtacaagctgccggtgaagacgatggtgtacccggagcctgggttcgagcaccagcacaggcagggcgacacgagctacgcacagatgttcacggacgtgggcgtgtactacgcccccggggcggtgctgaggggggaggagttcaacggcgcggaggctgtgcacaggctggagcagtggctgatcgagaaccacagctaccagccgcagtacgcggtgtcggagctgaacgagaaggacttctggcgcatgttcgacgcgtcgcactacgagcactgccgccaaaagtacggggcggtgggcacgttcatgagcgtgtactacaagtccaagaaggggcgcaagacggagaaggaggtgcaggaggcggaggcggccatactggagccggcctacgcggacgaggaggcctaaaagctcgtggtcgttttgcttagcccattttaattagaacttgatggatgtagtgtgtgtctgtctcaagtcattttaattagaactcttaaagctcgtggtcggtcggtcagtcagtcagtcattgtcgttgatgtccagcgttgtgttttttttatattctctaatggaatctctcagattgattcgggaaaaaaaaaaaaaaaaaaaaaaaagaaaaaaaaaaaaaactcgaggggggggcccgggtacaaaaaaaaanaccccaaaannaaactt

SEQ ID NO: 586 - DNA, 1647 bp, Zea mays
gtcctgctcaaagattgccttctgcgtatgtcattcgaaacactgttcgtcgatgcgctgtcacgtcgtcctaagatcgccgatatcatccatatcccgctaaaaaaagggcacagcagactagatagatatatatattaggaaagaaaagcgcaacgcctgtgaagaaaaactgacttgctatgagcccatgacccaggggaggggacagcgcgacactttatgcctgtgccgctcacacgtggcccctaagcgacaagcatcgaatcctcccaaaatccggcacaacaccagcgccacatcgcctcgcgaatcatatggttccatttgttgccgccgagtccgcgctcctcggcccgtaccacgacctgaggagatagatatataggcggtggcaggcgctttaccgccccggacagaaatatctgaggacacgtaggagtaggactcgcccccacccccgaaccaccgacgaaggagacgaataaaagaaggcaaaccacacggccaccacacacacaggcaccgaacgaacaggacagcgagagaaagcaaagcgagctgctgcttccttatccggttcttcgccgtgagcgctccacagggaacggaacgggaactgggggatcgggatccttacgttgttgtgtgtattatcgagcaagctaagagccatgggcagcgagtgcaagggctacggcgtcggcgtcgccaccagcccgcagcaggagcaggagcaggctggcgccgccgtcgcaccgttcgtggccaagacgttccacatggtgagcgacccggccacggacgccgtcgtgcgctggggtggcgccagcaacaccttccacgtcctcgacccggccaccttctccgactacctgctgccctcctacttcaagcaccgcaacttcgccagcttcgtccggcagctcaacacctacgtgagtgatatgcgcgctacctcctcagctcctctgcccccgctccgctgtccgctcagcgctcactcaggactcagctaccactcctcctcgtgtgagtaacagctctcggcacgcatgcgtaccgttatttttttaacaggggttcaggaaggtggacacggaccggtgggagttcgcgcacgagtcgttcctgcggggccaggcgcgcctgctgccgctggtcgtgcgcaagaggaagaaggcgggcgccggcgccggcggcggcggccgggagctgtgcgaggccggggaggaggtgcgcgggaccatccgggccgtgcagcgcctgcgggagcagcagcgcggggtggaggacgagctgcgggccatggaccgccgcctgcgcgccgccgagagccggccggcccagatgatggcgttcctcgccaagctcgccgacgacccgggcctcgtgctgcgcgccatgctcgccaaggaggaggagctggccctgatcgacaaggggtcggaggcgcagccggccaagaggcggcggatcggggctgaagccgtggacctggcgcacagcaggggcgggggcgccgtgccgtttccgttctctgttctcggccaagtgttctactagggtagatagggactggtgtatatatgacttgcactgtattatagctttgcctcggtttcagcagttactgccttccgtttt

SEQ ID NO: 587 - DNA, 1992 bp, Zea mays
gcacgagaccatacctagaacatcctaatcgaaaaaactcgactcgggtccggcgctgagccgctgaccgtcgacccgaccttgccctggctcgcctcctccgctgcggcggtctggaagggatcactggatcgtagatcccactcggcaaacccaaacggccaaacctttgcttccattcagcacccccggcgagacgccactccaactgccgggatccagccgctgcacgcggcggccaccccgccctgccggccgaccaggggggttgagagcgggcgaggcggagatgcagagcgccacgcggctgacgctgctactgtgcgcggcgtgggcggccgcgctgctgtacggcgagatgggcgcctactgggtctcctacctcgcatgctcgtggccctcgtcgtcctcctcgccgccgaataaccatgtcaaggttgctgttgttgctgacccacagcttatggatagcacctcccttggtcttccatcaagctcagttgctctccaagctgctgagttttacacggatttgaacatgagaaggtccttccagtccaccatactgccattcaaacctgatgtggtcttatttcttggtgatcactttgatggaggcccttacatgcccgatgaagagtggcaggaatcattgtttcgatttaaacatatattcggcctgaatgatcaaagaacaaagcaacagatccctatctactaccttccaggaaatcatgatattggttactcagcatttcattcagtccatcctgaggtgctcagtcggtatgaaaaagaatttggatcaagaaattatcaattttctgctgggaaggtggacttcgttgttgttgatgcccaaacacttgatggagctaaacaaagcaaagaaaggtcctcctcttgggagttcattaaaactctatctccaggtaacacatcaaacccaaaggttctgctaacacatattccactataccgacctgataactctccttgtggcccgcatcgttcttcacctgttataaatcagagggtatcttatgccgccttagaccaaggaatcacctaccaaaattatctaactaaagagacttctgaccttttgctaagcttgttgaagccgatccttgtgctctcaggccatgatcatgaccaatgcacagttgtccactccactccttttgggccagttacagagcataccctggggacaataagttggcagcaaggaaatctctatccatcttttatgctgctatctgctggacccaagttatcacaaaattcaactgatctggaacatgaggttgcaatgaacctttgctttttgcctaaacaaacccatatttatatctggtatatctgccagtttgtagtgaccatccttctcctagtcttttggccaacaaatggtctcggttctcttccttgcatgaacacattcatgagcttcatgaggtcggtgggtgccgaactgctttcaaggaccaaggaaaaagatgacgaggacgatggtgattatgatatggtttttgatgcggaaggatccatgcacctcgttaaaaaggcagtggcaaagaccccaagtgctagctcagattccagacctactggacgcggaagtgttgttgcaagggcaacagcaggaagacaccgattggagcctgattcatcgattcgtgtcgacatgggttctgagatgacatcagaagatgggggaaagttggcccgcgctggcaaatcgggagcaaggaaggtgctccaacggctgttccgtgtcattcagtctgttcttgtcattgccgctctgaatgcccccttgtacatgatgcttctcttcaaggattggattgatcgttgaagtatgtgagaatctattgtttttcagtaactcagtagattgatatatcaatatgaacgactgcacatgctaaaaaataaagttcgtttttgccgaggcatcaaatagtatatatagtatctctattt

SEQ ID NO: 588 - DNA, 1799 bp, Zea mays
aaatctagtttgtgccatcatcgtgtagctatttctactgaccttggccatctcatttgtaggtgaaaatgttgaacctgctgagatcgaggaagcagccagcaggagtaccttgattaatcagatagttgtgatcgggcaggtaagcgatactgtaatagttactacactcaaatcagaccactttatatgtgttggcagatatatttttttctcgatgcaactagggtaaatatttctctaagggcttgtttgggcaaggaaaacagaggggattggaggggttaaaatcattttgctattcaattttgaatagcaaggaaattttagcctttccaatgatctccattccactggctcccaaacatgcaaaggaaaaaaaaacatgccgttatctgaaactgtggtgttatggctcctgcattgcgcttgcatttatcattttttttcttcttctgatgagattagatttgaatgtaacaatgataactggattaatcccactgaagccacataagtaagttcatgccattgttctctgaataggatcaacggcgtcttggtgccataattgttcccaacaatgatgaagttctggcagaagcaaaaaggaagtccatccttggtgaggatggcgagctagcgaaagataaggtcatgaacatgctatatgatgaattgagaacctggtgagactggccctcccctcccctccctgctgttgcttctctcaacctgctgccgtcttcttgctgttgggaacagaaacaactggcggaaagaactgaaaagaggcacacgtaatataaatataaaatttataaaaaagaacgaacatggatttttttgggacgacgcctttctttgtgtgcacgtgacgctgctgttccatgattttttttgactatttgacatctggtgtcatcaggaggaagtgcttaattattttgttcacgcgtttcaggacagcgcactgctccttccgtgtcgggccaattctggttgtcgacgaaccattcacggtaggttttgcacccatcatatttgtaaatataattgatgtttccttggaacttgacggtaatttttgtttgttttgttcagattgacaatggtctgatgacaccccccatgaaaataaggagggacaaagtgacagacaagtacaggagggagatcgaagccttgttcaagtgacacgcggagcgcgtgcgcacccatcagagttcccttttccgagtacaagacggcaaccgtacggcgtacatacagacacctgcaagctgcaatgcgtccatgtaccatgtatacgtacgtacttgcgtacggtcggaagatgactgggttggaactggaagagatgatatggcggagcggccggtgggagaacaccatgagacttgttactagactcgaatgttcgtaggttgcatgagcaaaatgacatgtgttccacaattgcatcattcaataagcgattcactgagccaggtaaggtcttgttcggttagttctcaatccatatatatggattgagtgagtttaaatcccaaacaagtcaaacttcttcttaatttttttcaatctcatccaatccatatgtaatgacaataaccgaacaaggcatgaatcaataaaattctcccaaaccgccgcaggtaccatgcaattggtaaaaatatcatgcttctatcttatagatatctgaaaccaactttacagttttcttaataccataagaatatttgtctgatagaaacatggaaaaaatacagacagctatgtacaactcttgttac

SEQ ID NO: 589 - DNA, 1677 bp, Zea mays
  misc_feature (6)..(7): n is a, c, g, or t
  misc_feature (21)..(21): n is a, c, g, or t
  misc_feature (466)..(466): n is a, c, g, or t
gccggnngttttggaactgtngagactcaataacatatgtactacggtaaatgattggtcaactaatagggacacttcagttcactaatggttgcatgcaggtagcattttttaactgttgaatggttaagcgaatagtgacactttatatggaaagacttctgcccatttcctttttcttcttgattttgtacagttcaattcataggcagatttcatccagttctgctgctcgaaaaattattgctctttcacttatcaagataagtttcctatatatggaggcaaagaagatctatgagggaacagttttatcaaacaatcttgtcaaaccatcagtcatcgcctatatgatgaagtggctgtgggcaagattggttgctgcatttctttggcctttacataatctggcgaagattctagtatacaagaaaattcattcagcaatcgggatttcaaaggctgnggctcgggggcggcggaagtcttccgatgcatgttgataagttttttgaggccattggcattaaagtacaaaacggctatggccttactgagacttctcctgttgttgctgctagacgaccattctgtaatgttcttgggacagttggtcacccaataaagcatactgaaatcaagatttttgacattgagactggtgaggtccttccagatggttcaaaggggattgtgaaaattaaaggaccacaagtaatgaagggatactataagaacccatcggctacaaatgaagcttttgatcaagagggttggttcagcactggagatgtaggttggatagtacctcatcatgccatggggccaagtcgccagtgtggagggatgattgttcttgaagggcgtgcaaaggatacaatagtcctatctacaggtgaaaatgttgaacctgctgagatcgaggaagcagccagcaggagtaccttgattaatcagatagttgtgatcggccaggatcaacggcgtcttggtgccataattgttcccaacaatgatgaagttctggcagaagcaaaaaggaagtccatccttggtgaggatggcgagctagcgaaagataaggtcatgaacatgctatatgatgaattgagaacctggaccgcgcactgctccttccgtgtcgggccaattctggttgtcgacgaaccgttcacgattgacaatggtctgatgacacccaccatgaaaataagaagggacaaagtgacagacaagtacaggagggagatcgaagccttgttcaagtgacacgcggagcgcgtgcgcacccatcagagttcccttttccgagtacaagacggcaaccgtacggcgtacatacagacacctgcaagctgcaatgcgtccatgtaccatgtatacgtacgtacttgcgtacggtcggaagatgactgggttggaactggaagagatgatatggcggagcggccggtgggagaacaccatgagacttgttactagactcgaatgttcgtaggttgcatgagcaaaatgacatgtgttccacaattgcatcattcaataagcgattcactgagccaggtaaggtcttgttcggttagttctcaatccatatatatggattgagtgagtttaaattccaaacaagtcaaacttcttcttaatttttttcaatctcaaaaaaaagaaaaaaaa

SEQ ID NO: 590 - DNA, 1401 bp, Zea mays
acgccacagtgcctcctcgcagcttcatccactcgtctcccctccccacaccaaaaaaacaagcaagggtcagcagatagccgcattaaaaggagggaggtcacgtaaacttaatccaatccaccaaaccccaaatctctgtctcgcgctggcgcagcgcagggcaccgccacgcgcgcctcatccggtaccggcatgacgagcgcctccgagctcttcaccgcgcgccgtgccgcccgtggggcccgcctctccgacctcgacctggatccgcacgccgacgcgctccgggaccagcacggacttggcgcccggcaccggcgccgcgggtgccgcccgcgacgccagctcgacgccgccggggacgtgcggcagcacctgcacaccggggccccgccaccgcgtcgccgcgggtcgtacaccgatcagatcttatcgtacatagacaacaacaaccttggggttggggattctgcagctcggaggaacagacttgataggctgatgttcaggacaaatgagcggcttcctggtgctgtactgcaagcacaagcgcgtgtcctggagagactcagaggcatttctcttggttcatctgcgtccaggccatccatctcattagatgaattttcagctagcgatgtattcagaatcatcgacttcagaaacagggaagcacggcatgaagcaaatcggcaccactcatcgtcgttccacccaagcagtgaatcagatgaagaaagaccaaccgtcggttccactcactccaaccggtcaaccggacttaccaaggcagctttcctgcgtctgcaggtcgagatttttgaggctagcaaagatgatagcagagaggcatcgcctgaatgttctatttgccttgatggattttacgatggagatgagctgataaggttgcgctgtgggcacaggttccactcgacatgcttggagccatgggcgcggaaatgtgcagactgcccatactgtcgaacgaacatacggtcacgatcctgacgacaaacccttagttcagagtaagcttataaccaccatggagtttcactgttgtaaaattcgctgttgtgggcatgccagttaatccggtgctcctatggcgacatgtaatttctaatatcctgaatattttgtgttgtgtcactcagagaggtttatggtgttgtgtgcgagtggaggctagtagcagtatagcttagaaagcacccttttgtgtgtatgtagcgagggatcacgcaaatgatcctgtactactaatgataatgttctgatgtctgaatttcagttgttactgcatgcttcttgttatgaagggcgaggaacatgacttcgctatgtcgcggctatagatctgtagtgcaaagaaattgagtaaaaaaaaaaaaa

SEQ ID NO: 591 - DNA, 3199 bp, Zea mays
  misc_feature (837)..(837): n is a, c, g, or t
tagctgaaaaaccctgcgccttttctgccgtcgttttctggcgacttgactcgcgtgggggtctgtgttaacatacaactcgaactgacaaggcaatctcagatttgaacagctttccttacaaggatgatgtaaggtaacggcccattcattccgggccgaaaacacagcgaagcatatcggcccagatcgtgcggaatgcctgtcttgccggttgccgtctctctgaagcatgaaccggccatgaccatgactggctgacgacaaaactcgcaatcaaatacgcgtgcggtggcgaccactgaaatttctaatccagcgcgggcaccagtcgccgtcaccgtcaccgtcacattctattccaccggtcctggcttccgtcgtccgtcccacgccacgccacgccacgccacgccagatcacgccatcacggtggctctcctcgcatcttcctccactcgtctcctcctcccctctctcgcctcaaaacaaggaagggagcagatggagccgcatcattaaaaaaaggacacggaaacttaatccgatccaccaaacaaaaatccctgtctctcgcgcagggcaccgccacgcgcgcctcatccggtaccgccatgacgagcgcctccgagctcttcatcgcgcgccgcgccgcccgtggggcccgcctctccgaccccgaccccgacccggacccggacccgcaccccgtcgcgctccgggaccagcatggactcggcggccggcgccagcgccgcgggtgccggccgcgacgccagctcgacgccgccggggacgtgcgccagcacctgcacaccggggccccgccaccgcgtngccgcggatcgtacaccgtgagaatccgtcgccccagtctccctcccgcttgattaattattgtcgtatcagttgtgttgtggctggatcggagaatcaccggcgctggcttatacaattcgtggacactattaggattaggctcgcgcggaattcaatgatgaatggaaatgccgattttatgatcatggttacatagctcgggaaatgggtaccgatagggattacgcacttgcatttgttaccggggttgaacctgtgtattttttttgccaacatactggggttaaactttcaacgttctaattggtgaaatactgaaatgtatcggatttgtaatcctatctgagattctgaaccaagcttcataatcccacaggcactggactaccatgttgcacaaagagtgaaacgacaaacgagccttgttcattatagtagcagtgatcgagcttggcatcatgtagtcctgacggctttgtgcgattgtagctcttccgccagtgaaaatttcgtagatgacgcaggttcgttgctagttctggtcttgtggatatatttttgcgggaaacattagttcacagttttcttaggtcatgttttaatgtactaactactaaaattagctaaaaacatccaaacaatctagctaatagttagctaactatttgttaactagctaattgtactagcaatttttagccaactaattattgggcacgactaatatgcaagcaggtaatatgtgcaagcacgcaagcagacattttgatccgttagatctagatccaacgctatgtcatatttagcacttaaactcttccaccaccacctgatatagctttataaaaaaaactcctaacaaaccacaattgtatttaccgttggatacagatctaacaggctaaaaagtctgcttacacgcttgcacctagtacctgcttgcatattagttgttgccctaactattagcttttatgcattcaaacaccctcttaatcaacatacctagtacctgctttactctttatcctttgaactccacttgaaatattcgattcatcatccatgtaatttggtatttggggtgttggctatgtgtagttgtaacttaaaatcatggccgaactgatgcacatgtttgcccttttgttatgtacaactctacaccaacccaacttcatttcaggaatcctgccattggctaccattttcatcctcattgtttgtgatgggccatcaaatgaatttatttctctgttttgctgtctgcaggatcagatcttatcctacatagacaataacaactttggggattctgcatctcggaggaacagactcgataggctgatgttcaggacaaatgagcggcttcctggtgctgtactgcaagcacaagcacgtgtcctggagagactcagaggcatttctcttggttcatctgcctccaggccatccatctcattagatgaattttccgctaacgatgtatttagaatcatcgacttcagaaacagggaaacgtggcatgaggcaaaccggccccactcatcgtcgttccacctaggcagtgaatcagatgaagaaagaccaaacgtcagctccgttaactccaaccggtcaactggacttagcaaggcggctttcctgcgtctgcagattgagatttttgaggctagcaaagatgataacagagaggcttcaccagaatgctctatttgccttgatggattttacgacggagatgagctgataaggttgcactgtggccacaggttccactcgacatgcttggagccatgggtgaggaaatgttcagactgcccatactgtcggacaaatatacggtcacaatcctgatggcaaacccttagttctgaacaagattataaccaccgcgaagttcaactgctgtaaattcgctgttgcgggcaccgcgttccagttagtctggtgctccaatggttgcgtgtcatttctaatatactgaatgttttgtgttgttgtgtggctcaaagaggcatatggtgttgtgtgctagtggaggctgatagcagtatagcttacaaagcaccctttttgtgtgtatgcagctacggacaaacaaagtaatcatgttctactggcggacgcatgacaaatttaaagggggggtgacacaataaaataaaaatcattagattagaccactagataaaagtagtatgacggagcgaagtgacccagtgagaaagcgagggcatgtgataccgttgtgccaaggcagaatcccatcgataccctgaccattcgtcggtgaagacgggaaagtaaagtagcaacgttgcatactggattccgacgagacatgagctaacgagag

SEQ ID NO: 592 - DNA, 815 bp, Zea mays
  misc_feature (804)..(804): n is a, c, g, or t
cattgggtacctcgaggcccgcccgcattgggtacctcgaggccggccgggagtaacccgcatcccacatcactcatccacagctcgcagccgtattcctgtctcgaatcctctctcgccgctccgatggcccgcacgaagcaaacagcaaggaagtcgaccggcggcaaggccccccggaagcagctggccactaaggctgcgcgcaagtcggccccggccaccggcggcgtgaagaagccccaccgcttccgccccggcaccgtcgcgctccgcgagatccgcaagtaccagaagagcactgagctgctcatccgcaagctccccttccagcgcctcgtccgcgagatcgcgcaggacttcaagactgatctgaggttccagtcctccgccgtcgcggcgctgcaggaggccgccgaggcgtacctggtggggctcttcgaggacaccaacctttgcgccatccacgccaagcgcgtcactatcatgcccaaggacatccagctcgcgcggcgcatcaggggcgagagggcttgagcgcccgtcgtgctgctcgtcgttgtagtgttactagaagtagatggtggcattcgtttcgtggcttccttatcctgtaggagtaatgttctagatgtcttggcttcagtgcaatggactgtgattgctcatttctgaaatttatcaatggacttgttcttgcaaaaaaaaaaaaaaaaaagggcccaaaagaaaccaaaaaaaaaaaaagcggcccggccaaaaaaaaaaaaaaaaaaaaaaaaaaaaaaaaaaaaaaaaaaaaanggggggggccg

SEQ ID NO: 593 - DNA, 884 bp, Zea mays
  misc_feature (852)..(852): n is a, c, g, or t
ggcgaaacagcccatcacggctcagggcacagccggctcggtccgcaccttctcgcccggcgcgcgccatccgatccatctggtccgcggtcatctgtcagtttgtttgcgcgaaaaaggttaggaatcctcttgtgtcctggccgtcggccgtcgctgcgtcgttccagatttggggaaggaaatccggcaccgagattcgagtcgaaaaggacatcatttgctagatggcgcgtaccaagcagaccgctcgcaagtccactggaggaaaggctcctaggaagcaactcgctacaaaggcagcccggaagtctgcacccacaactggaggagtgaagaagcctcaccgttaccgcccagggactgttgctcttcgtgagatccgcaagtaccagaagagcactgagttgctgattaggaagctgccgttccagaggcttgtcagggagattgctcaggatttcaagacggatctgcgcttccagagccatgccgtgcttgctctgcaggaggcagcagaggcctacctggttggtctcttcgaagataccaatctgtgcgcgatccatgcgaagcgcgtgaccatcatgcccaaggacattcagctggcaagaaggatccgtggcgagagggcgtaagtctgtcgacgggaggaagaactctgcgctcgttttgtgtgttcgcctctctcaccctgtaagttttgtgaaaagataatctagtaaactgtacttggcctgtttgactgtagccgcagtagcgtctgcgcataccgttggctgttggcgtgtctggagtcttttatccatccattctagtactacttaataatcgtgatatatcaccggggtngccaaaaaaaaaaaaaaaaaaaaaaaaaaaaa

SEQ ID NO: 594 - DNA, 901 bp, Zea mays
ggcccgcccggcccggggtccgcggtcatctgtcagtttgtttgcgcgaaaaaggttaggaatcctcttgtgtcgtggccgtcggccgtcgctgcgctgcgtcgttccagatttggggaaggaaatccggcaccgagattcgagtcgaaaaggacatcatttgctagatggcgcgtaccaagcagaccgctcgcaagtccactggaggaaaggctcctaggaagcaactcgctacaaaggcagcccggaagtctgcacccacaactggaggagtgaagaagcctcaccgttaccgcccagggactgttgctcttcgtgagatccgcaagtaccagaagagcactgagttgctgattaggaagctgccgttccagaggcttgtcagggagattgctcaggatttcaagacggatctgcgcttccagagccatgccgtgcttgctttgcaggaggcagcagaggcctacctggttggtctcttcgaagataccaatctgtgcgcgatccatgccaagcgcgtgaccatcatgcccaaggacattcagctggcaagaaggatccgtggcgagagggcgtaagtctgtcgacgggcagaagaactctgcgctcgttttgtgtgttcgcctctctcaccctgtaagttttatgagaagatgatctagtaaactgtacttggcctgtttgactgtagccgcagtagcatatgcatgcgcatactgttggctgtttgtcgtgtctggagtcttttatccatccattctagtactacttaataatcgtgatatatcaccgggttgctaaacgtgtatccagacttaactgtgtgtttggctgtctgaacctcagaatcgttattgatgtcatcccattcgtccaagaaaaaaaaaaaaggcccggccct

SEQ ID NO: 595 - DNA, 770 bp, Zea mays
gaaaaggtgagctgccgtcccgctagtaatcttgtttggaaacagtcgtttcgcgtgacgttggcaagctagccgcgcgcgcttgttggaggacatcatttgctagatggcgcgtaccaagcagaccgctcgcaagtccactggaggaaaggctcctaggaagcaactcgctacaaaggcagcccggaagtctgcacccacaactggaggagtgaagaagcctcaccgttaccgcccagggactgttgctcttcgtgagatccgcaagtaccagaagagcactgagttgctgattaggaagctgccgttccagaggcttgtcagggagattgctcaggatttcaagacggatctgcgcttccagagccatgccgtgcttgctctgcaggaggcagcagaggcctacctggttggtctcttcgaagataccaatctgtgcgcgatccatgccaagcgcgtgaccatcatgcccaaggacattcagctggcaagaaggatccgtggcgagagggcgtaagtctgtcgacgggaggaagaactctgcgctcgttttgtgtgttcgcctctctcaccctgtaagttttgtgaaaagataatctagtaaactgtacttggcctgtttgactgtagccgcagtagcgtctgcgcataccgttggctgttggcgtgtctggagtcttttatccatccattctagtactacttaataatcgtgatatatcaccgggttgctaaacgtgtatccagacttaactgtgtgtttggctgcc

SEQ ID NO: 596 - DNA, 877 bp, Zea mays
  misc_feature (625)..(625): n is a, c, g, or t
gggaaaaaaaaaaaaaaaaaaaaaggtaccctcgaggttacggtcttccgtcagtttgtttgcgcgaaaaaggcttaggaatcctcttgtgtcctggccgtcggccgtcgctgcgtcgttccagatttgggggaaggaaatccggcaccgagattcgagtcgaaaaggacatcatttgctagatggcgcgtaccaagcagaccgctcgcaagtccactggaggaaaggctcctaggaagcaactcgctacaaaggcagcccggaagtctgcacccacaactggaggagtgaagaagcctcaccgttaccgcccagggactgttgctcttcgtgagatccgcaagtaccagaagagcactgagttgctgattaggaagctgccgttccagaggcttgtcagggagattgctcaggatttcaagacggatctgcgcttccagagccatgccgtgcttgctctgcaggaggcagcagaggcctacctggttggtctcttcgaagataccaatctgtgcgcgatccatgccaagcgcgtgaccatcatgcccaaggacattcagctggcaagaaggatccgtggcgagagggcgtaagtctgtcgacgggaggaagaactctgcgctcngttttgtgtgttcgcctctctcaccctgtaagttttgtgagaagatgatctagtaaactgtacttggcctgtttgactgtagccgcagtagcatatgcatgcgcatactgttggctgttggcggggctggagtcttttatccatccattctagtactacttaataatcgggatttacccccgggtgccggaacgtgtatccagacttaactgtgtgtttggctgtctgaacctctgagtcgttattgatgtc

SEQ ID NO: 597 - DNA, 770 bp, Zea mays
acgcaggtgtcctaagatgagctcaacgagaaaaaaataaaaatctggtccgcggtcatctgtcagtttgtttgcgcgaaaaaggatgaggaatcctcttgtgtcctggccgtcggccgtcgctgcgtgcgtccgttccagatttggggaaggaaatccggcaccgagattcgagtcgaaaagtcttttgtgtaggacatcatttgctagatggcgcgtaccaagcagaccgctcgcaagtccactggaggaaaggctcctaggaagcaactcgctacaaaggcagcccggaagtctgcacccacaactggaggagtgaagaagcctcaccgttaccgcccagggactgttgctcttcgtgagatccgcaagtaccagaagagcactgagttgctgattaggaagctgccgttccagaggcttgtcagggagattgctcaggatttcaagacggatctgcgcttccagagccatgccgtgcttgctctgcaggaggcagcagaggcctacctggttggtctcttcgaagataccaatctgtgcgcgatccatgccaagcgcgtgaccatcatgcccaaggacattcagctggcaagaaggatccgtggcgagagggcgtaagtctgtcgacgggaggaagaactctgcgctcgttttgtgtggtcgcctctctcaccctgtaagttttgtgagaagatgatcctggtaaccggtcctggccctgtttgactgtagcccgcagaacatatgcatgcgcatactgttggctg

SEQ ID NO: 598 - DNA, 894 bp, Zea mays
cattgggtacctcgccgcccgccagggggatcctcttggccggccgccgtcggccgtcgctgcgctgcgtcgttccagatttggggaaggaatccggcaccgagattcgagtcgaaaagatccgcggtatcgctcgaccttcaaatacttcggcaacgtcgccggttcaggacatcatttgctagatggcgcgtaccaagcagaccgctcgcaagtccactggaggaaaggctcctaggaagcaactcgctacaaaggcagcccggaagtctgcacccacaactggaggagtgaagaagcctcaccgttaccgcccagggactgttgctcttcgtgagatccgcaagtaccagaagagcactgagttgctgattaggaagctgccgttccagaggcttgtcagggagattgctcaggatttcaagacggatctgcgcttccagagccatgccgtgcttgctctgcaggaggcagcagaggcctacctggttggtctcttcgaagataccaatctgtgcgcgatccatgccaagcgcgtgaccatcatgcccaaggacattcagctggcaagaaggatccgtggcgagagggcgtaagtctgtcgacgggaggaagaactctgcgctcgttttgtgtgttcgcctctctcaccctgtaagttttgtgagaagatgatctagtaaactgtacttggcctgtttgactgtagccgcagtagcatatgcatgcgcatactgttggctgttggcgtgtctggagtcttttatccatccattctagtactacttaataatcgtgatatatcaccgggttgctaaacgtgtatccagacttaactgtgtgtttggctgtctgaacctcagaatcgttattgatgtcatcccattcgtcctg

SEQ ID NO: 599 - DNA, 1466 bp, Zea mays
tgtaaaaagattacgtagaacgacaatacaagtgaaccgttgaatcgaatgctttggacggtctaaaaggaagcaagtgacccttatcaatgagaaaatattaaattcgaaaaggttcatttctttcacagcttcgctctctcaattctgttgagcgagtcctcttcccctccggttcacgtcgcacgcggatttccacggctcccaccagcgtgagtgcgtgaccagccccaatgccctccaaaccctagtccacagctcctgtaccctggcggccatgccggatctgagcaccagctacctccctcccttccctgaactgtccctcgatgcgggggccctcgctgtcgaccacgccgggaatgctgcagccgccgcctcggccgatgcggcgtccgcgtacgcgtcttcgtctgcctctgtgggcagcggcgtagacgacctcgttattccagcggaatgccggtggaagggccatgtccgcaccttcgacatggcgggcgcgggcgctgtcaccacttgccccgccgcgcggcgtggcggcgggaagaagctgtcactgattccgtcactcgagccggcacggacgcaggcttcagcatcggctccgacgctcgaggaacgcgtgagcgagtgggcggctaagaaggcagcggccggcgttccgactcatcactgcgtgctgcctttcctcaccggggcgccaatggcggtaaggattttggctcgaagcgcttcgcgttgaaggaccaatgtctgcttcagcttacttcgaattcccatttaactcgactcttatgtctgggcggatcaagcaaaatgcagctggtaatgagttgtgcagttcaggtcgattcagcgaaattctttagcattgtggcaacaaatactacttgagctacgagatcatgtgtgttcgttgcacatttcactcccattaatcacttattttgaacttaagacactctagagagtttgcaatcagttccttcttctttactttggatggtaacatacttttagttatgtgcattagtcacaaaaaagtgctagtatatttgccattaaaatgctataatatttatatttgatagatttacatctctgtcacaacgatatctgttgctctgttttctccaagagcaagagattatgaaaggccaccaaattcagaagagttttagcgagggagtagacagtagaaactagaaaccatgttggttaacattgcctatttgcctttatttggaagcaagctggggttagctaaatatggaacccgttgatagccaaaaatatagaaacgtgttggttaccagggttctcgtgtccccaccagtaaaaatactaataatgcaaaatgtcgtgaattttgaaatatattctaaaactcatgtgcatagtacacagagttaaagaaacttgaaagaacttcaatttaaaattaatctgttatattacggttc

SEQ ID NO: 600 - DNA, 2195 bp, Zea mays
ctcgaggcccgccgcgcggggccgcccgagttacatttccacggctcccaccagcgtgagtgcgtgaccagccccaatgccctccaaaccctagtccacagctcctgtaccctggcggccatgccggatctgagcaccagctacctccctcccttccctgaactgtccctcgatgcgggggccctcgccgtcgaccacgcggggaatgctgcagccgccgcctcggccgatgcggcgtccgcgtacgcgtcttcgtctgcctctgtgggcagcggcgtagacgacctcgttattccagcggaatgccggtggaagggccatgtccgcaccttcgacatggcgggcgcgggcgctgtcaccacttgccccgccgcgcggcgtggcggcgggaagaagctgtcactgattccgtcactcgagccggcacggacgcaggcttcagcatcggctccgacgctcgaggaacgcgtgagcgagtgggcggctaagaaggcagcggccggcgttccgactcatcactgcgtgctgcctttcctcaccggggcgccaatggcggtcgaatgtcgtttgtgctccaagattatttatgttggagaagaaataaaatgttcagttaaaaagtgtccacaaatgttccatctcaaatgtgttgcggaagatacttcaaactttaccgttgaaagcttcaggtgccctcaacatgggtgtatggtttgtaagcaaaagatgttcttttggcgctgcggacgttgtacagttgcagcacatacgaaatgtgcaccatggccagtggttcaccctaaaaatgatcaaggaagtgcaatttgctggaggcatccttctgactggctgctgcaaaataagaatgctgactttaccaacagtgtagaggaagtattttgccggctacctcttccatatgttaatgaagacttaaatattgattcaatcatcagggattatgctgaggctgtttataagccacccccctatacatctatcaggcgcaatgtatatctgataaaaaagaagcgcactggtgttcgcgtggatattgggtgcacaaactgcagggctgattctacttgcaaagaagactgtgaatgcaggggtctttctatgagttgttccaagaattgtcgctgctcagatctatgtacaaacaggccattccgcaaggataagaaaattaaaattgtgaagacaaagcgatgtggatggggtgctgttgcgttacctagaacatcctaatcaaaaattgtaatcgagtatgttggtgaagtcattgatgatgcgacatgtgaacaaaggctttgggatataagacggcgtggtgacaaaaacttctacatgtgtgaaatcagcaaagattttacaatagatgcgacatttaaaggcaatgtgtcacgttttctaaatcacagttgtgagcccaactgtaaactcgaaaaatggcaggttgatggtgagacaagagttggtgtctttgcctctcgttccatcgaagttggagagcccttaacttatgattacaggtttgtgcattttggagagaaagtgaagtgccattgcgaagcagtgaactgccagggatacctgggcagccaaataaagaacccaattcaaagcattcttgccactgtagcaccgcaagtgcagttgcgagagtattcgcccatgcaccacgaagctccaagattgaagccaataaatcacttgttaccctggaccaactgtatagaggtctcttttaacctgagaagcaaaaggaaaattgaccggctatgctgggcccgcaagaagaagagaacatccctcgtgccatcttcaacaagcatgccagcatcgccgagtgaagttcctgccgcggatttctaactgcccttcgttgaagagcaagcctgccctgtataataatttcatggtacattctttacatgcattggttggaaacgattctttcacattgctcatcaatggtgttgtaacctgcaacattctttatttggtttcatagggcattcagtcagtttacgggtggtagtttgtcggaacatgtacccaatttttctgatgaaacaaatgtttgagcttcacgaaaaaaaaaaaaaaaaaagccaaaaaaattaaaataaataaaaaaataattaaaaaaaaaataaaaaaaaattaaaaaaaaaaaaaaaaaggggggg

SEQ ID NO: 601 - DNA, 2619 bp, Zea mays
agactctagtgtaccccagtcccggggtctagtctgagggccgttcccatggccaaccgggcgaggccactccacgccatctacatgaccagcagctcccatgaccctgacaagtgggcgcacctcgtcaaggagtacgcctcgcaatccttgctccgggaagccgccctcgtctacgccaggaacctgccccgccggacgcaccaccagcccctcctccccgtcctcctcaaggccgccgctgcctcctccccgaccgagctaggtctcggcaagtccctccatgcggaggccctcaagtccgcctttgcccgcgatctgctcgtcggcaccacgatcgtgtcgatgtactgcaagtgtggcgcactcgccgacgcgcgcagggcgttcgacgaaatgccggaccggaacgtcatcagttacaacgcgcttctcgccgggtacgccgtggcgggggacatggacggtgccctggctctgttcggtggcatgcgctcctggacgcacgtcacgtgggcgacgctgatccgcgggttcgcggagaagggcgacatggcggaggctcggaggtggttcgaggccacgccgccggggatgcgaaccgttgtcacgtggaccgtgctggtgcagggctacgtgtgcgcgggtgacatggagacagcgagggaggtgttcgacaggatgcccgcgaggaacgcctttgtgtggtcgtcgatggtcacgggatacttcaaggccggcgacgccgaggaggcgcgggcggtgttcgataggatcccgacgcggaacctggtgaactggaacgcgctgatcgccgggtacgcgcaaatcgggtgcagtgagcaggcgcttgaggcttttcatttgatgctgcaggagagggtaaaaccggacgagttcaccatggcgagcttgctttcagcgtgcgcgcagctcgggtcgctagagcaggggaagaaagttcatgacttcattaaccaggagcatatccggaagaaccactttgtgatgaacggtttgatagacatgtatgccaagtgtggtgacctcgcgcacgcccgatacatctttgatagcatgagatggaagaacaacgaatgctggaacaccatgatctccgcacttgcaagccatggtcagagcgatgaagcactccacctgttcttccagatggagcgctctgggcggaagcccaacacaatcactgttcttgccgtgcttggagcttgcacgcacggaggcttcgttgatgaaggattacaaatcttcaacaagctcgatgcatatggagttggagcgggagtggaacattacggttgcctggtcgatctattaggcagggctggaaaactgaaggaagcctacgagattgtcaataacatgtctgaggaacccaacgaggtgatctgggggtcattgcttggagcttgcagagtgcatcgtgatgcggaaatgtcaagattggtaacggaggagatccttcgattgcattcttttcacgcgtcgtctaacgatgcagagtacatcatgctcgcaaatatcatggctgcatcagagaggtgggagcaggcagaacaaatgaggaggaaaatggcgcgacgtggggttgagaagactcccggctgcagttcgcttgagcttggcattccaggatgccaagtgtatgcaggcagtgggcagtagtgctttgtttcgagtaggttactctaaatctgtttaataattttgtttcatatttttcagcggtccgatttcagtacataaccctgagaagaaatgatcttgatgtgatgcattcgatagggaacaaaaatatcagacatcgatcattgcagtcatgttctataactttgagagctgcagacgccgaacttccaggttttgaagtttgatttcagaaaatgtatccatggaagtaaaatgcagaagaaattattgtaccaaaaaaaaaaaaaaaatttggttgctgggcttgctagtgtcttactagggtatgttaactctaagttcaaaaataaaatagattatttgggtatttgtttaggattataatctgctcagaatatataatctagcaaattttgaactaatgctagattatataatttggacaaattataatatcaaacaaacaaaccttgagagaactgtgtggttcactcatacctggtgcattaggttttattaaaagggattcgggatttagctcttctccgcgcttcgtgcgttcggcgggtgccgaccgcgtgcggacggtacatgaattatagccggacgatccgcgcaggggttcagacggtcttcaattatgctctggacggtccatcagtcaaatgaatgaaacaacaagttcctgttttatttctgatctcaatagtccggatccgtgattgggatcggacggtccatgcttggcgttttcagaacttcgtttcgattgtcttgtttgttcttgaagtatcttcaaaaacgatatttaactaaactagagggattttctatgacttagacaaatatatctagtggctttctaactaatctaagtcatggaacttagtcatttaattcttttattcacattccttattttgctcaaactagctccaaaaggatgattcg

SEQ ID NO: 602 - DNA, 1699 bp, Zea mays
attgggtacctcgaggccggccggaagtatatacgaggggcagggcccccccccgcgcccttcgtccatcgtcttcgtccattccgatcactcgctgctcccctctctcgccggagcgagccccgggccggatggcggcggcagcagcagctcctcccgcctccgcgatcgcgtgatggacgccgacgccgacgccgccgcgatccgccgatggacgacgccggaagggcaccaccacccgcgccagcggcggtgaccgtctccgccaccgccgcacccgcgcctaccccgccctccgccacggccgccgccgacaagtcctccctcgaccccgacgcgctttatgaagaggggatgtggcaacagatggccatgaacagcggtgccacaatgcaacctgggtcatatcctgagcgaccaggtgaaccggactgcacttactacctcaggactggattgtgtcgatttggcatgagctgcaggttcaatcatcctccggataggaatctggctattgcctctgccagaatgaagggagaatatcctgagagagtgggacagccagagtgtcagtattatctgaagaccggaacatgcaagtttggtcctacatgcaaatttcaccatcccagggaaaaggccggaattgcagggagggtgcagctaaacacattaggatatccacttcgcccgaatgaaaaggagtgtgcgtattatttaaaaacaggacaatgtaaatacgcaaatacttgtaaattccaccacccagaacttttcaatgtggtgccttcgtcacgtggttcacctatttatacttctgtacattcctctgcaagcgctggtccacagtcatatactggaactatgtcaagctggacttttccacgagcttcttttataccaagccctaggtggcaaagtccttcaaattatgcaccaatggttgtacctcatggccttgtccaagtgccgagctggaattcatatcctggtcagctgcagtcacctggggctcaacaaacttatggaagttcacaacaaggcgaagctagtgcaggaaatcagggaatgctatcaccctatagatccagttcatttcctgtgcctcaatatgcgttgcagagagataatgtatttcctgagagacccgatgaaccagaatgccaatattacatgaagacaggagattgtaaatttggtgcagtgtgcaagttccatcatccccgtgtgagatcacagccccctccggattgtgtcttaagtccaatgggtcttccaatacgtccaggtgaagaactttgcaaattctattctcgttatggcatctgcaagttcggcgccaactgtaaatttgatcatcctacaatggctgctccaatgggagtttatgcatatggtttctctgggtctgcttctgtcgcacccgcttcaactaatgcacctatgacgcgacatcttcttggatctccatcaggttctggatatatgtcttaggtgtcttttttttcagttgacctactttgatgtataaaatccacggcatcgcctcaggcgctgtgaatgtttctcctaacttcccgccgggatgaagttctgtaaattgagttgctgctggagatgtacagcccccccccccccccccccctcccaaattaatccagaactttgggaataactgttggaacctaataaacttcag

SEQ ID NO: 603 - DNA, 5002 bp, Zea mays
gggtacctcgaggccggccgggattctattcctcccaccgatcactcgctgctcccctctctcgccggagctccgggccggatggcggcggcagcagcagctcctcccgcctccgtgatcgcgtgatggacgcacacaccgccgcgctccgccgatggacgacgccggaaggccaccaccacacgctcccgtggcggtgaccgcctccgcctccgcctccggccaccgccgcgcccgcccctccccaaccctcagccactgctgccgtcgacaggtcctcccccgaccccgacgcgctctatgaagaggggatgtggcaacagatggccatggacagcggtgccactatgcaacctgggtcatatcctgagcgaccaggtgaacccgactgcacttactatctcaggactggattgtgtcgatttggcatgagctgccgattcaatcatcctcccgataggaatctgaatgaagggagaatatcctgagagagcgggacagccagagtgtcagtattatctgaagactggaacatgcaagtttggccctacatgcaaatttcaccatcccagggaaaaggctggaattgcagggagggtgcagctaaacacatcaggatatccactccgcccgaatgaaaaggagtgtgcatattatttaaaaacaggacactgtaaatatgcaaatacttgtaaattccaccatccggaacttttcaatgtggtgcctttcgtcacgtggttctcctatttatacctctgtacattcctctgcgagtgctggtccgcagtcctatactggaactatgccaagctgggcttttccacgagcttcttttataccaagccctaggtggcaaagtccttcaaattatgcgccgatgattgtacctcagggccttgttcaaatgcagagctggaattcatatactggtcagctgcagtcacctggggctcaacaaacttatggaagttcacaacaaggagaagctagtacaggaaatcagggaatgctgtcaccatacagacccagttcgtttcccgtgcctcaatatgcgctgcagagagagaatgtatttcctgagagacctgatgaaccagaatgccaatattacatgaagacaggagattgtaaattcggtgcagtgtgcaagttccatcatccccgggtgagatcactgccccctccagattgtgtcttaagtccaatgggtcttccactacgtccagtaagtcattaaacccttcaccgtttctgttgtatcggtcctttgtttaggcattttatcaattatatatgaatatgttgattgttgtactacctcgtctctttatgggataggctccgcaaattttcttgtggaaacacatcatcatttagaatatgcatcaatgcgactgcttggttgttgtagtctagaaatttgaaaatccaatatgtgctatgctgtttataaagaggctctcgtgtcagacaaagaaagtgaaggatgttccatacacgtttctcagccagatgattgatttcagtggggcatgatttctgctaatgatgattgatttattctcctagtcctagcaataaatgcacaacttatttaaagacactaagatgcatattcaaggtaccactattagaccattctttatatgtgttggttgagctctggtttatcataaaaaactttagagggctgtgcaacaaatctcactgtggcttgcaggcatcgttgttgatacctggacactgattagagcaatgtcaaaagttacaaatttgctaggacaggtattatcagacagttactcggtagaggaagggacaagtgcacagactgatgtctgcttacaaatagagcctgtctcatcaataggcactagatagtccttttgctgcacctcattgaatggcctgtcgtcttgattatcctgtccccaatggtttttcagggtgaagaactgtgcaaattctattctcgttacggcatctgcaagttcggcgccaactgtaaattcgaccatcctacagtggttgctccaatggtctatgcgtatggtttctccgcgtctgcttcccctgcatccgcttcgactaatgtacctatggcgcgacgccttctgggatccccaccggggtctggatatacatcttaggcgtcgttttttttttcagttgacctacttcgatttataaaatccatggcactgcctcaggcgctgtgaatgtttctcctaacttcctgccgggatcaaagttctgtaaattgagttgctaccggagatgtacagcccctttttttttggttaatccagatctttgggaataactctcgaaaccgaataaactttggatacagagatgccagttttcaggtgcctgcactatttgacattattgctgcacctatggttccgaacagaggaacagttgaattctctggaggggctgaagcctgcacttgtgcagttgagattatatcatcgcgtcgatttattttggaacctgtattcagctggtgttgaggcatttgtttctgaggtgaaatgaactctccatgcccaacaactgaaactaaagacgacacgataaggtgcctgacctgaaccggcacatttcctgtggtcaggtttaatcatatatatgtagctgaaaggaaaaaaaaaacgcgaaggacttttattgtgatgaactgatgatgtcatgtgggccaggtggcttccaccaggccctcactctcgactcctctgatctgtatgaaaagcctactgcaccctcactctgggactcctgaccgaagcctgtctactgctgtggttggtttacgaaaggagcaatttgaccataccctacagagttaaagaccgagtctctcccatcttttgttgggcctgagattcctcagttttgcttgagcgatctgtgcacgatgaagcatgttatgtacaccacggcttgcatttggttcgacttcgacacaacacatggttcgagtatactcgccactcggcctcgggtgcccatgccgtggccgttgggtcggtcgcggccagccccgaccccgacgaggccatgacgccagctggtgcgtgtcagcgtgtgcgcacgggagacgacgggagggtagtggatgatttctaattccaaatctcccatcccgagccgtgccctcgctttctccgaaaagcgggagcgagcgctcctctcactttttacatcttcacttcacttggcctaccagcagtccagcagagtttccgtctccccgactcccgactgccggccctgacctgccctgcgccgcgcggagccgcgtactaccgcccgcccaccaccgaaaccctagagcaagcagggatgcacagtccggtcccgctcctcctcctcctgctcctctgcacggccgcggcggcctccgacggctcccagccccaggtacgtcacgccagccgccagcgtcttctcttcccctattctcgcttggctgcctcgacccccctgccgcaatcgatcccagctcacgttgcgcctccgcgcaggcgcaggcaccgggggcggcgcggcgggggatggtgccagtggcccccgcggaggcggagctcggcaccatggtggcgctcgccctcaacggcacgcggcgccggctcgggggcagcttccagctttgcgcgccctgcacctgctgcggcggggccagcggcgcctgcatcctcgcgccctgctgctactccatcaactgcaacatccccaaccgccccttcgggtactgctccttcacgcccaagtcctgccagtgcgtcggatgcaacctctgagctccgtggccgcgggattcattggattggattggtcagagtgtgtttgtgtgtgtgtgtgtgagagagagagagagtggggtggtaacgaatctgtataaaaaattccccacatccttagttaagtggcgattgctattacttctacctagtagtattttgctgtgatcactgctacgctcgacttagttgagggaaaaaaaagagaaaggggtctgggttgatctagaggtcactactctggggttttgcttttctgtcgccacacattggatgtctgattaggatgctacttgttcatagtggtttgttgttgatagctggaataaatatacctgtttaggtgcatggatctagtcatctagtgcattttagtggatgccatctcttccgtcctgatcagtgcctactgccctggaatgtgaatatgtgatagctctagctcaaaaaaaaaaaaaaaatctgatgctgactggattggccagaccttatcaatcaccacatttaataactcaaggtgatgagaacgggaggcgactactgtagcaaatgagtggaggctcgacggtgaggaattgctgacattagggaaacacatgcgtgatggtgggttgcatagggtcggaggctcggagcagagtttgagtaattacataggatagtggtgactccaatggcagcgagaggggatcagttgggtggggctgaaacacaaaagggattaggtgggatttttaactaggtgggggctggttcaaatgatgaatagtgatgcacgctcgtgtgtgtatatatttgtatactttcttcaatttttgcctttcctagacataatacataactgaatagcaaaaattacgtatgccgaaaaaaaatatcaaatcttataatttataaaccgagagtaccatttaagcgtcatacttcctaacattggtactttaaaatcgtactacctactttgatactttaatagctatgatcgagatttccatccgtttcaaattatgagacaatttagcttttctagacatatctgtatctaaaaaagcaaaaaataaataaataattgtaatggatggagtaccatttaagccctgtttgacataagtccggctcccaaaaacataacttcggctctagcttttctttaagagcagcccgtctatacgagctagtgtttttaaaca

SEQ ID NO: 604 - DNA, 1738 bp, Zea mays
gcacgcgtccggtacctgggccggcccgtcattctattcctccacaccgatcactcgctgctcccctctctcgccggagctccgggccggatggcggcggcagcagcagctcctcccgcctccgtgatcgcgtgatggacgcacacaccgccgcgctccgccgatggacgacgccggaaggccaccaccacacgctcccgtggcggtgaccgcctccgcctccgcctccgccaccgccgcgcccgcccctccccaaccctcagccactgctgccgtcgacaggtcctcccccgaccccgacgcgctctatgaagaggggatgtggcaacaaatggccatggacagcggtgccactatgcaacctgggtcatatcctgagcgaccaggtgaacccgactgcacttactatctcaggactggattgtgtcgatttggcatgagctgccgattcaatcatcctccggataggaatctggctattgcctctgccagaatgaagggagaatatcctgagagagcgggacagccagagtgtcagtattatctgaagactggaacatgcaagtttggccctacatgcaaatttcaccatcccagggaaaaggctggaattgcagggagggtgcagctaaacacatcaggatatccactccgcccgaatgaaaaggagtgtgcatattatttaaaaacaggacactgtaaatatgcaaatacttgtaaattccaccatccggaacttttcaatgtggtgccttcgtcacgtggttctcctatttatacctctgtacattcctctgcgagtgctggtccgcagtcctatactggaactatgccaagctgggcttttccacgagcttcttttataccaagccctaggtggcaaagtccttcaaattatgcgccgatgattgtacctcagggccttgttcaaatgcagagctggaattcatatactggtcagctgcagtcacctggggctcaacaaacttatggaagttcacaacaaggagaagctagtacaggaaatcagggaatgctgtcaccatacagacccagttcgtttcccgtgcctcaatatgcgctgcagagagagaatgtatttcctgagagacctgatgaaccagaatgccaatattacatgaagacaggagattgtaaattcggtgcagtgtgcaagttccatcatccccgggtgagatcactgccccctccagattgtgtcttaagtccaatgggtcttccactacgtccaggtgaagaactgtgcaaattctattctcgttacggcatctgcaagttcggcgccaactgtaaattcgaccatcctacagtggttgctccaatggtctatgcgtatggtttctccgcgtctgcttcccctgcatccgcttcgactaatgtacctatggcgcgacgccttctgggatccccaccggggtctggatatacatcttaggcgtcgttttttttttcagttgacctacttcgatttataaaatccatggcactgcctcaggcgctgtgaatgtttctcctaacttcctgccgggatcaaagttctgtaaattgagttgctaccggagatgtacagccccgttttttttggttaatccagatctttgggaataactctcgaaaccgaataaactttggatacagagatgccagttttcaggtgcctgcactatttgacatgattgctgcacctatggttccggccagaggaacagttgaattc

SEQ ID NO: 605 - DNA, 2990 bp, Zea mays
  misc_feature (1701)..(1701): n is a, c, g, or t
attgggtacctcgaggccggccggggtccatcgtcctcgtccgttccgatcactcgctgctcccctctctcgccggagcgagccccgggccggatggcggcggcagcagcagctcctcccgccgccgcgatcgcgtgatggacgccgacgccgacgccgccgcgatccgccgatggacgacgccggaagggcaccaccacccgcgccagcggcggtgaccgtctccgccaccgccgcacccgcgcctaccccgccctccgccacggtcgccgccgacaagtcctccctcgaccccgacgcgctttatgaagaggggatgtggcaacagatggccatgaacagcggtgccacaatgcaacctgggtcatatcctgagcgaccaggtgaaccggactgcacttactacctcaggactggattgtgtcgatttggcatgagctgcaggttcaatcatcctccggataggaatctggctattgcctctgccagaatgaagggagaatatcctgagagagtgggacagccagagtgtcagggaaaaggccggaattgcagggagggtgcagctaaacacattaggatatccacttcgcccgaatgaaaaaggagtgtgcgtattatttaaaaacaggacaatgtaaatacgcaaatacttgtaaattccaccacccagaacttttcaatgtggtgccttcgtcacgtggttcacctatttatacttctgtacattcctctgcaagcgctggtccacagtcatatactggaactatgtcaagctggacttttccacgagcttcttttataccaagccctaggtggcaaagtccttcaaattatgcaccaatggttgtacctcatggccttgtccaagtgccgagctggaattcatatcctggtcagctgcagtcacctggggctcaacaaacttatggaagttcacaacaaggcgaagctagtgcaggaaatcagggaatgctatcaccctatagatccagttcatttcctgtgcctcaatatgcgttgcagagagataatgtatttcctgagagacccgatgaaccagaatgccaatattacatgaagacaggagattgtaaatttggtgcagtgtgcaagttccatcatccccgtgtgagatcacagccccctccggattgtgtcttaagtccaatgggtcttccaatacgtccaggtgaagaactttgcaaattctattctcgttatggcatctgcaagttcggcgccaactgtaaatttgatcatcctacaatggctgctccaatgggagtttatgcatatggtttctctgggtctgcttctgtcgcacccgcttcaactaatgcacctatgacgcgacatcttcttggatctccatcaggttctggatatatgtcttaggtgtctttttttcagttgacctactttgatgtataaaatccacggcatcgcctcaggcgctgtgaatgtttctcctaacttcccgccgggatgaagttctgtaaattgagttgctgccggagatgtacagcccccctcccccaattaatccagaactttggggaataactgttggaacctaataaacttcagatacagaaaacgctgggttttcaggtgcttgcactattttgatactgctgcacctatgggtcctaaacagttgaggtaggaattcctctgaaggagctgaaacctgtagcntgcaggtgtgcagttgaaattatattattgcgtcaatttatttggaacctgtattccccccgtgttggggcagatattggcattcctcttatctgtgaatgctggttttctgacttgaacagtgtatcccagcctacggcttctgccaagacagtaaactcaggacctgtttgggactgttccactattcaaaaaatgaatttgaatctgggattcattattaaagtttcgccgacgaatctgagatcctttttagatagcagcttattcacgtaaggatattctgtctgaaatagactaatttatttttatgatagacctcatttgtcagtgtgtattcttttatctattatataaagcatccgtcaccgttccgctttatataaaaatgaattaaaattatacacaagtgggcttttatatttatactcatctaaccaataaaatatatattttgtgttttattaaaataaagtctattaatgtgatgtatagaaatcggcgtagaactaatttttcagaagaagaaaaaaagcacagctttcaatgtggtttgtttgtttcagcatttttctgatgaacttttctgaaaatttggctattgagaaatagagagcgaaggtgtagagattgagagctactaaatttaaagagttatttatagccttttggagacagttttcttttaataatagacaaatttatcttttacaaacaatttgtctagtctcttggacttagttgtcctaaagaaatatttccttgttctttatagcacattttcgaggatttcgtccttcctgttccattttgtgcggggtgacgatagcctaggcttcacaaatcacaacacactcatgtgcgcttacctcacaccaccgttctcgctcgcccacccacctccatggctatgtggacacctcagccctgcccaaacacgcagggaaaaagtacatgtggccgtgccgcaaacagccgagttgtggcacatctctataattgaggacacgtgtatatcaaacggtcaacatttctgattgaggacgcatgtatatcagacgatcacctgatgcttccggttccgtggctcaagtcgcccctactctgaatcagaatcaaggtgggtggtagcagagatgacaccagcaaccttacctggcaggcaacaaaggcgaaggcctaacctggcgatggcctgatgggaggttttcacaggctctgattctgattcaggggccccgcgaaaaaaaagtatttgtttcggcccgcattaggtgattccagcgtcc

SEQ ID NO: 606 - DNA, 1904 bp, Zea mays
gctaaacacattaggatatccacttctcccgtcatatactggaactatgtcaagctggacttttccacgagcttcttttataccaagccctaggtggcaaagtccttcaaattatgcaccaatggttgtacctcatggccttgtccaagtgccgagctggaattcatatcctggtcagctgcagtcacctggggctcaacaaacttatggaagttcacaacaaggcgaagctagtgcaggaaatcagggaatgctatcaccctatagatccagttcatgtcctgtgcctcaatatgcgttgcagagggataatgtatttcctgagagacccgatgaaccagaatgccaatattacatgaagacaggagattgtaaatttggtgcagtgtgcaagtttcatcatccccgtgtgagatcacagccccctccggattgtgtcttaagtccaatgggccttccaatacgtccagtatgttgttaaacccttcactctttctgttttattttgttttagaactacactgtttctgttgtattgatcctttgacattttatccattatatatgaatatgtcgattgttgtactatttggttgttcttatctaaaagaaatttgacctggcctttggcgtgggacaaatgaggtgattttttttaaccctagcctgaaattcgctctccagttctttggggtgggacacatgaggggattttttttaacctcggcctgaaatttgcttccacgaagagtcaatctcaggacttgaggaatgctactcaagccacctaatcaactcacctagaagccctttcgcaagtatgtgctatgcatttgttgtttataaaatggttttcatgtgagacaaaaaatgaaggatgttccatacatgttgtttctcagctagatgcctagatgattgatttcagtggcatgatttctgctaacgataactgatttattctcctagcaataaatgcacaccataccaaagatattaatatgcatatctaaggtaccactattggagcattctttacatgtgttggttgagctctgatctatcataaaaaacttttgagggctgagcctcaaatctcactacgacttacaagcgtcattgttgatgcctggacactgattagagcaatgttaaaagttacaaatttgctaggacatgtattaattttttactttagcatacaagttgttgaagggacgagtgtatagactgatatcagcttacaaataaagcctgtctcacgaataggcactagctagtccttctggtacacctcattgaatggtctgccatcttgattatcctgtccaatggtttttagggtgaagaactgtgcaaattctattctcgttatggcatctgcaaattcggcgccaactgtaaatttgatcatcctacaatggctgctccaatgggagtttatgcatatggtttctctgggtctgcttctgtcgcacccgcttcaactaatgcacctatgacgcgacatcttcttggatctccatcaggttctggatatatgtcttaggtgtctttttttcagttgacctactttgatgtataaaatccacggcatcgcctcaggcgctgtgaatgtttctcctaacttcccgccgggatgaagttctgtaaattgagttgctgccggagatgtacagcccccctcccccaattaatccagaactttgggaataactgttggaacctaataaacttcagatacagaaacgctggttttcaggtgcttgcactattttgatactgctgcacctatggtcctaacagttgaggtaggaattcctctgaaggagctgaaacctgtagctgcaggtgtgcagttgaaattatattattgcgtcaatttatttggaacctgtattcag

SEQ ID NO: 607 - DNA, 1603 bp, Zea mays
  misc_feature (27)..(28): n is a, c, g, or t
  misc_feature (30)..(33): n is a, c, g, or t
  misc_feature (36)..(39): n is a, c, g, or t
cattgggtacctcgaggccggccgggnnannnntcnnnnaaaaaaaaaacaaaaaaaaagggtacctcgaggccggccgcccgcccttattctattcctccacaccgatcactcgctgctcccctctctcgccggagctccgggccggatggcggcggcagcagcagctcctcccgcctccgtgatcgcgtgatggacgcacacaccgccgcgctccgccgatggacgacgccggaaggccaccaccacacgctcccgtggcggtgaccgcctccgcctccgcctccgccaccgccgcgcccgcccctccccaaccctcagccactgctgccgtcgacaggtcctcccccgaccccgacgcgctctatgaagaggggatgtggcaacagatggccatggacagcggtgccactatgcaacctgggtcatatcctgagcgaccaggtgaacccgactgcacttactatctcaggactggattgtgtcgatttggcatgagctgccgattcaatcatcctcccgataggaatctggctattgcctctgccagaatgaagggagaatatcctgagagagcaggacagccagagtgtcagtattatctgaagactggaacatgcaagtttggccctacatgcaaatttcaccatcccagggaaaaggctggaattgcagggagggtgcagctaaacacatcaggatatccactccgcccgaatgaaaaggagtgtgcatattatttaaaaacaggacactgtaaatatgcaaatacttgtaaattccaccatccggaacttttcaatgtggtgccttcgtcacgtggttctcctatttatacctctgtacattcctctgcgagtgctggtccgcagtcctatactggaactatgccaagctgggctttcccacgagcttcttttataccaagccctaggtggcaaagtccttcaaattatgcgccgatgattgtacctcagggccttgttcaaatgccgagctggaattcatatactggtcagctgcagtcacctggggctcaacaaacttatggaagttcacaacaaggcgaagctagtacaggaaatcagggaatgctatcaccctacagatctagttcgtttcctgtgcctcaatatgcgctgcagagagagaatgtatttcctgagagacctgatgaaccagaatgccaatattacatgaagacaggagattgtaaattcggtgcagtgtgcaagttccatcatccccgggtgagatcactgccccctccagattgtgtcttaagtccaatgggtcttccactacgtccaggtgaagaactgtgcaaattctattctcgttacggcatctgcaagttcggcgccaactgtaaattcgaccatcctacagtggttgctccaatggtctatgcttgacctacttcgatttataaaatccatggcactgcctcaggcgctgtgaatgtttctcctaacttcctgccgggatcaaagttctgtaaattgagttgctaccggagatgtacagccccgtttttttttggttaatccagatctttgggaataactctcgaaaccgaataaactttggatacagagatgcc

SEQ ID NO: 608 - DNA, 1475 bp, Zea mays
acgcgtgggctagtgctgaaaatgtccactgctctctttctctttagcataacctccacacgggggctggggctaatttgcaatactctgattcagaggcttatgtgcttagctgagttgaattcggatgattggtcatgcagaggttggatgagatgggtgtagaaatcatgcctgtggacgcgggtatcaaggatttcaatgtcgtcgagcaaggtgacgttgtcgtgttgcctgcatttggagctgctgtggaggagatgtacacgctaaatgagaagaaggtgcagattgttgatacgacatgcccttgggtttcaaaggtctggaatatggtcgaaaaacacaagaagagtgaatatacttcaattattcatggaaagtattcccatgaagaaactgttgccactgcttcttttgcaggaaagtacatcattgtgaagaatatggcagaggcaacctatgtgtgtgattatatacttggtggccaacttgatgggtctagctcaacaaaggaggagttccttgagaaattcaagaaagctgtttctccagggtttgatcctgatgttcatcttgatatggtgggaattgcaaatcaaacaacaatgcttaaaggagaaactgaagaaattgggaagcttattgaaaagacgatgatgcaaaaatatggagttgaaaatgtaaacgatcacttcatggccttcaatactatttgtgatgccactcaggaaagacaagatgctatgtatcagctggtgaaagagaaagttgaccttattcttgttgttggaggatggaattcaagtaacacctctcatctgcaagaaattggagaactcagtggaattccatcatactggattgacagtgaacaaaggattggaccaggaaacaggatcagctacaagttaaatcatggtgaactggttgagaaaaataactggttacccgaggggcctattaccattggtgttacttcaggtgcctcaactccagataaggttgttgaggatgctcttcagaaggtatttgagatcaagcgtcaggaaattttgcaggttgcataaattttaagcagagatttggtgaagagctgaatagttttggcttggcaaaggttactagaaacgttgcacaggcaaatgtttgtacagtagctaaggatgtaacgagttgggcacgaatactaccacgagtcactatccttgtgctggaatttacagtacggtggaaactaaaatggtgttatcattggcccgaataacatttgcatcagcctctctaaggtctaactttttgccacttaaattgatgtcagggatgacactcagatgtgtaagttaagaatgcacagttcctacgtgtaaaaagcttagttccagtacttgaactctcatcagttgggacaaaatcgcaataaaacctcgaattgctctaatcaaatttctccgtttcctaagtgcaattgcgca

SEQ ID NO: 609 - DNA, 1338 bp, Zea mays
taggagaaagaccgacatcacggtattacattaagaagctcaattagagccccgaccgagaaaacgccacgaaagctagtcccccgtgcaatatgagggtccgccccctatagaccagatctttactcgtgctgagccttcctagctcctacataaggatctacccccataggtcagtccatctcatgtgcacacaatcaggggaaccagcgagtgaccttttttaacctcggcctaaaattcgctcctactgggattcaaactcaggatatgaggagtgctactcaggctacctaaccaactcggctagagttcctttcgctttgcccacttaggcttgaacaagggtgctagactactagaaagctgtgtctacctagagggggcaatgaaattcttgaagttaacaattatcgacactagagtttcacttgaatagaattaatgcactattagtaatccaaattgatcatgtctataaattgacatttctataaccagcacactcacaagtatatcttattttttctatttcttgtgtatgaaagattgcacatcataacctttcatagatgtagcatgatttatgagtagatatttgaaattctagtaagaatgagtctacgtcaatgctgagagtgaagatgatagaaaatccattgataagtatcaggcagagacagagttgatgaaaagggagatacaagatctcaagacgaacgcgaaggttttccaactgagcaagtgtagcgcgtgcactttcacccttgatctacctgctgtccatttcctgtgcatgcactcgttccaccttcgctgccttggtgacaacgaaaaagaatgcccagaatgcgcgcctgaatacagatccgtcatggaggcaaagcagaagctagagcaaaacgccagggaccatgatctctttttcaggcagttgaggggttccaaggacggtttctctgtcattgcagactattttagcaagggcatagtgagcaagacaaccttacctcctgagaatggacggtagtgaaggaccactggtactccgttgccttgtacgacattatatggtgttatttccctttcatgcaccgggttatgcaatctggcctgtttcatccatgcagtgagggttttttctttttctttttggtttgacattgtagatactcattttccggcagtttctttctgaacccaactgcatttgcttagacattgctgtgcagttttccagcattgggtttcgatgtttgcctcgtgctctcctacgtttgaaagaagtactatatgaatcatgttttttgtccgtttcagcaataaaaaaaaaaaaaa

SEQ ID NO: 610 - DNA, 1252 bp, Zea mays
gtgctgcctgcggtgcgcctctgggggagccccctgcccagtagggtaacataattattatcgcgcgtgagaaaacgatatcatcggtcgaagctttaggcttggccgcttgggttatccgttagaataagctttttttggggggctgggaggatgagaataagctgttggtcatatctccattaactgtagtctccactttccatctgtgcctacagtagccggccaccatggaccaatggggtagcgaaacgcgtcctgacgtaagcaatcgtcatctcgacgggggagtggtcactgacagccggcccgggagggatattatagcctttacctgttggtcgagcagtgaggcggggagccaagccatggtatacccaccctctcaagcgcaccagtaggtgctgtgccatcagatcctccaggggccacaacttccttccactccctctctctatctctctctatctctcttctcaccgagatttgttccgatcctcttatggttacgacccgcctgccgtccgctgccacacagcagcggagttagtgactacgcaatcggtcgagctcgtcgtgaggctcttccgctcttggtcggtggtgctgtttcgcgtcctgggaaaaatggatgcggaggcggcgagaaggaagcaggtggcgcctccgcaggagaagaggaagcgcggccggctggagctgcggcggatccaggaccggacgagccggcaggtgcgcttctccaagcgccggagcgggctgttcaagaaggcccacgagctctccgtgctgtgcgacgccgaggtcgcgatggtcgtcttctcccccgccggccgcctctatcactacgcctccctaggcaccaggtgaagctactctccatcgtatgcatggttgagctggtgctttctgctgcttttgcttcttcttcttcctcgcattaaattttagatttattgcgttgacgaccgccctactcctactggagtagcttttgactcgatcgatatggataaactggattttcgtcgagagccgtgcgggagcagtagtttactacttgctgtggctgccactgcaagaacacaccgcagccgcagcagctgcaccgaggcgagcagttttagaccgtcaacaagcacgtgctcatttggtggatccatatatagactagtatatatgaacaagtacgagattaaggttttatacatctatttagaggcatatatatagatataaatattaactagca

SEQ ID NO: 611 - DNA, 2065 bp, Zea mays
attcggctcgagaaatcaacccgttcgttcctcccttctcccccctctccccacatcgggcagcctcccccctctctctcaccgctcaggtcaggccaggcccggcgggagagagatccggcgagagacgcggcctcttgctcccctcaacccccttaaagaagcgcatagaagcttcggaaggtgcccctccgcggctcgaaggaggggaggggacgccgcggacaatgacggcgatggaagccgccgtcgacgctatgctcgccgccgcgagccgtgccttcacgagcacctttgccatcgccatccagatccaggggtgcatgatctgtttagtccttgctctcgggtgggcggctgcttcaattgtcagaaaaggggttataaagaacatgaggcgcaacattgtagatggaaatagttttgcatttctttgtgacaacatagatgagcttgagcactctgttcaggagaatttacctagagtctctgtagtcatgcctttgaagggctttggcgaacataatttgcaaaattggcgaactcagattacatcactttatggtgggccactggaattcttgtttatcgtcgagagcaaagatgatcctgcttatcatgctgtttcccgtttgatcacagagtacaaggacaatctggaggcaaaggtggtcgttgctgggttgtcaacaacctgtagccagaaaattcacaatcaattgatcggtgttgaaaagatgcacaaggataccaagtatgtattgtttcttgatgatgatgtgaggctgcatcctgggactatcggagctctcacaaaagaaatggagaagaatcctgagatatttatacaaactggatatccccttgacttaccttctggcagtttgggcagctattgcatatatgaataccacatgccttgttcgatgggatttgcaactggtgggaagactttcttcttgtggggtggctgtatgatgatgcatgctgatgattttaggcaagaccggtacggcattgtcagtggattaagagatggcggttactcagatgatatgacactcgctgcaatagcaggacagcacaaaaggctcatattttcaccacctgttgctgtgtttccacacccccttgccagtgatcttagcttctccagatactggaattacctcaggaaacaaacttttgttctcgagtcatatgtatcgaatgtaaactggatgatgaaccgtgcattatttacaagccattgctatctgtcatgggggtttgtctggccatacattatggctttggtccatgttttagctgctcttcgggcaccgtacagcaaagttgtaaaggaagcatccgattcatcttggggtttgttcctggtgggcctcttgttcacatgcactctgatcgagctcgtttcaatgtggaatttgactaaggtggaaattcaactgtgcaatatgctgtctcctgaaggaccgaaagtatctcttgattcatacaactgggggctcgtgttcatcgctgtgttggtagacaacttcctctatccagtatccgcaatccggtcgcatttctcccaatcaatcaactggtctggcatccggtactacttgagggacgggaaaataagcaagatcgagagagagaacagttcgaagtacactgatcttggagggaagcatctatacggcaagaggacataccctcctaacaaatcgttgctcggttacctgtcaagaactctagtgcaatggcatcagccaaagaaatatgacgtataggaaggtcgaccgggggagattcagccctcgattgtgtggggggcttcttgttgtacacctcttttggtttcaactttctttcatgcctctctctctctctctctcctctctgattgtttagtggttattaggttcattcatattaaattttgtggtgttcaatcggcgccaccactttgaaagggttgcattgcacctcatagttctttgtaacactagagatatgtaacgatttggctgaagaagtgaaatgttccatgttggtgagtcggtctctttggttc

SEQ ID NO: 612 - DNA, 923 bp, Zea mays
actcctatgggcgattgggttcctcgaggccggccgggaacgcggcgtctcctttcgaccaccattgactactcagacatacatagcttccttgcgtccgtcgatggggctcacatcgaccaggtggatggcgcagccgccgccgccgccggagatggagagacctgctgcttccggggcgctcatctacgccatggtggcgcggggcacggtggcggtggcggagcacacgtcctacacgggcaacttccgggacatcgccgcgcagtgcctgcacaagctgccggcggggaacaaccggttcacctacacctgcgacgcccacaccttcaacttcctcgtcagcgacggatacgcatactgcgtcgttgccaccgagtcggctgggcggcagatccctatggccttcctggagatgatcaaggaggaattcaacaggagatattcaggtggcgaagcaggaacggctacagccaacagtctcacccgagatttcgggcccaggcttagagaccagatgcagtactgcacggatcacccagaggaagtgagcaagctgtccagagtgaaggcccaggtggatcaggtgaaaagcatcatgatggaaaacatcgacaaggcctttgatcgcggacagcagatcgacgggcttgtcacaaggacggagcagctccacgacgaggccgttgatttcaggcggcaaggcgtgcagctgcggcgcaggatgtggtaccagaacatgaaggtgaagctcatcgtcctcggcgtcgtcgtcgcgctcatccttatcatagtcctctcaatttgccatggcggatgcagcaagtgattattctttttttttttaaaaaaatgtgctggtgctggtcttttgctcgctctacctataaacatatctaatctagagattatacatttttact

SEQ ID NO: 613 - DNA, 3763 bp, Zea mays
gttatatttatcttatttttttgtaaaacttacgctatgtaataaatactctgattattgtgacatttatctctatacactatgtaattatatatgatatctttttagcgtatgtataagatttaaccagctttgttacttaaattcgagtgtgacaaatattatttcccgagatgttaactgatttcctattatccaatcaccatcatgcagttcatacccgtacacctttccagagctaaagaaggaaagcagacattaaaaaaaaggcggagatccgacggctgaggaagctcgaaacgccctatccgacggtccaaaccgcgccgagcgggcgatccgtcgtccttgcagcgcaccactgcagctcgctcgctcaacactcggagtgtgtcctctcgcctcctcccctctccgccagcggctgccaccagcccaccaccgggtcccccgccgccagccggcaaaaatttccccacctctagacgccctttcccctccccccgagatcccatccatggccacctcccgcccccggatctggcgctgagcccgccattgccggatccctgccaggcctccaccccgccgtcgcgctcccggcccggttctattgggcgcggcgtggcattccctctcttctttgtgcgctcaccggggggtggtggttgatctgtactggcgggtgcagcgcgccttgcgatctctagctgttgctgcgggaggaccggccgcctcgtcgccgttgccaagcgcgctcttttaaagcccgaagattcgccccctccgcgtgttcgtgtcgccgagaggaggtcggacttgtcggaatggtcgtctaattggggagatttgatgtgttattggtgccgccggatctcgccgacatgtggaagcaatttatcggaaagctatcgtggaagtcaatgaaatccagctctggcagcggggggtcgccgccggcgccactatcgtcgccgcgggataatggagcctcaccgcgggagaatggggccacggggaagcctaacgtctcgcctcggtctcccgcggctggcgccggagccggagccgaggtgaggtccagggaggacgcctttgtccagaaagttaacatttgctgcgcggtgtacgacttctccgaccgaggcaaggactcgccggagaaggagcggaagcggcaaatgctcatgtccctcgtcgactgcattggcgccgccgaggagccgctcacggagaccatgatagcagcgtgcgtgcgcatgttcgctgctaacctgttcagggtcttcccgcccaaagtccggtctggcacctcggcttcggagaccgaggaggacgagccgttcttcgatccgtcctggtaccacctgcaagtcgtttacgagtttctccttaggtttgtgacctcaccactcgtggatgctaaggtggctaggaagtatgtggatagccctttcgtctccaagctgctcgatctgtttgattcggatgacccgagagaaagggactgcttgaagacaatattgcataggatatatggcaagttcatgggaaaccgaccgttcatccgtaaggctgtgagcaacatcttctataggtttgtgttcgagacggatcaccacaatgggattgccgaactattggaggtctttggcagtgtgataagtgggtttgcaaagccattgaaggaggaacataagttgttcttatggaaagcattgataccacttcataagccgaaatcaatgggagtgtatctgccacagctgacatattgcatcacacaatttattgacaaggaaccaaagcttgctgggactgtgatcaggggcctgttaaagtattggccagttacaaatagtcaaaaggaaatgatgtttttgggggagttggaggaggtgctggagttgactgacatggctgaatttcagaagtgcatggtccccttattccggaagattgctagttgcctgaatagctctcattttcaggtgagattcactctttatatttttgctctggtcttgtgctcataacaattgccgtggtaagaaatgctaacaggaatatatgctcgtgtaatcattagtttcctgactaagggttagatgcacagcttttagcttttttttaatcaagtaatagttgcaatgttgtttgccagatggatcttttttcttatgttaattgaagagtatgtttggcacctttcgtttttcgccttgcttttctgatttattagtgtccctttacatggtctcctatgcctttctgacatagtgctcgctaattaatgataaaagtttcatcagtggttagaatctgttcttgttggctaaagtgagaccacacacttatgttagtggcttaagtttagttggtggtcacttctctttatgaggcttcaggccattcgttttgaccatagaattggaaatgacctatctaattctgcctcatatcagtctcagtgtactacggaaatcttaggtcacaaataaatccggtacaaaggcagatgataggagtctttggggtgtttgtgtggcaattgccaaaattctgcttctcttgtaagttgtaaatactcgaattttctcaataaatcgaagatgcagacatttgcactttgtggggcttgacaatcagctaggtagaattgtgattttcaatcggttctgtatcgattttgtgcacggatgtggatgaacacagcaacactcatttccttgtatgtacaatatattgtattcatctgtcttcgtcgactaaataggatacataaatgtagggttgggaacagcatgatgtttgcgattatactatctttgttcgtgtcactggcatgttcaacaacacatgcatattgcattgttgcgtaaagggattatcctttgacactcaagcactgccttttcttggcatgcttttttgcaggttgcagagagagccttgttcctatggaacaacgagcacctattcgacatgatctcccaaaaccgccaagtaatcctaccaatcatatacccagctctggagaggaacacccgctggcactggaaccagtcggtcctcaacgtaaccatgaacgtgcggaaaatgttccgcgacatggacgagaggctgcttcaagcctgccacgacaacttccaagaggaagaggagaagcgggccgtgactgaggagcggcggaggctcatgtgggagcagctggagcgaagtgccgctcgcgggtaccaccagccggcgacgatcgctgccgatgcgagcagcttccccgcgccctcttcatcggctcgtcttgtatccctcaccgtgacatgagaacacgaggttgcaaccagatgttgctctgttttcgccgcttggtagctaaagctagatgatggagttgcttgcttcgctgggggatgcacgcacgaaggcattttgttaccttctgtgtatgcataaccccccttgtcaaagtctgtaattaatagctgacggtttgaggacaaagggacgttttggatttttgcaatggcgtattcttgaaatgggcatggtgttctcttcttgctgcctaaatgttgtctggttctaccacagcgctctctgctgtgtatctggacagtatgtatgccccatgggaggatgacaatcgacaagtttgcagctttccttttttttttggttgttgatttcgtggcaaatagcttgtgcttatttttttattcttttaagtggacataatcagtaaaaaaagaaacaagaacagcgg

SEQ ID NO: 614 - DNA, 2773 bp, Zea mays
  misc_feature (2301)..(2301): n is a, c, g, or t
gcttgcatgcctgcagtctagatgtgttgtatacatctttatggtttagggttttatggctaagggttaggttctggatgaatggatttttgctgtaaaccattaaagcttcatcattgctattgacagaaagataatcttgtggagggacaagcttattctgttatgggattggtaccttcgaactattgcaccgaaatcatgtacttgcatgctagaggatcatctacaacatggaagcccttagcatcagctcagactacagattttaagtaagcgcattggctgcactccagttacatttcatcggttcaaccttaaccatgtttctttatccagaccattctttacccctcgtagagcaattgaactcttgaaatttggtgaggtgccgatttcaaggtaagtctaatctcatatttaaccttcacaatattctttcattgtattaatgaacctattgaataattcctattggttgcagtgaatttgatattgcaggtcttattttatatgttggcaatacttatttatgtaacaacaagaaaaagcagtggctttttttaacagatggatctaaatttgtctctgggcaagggtgtgaagagcaagattgtcttctagctgttagcttttcgtccgcaaccactgatgaagactctacattatttagttacactctctctggaaatacagtatgttttattttgattttgtatgttgagtttctgtttcttgttttgaaacctctagatggaacaccagtctgggaaatctactgctagacatttgaagaccatttgaaagttattacatttgttcagctttaagttaaaccctttcaaaacaagtgtggcttcagcttattgctaattttcttgctcaggttggttttagtaatctggtcaaacgacagaaagacgagacgaggcaagtatgggtagctgaggcccctgagagctcaagctacactctttccaacgagattcctagaaaatctcacctaaaagaagccgcagttttggctgagagatgggcttctagatcttatcatgtaagttttccactcctgacaacaacctgttaggcgcgagtgctatatttttatgatgattctagtgccactcattattttactgcgataccaatggcccttgcagaaaattcaagagctaaaagaaagggttttatgtatagttggcaacgctggtgtctgaattataataaacggtaccacctgctgtttttggaaatggtgcaagattttgcttgggggttgtcttagctacaccattatttctcactgatgttggttggttctggttggagcctttttaacgcaatatgaatggcccttgcaaaaaacttcaagagcagcaagatccttgcacaaacttcaaaaatcaacttgaagatgtacacatttgaagacacgaggcttcagggctgttttctaagtctgtgtataaagcctttttcagagggtcgattaactttgagccgtggaaaaggttatggagatcttgggcgccgcctaaatgcaaaacttttctctggctagccattaggaacaaatgttgaactgcagacagataggagaagagggctttctcacctagaggcctgccccctctgcgatcaagagcaggaaacagctcaacacatcctaacgagttgtgtttttgcaaggcttttttggcacaacattatggctcccttcggtatgggtacctcaccccgagtcagaatgaacttatcctttgcagatttgtggcgaaaagtgagcaacaatgtgcataaagagaagagaacaggaataaacaatgctattatcttggaggcctggtgcatttggcggcaaagaaatcgtacggtttttgaaggagatttgccagctgttagcaaggtgcagcaaagttttctagaagagctaacatgtttggtcttgactggggctcatcaccttagcattttagggataattgatactcttagagcggtcggattgggctctcttgatcatatgtaatttttgtttcagtttcgatgtggtgtgggtgatgatcttgctcagcaagatcctcatcttgtaggattttcttttctctctaatataaaatatgggacgcgttcgagaaaaaaaaaacttcaagagctaaaagaaaggcttctatgtatagttggcgaccctggtgtctgaattataataaatggtgctgcccgccattttttttggagatgatgcaagattttgcatgggggttcttgccataactacatgtctacatcaatatttctcantggtacaattagaagatcaacaacccacattggcacattgtatgcacaactttcagaacttcggcctagccataaccactaccgttgctatatttttgcacttacagggcttgctatattgggctggacagatcagagttcgactctactcatatgggaactcatacgcgaatgaccaccagaaagtatatatatgcagccaaggtgtattggagtgcctcgttgccgagaagtatatttgagctgagcagatatcggttggttctggagtgtgcatgcagtgcagtggtaccaagcgtgtgctgagccagaaaattgaataagaagtggattcaagcccctccaattccatccacaaaattaagaaccacaaaatttaaaagccaattcatcaaccatactcctgcaataatggcagcaaaaccaaaaataaaacattgggaaggcctttgagcactatacttattttaag

SEQ ID NO: 615 - DNA, 1745 bp, Zea mays
ggccgggaaaagcgaggcaggcagcggctgtcccgagctgtcgaaagcgaggcgcggcggcagtcctcgcagggccgaccggtcaaaagcactgctgctccacaccacccccaccatccctttccccaacccccgaagccgagccagcgaatcaccccgcccgcagccgcaagcaagcagccaagcagtgtgaactgaccgtccgttccgtccagcccaccatggaggcgccgccggtaccggagctcatggatctggacgcgccccctcccgccgcagccgacgccgcagccgcggcgccggttccccccgccgtcagcgacaagaagaaggaaggggaagggggagacactgttacgggccacatcatctccaccaccatcggtgggaagaacggcgagccgaagcggaccatcagttacatggcagaacgtgtcgtgggtacgggctcatttgggatcgtcttccaggctaagtgtttggagactggagagaccttcgccattaagaaggtgctgcaggatcggcgttacaagaaccgggagctgcaacttatgcgtgccatggagcaccccaacgtcatctgcctgaagcactgcttcttctcaacaacgagcagggacgagttgtttctaaaccttgtcatggaatttgtccccgagaccctgtaccgtgtcctgaagcactacagcaacgcgaaccagaggatgcctcttatctacgtcaagctctacatgtatcagcttttcagaggcctagcctatattcataatgtaccaggagtctgccatagggatgtaaagccacaaaacgttttggttgatcctctcacccaccaggtcaagctctgtgactttggtagcgcaaaagtcctgattcctggtgaaccgaacatatcttacatatgctctcgttattatcgtgctccagagctcatatttggagcgacggagtatacaacttcaatagacatatggtcagctggctgggttctagctgagttgcttcttggtcagccactgtttccgggagagagtgctgttgatcagttggtagagattatcaaggttcttggtactccaacccgtgaggagatacggtgcatgaatcccaactatactgagttcaggtttcctcagataaaggctcatccgtggcacaagattttccacaagagaatgcctcctgaagccattgaccttgcttcccgtctccttcagtattcaccaagtcttcgccgctctgctcttgacgcatgcgctcatcccttcttcgatgagctgcggacaccgaacgcacgcctaccaaacggccgcccgttccctccgctctttaacttcaagcacgaactagcaaatgcctctccggacctcgtcagcaggcttgtgccggagcacattagacggcagatcggtgtcaacttcgggagcagctaggagggcaggcgctgcgatggtcggagttttcggtcttggtttccccttctggagagtgggaggggctcaagcagtacctgagaaaagtagtgaaaccgtgtaaattatctgaccgtgaaggagtactaccgccagtaactggcgcatgttcgtccagtagttatggtaagaatgtaggaggtggagactggttaatgtgtagggtcgttttttttgttttgttttgatattactaccattttgttgtaatgttcgtcggtacttccagcagtagtgtagctggccacgttttgttaaaaaaaaaaaaaa

SEQ ID NO: 616 - DNA, 1731 bp, Zea mays
gaaaaccaccatccccgttccccaacccccccaaagccgagagccatcccgcccgcagccgcaaccaggcaagcaagcgggagccgccaactcgtgcctctcggcagcggcgtctgaactctgaaccgaccgaccgttccgttcacccccaccatggaggcgccgccgggaccggggcccatggagctggacgccccacctcccgccgccgccgcggcgattcctcccgccggcagcgacaagcacaaggtggacggggaagggggagacgctgtgacgggccatatcatctccaccaccatcggcgggaagaacggcgagcccaatcggaccatcagttacatggcagaacgtgtcgtgggtacaggctcatttgggatcgtcttccaggctaagtgtctggaaacaggagagacctttgccatcaagaaggtgctgcaagatcggcgttacaagaaccgggagctgcaacttatgcgtgccatggagcaccccaacgtcatctgcctgaagcactgcttcttctcgacaacgagcagggacgaattgtttttaaaccttgtcatggaattcgtccctgagactctataccgggtcctgaagcactacagcaatgcgaaccagaggatgcctcttatctacgtcaagctctacatgtatcagctttttagaggcctagcttatattcataatgtaccaggagtctgccatagggatgtgaagccacaaaatgttttggttgatcctctcacccaccaggtcaagctctgtgactttggtagtgcaaaagttctgattcctggtgaaccgaacatatcttacatatgctctcgttactatcgtgcccctgagctcatatttggtgcgacggagtatacaagttcaatagacatatggtcagctggttgtgttctagctgagttgcttcttggacagccactatttccaggagagagcgctgttgatcagttggtagagatcatcaaggttcttggtactccaacccgtgaggagatacggtgcatgaatcccaactatactgagttcaggtttcctcagataaaggctcatccatggcacaagattttccacaagagaatgcctcctgaagccatagaccttgcttcccgtctccttcagtattcaccaagtcttcgctgctctgctcttgacgcatgtgctcatcccttcttcgatgagctgcggacaccgaatgcacgcctaccaaacggccgcccgttccctccgctctttaacttcaagcacgaactagcaaatgcctctccagaccttgtcagcaggcttgtgccggagcacattagacggcagatcggtgtcaacttcgggagcagctaggagggcaggcgctgcgatggtcggagttttcggtcttggtttccccttctggagagtgggaggggctcaagcagtacctgagaaaagtagtgaaaccgtgtatattatctgaccgtgaaggagtactaccgccagtaactggcgcatgttcgtccagtagttatggtaagaatgtaggaggtggagactggttaatgtgtagggtcgtttttttttgttttgttattactaccattttgttgtaatgttcgtcggtacttccagcagtagtgtagctggccacgttttgttcgtccgccatgatgtaaatgatcatcgcccaactgtaatgcatgttctctctgatcgtttcgtagtccaaaaaaaaaaaaaaaa

SEQ ID NO: 617 - DNA, 2371 bp, Zea mays
gatcatatcgaaactttgagctcagaatgcatcaattactaactgatgcctctactttccgttttatcctccagattttccacaagagaatgcctcctgaagccatagaccttgcttctcgtctccttcagtattcaccaagtcttcgctgctctgctgtgagtactttttgtttactttgttaatttagattagagttggctttgaagctaatagtttgagataatagacaatgaaactagacagactaaggtggttgtgttgtgcatggtccattttacttggctgtacctgttccaaagctttccaatgttgtcaattattcgcagtcttgtagaccgtgaccaattaaaagtggccaagtccatgtggaagtatgtcctcccaaaccttagcttaaatggtcctgcatggatatgataattatgctgcccagtggtccagaaggctagaaccaagagttccatgcatgttagctgatgaagagtgggtgcaactttatagtcacatgtgcttgttaagtgtactagctagtggcccatctaaaaggtgtagtgctagtgctcatgctgtaggtggcacgcaacaatacaacataatcttttaatgtaccagtctgttggttagaaatgttctcatgcgtttcatgtattctatacagcttgacgcatgtgctcatcccttcttcgatgagctgcggacaccgaacgcacgcctaccaaacggccgcccgttccctccgctctttaacttcaagcacgaagtaagcagactaaacacagtgcgaagttcaagcagttaattcaagccacgtgcttcagttcttgatctgctgtttcgcttatcactcttcgaccatccccttttctgccgtgcgcagctagcaaatgcctctccggacctcgtcagcaggcttgtgccggagcacattagacggcagatcggtgtcaacttcgggagcagctaggagggcaggcgctgtgatggtcgaagttttcggtcttggtttccccttctggagagtgggaggggctcaagcagtacctgagaaaagtagtgaaaccgtgtaaattatctgaccgtgaaggagtactaccgccagtaactggcgcatgttcgtccagtagttatggtaagaatgtaggaggtggagactggttaatgtgtagggtcgttttttttgttttgttttgatattactaccattttgttgtaatgttcgtcggtacttccagcagtagtgtagctggccacgttttgttcgtccgccatgatgtaaatgatcatcgcccaactgtaatgcatgttctctctgatcgtttcgtagtcctgatgcctgctgtgatgaagctcagagtctgaggcaggaaagtcggaagaacttccggctcccgaaataggaatcgctgccggtgtgaaactacggtgaagttgtatcgaaattttgcatgccaatacagactattctatcggttggaacttggaagttatctgatgagcggttcaatcgcaaatgttcattcccaactcccaaggccacaaatgctctcggattgtagtgggctttacacgaacagtggcttcttaaaatcgtagtttgattttgttcttacacagagatatatcgaaaatcacaggcaacgcgggttggtatcatttcttccgcatcgagtcagttcaaggcatagaaacgggaataattaatagatacagtctagtttttgcgatttatttgaccgggcacaagtgcgtcgctacacattcttgatgtgactcgcaagtcgctgtagcttggagcaattcggtcgtacctatcgggcaaccaaccagtgcaccaggcggcgcgcacgactagagccgcggccgcgccggcgccggcccggcgccgtggtccttgacctgggaccacagctggggccacgcggccttcctgatctcggcgacggcctccccgtcccagcccctggcggccagcctctcggcctcggcgacggccgcggccaccacgtcctcggggccgccgtccacggcggcgtccacgaggccccggcgcacggcctcggccgcggccacccggtccccgcgcagcaccaggtcgcgccgggccgcggcgtcggggaccttgtcgcggagcacggcggccacgaagtcgacgaacttgatgccgacgtcgacctcgctcatgtacaggagcccgcgggaggcgcgcatgagcgcggcgtcgtgcgcgagcgccagcgcgcacccggccgccgccgcgtggcccgtcaccgccgccaccgtgggcacgcgcagcgccagcaggtcggccagcagcgcgcggagcccgccgtccatggcgtcgtgcaggccgggcggcgccgcgcgcgcc

SEQ ID NO: 618 - DNA, 1884 bp, Zea mays
aggccggccggggaggcaggcagcggctgtcccgagctgtcgaaagcgaggcgcggcggcagtcctcgcagggccgaccggtcaaaagcactgctgcgccacaccacccccccccaccatccctttccccaacccccgaagccgagccagcgaaccaccccgcccgcagccgcaagcaagcagccaagcagtgtgaactgaccgtccgttccgtccagcccaccatggaggcgccgccggtaccggagctcatggatctggacgcgccccctcccgccgcagccgacgccgcagccgcggcgccggttccccccgccgtcagcgacaagaagaaggaaggggaagggggagacactgttacgggccacatcatctccaccaccatcggtgggaagaacggcgagccgaagcggaccatcagttacatggcagaacgtgtcgtgggtacgggctcatttgggatcgtcttccaggctaagtgtttggagactggagagaccttcgccattaagaaggtgctgcaggatcggcgttacaagaaccgggagctgcaacttatgcgtgccatggagcaccccaacgtcatctgcctgaagcactgcttcttctcaacaacgagcagggacgagttgtttctaaaccttgtcatggaatttgtccccgagaccctgtaccgtgtcctgaagcactacagcaacgcgaaccagaggatgcctcttatctacgtcaagctctacatgtatcagcttttcagaggcctagcctatattcataatgtaccaggagtctgccatagggatgtaaagccacaaaacgttttggttgatcctctcacccaccaggtcaagctctgtgactttggtagcgcaaaagtcctggttcctggtgaaccgaacatatcttacatatgctctcgttattatcgtgctccagagctcatatttggagcgacagagtatacaacttcaatagacatatggtcagctggttgtgttctagctgagttgcttcttggtcagccactgtttccgggagagagtgctgttgatcagttggtagagattatcaaggttcttggtactccaacccgtgaggagatacgatgcatgaatcccaactatactgagttcaggtttcctcagataaaggctcatccgtggcacaagattttccacaagagaatgcctccggaagccattgaccttgcttcccgtctccttcagtattcgccaagtcttcgctgctctgctcttgatgcatgcgctcatcccttctttgatgagctgcgggcgccgaatgcacgtctaccaaacggccgtccattccctccgctctttaacttcaaacatgagctagcaaatgcctccccggacctcatcaacaggcttgtaccggagcacattagacggcagaacggtgtcaactttgggcatatcgggagctaggagggcaggcggctgccatggtctagtttttggtcttggtaccccatgtgcagggccggttgcaggtgaaggtgatattgctgcaccatctgggagaggaggggctcagcagtacctgagagagctgaaactatgtaaattatctgaccgcgaaggagtacggccagtgttaagccagtaaactggcgcatgttggtccagagtagttaaggtaagaatgtagcaggtggagactggtaaatgcctagggtcgtttttagttgttaccagtattttgtaatgtaatgttcgtcggtacttcccagcagtagtgtagctgctcctgttttgttcgcccgccatgatgtaaatgatcatcacccaactggaacccctgttatctcgttaaaaaaaaaggcctctgatcgtttcgtaggggcccggtacgagaatttaaaaa

SEQ ID NO: 619 - DNA, 1792 bp, Zea mays
gcagtcgcagcagggccgagccgaccggtcaaaagcactgctgccccaccccaacccaccaccatccccgttccccaacccccaaagccgagagccatcccgcccgcagccgcaaccaggcaagcaagcgggagccgccaactcgtgcctctcggcagcggcgtctgaactctgaaccgaccgaccgaccgaccgttccgttccgttcaccccaccatggaggcgccgccgggaccggggcccatggagctggacgccccacctcccgccgccgccgccgcggcgattcctcccgccggcagcgacaagcacaaggacggggaagggggagacgctgtgacgggccatatcatctccaccaccatcggcgggaagaacggcgagcccaagcggaccatcagttacatggcagaacgtgtcgtgggcacaggctcatttgggatcgtcttccaggctaagtgtctggaaacaggagagaccttcgccatcaagaaggtgctgcaagatcggcgttacaagaaccgggagctgcaacttatgcgtgccatggagcaccccaacgtcatctgcctgaagcactgcttcttctcgacaacgagcagggacgaattgtttttaaaccttgtcatggaattcgtccctgagactctataccgagtcctgaagcactacagcaatgcgaaccagaggatgcctcttatctacgtcaagctctacatgtatcagctttttagaggcctagcttatattcataatgtaccaggagtctgccatagggatgtgaagccacaaaacgttttggttgatcctctcacccaccaggtcaagctctgtgactttggtagtgcaaaagttctgattcctggtgaaccgaacatatcttacatatgctctcgttactatcgtgcccctgagctcatatttggtgcgacggagtatacaagttcaatagacatatggtcagctggttgtgttctagctgagttgcttcttggacagccactatttccaggagagagcgctgttgatcagttggtagagatcatcaaggttcttggtactccaacccgtgaggagatacggtgcatgaatcccaactatactgagttcaggtttcctcagataaaggctcatccatggcacaagattttccacaagagaatgcctcctgaagccatagaccttgcttctcgtctccttcagtattcaccaagtcttcgctgctctgctcttgacgcatgtgctcatcccttcttcgatgagctgcggacaccgaacgcacgcctaccaaacggccgcccgttccctccgctctttaacttcaagcacgaactagcaaatgcctctccggacctcgtcagcaggcttgtgccggagcacattagacggcagatcggtgtcaacttcgggagcagctaggagggcaggcgctgtgatggtcgaagttttcggtcttggtttccccttctggagagtgggaggggctcaagcagtacctgagaaaagtagtgaaaccgtgtaaattatctgaccgtgaaggagtactaccgccagtaactggcgcatgttcgtccagtagttatggtaagaatgtaggaggtggagactggttaatgtgtagggtcgttttttttgttttgttttgatattactaccattttgttgtaatgttcgtcggtacttccagcagtagtgtagctggccacgttttgttcgtccgccatgatgtaaatgatcatcgcccaactgtaatgcatgttctctctgatcgtttcgaaaaaaaaggccccta

SEQ ID NO: 620 - DNA, 2788 bp, Zea mays
ccccggccccggaattttatttccccccccctttgggggaattggggtccgggcccccccccggggtttttttttttttttttttccttttttttttttttttttttttttttttttttttttttttttttttttttttttttttttttttttttttttttttttttgtttacataaccggcaaacgaatttaatatgaatgttctagctgggaggagtttacatttttagcctttgaatatccatcaggcaatgaaatatatactccttagctacaagtgtcaccgaaacaacagttcctcaagtgtcaacgatacaagtttgacatgtggcttaaaacaagcctacaaaactgagtgagtttgatggcaagactcattgcaaaatcaactttccgcgcttcttactatttgttctatatatctggttctccctctgtatctctcctccgtctccctcgttttccctcagcagagagttttaagaggatctctgcttctccctgatcctcccttaaacccgtgtctttttcgtctttggggcttgtccatacccataggagccctggaaagtttgacaatggcttcttttgatttagggtcaattagatagtcaggaacataacgcatgtgtgcatcagttcatgaatttccctgttgtttatcaacttatcacgcttgagcaaatcaatgtcccttggattcgcttcaaaatgagacttcaatcacagaaggtttggatgcatcaacgactttccgaagattatctcgccttgatttatcattaagaccccgtacattccaaatcaagatattggatctatccattgacgcagaatcagaagcaggaccaaaaataggagctgtcagacaactaacacggtgttgtcggcaagacaagcttgtccttcaggaggcgcgtcccagccaaataaagcagcaagcgctgccacatggtcgcggaatagtctatcctcatcatagagtttgatgtacctctcaagggtttcatcagatatccttccttcttcatctgacaagccaagctcgcggcatagtctatcctcatcatagagtttgatgtacctctcaagggtttcatcagatatccttccttcttcatctgacaagccaagcttacggcaagcggctgatgctgaaactaggtcagtttcagcctttcaggtggcagttaggcaattcgacgggtgcgccgtggcaggcgggtcgggtagttcattttctttctccttttctgaatgatcggaacaggtacaagggtgtctatcttcttggtaaccttttcaatgaactcagatgctggagctggcgattctccctgttgtcttggtgctcgagaatagacaatgatgttatcagggcgaaatcttacagcaaattctggaggcccttggagcagcagtgtctggagagctttgcccacttcgccgttggttggaggctcggagcacttggcactaggaacttgccaacagccacaagctcgatgtccgaggggtagcatctgttgattccagaggcacacagcagggaatagtcggctcaggaatttgcactgcattcacctcagtcccctttgtcgcccatggaattgccgcatcagggatggtccagcacaagccaagaatttgatatacacttcacaatttgtgttacttcccaggcagaagatttagattccatagtttttttctttcattctagaatatatgttgcctttttgcagagcctcaagccttggaccacctagtcagaatcacccgatcatccacctgtgcatccctaatctcaagattagagcaacaaccctccagctatttgatttgttgcaccgacagtgaaacaggaaaatgatctcatgctgggagaagaggacctgcttatatcagggattatttgtgttgccacatccttcctcacaattacaggggcactgctaatgtcaaacagccaaagtctttttagctttcaatttgcccatcttgtactgattcatggaaccatcaacaccaacactaaggttggttggtttgtccgtattcatgtagcaatttcctgagcttcacttgtaactgttatttcgcctgtaagcctagaatatattgcagaaccaggacggcaattctgttcctccatgaatgatagcagacgggagcagtcagcagtgtttcctttttgtaataagccatcaatcaaaatcttccaagcaatctcatcacggttgtattcctttgatagtatgtcaccaaaaatgcttttagcagtatgaaagcttccttcctcacaaagagcacaaataataaacctataagattctaaacgtggtaaatagtttcttttcaccattgaatcaagaaaccttaaagcttcttttagcaatttcattctgtagcaacattctatcatacaagtatatacatcctcacttggggttaagttagcactctgcatccctacgagaaaactttttgcttcctccaatctgtcgactttgctcaaacatctaataaaacaatcgtaaacatagctggctgagctgcactgaagcttaatcacttcctccaaaagttcctcgagaactttcatgtcaactattttccataaactaatagaatcagcaactaagtcatggtaggaattgggggggggggggggggaataagggagctctctctctctcctctctctcctgccgaaattcctggcacccccggtggatccccctaaatcaaagagcgggcccgccaccagcggtggaagctcccagc

SEQ ID NO: 621 - DNA, 915 bp, Zea mays
  misc_feature (38)..(38): n is a, c, g, or t
cctcgaggccggccgggaattctttttgtctcgcgaanacaggggcggaaggatccaatccaatccaaccaaacctctccccccaccacctgctgcaatcgctagcgtgcgcataaattaacaaggcccccccccgcccggcccgccacccggtttctgcaaacatcgcaagtccacggcccgcccccaatcggccaatcctcaccccgcatcttaaggttcctgtcgcctcagcggctgcctccagtcctccgccctcccgctccagcggggctcgccattgatggagtacgagcgcatccacgggccgctcccgcgccatcagtccgggggattctctccagctaagttgcgagcaatgcttcgcgggatagagaaacgccagcgcaacaacggcgaggactcttctccggaggccaacgactccggcgagctcgacgaccggaggagcttggaatgctccacctccaccgagatgtcgagcaacagcggccacaggtcaagaaaccgtgccccggacgacgacagcttcgactcggagagcagctcgtcggggccgccgacggtgaagaggtcggccgcggtggccgcgttgctgccgcccttctctcggccaacgccgtccaagtgggacgacgccgagaagtggatctccagcccaacgtcaaaccgtactggccgtgcggggcctaccgctggagctgtgccaaagaagtctgcattggccttccctgaccatggaggccgcccgccagccgttgctaaggtggtagcggatgtgcctaccaacgctggaccagatggtctcgcccatcctgatttacttaagcctgggacacatgcctcagtagttggtgacggaacagcacctgcagttaggtctgtctgtatgagagacatggggacggaaatgac

SEQ ID NO: 622 - DNA, 1657 bp, Zea mays
ggctcgagctcgagccgcacaaccacaagacccacacacccgtcggtaaatgcaaagatcgcaagtccacggcccaccccccaaatcggccaatctccacttcttaagctccctgtcgcctccgcctcctcgtcgtccggcctcccgcgccaccaccggggcctcgccgccacgaatggagtacgagcgcatccacgagccactcccgcgccgtcagtccggcggattctccccagctaagctgcgagcgatgcttcgcgggctagagaaacaccagcgcaacagcggcgaggacacgtcgccggaggccaacgactccggcgagctcgacgaccggaggagcttggaatgctccacctccaccgagatgtcgagcaacagcggccacaggtcaaggaaccgggccccggacgacgacagcttcgactcggagagcagctcgtcggggccgcccacggtgaagaggtcggccgcggtggccgccttgctgccgcccttctctcggccaacgccgtccaagtgggacgacgccgagaagtggatttccagccccacgtccaaccgtactggccgtgccgggcctaccgctggaactatgccaaagaagtccgcattggcatttcctgaacatggagcccgccagccagccgtgctaaggtggtcacggatgtgcctactgtcgctggaccattggttaagaattcagatggtctcgcccatcctgatttgcttaaacctgcacacgatgcttcaatagttgatggaccagctcctgcagttaggtctgtctctatgagagacatggggaccgagatgactccaattgccagccaggagccttctcggaccgcgactcctatgattgcatccagtccaacctcctctcggacaccaactcctcaacgcaccacagaagttcagtgtcgcgcaatatagattctaacaagatggcgatgtctgaagaggaggtccatataagtacaagacaggaaattatggatcttggcgaaaggttaggcaagactactatagctgcatgggcaagcaaggaggagaaagctgctgcacgttccacggatactgcagccgataatgctgttgatgtcaacagggagaatcgagcggcagattggcaggaggcagagaaggcaaagtatcttgcaaggtttcatagggaggaggcaaagatccaagcttgggaaaatctccagaaagcgaaaattgaagctgaaatgaaaaggatagaggccaagatcgagcggaaacgggcgcgcgagcaagacaggctcgccagcaaactggcagcggtgagccaccgagcggaggcgaagagggaggccgcggaggcgaggcgggaccaggaagccgcgagaacggaggagcaggcggctcagatccgagaaaccgggcacacgccttcctccttctcatgctggtgctggtgcctgtgactctggttccttcactgcatgaccagcacagcacgtcatccaactgtaacatagcatgacccgtgagactgatctccggccatggtagaaaaatttgctcactgtacgacttgtgtagttccttggtctaatggtgtccagttttttggtgcctcgcggttaaaaaaaaaaaaaaaaaaaaaaaaaaaaaaaaaaaaaaaaaaaag

SEQ ID NO: 623 - DNA, 1894 bp, Zea mays
cctcgaggccggccgggccgggacacacacaggccgagcgcgcgcgcacgcagcagccaacaggggctcgccggggtagcttttaacagggacaagcctcctccccccggccggccctctttttctctttgttctcttcccggccgctttgttccctctcgctcgccctcttcttttgcgcggccctgtcattcccctggggatcagccttagcgttgcctcatatgggggcgagctagctagctgctgagcaaagcggcgggacaacaagaggctttccatctccctccctctgatctgctatcgtccccttccctgcttccctccccctcttcttgtagagaaagaggaggcgagggctgccggccggccgggacgtggtgacaagctaggctagctgggggccggggagagagagatcgagagagagggcgagatcgtcgattcgtaatacatcgcgtcgccggccatgacatggtgcaacagtttcaacgacgtgcgcgccgtggagaacaacctggccaccgccgccgccgtggctgccgccgccgccaagaaacagcagcagcagcaggcatcctcgcacgtcaacctcatcaggacctgcccctcctgcggccaccgcgcacagtatgaacaggtgcaggcggcggcgacgatccaggacctgccggggctgccggccggcgtgaagttcgatccgacggaccaggagctgctggagcacctggaggggaaggccaggccggacgcccgcaagctgcaccacccgctcatcgacgagttcatccccaccatcgagggcgagaacggcatctgctacacgcatccggagaggcttcctggtgtcggcaaggatggcctcattcgacacttcttccaccgtccgtctaaggcttacacgaccgggacgaggaaacgacgaaaggtccataccgacgaacagggtggcgagacacgatggcacaagacgggcaagacccgtccagtgttcaccggtggaaaactcaagggctacaagaagatcctggtactctacaccaactacgggaagcagcggaagccggagaagacaaactgggtgatgcatcagtaccacctagggtccgatgaggaggagaaggacggcgagctcgtcgtctccaaggtgttctaccagacgcagccgaggcagtgcggcagcggttcggcgacggctaaggacgccatcccgctcgctgccaacgcagcgactgaccaccaccaccaccaccaccatgacggtggcaatggcggcggcaacaacatgttgaaggaggcaggcattgtagatttctacagcccagcagcactaattagctacaaccaggcagcttctaacagcagggttgccgcttctgctcacctggtgcctaactttgaggtgcacactacatcgggggctgctggctttggtccctgaccaagacgcgcaagaggaactattcgactgatataggttagaggggagggaaatgcaggcagataatggcaacttcatgaatgcaataacttactacaaatggtcgacgagtttactgaaccgtaatggtggacaataagaggatgagtacgtgttgagtgagtggttggacatacaaatactgaagtgtaggaatccatacaactatacattgttcattaattgttacacatatatgtaacttgatgctatcaattttttgtttaatgatctttgttccataataagaatggagtttaatattggaaaaaaaaaaaaaaatacctaaaggacttgtatatgtatacaaatcattgtacacctttttttggaagaacatatctgttgtatcaaggagaagaaagaagcacaaggcttccagcaaagtaaaatgaagcatatataactttgaat

SEQ ID NO: 624 - DNA, 4280 bp, Zea mays
  misc_feature (491)..(491): n is a, c, g, or t
  misc_feature (559)..(559): n is a, c, g, or t
  misc_feature (895)..(895): n is a, c, g, or t
  misc_feature (972)..(972): n is a, c, g, or t
gtaaggcaattgacatttcaccactagctctagtatcataaaatgtagcaggaaatgggctggctgggtcaagtacaaatgatgccttggagggagttcgatcgggagctgttcagtggtgatgggcaggcaaggaaagggactgaaagggcaaaacgaagtatgcggcagaatcttttctctagctcttgcagagtaacttaacttttaaagcttgcagagaggatacttggtctaatactgcatttggtgcattaggtttaggtccctcttcctccgggtgtgcaccacaccacaggctgatgacagacaagccccacaattgtgtttatttacactctgcgccgctagtgtttttattttctcgcaatgactgaagcaggtaaacatagctttttttttctcgactgtcttctgtaattgttttaggtgcgctatgagaacagcagacgatacaaaatcttcgtgacacactcggaaccatactgcgnttgtagacctgcaagagtgaaggctacgacctccatggcttctcatggtggacactgaacccgctcgnggtggagacccaaggatcgaagtgtgcatggacattttgattttgcggcagagtaatgcctattgtagtctggttttgtatcgttgacaatgcaattgtcttcctccaaataaagaggaacagctaagcagaaataaaacaaaaaagaaagaattcatgtggccataccgaatcacgggcggcgtgatttatgctgccatgggcgcgtactgttcattatatgccatgcttcgtgcggttacaggtgccagttccttagccacacgtgcgaccggcgcgttctcgttaatggctgctcaacgccaacgcctgccccggttgaggccgggaatgtcnacatactcgggccgttgcctacctaccacttccatccatctcgagttgccaggcacgccatgttattattaggcgtnattttggctatatgagctcgatcttcgtagcttagttattaggttagtcgataagtttaaaaccaaagtcacatctctcggcgatagtaatataacaatacatattcagttaaaatcaaagttatacatattttttagataatggataccagtccagcttctcctcgtttggaggattagccaacacatcaaaagtttttacaataaatagattgtatatataaacaccaaaagtttttaaaatcaaagttatacatatacaatttatttatgtaatttgttacataagttttgtttagctaaaaaaaatagagaacttagtttataaaatagattgtatatatagacgtcacgttatatttgtccgttaaactgaccctcgattgctaacacagatttaagacaacgtaggccctgttcgtttttcgcggattggagatccaaaacgattctagccagattgtttctctatttatataagttttaatatgttggaaagaatcctagtccatttctagagaaacgaacggccccatagcgtgatatatgtctacatacgtatttccgctaaaaaaaactatttcccgattctgaatagcaaggaatttctgtctggtatctggtatatcgcaacagaaaacattcatatgcgacatgggtcatcaggacaacgatcaagccatagatccctaatcactcgttcttataataaagctgaaaaaaatccaagtgggcacgcacttaacctctagtactcgactgctaccggtaccggggacgacggcggaagccgcctgtctcagtcgcggccgtcccccggcttcttggactttgtcgtacgtgcccctctcctcttccccagctccctgtgccttgggtacctcgaggcccccagctgacagccactgcgtcgcaggccgcacccgcacggcgctacgcaacaacaaaagcaggtccgctcgtcccgtctcgtgaccctcccgccccgcggctcgtctccctctcacggtctctcacctcacaacctcacggtcctcacctcactccacctcgttcgccgcctcgctgccgcgtcgggccagtgcgtgcgtgggggcgggcgtgagtgactggctctcctcggcgcgcggacccaggggcggcggcgatggggaagaatatgcgcatcaagacggcgcccaaggcgaaccgtgtccccctcctcggcgacggggagacgtcaagggcgctctcggacctggaagagggcagcgacgtccagccagcgaacgtcggcttctgtcgggtcatcaaacttgcgaagcatgacgccggaaagctggtcctcgccaccgcggcgctgctcgtcgcctccctcagtaaccttctcgttcccaaatatggtggcaagataattgacattgtgtcaagagatgttcggcgcccagaagataaggcgcaagccctggaggatgtcaagggcacaattttgtacattgtgacaatcgtcttagtcggttcagtttgcacggctcttcgggcatggctattcaattctgctagtgagagagtagtcgctcgactaaggaaagacttgttcagccatctcataaaccaggaaatagcgttttttgatgtgactagaacaggagagctcttaagcaggctttctgaagatacacaaataataaagaatgctgctacaaccaacctatcagaggcactgcgcaatgtaactactacagctattggtcttggtttcatgttttcaacttcatggaagttaacattgctggcacttgtaattgtcccggttatatcagttgctgtgcgtagatttggacgttttcttcgtgagctttcacatcaaacacaagctgctgcagctgtagcttcatccatagctgaggaatctttcggtgccatccgcacagtaagatcctttgctcaggaatatcatgagatttcacgctatggtgaaaaagtagaggagacacttaaacttggtctcaaacaagctaaagttgttggcttgttttctggagggcttaatgctgcatcaaccatgtctgtggttattgttgttatttatggcgccaacttaaccatcaatggttacatgacaactggctctcttacatcattcatcttatacagccttacagttggttcgtcagtatctgccttgtcaggactatacacaactgtaatgaaagcctctggtgcaagccgtagggtttttcaacttttggaccgtgtttcgtcaatgacaaactctggggacaaatgtccaataaatgaaaaggatggggaagttgagcttgatgatgtctggtttgcatatccttctcgcccatctcatatgattcttaagggaataactctgaagctagcaccaggttcaaaggttgcacttgttgggccaagtggtggtggtaaaaccacaatagcaaatttgattgagcggttttatgaccctctaaagggaaggatcttgcttaatggagtaccgctggcagaaatttcacatcaatatcttcacagcaaggtaagcattgtcagccaggagcctacgctcttcaactgcaccatcgaagagaatattgcttatggactagagggcacaacgaactttgctgacgttgagagtgcagctaaaatggcgaatgcacacaacttcatatgcggctttcccgaccaatataagactgtcgtcggcgagcgggggatcaggttatccggcgggcagaagcagaggatcgccattgcgagagctttgcttatgaacccacgagtgcttctcctggacgaagccaccagtgccctggatgctgaaagcgaatatcttgtacaggatgcaatggactccttgatgaaagggaggactgtccttgtgatagcccaccggctctcgaccgtcaagagcgccgacaccgtcgccgtcatctccgacggcctaatcgtggagagcggcacgcacgacgaactcctggaccgcgacggcatatacacggccttggtgaagaggcagctgcaggggccgaagtttgaggccaccagcagcatcagcgaggcctccgaaattgaagcggaacccagcagtaatgggcaatagcggccccgattattaggaagaccacagttgatttgaatccacacaagtgtatgtaaccctgatgttgacgtatgccactgcgaatcacgcgaaaccattggatatcacatgatgctacggttgttgtacgagtaatttcccacttggttaatcctacacatatggtccagttttgtgtttaaaaaaaaaaaaaaagcgggcctcgagctccagc

SEQ ID NO: 625 - DNA, 2288 bp, Zea mays
aacaagcgtagcgattgtcaatgtcaagtcggatttgggcatctccaatgcgacggcatgacaccgtaacagaagggaatgctcagctggcacgtgtgtgccgcacgagaccattacctagaacatcctaatcaaaatcgcctcgccgtcgccgtcgtcatctcagctttaattcgcagcaggcgggcagtggcaggccaggccacggcgtccagcaccagctacgcctgtgcgcgcgcttgtgcagtacctacgttggtgggtgggtaggtagctagtgcggcggagcatcgatcgcgcggtactctcagttccatccgtcgagagatcgaccggtcgtcgatcgacatggcgggccggggaggagcctcggcggcggcgccgttgctggagaagacagcggcggcggcggagtcgggcggcgggtgctgctacgtggacgggtgccccgggtgcgccgtggaccggcacaaggcggcgaacccgggcattccctacggcaacttcatctacgtctggatcgtcaccctctgcacagccttaccgatatcgtcgctcttccccttcttgtatttcatgataagagacctgaatgtcgctaaaagaacagaagacatcgggttctacgctggttttgtaggtgcctcattcatgtttggtagatgcttgacttcaacagtatggggcatagcggcagaccgcgttgggaggaaacctgttgtcgtgttcggcatttcctctgtagttgtgttcaacacattgtttggtctgagtgtcaactactggatggcaatagctacccggtttctgcttggtgccttgaatggtttgcttggaccgataaaggcttatgccattgaagtttgccgacctgaacatgaagccctagcactatcacttgtcagcacagcatggggaataggtctcattattggtcctgctcttggaggctaccttgcactgcctgcagaaaattttccaactgtcttttcacctgactcaatctttggaaggttcccatatttcttaccatgcttatgcacgtcaatcttcgctgcggttgttctcataagctgcatatggatgccggagactttgcacaagcacaaagtccatgaaaatagaagtcggaacattgaagctttggaggcccgtctgattgattcaaatgaaaaggttgaagaaagtggtagtttagatagtaagaagagcctattcaggaattggccattgatgtcatcaataattgtctattgtgtcttctccttccatgacatggcttacacagaggtgttctctctatgggctgaaagcgacaagaagtatggtgggctgagtttatcatctgaggatgttggtcaagtgcttgcagtcacaggtgccagtcttcttgtatatcaactctttctataccccagtatcaataaggttcttggacctatcaaatcttctcgagttgcagctatcctgtgcataccgatcctctttgcctacccctacatgacgtacctgtcggaacctggattgtcaatcgttttgaatattgcgtcagtgataaagaataatctcggtgtcaccatcattacaggcactttcatccttcaaaacaatgccgtgcctcaggaccagcgaggcgctgcgaatggactgtccatgactgggatgtcctttttcaaggcacttgctccagcaggagcaggcattgtgttctcatgggcgcagaaacgccagcatgcgtttttcttcccaggtgaccagatggtattcttcctcctgaacgccgtcgagctggtcgggcttctcctcacgttcaagcccttcctggcagtaccagagcagtacgatacgagatagttagacgatctatctatctatacaagttctggaacgttcaagacgattcatcgtgtgcggctgtaccagtgaaggagaagcgccaaagcgtgtgccctttacgccgcggaaggtctacaaacagggacatactcctatataggaagatgcaatgcaagagctgtggtgtacttttaattgtaggtgatgtagtagtgtatggtagtatcagcattttctgcattcatgaaatgcacacgcaggtggtgggaaatgtgggcatggatcgagagtcgctgcgctgttaagtagcaataaatgttaaggttcagtgactcgctgttatttgttgggaatgaaattactgggcatctgtaccctcgttgttttatatctggctgttggattctacaaaaaaaaaaaaaaaaccccgattagtgaccccttcgacccgg

SEQ ID NO: 626 - DNA, 3280 bp, Zea mays
  misc_feature (3142)..(3142): n is a, c, g, or t
acagatcatcaagcgcaaataactatgaacacatcatattacatttcccagtcgcgagtcttgttagaagaacctaacaagcaccccgcgcgcgtcctgtttttttttttttttttttgcaaatatcaagctggattaaaccctgatgaaatggtgatgttcatatttacagatgcagtaaatggaaaatagaaacagataattaagccaatgaagtaactaacattaagcagaaacatagggatggcatgacaaatagacataagttagcacctaagcacatagagcataaatatttcaggaacgacaacaagcagccgtcataactccttgatctaggtctagttggggtcaaagacatatcatatccttcacaacaaaattagacacacccaaccatatgtccataacactgcaattccaggcaactggaagacttaggtcgccctttttgagcaacaccttaccaataccggacacaatccaaaaccaccagcacatcaatatgcaccctccagagcatcaagcaccaaccccactgtctccttcatcaggtccatccgacgcagctgctgcctgatctctaacattctgaacttcctgagcttctcctccaccgctcctgcctttgatttttcaagtacaccaaatgccttcctgaatataggtccactcggatgctccttcgaaagctcctcaacagcctcccacaggtatgggtacatttgttttcccttctcagcatcatctctcccactgccatcaccatggcaagccctacctgcagtgacaattgcattaccattgccattttcaaatgtcaatgcccttggtttcttgcctgtgcgatcacggagtccccattcattttctatatcctcatcactctcctctatctcctgctcttcattgctctcttctgcatcttcagtgtcctcgtgtgacacacgagatcctcgtactagtagtagacttttcaatccccaaactttcttgctaagttgatagacatcgcgatcatgtttggttggcaaatcaggatcccgtccattctttgaacgagtgagcagcaacttgtacttgtgcttgaggcgcctgaccttatcactaagctgagccgtagaagcattagcagtgagttgatgaataatctggctgtgtaccttgctcgtgtcctgaatggacgcaggaagccgaccttttttggcacggaactcaatgagagcactcagtatggtcacctcgtcttcaggactccaaacccggggcggccgcttctggtgctccggggagtgggggctggggcggcgcttggaacgacgttgggaagatcccgcggcggcgcgcgagggcacatccatcgggcgcgtgctgacgggtttgacgttggaggtcccgatgtgcgaggcacggtgcgcaatagccaaaggcgaggcgtcgccggcgtcatcggaggcggcggccgcggccgtggtggagttgtcggagtcggagtcagagtggaggtgaagggtgcgctcgcggttgcgcctcggcgacggagagcgcccggcgacgtcagcgtccgagttggagtggaagctcggggaacgttcgccgagaagcctcgaggaacgggcgccgcggccggcgccggcgccggcgtcggcgtcggagtccgcatcggagtcgaggtggtcgcggggggaacgctcacggttggtgtcggaagcggcggcgctagggccgaggttgggccgaggggactcggatcgggagcgggacggggagactcggcggcggtggctgttgcgggccgcgcccgcttcgccgtcggaggcgtcggacgccgaccccaggctggcggcggcggccgagcgcttgagggccatgccggcaagtgtggattggagttagtttagggttttggatttcaatccctcttcgggttggatgttctaggtaatggtctcgtgcggcatgttgctctgttgcgatggctgtggcctgtgggagagctgggcgggtggatcccctgggcggtggcatgttcggttgcggaagtgttcactggagagagaaaaaaaattgcacaattatatattttaactatatcttttacctacgcatagtggagttagtctattcaaatcatatattgtacctctttttctcttgttcttttcctaagtagagaatctaggggagtatatcttcttttagatctagtttgagagtccaaaacccggagaggattagaggggttaaaattcacttcttattcaaaattgaatacgaggaaattttatcccctccaatccactccggttttgtggttaccaaactagctcttatggtaaaaaaaatgagagtatattttttaaagggggagaacacttttttaaggagtaatcttttagaggacaagttttatttgcttcctaaatgcttttaatctcttccttttcgatgcttgattccaaaggggagaatttttagagaccaaagcaattcaaaatatatcaaacaccaaataccacccaatcactcaatttaaaattttaaaatcttaaacttgcaaatggttttgtttctacaagtgtttttgttctaaaataggaattacgtggattgtggagttagggtgaggcttaagtccataatctcactttgtgggaacattcatgcatcctagcatctagattgcatattttcatcaaagtatttgttatatttgcttgcttggttgtgttgtcatcaatcaccaaaaagggggagattgtaaggaaaatggacaccggcccatttgtctaaaggattttggtgtttgataatcaacataaccttgtgaactaatatgtttggtaatgtttgtgtttgtagttcacaggatgcgaagaggattggactaaggctatgaggatgcaacacctcaaaataagacctaaaagatccgtagaagtccaagactcgagaacgaaagaagcccaaggaaacaacgaaaaaatccaagaagagggcagtcagccagcgctatggtggcgcaccgaacagtgaacagtacctgcccggtgtgcaccggactgttcggtgtgtgaccggatagtctgagcagagaggcccgcaaccagtgactctcgggcgttgtagcatcggactatcnggtgtgcactggacagtctgcaacggtcggatccaatggtcgactgctacagacatcaacggtcggctgacgtggccagggcatcaggcatgttcggtgtgcaccggactgtccgatgcacccgacgatagacgcagc

SEQ ID NO: 627 - DNA, 3349 bp, Zea mays
ctgacagaattgagaaaacaaaaaaaagatcacagacctatataatctcccatgtcagtaccaaagagactgtcctgttaatgcaattaccctgtatataatgcatcgcaaaactccaagcactgtcaaactcagctaaattaaagaaagatattatgtctggcatgttaactgaagacagacaacatacatgagagaagaatgttccaaagttctgtagagaaggttgtcagactatccatggaccattgttccatgggactacagaaaccatactgatagcaacatcaatacctactccatccttgaaaccctcatcacgtgattcacgtatcagctcccattgcttaacgaagccacaggagagctcgaagccctgcaattgatcaaacgtactatgcaatgtcaacagtaactacaagataaaacataattttaattttgacaattttctgcattgagagcttactgcttccacttaacaataaccagtgctgtaccaaagatgttaagtcctctcattataatttattcctcgtactgtaacgtctcattaggggtttaatcgcatggtgtcatgctgtaagcacaaattaaacaacatagcaacatgatttcgacaagctacttttctaaactagattggcatacaagcgttgataagacacatgaaattaggcaaaaatgttttgtactagccctgttgtatttttttccatttccaaaatttgcaatgtgataatgaacaaacaccagtatacatagcagcacgaaaggactatgcaggacaagattcacaagtttgccgcttaaaataagaaatatcaagttcatggtaaatctaacaataaagtaatcaaaatgataactcccacaatataacacttactactacaaaaattgcccactaaaaaaaggtaacaaaatctacaccaattaatttaaactgtggagcactaagtctcaaatgcagcaaatgatttgacatcaagaactagcccataaagtgctaaacaatgggacctgaacaataagcctttgttgctcttcagtagttgtgtacaggacagtttaagctaattaactcagagaacaccaagtctacacataacattatttgtctacaacacaagtaccttttccaacaaaggcaaagatgaaagctcacacaaatcaactaaacaaactaacactaatgctaagtccagtataaaatcaaatgacaaaaacagggtttacattgacaaggagacaactggtactatcattatatcaaaggaaaaaaataatattttgccatccttatggaaagaatggcagaccgaatccctgtcagtgactcagctggccccgctggtcagtgactgggaatttggtatatcaaacagctaaacattccttttccacagtaagaggtatgcagcagtggcagaactacaaagccacaactctagttcagtaaatagttcaaaaattcatacacaaaaaaatgacctcagaaatggtaaaagttcacattacacaacgaatgcacaaaacacccaaaaataagcattgccctgcatgtattaggccatatttggatcacactctcatagtgattccagatagtgaaatagaatctggagatccaaaaaagagatgtttggatctcatctcatagtgattatttcctttccccccgagaatctccaaattgcaagctcccggtagatagttggattctagaatctcattttacaatcaagtgtttggaactcattctcatttttagagatccaaaccgggcagctcctacatgagtgggatctaaaaaagggataaactaaggcaagccatcccggcaaatgaggagagactcaccaaaacaagaatttagtaatatttttatctaaataacttctcatcgaagtattaaacaagggcagcaaaataaaatagcacgcatttttcagaaaatttgatcacacacataacatgtcacaagatttttgaagtgctacataattagtttcaatcagagacatactaaacaatcaaacacatataattaaggtgaaatttaaacaaagccagaatggggctcacggcatggatcctcaagatcagagcacaataggcaaaagacatgatttaaaccagataaactacactaatttagtatcattcacctgtttcatgctccaggacagccgtcatgtatcagcggccattgctgaccgcatccatagcaaaactcatatccgcacctgtgccatcgattcatcgaatcaaacaacgacaatgtactgatgaaatatgaatggttgactgcggtaaaggcaaaactcacatccgcacctgcaggttatgtgcaggcagccactggacttctcgacgtagaacctgcagcgcgggcagcgcttccagctgccctcccgggcggccttcacgagcagcaggtcctcccgctcgcgctccccctcaccgagccgcgcaatctcctcgcaggtcaagccggcgtgccacggcaccgcgcaccgcgcgcagaacagccgccggcacccgtggcactcggactgggtcacgcactcctcgccgtcgtcgtcggccaccatcatctcagagcagtccgggaacgggcagtaggtgcggcgcgctccgaggaacagggactcgcagagcttggcgcaccagcgctcgaagacttcggaggggagcgcgccgcggcagagctccgggtcgagcgtggcagcgcaggacgcgtcggggcaccgcaccacggcgccgccgccgccgcactctagcttggcgcggacgtgaccggacaggcacgcgccgcagaatgcgtgcgtgcaggcggcgccgccgcggtgggccgcggagggcgccatgggctccatgcagatgctgcaaggatggtgttgctgcgccccgtcggctcccgccattctgccgtgggcggcgcagggaagggaagggaggggaggcgagaggtcccgcgatccggtgcgtcgaaacgacgggaatctctccggctcaccggcttccttttgcgaggaaaatgacgaagaatctatgcctgcaacttcagtttggcttctctggggttcagttcagttgggattttaaggggccatttccgtcttttctgatgtgtgagacttcgtgccttcgtggggagtgccgcactgggaaggagcgaaatgcgcaaaaggccgcaggtcgtgccgtcgtggaattctactttttcgaaacaccaggggtttgttagttttgaggttaattcattatccatgtggacacggtcgaatcggattaagtccataataaatcaaaaatatattttaattctacttaatccacttta

SEQ ID NO: 628 - DNA, 1138 bp, Zea mays
  misc_feature (773)..(773): n is a, c, g, or t
  misc_feature (806)..(806): n is a, c, g, or t
  misc_feature (829)..(829): n is a, c, g, or t
  misc_feature (832)..(832): n is a, c, g, or t
  misc_feature (838)..(838): n is a, c, g, or t
  misc_feature (842)..(842): n is a, c, g, or t
  misc_feature (845)..(845): n is a, c, g, or t
ttttttttttttttttgtcctgttaatgcaattaccctgtatataatgcatcgcaaaactccaagcactgtcaaactcagcctaattaaagaaagatattatgtctggcatgttaactgaagacagacaacatacatgagagaagaatgttccaaagttctgtagagaaggttgtcagactatccatggaccattgttccatgggactacagaaaccatactgatagcaacatcaatacctactccatccttgaaaccctcatcacgtgattcacctatcagctcccattgcttaacgaagccacaggagagctcgaagccctgtttcatgctccaggacagccgtcatgtatcagctgccattgctgaccgcatccatagcaaaactcatatccgcacctgcaggttatgtgcaggcagccactggacttctcgacgtagaacctgcagcgcgggaagcgcttccagttgccctcccgggcggccttcacgagcagcaggtcctcccgctcgcgctccccctcaccgagccgcgcaatctccgcgcaggtcaagccggcgtgccacggcaccgcgcaccgcgcgcagaacagccgccggcacccgtggcactcggactgggtcacgcactcctcgccgtcgtcgtcggccaccatcatctcagagcagtccgggaacgggcagtaggtgcggcgcgctccgaggaacagggactcgcagagcttggcgcaccagcgctcgaagacttcggaggggagcgcgccgcggcaganctccgggtcgagcgtggcagcgcaggacgcgtnggggcaccgcaccacggggccgncgncggcgnactntancttggcgcggacgtgaccggacaggcacgcgccgcagaatgcgtgcgtgcaggcggcgccgccgcggtgggccgcggagggcgccatgggctccatgcagatgctgcaaggatggtgttgtgcgccccgtcgctcccgccattctgccgtgggcggcgcagggaagggaaggaaagggaggggaggcgagaggtcccgcgatccggtgcgtcgaaacgacgggaatctctccggctcaccggcttccttttgcgaggaaaatgacgaagaatctatgcctgcaacttcagttt

SEQ ID NO: 629 - DNA, 4460 bp, Zea mays
  misc_feature (572)..(572): n is a, c, g, or t
tacccctggccgcagcagcagcagcagcaacacgcctactacatctgccggtggcggcgctgctcctcctcctccttcttcgcctccccctccgccggcttctctggagaccgagcagccgcccaatgccaggccagcctccgccggcgccaatgacagcaagaagcccaccccgcccgccgccctgcgcgacctcttccgcttcgccgacggcctcgactgcgcgctcatgctcatcggcaccctcggcgcgctcgtccacggctgctcgctccccgtcttcctccgcttcttcgccgacctcgtcgactccttcggctcccacgccgacgacccggacaccatggtccgcctcgtcgtcaagtacgccttctacttcctcgtcgtcggagcggcaatctgggcatcctcgtgggcaggtacgctatccctcctcctcctgccgccccagcttgtgtgcgtcgcgaattggcggtcaatttggattggatgacaaatcacgtcggtcagccaatcgccgtggctacaaacgagatgttcaaatcgttcgccccgctcgcagagatctcttngctggatgtgggccggcgagcggcagtcgacgcggtggcggatccggtacctggacgcggcgctgcggcagggacgtgtccttcttcgacaccgacgtgcgggcctcggaacgtgatctacgccatcaacgcggacgccgtggggtggtgcaggacgccatcagcgagaagctgggcaacctcatccactacatggccaccttcgtggccggcttcgtcgtggggttcacggccgcgtggcagctggcgctggtcacgctggccgtggtgccgctcatcgccgtcatcggcgggctgagcgccgccgcgctcgccaagctctcgtcccgcagccaggacgcgctctcgggcgccagcggcatcgcggagcaggcgctcgcgcagatacggatcgtgcaggcgttcgttggcgaggagcgcgagatgcgggcctactcggcggcgctggccgtggcgcagaggatcggctaccgcagcggcttcgccaaggggctcggcctcggcggcacctacttcaccgtcttctgctgctacgggctcctgctctggtacggcggccacctcgtgcgcgcccagcacaccaacggcgggctcgccatcgccaccatgttctccgtcatgatcggcggactggccctcgggcagtcggcgccgagcatggccgcgttcgccaaggcgcgtgtggcggctgccaagatcttccgcatcatcgaccacaggccgggcatctcctcgcgcgacggcgcggagccagagtcggtgacggggcgggtggagatgcggggcgtggacttcgcgtacccgtcgcggccggacgtccccatcctgcgcggcttctcgctgagcgtgcccgccgggaagaccatcgcgctggtgggcagctccggctccgggaagagcacggtggtgtcgctcatcgagagattctacgaccccagcgcagggcaaatcctgctggacgggcacgacctcaggtcgctggagctgcggtggctgcggcggcagatcgggctggtgagccaggagccggcgctgttcgcgacgagcatcagggagaacctgctgctggggcgggacagccagagcgcgacgctggcggagatggaggaggcggccagggtggccaacgcccactccttcatcatcaaactccccgacggctacgacacgcaggttggggagcgcggcctgcagctctccggtgggcagaagcagcgcatcgccatcgcccgcgccatgctcaagaaccccgccatcctgctgctggacgaggccaccagcgcgctggactccgagtctgagaagctcgtgcaggaggcgctggaccgcttcatgatcgggcgcaccaccctggtgatcgcgcacaggctgtccaccatccgcaaggccgacgtggtggccgtgctgcagggcggcgccgtctccgagatgggcgcgcacgacgagctgatggccaagggcgagaacggcacctacgccaagctcatccgcatgcaggagcaggcgcacgaggcggcgctcgtcaacgcccgccgcagcagcgccaggccctccagcgcccgcaactccgtcagctcgcccatcatgacgcgcaactcctcctacggccgctccccctactcccgccgcctctccgacttctccacctccgacttcaccctctccatccacgacccgcaccaccaccaccggaccatggcggacaagcagctggcgttccgcgccggcgccagctccttcctgcgcctcgccaggatgaactcgcccgagtgggcctacgcgctcgccggctccatcggctccatggtctgcggctccttcagcgccatcttcgcctacatcctcagcgccgtgctcagcgtctactacgcgccggacccgcggtacatgaagcgcgagatcgcaaaatactgctacctgctcatcggcatgtcctccgcggcgctgctgttcaacacggtgcagcacgtgttctgggacacggtgggcgagaacctgaccaagcgggtgcgcgagaagatgttcgccgccgtgctccgcaacgagatcgcctggttcgacgcggacgagaacgccagcgcgcgcgtggccgccaggctagcgctggacgcccagaacgtgcgctccgccatcggggaccgcatctccgtcatcgtccagaactcggcgctgatgctggtggcctgcaccgcggggttcgtcctccagtggcgcctcgcgctcgtgctcctcgccgtgttcccgctcgtcgtgggcgccaccgtgctgcagaagatgttcatgaagggcttctcgggggacctggaggccgcgcacgccagggcgacgcagatcgcgggcgaggccgtggccaacctgcgcaccgtggccgcgttcaacgcggagcgcaagatcacggggctgttcgaggccaacctgcgcggcccgctccggcgctgcttctggaaggggcagatcgccggcagcggctacggcgtggcgcagttcctgctgtacgcgtcctacgcgctggggctgtggtacgcggcgtggctggtgaagcacggcgtgtccgacttctcgcgcaccatccgcgtgttcatggtgctgatggtgtccgcgaacggcgccgccgagacgctgacgctggcgccggacttcatcaagggcgggcgcgcgatgcggtcggtgttcgagacgatcgaccgcaagacggaggtggagcccgacgacgtggacgcggcgccggtgccggagcggccgaggggcgaggtggagctgaagcacgtggacttctcgtacccgtcgcggccggacatccaggtgttccgcgacctgagcctccgtgcgcgcgccgggaagacgctggcgctggtggggccgagcgggtgcggcaagagctcggtgctggctctggtgcagcggttctacgagcccacgtccgggcgcgtgctcctggacggcaaggacgtgcgcaagtacaacctgcgggcgctgcggcgcgtggtggcggtggtaccgcaggagccgttcctgttcgcggcgagcatccacgagaacatcgcgtacgggcgcgagggcgcgacggaggcggaggtggtggaggcggcggcgcaggcgaacgcgcaccggttcatcgcggcgctgccggaggggtaccggacgcaggtgggcgagcgcggggtgcagctgtcgggggggcagcggcagcggatcgcgatcgcgcgcgcgctggtgaagcaggcggccatcgtgctgctggacgaggcgaccagcgcgctggacgccgagtcggagcggtgcgtgcaggaggcgctggagcgcgcggggtccgggcgcaccaccatcgtggtggcgcaccggctggccacggtgcgcggcgcgcacaccatcgcggtcatcgacgacggcaaggtggcggagcaggggtcgcactcgcacctgctcaagcaccatcccgacgggtgctacgcgcggatgctgcagctgcagcggctgacgggcgcggcggccgggcccgggccgtcgacctcgtgcaacggggccgcgtaggacggaatggatggatggatgggtttggttcctcgagagattgatgggtgaggaagctgaagctccggatcaaatggtggtactccatgatcgcaacaatgaggggaaaaaaagaaaggagaaaatacggtggttcatatgattgtacaatttgacgatctgtttgagtcggggttttaggatgatgtaaaccttcactcgccttttttttactcttgtttctcatccgcatcagtatcatctatctacatacagtgtcagagatgggaactgatccgcatcatcatctacctcccaaggcaccccagattgtattaatgtacttagttagcctgttttatatatacttataagtac

SEQ ID NO: 630 - DNA, 3513 bp, Zea mays
gatcgacgaatgaaatttgttagggtgattggagtacatttatttcatgttcaaacatacattccaattacataataaaaaaattgcattttgttctattatatcttgtgcataggatccaaagattgtttagaggaactttgtgattgacctgttaagttataagtgtaattaatactgatataccatcactacaaacatataacagatgcatcaatgtcgctaaaaaagtttagattaacgcaatatatttgcctaacattcagaattctatattgattctttaaaaataatttttgtgatactataatgtttgttcgacatcagttcattctatttagtcaacatatttataataatattacatatttatatcgtcaatataatattaatattatactgatattttgtcatacagattttatatattataatgatacttatcgttctatttttatgttttatattagtttttaactctaagactttgctttaagatgtcgtgaaaatgacatggtactttatgcgtataatatcagatgcgactatacaaagcacgctctctagtcatcaacgaattccatttatttctttcctcaataaactttctccacgtgcatcgaactttacagtggactcgaccagattagcgtttaccgtttgggccagccagctcgttggcgcgggccgtggccctggccccgggcgccctcacgcccgctggccgctataaatagcgttcggcgttcctgtctccacccatcccaagaagagccgccctacctattccttctccccgccgtcgagctgcccaacccagagcaccagcagccctcacctccttcctctcggccggtccttccaacgagcccgctggtcttggagccgccaccgttctcgttctggacgaacgtgagttttccttcctctcgtccttccttgcgctcggtttactcatcctgctgccgtgccctgcgttgtgtgcgccaggactctgttgggtcctgagaggagtggccggcggtttcgtctgtggtagatcgtagtacgttggcttagatcttggttaggttcttgagggcgcttttgattttcgtcgggagagtttgagatcgccttcctgcccccgtttgtcggaggtgtcaggaaaacttacattttgtctgtgctaccttagaatttggatcctgataactgctaatcgtttgtgctgttctgctgcccaagaaggagaacttactctctttcgatcgacaggttcaaggagattgcatttgtggatgctctaatggagtcgaaaggtggcaagaagtctagtagtagtagtagtaatttcatgtacgaagctccccttggctacaagatcgaggacgttcgcccagccggaggaatcaagaagttccagactgctgcttattccaacgtaagaaccaaaaaacctgcggtacaagcaatgccgttctaaatctacttctcattgatacgttccacgctttggttactgacgctcgttatttgtttgatcttttgttttgcagtgcgtccgccagccatcctgatatcgcctcacatgcaattcgcggtagagtaggattttaattcagggggcctcttgtgtcggtagttttccgttggctctggctgccttcctctgcttctgagattccaacttgtcttgcccatctctccttttcctctctcatcctctctttcttgcaacacgtcatccagtggcgatgtcttcagcagattcttgtgtctcttctcctgcctcccctattggctttgagggctatgagaagcgcctcgagatcacgttctctgacgcgcctgtctttgaggacccttgtggtcgtggcctgcgcgccctctcccgtgagcagatcgactcgtttctggatctcgcacggtgcaccatagtgtcacagctctccaacgagagcttcgactcatatgttctgtccgagtccagcctctttgtgtatccccacaaggttgttctgaagacctgtgggacgacgaagctgctgctcgccattcctcgcatccttgagcttgctgcagggctgtcactgcctcttctttcagcgaagtactctcgtgggaccttcatcttccccggcgcgcagcccgcgccacaccgcagcttctcggaggaggtatctgtgctgaacgctttctttggtaacctcaagtccggtggcaatgcctacctgatcggtgaaccgttcaagcccaacaagaagtggcatgtctactacgccacagaggagcctgagcgtcctatggtgacgcttgagatgtgcatgacagagcttgacgttaagaaagctgctgtgttcttcaagaactccactggtggcagctgcacttcagctaaagagatgacgaagctctcggggattcatgagatcattcccgagatggagatctgtgacttcgagtttgacccctgtgggtactcgatgaatggcgtcttcgggcctgcagcctccaccatccacgtgacacccgaggaaggtttcagctacgcaagctacgaagctatgaacttcgaccccagctcactggtctacagcgatgtgatcaggagggtcctggcaggcttctctccttcggacttctcggtcgcagttaccatctttggtggccgtgggttcgccaaatcatgggcgacgggtgcagacatcgattcctacatgtgcggtgatcctgtagagcaagagcttcctggtggcggtctgctgatgtaccagagctttactgctgttccctctggctctgtatcgccgaggtcgaccttgcagacggatggctggagcagcgatggaatggagatggcctcaaatgacgagatgtgtattggctgctggaatgcggtgaagaaggtggtgaagaaagatttggatgcttaaagatttggataacttaggtggttcttcacctaagttatgaagaagtctgagacctctgtctctctgttcttttggtttcagttaagcagttagctgggctaccggcaatttgtttgcttaatatttttcctgttcaataagtactctggatggcttgctgcgtctgccatagtgagctgcatattgttgtttagtcatattgtttcagtgggtcttcaacgactgatgttattcttgttctcaacagaagccatcaacacgacatgagattattcttgttcatcaaaaaaaaaaaaaaaaagttatttaattagttacatagtctcagtatgagcaccaagttttgtcaatgttttgattcacactcttgttggacaggtttataacacagcatatatatgtttttcctgttatgccgtgtaagagttgcgagcgggtcggagtcagcaatgtatttcttcgagtcttaagaccgtgtccagcagtttacctatatagtcacctaaaatattgttttgcacgtaaattgtactgctcatagagttgaattttaatatagggatgtgtatagataaattgtggagatagtatacaaagc

SEQ ID NO: 631 - DNA, 2387 bp, Zea mays
ggccggccgggcccgggccccgagggcggccgggccgccatcccaagaagagccgccctacctattccttctcccagccgtcgagctgcccaacccagagcaccagcagccctcaccttcttcctctcggccggtccttcaaacgagcccgctcgtcttggagccgccgccggtctcgttctggacgaacgttcaaggagattgcatttgtggatgctctaatggagtcgaaaggtggcaagaagtctagtagtagtagtagtaatttcatgtacgaagctccccttggctacaagatcgaggacgttcgcccagccggaggaatcaagaagttccagactgctgcttattccaactgcgtccgccagccatcctgatatcgcctcacatgcaattcgcggtagagtaggattttaattcagttttcctcttgtgtcggtagttttccgttggctctggctgccttcctctgcttctgagattccaacttgtcttgcccatctctccttttcctctctcatcctctctttcttgcaacacgtcatccagtggcgatgtcttcagcagattcttgtgtctcttctcctgcctcccctattggctttgagggctatgagaagcgcctcgagatcacgttctctgacgcgcctgtctttgaggacccttgtggtcgtggcctgcgcgccctctcccgtgagcagatcgactcgtttctggatctcgcacggtgcaccatagtgtcacagctctccaacgagagcttcgactcatatgttctgtccgagtccagcctctttgtgtatccccacaaggttgttctgaagacctgtgggacgacgaagctgctgctcgccattcctcgcatccttgagcttgctgcagggctgtcactgcctcttctttcagcgaagtactctcgtgggaccttcatcttccccggcgcgcagcccgcgccacaccgcagcttctcggaggaggtatctgtgctgaacgctttctttggtaacctcaagtccggtggcaatgcctacctgatcggtgaaccgttcaagcccaacaagaagtggcatgtctactacgccacagaggagcctgagcgtcctatggtgacgcttgagatgtgcatgacagagcttgacgttaagaaagctgctgtgttcttcaagaactccactggtggcagctgcacttcagctaaagagatgacgaagctctcggggattcatgagatcattcccgagatggagatctgtgactttgagtttgacccctgtgggtactcgatgaatggcgtcttcgggcctgcagcctccaccatccacgtgacacccgaggaaggtttcagctacgcaagctacgaagctatgaacttcgaccccagctcactggtctacagcgatgtgatcaggagggtcctggcaggcttctctccttcggacttctcggtcgcagttaccatctttggtggccgtgggttcgccaaatcatgggcgacgggtgcagacatcgattcctacatgtgcggtgatcctgtagagcaagagcttcctggtggcggtctgctgatgtaccagagctttactgctgttccctctggctctgtatcgccgaggtcgaccttgcagacggatggctggagcagcgatggaatggagatggcctcaaatgacgagatgtgtattggctgctggaatgcggtgaagaaggtggtgaagaaagatttggatgcttaaagatttggataacttaggtggttcttcacctaagttatgaagaagtctgagacctctgtctctctgttcttttggtttcagttaagcagttagctgggctaccggcaatttgtttgcttaatatttttcctgttcaataagtactctggatggcttgctgcgtctgccatagtgagctgcatattgttgtttagtcatattgtttctgctgccgatgcccttgtggggagaatgatcttgtaacagacttgcctattcccgcaatatattggaaattttggttaataaaaaaaaaaaaaaaaaaaaagaagggcttcctggcccgctcggccccttgcgtacttcttttttttttaaatatcttgatattatttttgttgttagtcagtgggtcttcaacgactgatgttattcttgttctcaacagaagccatcaacacgacatgatattattcttgttcatcaacgtaacactagcagtattattgaattagttacatagtctcagtatgagcaccaagttttgtcattgttttgattcacactcttgttggacaggtttataacacttttgcatatatatgtttttcctgttatgctgtgtaagacagttgcgagcgggtcagagtcagcgatgtatttcttcgagtaaga

SEQ ID NO: 632 - DNA, 2020 bp, Zea mays
tacctcgccccgcccgggccatcccaagaagagccgccctacctattccttctccccgccgtcgagctgcccaacccagagcaccagcagccctcacctccttcctctcggccggtccttccaacgagcccgctggtcttggagccgccgccggtctcgttctggacgaacgttcaaggagattgcatttgtggatgctctaatggagtcgaaaggtggcaagaagtctagtagtagtaatagtaatttcatgtacgaagctccccttggctacaagatcgaggacgttcgcccagccggaggaatcaagaagttccagactgctgcttattccaactgcgtccgccagccatcctgatatcgcctcacatgcaattcgcagtagagtaggattttaattcagttttcctcttgtgtcggtagttctccgttggctctggctgccatcctctgcttctgagattccaacttgtcttgaccatctctccttttcctctctcatcctctctttcttgcaaaacgtcatccaatggcgatgtcttcagcagattcttgtgtctcttctcctgcctcccctattggctttgagggctatgagaagcgcctcgagatcacgttctctgacgcgcctgtctttgaggacccttgtggtcgtggcctgcgcgccctctcccgtgagcagatcgactcgttcctggatctcgcacggtgcaccatagtgtcacagctctccaacgagagcttcgactcatatgttctgtccgaatccagcctctttgtgtatccccacaaggttgttctcaagacctgtgggacgacgaagctgctgctcgccattcctcgcatccttgagcttgctgcagggctgtcactgcctcttctttcagcgaagtactctcgtgggaccttcatcttccccggcgcgcagcccgcgccacaccgcagcttctcggaggaggtatctgtgctgaacgctttctttggtaacctcaagtccggtggcaatgcctacctgatcggtgaaccgttcaagcccaacaagaagtggcatgtctactacgccacagaggagcctgagcgtcctatggtgacgcttgagatgtgcatgacagagcttgacgttaagaaagctgctgtgttcttcaagaactccactggtggcagctgcacttcagctaaagagatgacgaagctctcggggattcatgagatcattcccgagatggagatctgtgacttcgagttcgacccctgtgggtactcgatgaatggcgtcttcgggcctgcagcctccaccatccatgtgacacccgaggaaggtttcagctacgcaagctacgaagctatgaacttcgaccccagctcactggtctacagcgatgtgatcaggagggtcctggcaggcttctctccttcggacttctcggtcgcagttaccatctttggtggccgtgggttcgccaaatcatgggcgaagggtgcagacatcgattcctacatgtgtggtgatcctgtagagcaagagcttcctggtggcggtctgctgatgtaccagagctttactgctgttccctctggctctgtatcgccgaggtcgaccttgcagacggatggctggagcagcgatggaatggagatggcctcaaatgacgagatgtgtattggctgctggaatgcggtgaagaaggtggtgaagaaagatttggatgcttaaagatttggataacttaggtggttcttcacctaagttacgaagaagtctgagacctctgtctctctgttcttttggtttcagttaagcagttagctgggctaccggcaatttgtttgcttaatatttttcctgttcaataagtactctggatggcttgctgcgtctgccatagtgagctgcatattattgtttctgctgccgatgcccttgtggggagaatgatcttgtaacacacttgcctattcccgcaatatattggaaattttggttaataatctattggttatcaaaaaaaaaacaaaaaaa

SEQ ID NO: 633 - DNA, 895 bp, Zea mays
attggtacctcgaggcggcggggatagattatgtggtgcgggatgggcgccccgtcgcccggtccctgcctgtgttcttgcctcttgcctcttgcgccttgctagcttgcttgcctccctgctccctcctcctccctcttcctcgtcgcttctctgattcttcctggcctttgccggagcaaggctaggcgcgaggagagggtgctgtgctcagccagaggtcatcggcgctacgcgagcgcactgcctgtgagcctcatacattttgcaagaccactgaaacactggaacattcacaccctcaagaggttacacttgataaaacggtggcggggtcaacgctaataagtcatcaaaatgtgtgctgcactgccggagtatcaggggaaaacgctgaaatcatggaaatcaccttattgcatgatgaatctgatgcaggaagcaccagtttgctaccgccattgttgtcatatggtccaagatcaatggttccaatacaagtaccatcgtcatcagaccttgagagtatcctgtcaccagatccagtctgcagtgatcttcagttgaaagagataaactacaatgctgcagcaatggatgaaagcactgagctccttcacttgattcttggtggcaatgatgaaggatacaataccacaactgaattacaagtttgggatgttctggacttctatgtctcagaaaacttctcggctctccaatttgatagtttgatgggttttacaaatgaagttagtacttcctacaatgattgtatgaatttagttgacatggtagagtggcccgtggctcgtctgtctctagatgatacaccaaaactcagtaacagtgatgatgcggttctggcagacaatgtcacaacggaccctgatga

SEQ ID NO: 634 - DNA, 1808 bp, Zea mays
catcgagctgtcccctccctgtgctctactgctcttgcgccttgctagcttgcttgcttccctgctccctccctcctcctcctcgtcgcctcttctctggttcttcctggtgtttgccggagcgaggctaggcgcaaggggagggagctgcgctcagccagagctcatcggcgctacgcaagcgcgctgccctggtgtgctgcattgccgaactatcaggggaaaacactgaaataatggaaatcagcttattgcataatgaatctgatgcaggaagcaccagtttgctaccgctgccattgttgtcatatggtccaagatcaatggttccaatacaagtaccaccatcatcagactttgagagtatcctgtcaccagagccaatctacagtgatcttcagttgaaagagatgaactacaatgcagcagcaatggatgaaagcactgagttccttcacttgattcttagtggcaatgatgaaggatacaatagcacaactgaattacaagtttgggatgttgtggacttctatgtctcagaaaacttttctgctctccaatttgatagtttgatgggttttacaaatgaagttagtacttcctacaatgattgtatgaatttagttgatatggtagagcggcccgtggctcgtctgtctctagatgatacaccaaaacccagtaacagtgatgatgcggttccggcagacaatgtcacaatggaccctgatgaaacatccttataccttcagacaaaaccaacagattcagaaacagaaagtagttctgccgcaggagatgttgaaactgaatatctagatctaaagctactttctagatgtatgcctgatttaatggatgttgactcgcccaattgcttatcgaaaacaccagtgaaaaaaaagcatgtgactcttgtgcttgatttggacgagactctggtacattcaacattggatcactgcgacaatgctgattttaccctagaagttttctttaatatgaaaaatcacacagtgtatgtgagaaaaaggccttacctgaaaatgtttcttgagaaggttgctcagatgtttgaggttgtcattttcacagctagtcagagagtctatgctgagcaacttatagataaacttgaccctgatggaaaatatatctcacggcgtatttatcgtgaatcttgtgtattctctgacggttgctatacaaaggacctgacaattctggggatcgacttggcaaaagttgcaatagttgacaatactccacaggttttccagttgcaagtggataacggcataccgattaagagctggtttgatgacccctcagatcaggaactgatcgagttgctcccgttcttggagagcctcgtggattcagaggacgtgaggccaataatttcaaagacctttcatgacaaacttgagcagaattagtttgaggcgacagatgtatcatccagtgaacctgtcgctgaagttagcttcgctccacatggtgcaggccatcattcttgggaagttagatataggatgaaaaatcacaatttctgttatgttagctgttacaaatagcaagcataaactgcggtcgttgtctcgtcgatgaaaatggcttgtatatgtatgtccctttgggcttccgtgtcacggatcattgtacagagacgaacattagtgctgaataaagtgatctgagtgcaattttgctcaaaaaaaaaaaaaaaaatttactaataaggctttgagtttagatgagcccaacatcggaccatagttgtgcgcgcatggtgcacgccattcttt

SEQ ID NO: 635 - DNA, 422 bp, Zea mays
agtggataacggcatacccggtcgcggcggcggtcgcgtccccgcagaccaggaattaatcgagttactcccgttcctggagagcctcgtggactcagaggacgtgaggccaataatttcgaaggccttccatgacaaacctgagtagaaatagttctagaggcatacggatgtatcattcagtgaacctctcgctgaagttagcttcgctccacacggtgcaggccattcttgggaagttaggtataggatcaagattcaccatttatgttatgttagctgttacaaatagcaagcataaactgcggtcgtcgatgaaaatggcttgtgtgtgtatgtctcttcggtgttccgtgtcacagatcattgtacagaaacgaacaatagtgctgaataaagtgatctgagtgcaattttgctcc

SEQ ID NO: 636 - DNA, 873 bp, Zea mays
cctgccgggtcgccggcatgaaaatcgagctgtcccctccctgtgctctactgctcttgcgccttgctagcttgcttgcttccctgctccctccctcctcctcctcgtcgcctcttctctggttcttcctggtgtttgccggagcgaggctaggcgcaaggggagggagctgcgctcagccagagctcatcggcgctacgcaagcgcgctgcctggtgtgctgcattgccgaactatcaggggaaaacactgaaataatggaaatcagcttattgcataatgaatctgatgcaggaagcaccagtttgctaccgctgccattgttgtcatatggtccaagatcaatggttccaatacaagtaccaccatcatcagactttgagagtatcctgtcaccagagccaatctacagtgatcttcagttgaaagagatgaactacaatgcagcagcaatggatgaaagcactgagttccttcacttgattcttagtggcaatgatgaaggatacaatagcacaactgaattacaagtttgggatgttgtggacttctatgtctcagaaaacttttctgctctccaatttgatagtttgatgggttttacaaatgaagttagtacttcctacaatgattgtatgaatttagttgatatggtagagcggcccgtggctcgtctgtctctagatgatacaccaaaacccagtaacagtgatgatgcggttccggcagacaatgtcacaatggaccctgatgaaacatccttataccttcagacaaaacccacagattcagaaacagaaagtagttctgccgcaggagatgttgaaactgaatatctagatctaaagctactttctagatgtatgcctgatt

SEQ ID NO: 637 - DNA, 1530 bp, Zea mays
caggcgtctggttgggtcccacaagggcagctgccatctgtatgatacatctgatgacatgctttgctacaaaacacagatcgacctacaaaacaagagaaggaaatctagccagaagaaaataacaggatttcagtttgtcccaggggattcttcaatggtcataatcacatctgcagattcacggatcagagttcttgatggttttgagctagcgcataggtttaaaggtaaaattttattatcaactatttttcacgtacattcacaatttgcactagttcagaacttcagaacatggtgcaatcattgttgactgtgaatactgaagatcaattgtatctgccttgttcttcctcttaagagcagtgctggaacatgtcagattgctcttgtctgctatcatttgttctactgtttacttaacatgttaaaatagcttgtccttgttgatagatctaatggccacattgtttgtttttcttttgatatcactctctgcctgttattaagaaaaggaactattgctcaatttccgtcttctattctgccggttggtctcagttaacatagttcttatggcttgccatatttcaggattccgaaacacaagcagccaaatctcagcttgtttagctggaaatgggcggtatattatctcggcaagtgaggattcccatgtatatatctggagaaacaatgatggtccgaaaccaagtagaaagaagggcattgtttctgtcacagatagccatgaatacttccactgccagagtgtgacagttgctgttacctggccttttgccagcaccgcaaatgacttgtttaatgaaccccgggaagcaagaagagcttgagcgtgggtctgagccgcaagatctgcaaaccaaacttgccaaggcacaggagatgccagatgttgagtaccggagcccaaatatcccgagtaacaactcgaatcataataatggtggccggacatctccgacttggcctgaaaaacttaacacccccccaaatcaaagtttcaggggtacttcctgccatgccaacgagggagatcaagctttgaatcggtcggcctggggcctagtgattgtcacagcaggccgtggaggtcaaatcagaacatttcaaaactttggttttcctgtaagagtatagcatggatatgaatacctaaggtaatagtccctgccattcaggagtgtagtttgtgtataaataggagatagtgggtgagtttccccctattcagggattgggtctgattgttccctggggggcatgctagagatcagaattttcatttgacatacactgtgtactgcgaaacttggtatttatttaccctgaggcctaaattgtacacgaaaaagaaagccctagagagcaaccctatcagctgactgcagataatttatctgtccgctaaaaccccccctttcgctattaaaaaaaaaaaaaaaaaaaaaaaaaaaaaaaaaaaaaaaaaaaaaaaaaaaaaactcgagagagagcgccggtacc

SEQ ID NO: 638 - DNA, 2823 bp, Zea mays
aattcggcacgaggcacagggcgccgccgcggcccgcctgccgtcacgcgcggccgctggggcgtgggcgactgggcgtgccggatctcatctaacgccgccacttgctgccacgacctcctcctcccccccccgcacacctctgacctccctccgtccatctcatcatcatctttgtccctctcgcgcaattcgccgaacacaccgcgcgcgcctcgcctcccagcgacggccgcctcgacggccaatgctggcggcgggatgagcgtggaggaggaggtggagcgcggggaggaggacctgttctacgagtcgctcgaccgcatcctctcctcgtcgggctcctccacctctgcctcggacgacgatggcgccgaccgcccgcgccaccgccgcagctgcgatgcgccagccgcagcggccctcgacctgtggacctcccagccggcgcccgtccatgagcggcggcgccggctgctccatctcatggggctcaccggcgatccttccctcgccggatttgagattgcccggtccgcctccggagaagccgcgggaccgcccccggcctctcccgtctcgtggtccaggtcaggcggggccgccctgggctccgccgggaagccgccgctcgggggcggccgtctgcgcttctccttgtccgacgggtccgatgccgccgacgaggaccccaggtgcctgatcaggaacctcgacgacggcagagagtacgtggtgagggaagaattcgctctccgcgaggtcggcacggggcgccaccttaccgttgaggagttggcccgctcacccatcgttcaggagcttatgcgccgccaagctttcagtactcccaactccaactgcacctcaaattcccaaagcggcacctccacgccgatcgagagatcgagctcaggttccagcaacggtgtggggcgcgccaagcggcgtagcagctggctccgcagcatccgctgcgtagctggctccttcgcgtcccactcacgtgaccgccgcagcagcgacgagaaggacgcgtctccagagaaaggcgggcaccactccagctccacgacggatgacagccaggacagtgttccacgccatggcccggcccgtgtcaaggtgcggcagtatgggaagtcatataaggagctcagtggcctgtttatgacacaggagatacaggcacacagtggttccatatggagcatcaaatttagtcctgatggccgttaccttgcgactgctggggaggattgcgtaattcatgtttgggaggtgttggagtttgagagggcaaggaaggagaatgaggtgtgcaatccgcttgttgctatggtgtgcaatgagtcatcagagacaacggtgggatcagctgctccaagtgagagccattgggagaagaagctgagatcaaaggtactgcacggtgggggatcggtgagctcagacaggttgatggtgcctgagtatgtgtttgcactgtccgagaagcccgtgataacctttgcagggcattcagaggatgtgcttgatctcagctggtccaaatctcagtatttgctttcatcatcaatggataaaaccgtacggttgtggcacatgtcaagcacttattgtttgaaaaccttctcacacactgactatgtgacttgcatccagttcaatcctgttgatgatagatacttcattagtggttccctggatgagaaggttcgcatttggagtattccaaagcgtgaaatagttgattgggtcgaccttcatgaaatggttactgctgcctgctatactccagatggaaagggcgctctggttgggtcccacaagggcagctgccatctgtatgatacatctgatgacatgctttgctacaaaacacagatcgacctacaaaacaagagaaggaaatctagccagaagaaaataacaggatttcagtttgtcccaggggattcttcaatggtcataatcacatctgcagattcacggatcagagttcttgatggttttgagctagcgcataggtttaaaggattccgaaacacaagcagccaaatctcagcttgtttagctggaaatgggcggtatattatctcggcaagtgaggattcccatgtatatatctggagaaacaatgatggtccgaaaccaagtagaaagaagggcattgtttctgtcacagatagccatgaatacttccactgccagagtgtgacagttgctgttacctggccttttgccagcaccgcaatgacttgtttaatgaaccccgggaagcaagaagagcttgagcgtgggtctgagccgcaagatctgcaaaccaaacttgccaaggcacaggagatgccagatgttgagtaccggagcacaaatatcacgagtaacaactcgaatcataataatggtgaccggacatctccgacttggcctgaaaaacttaacacaccaccaaatcaaagtctcagggctactacctgccatgccaacgagggagatcaagctctgaatcggtcggcctggggcctagtgattgtcacagcaggccgtggaggtcaaatcagaacatttcaaaactttggttttcctgtaagagtatagcatgaatatgaatacctaagataatagtcactgccattcaggagtgtagtttgtgtatagataggagatagtgggtgagtttcacactattcagggattgggtctgattgttccttggcgtgcatgctagagatcagaatcttcatctgacatacactgtgtactgcgaaactttttttttttttgaacgaacggcacgagattgtgcacgtttctatt

SEQ ID NO: 639 - DNA, 1936 bp, Zea mays
ctgggtccttggtcacccactcccgtgaccgcagcagcagcgacgagaaggacacgtcttcagagaaaggcgggcaccactccagctccgctacggatgacagccaggacagtgttccacgccatggcccggcccgtgtcaaggtgcggcagtatgggaagtcatataaggaactcagtggcctgtttatgacacaggagatacatgcacacaatggttccatctggagcatcaaatttagtcctgatggtcgttaccttgccagtgccggggaggattgcataattcatgtttgggaggtgttggagttcaagagggcagggaaggagagggaggtgaaggagaatggggtatgcaatccgcttgttgctatggtatacagtgagtcatcagagacgatggtggcatctggtgctccaagcgggagccattgggagaagaagctgcgatcaaaggtactgcaaggtgggggatcagtgagctcagacaggttgatggtgcctgagtatgtgtttgcactgtccgagaagcctgtgataacctttgcagggcattcagaggatgtgctggatctcagctggtccaaatctcagtatttgctttcatcatcaatggataaaaccgtacggttgtggcacatgtcaagcacttattgtttgaaaaccttctcacacactgactatgtgacttgcatccagttcaatcctgttgatgatagatacttcattagtggttccctggatgagaaggttcgcatttggagtattccaaagcgtgaaattgttgattgggtcgaccttcatgaaatggttactgctgcctgctatactccagatggaaagggcgcgctggtcgggtcccacaagggcagctgccatctgtatgatacatctgatgacatgctttgctacaaaacacagatcgacctgcaaaacaagagaagaaaatctagccagaagaaaataacaggatttcagtttgtcccaggggattcttcaatggtcataatcacatctgcagattcacgaatcagagttcttgatggttttgagctagttcataggtttaaaggattccggaacaccagcagccaaatctcagcttgtttagctggaaacggacggtatattatctcggcaagcgaggattcccgtgtatatatctggaggaacgatgatggttcgaaaccaagtaaaaagaagggcattgtttctgtcacaaatacccatgaacacttccactgcgagagtgtcacggttgctgttacctggccttttaccagcaccacaatgacttctttaatgaaccccaggaaacaagagcttgagcgtgggtctgagaatggctattcaccgcaagatctgcaaaccaaacttgctaaggcacaggagatgacagatgttgagtaccggaggacaaatatcacaagttacaactcgaagcataacagtgaccggacatctccggcttggcctgaagaacttgtcacaccaccaaatcaaagtctcagcgctactacctgccatgccaacgagggagaccaagctctgaatcggtcggcctggggcctagtaattgttacagcaggccgtggaggtcaaatcagaacatttcaaaacttcggttttcctgtaagagtatagcatgagtccgaatacataagatagtcactgccattcaggagtgcagtttgtgtatagataggagatagtgggtgagtttcacactattcagggattgggtttgattgttccttggtgcacctgctagagatcagaatcttcatctaacatacactgtcagtagtccaaaactttgtatgccaaatttattttaccctgaaggcccaagttgtacatgaaagagaaagccctacagagagcaacactatcagctgactggagataaaaaaaaaaaaaaaaaaactcgagcccgg

SEQ ID NO: 640 - DNA, 1894 bp, Zea mays
gtacgacagttgagacttctaagtttaaacatgcgcctcccaggtctggtgttagcagggtgcttccttcaccttcttctgaattgattagcaaatggggtgtatatggaaacatatgcagaattgataagccttgtgtggtagatgagatccatcttcgaagatttgatggcatgttggaacatgagggggctcataggtgtgtttttgctagtatcactgtgaaagcaccggttcgagaggtatggaatgttctcacagcatatgagaatttgcctgaattcgtaccaaacctggctatcagtaggattgttcttcgtgataataacaaggttcggataatgcaggagggttgcaaaggcctgctttatatggtccttcacgcccgtgttgttatggatcttcgcgaaaaacatgagcaagagatcagctttgaacaagtcgagggtgatttttacacatttaaagggaaatggcgcttagaacaacttggggatcagcacaccctgttgaagtacatggttgaaactaagatgcatagggacacctttctctctgaatctatccttgaagaggtcatatatgaagatcttccatcaaacttgtgtgcaatccgtgattatattgaaaaggctggagccaagagtagcaattccacaggtcattctaatgtgcccacagatccagatccagatgttgatcatgatgaaagcaggcaatctgagcaaacgtgtgtgtcttgctcatccagtaccatgaagcagagaccaaaagtcccaggattgcaaaaggacatcgaggtcctaaaatcagagcttgataatttcattgcagagtatggtcagtatggtttcatgcctaagagaaagcatctccggtctcatggaagagtggatattgagaaggctataacaagaatgggtgggttccggaagattgccagcataatgaacctttctctttcttacaaaaatcgaaaaccaagaggctattgggataatctggagaacttgcaagaagagatcagccggttccagaaaatttgggggttggatccttcttatatgcccagtagaaaatcttttgagagggcaggtcgttatgacattgctcgggcattggaaaaatggggtggggtgcaggaggtttcacgccttctttctcttgaactaagatatcctagaagacaagcagacccggacgatgagagacagtctgaatccccgtctgggatgatgaagaagcacggagtgaaacctgatgaaggcaatgtttccccaaatgcgcagaaatggctcctgaagctgaaggacttggatgtcaattgggtggaatactaggtttagctttggaaaaagatatggtctctcatcattaactcagctctttcctttcttcggaggtgttctggatgcattccgacaaagacgccgcagattgtgtacagaacagcgcggtgcacgggccaaccccattctgaaggcgagctaccagcaggcaacatgttttcttgccagtaatcacgactcttggctactactgcgtatctagaactgctgacaatgctactcagcttcttttgcggtcaaaccgatccatgggtttgacaaagtcaggccataaaatgcagaaaagggtgtcgatttcgtgcgcctgttcaaagctgttttgagtcagccacgcctttgaaaaatctgaggtggtcatcgctgggttaagccgtgttcacaggttggtcgcctactttgttattactggtgatgtaagttgacctggtccttttgagagagaaggttacccgtctagtaatagtttcagtcggcacgtttgcattacattggtctcgatcaggaggcacagctacatactttacgtctttacctattgctgcttc

SEQ ID NO: 641 - DNA, 1740 bp, Zea mays
tccatccatccatccagttagttagttagtaagttagttgagggagaagaagcaggggaggggaagcgatgagcaacatgctgcgggctcgccgccgcctggacctcctgcaggtggtgctcttcgccgctgtgctcctcgtcgtcgtcgccgacgccggcgtgacgagccagtaccggcggaagctggaggcgacggtggagatgccactggacgccgacgtcttccgcgtcccgccggggtacaatgccccgcagcaggtgcacatcacgctgggtgaccaggagggcacggcgatgatcgtgtcgtgggtgacggccaatgagctgggcagcagcaccgtcatgtacagcgaggcgtcgccggacccggagaagatggagctccgggcggagggcacccacacgcgctacgactacttcaactacacctccggcttcatccaccactgcaccctcacaaacctcaagcatagcaccaagtactactacgccatggggttcggccacacggtgaggagcttctgcttcaccacgccacccatgccggggccctgacgtgcccttcaagttcggcctcattggcgacctgggccagacgtttgactccaacacgacgctgtcgcactacgaggcgaacggcggcgacgccgtgctgtacgtcggcgacctctcctacgccgacaaccacccgctgcacgacaacacccggtgggactcgtgggcgcgcttcgtggagcgcagcgcggcgcaccagccgtgggtgtggacggcgggcaaccacgagctggacctggccccggagctgggcgagaacgtgccgttcaagcccttcgcgcaccgctacccgacgccgttctggtactcggtgcgggtcgcctccgcgcacgtcgtcgtgctcgcctcctactccgcctacggcaagtacacggcccagtgggagtggctgcgggccgagctggcgcgcgtggaccgcgccgccacgccgtggctgatcgtgctcgtgcactcgccctggtacagcagcaacggctaccactacatggagggcgagacgatgagggtgcagttcgagcgctggatcgtcgccgccaaggccgacctcgtcgtcgccggccacgtccacgcgtacgagcgcagccaccgcgtgtccaacgtcgcctacgatatcatcaacgcccggtgcacgcccgtccggacaagggacgcgcccgtctacgtcacggtaggcgatggcggcaacatcgagggcatcgcggacaacttcacgcagccgcagccgagctactcggccttcagggaggccagcttcggccacgccaccttggagatcaggaaccggacacacgcatactacgcctggcaccgcaaccaggacggcgccaaggtcgtcgccgacggcgtctggctcactaacaggtactggatgcccaccgacgacgacatcaactgatgagtgatgatcacatcatgcatatgccatcgccaccactcatcaccggatccgggagttcggccgtatagattagatctcgcttcgttctcggttcagttcgtccatgtgtcctctcatgataattgtgtcagcaaactttcaatttatttggcttgtgctaaagcacaatatatcatatgtttagtactgcataagttagattttttctgtgatcgaaaaaaaaaaaaaaaaactcgtctgaaataaacgtataagaaaaaccacggccatgggggtcgagtgtcc

SEQ ID NO: 642 - DNA, 1960 bp, Zea mays
ccgaggcgtgcgtgcggttattaaatatataggagcagcagcttcatcattctaataatcggtgtcaactacggttgatggtgtttgtatagggattcgcggccccgtaccgtacgccaaagcacaatccatgggatattccccgcaaatttcggtttttttaactagaccgactggatcagttgaagcacagggaggaaacagttgctagcccaaaccccatacccaaacctagagctcgttattagggggagttcctccagccccgccggggtactctgtatatatatccccggcagtgggctgttgcgagttctgttgagggaggagaagggggtggccaaagaaagcaggggcagaggaagcagagtagtagagcgaaggcgagcgtatcaatgatggggcctctgcctctccgccgccgcgtgggcgtcctcctgttcctggccctcgtgctcctgggcggcggcggcgcggacgccggcacgacaagctcgtacaggcggaagctggaggcgacggtggagatgccgctggacgccgacgtgttccgcgtcccgccgggctacaatgcgccgcagcaggtgcacatcacgctgggcgaccaggagggcacggccatgatcgtgtcgtgggtgacggccaacgagccgggcaacagcaccgtcgcgtacggcgaggacccggcgaggatggagcgccgcgccgacggcgcccacacgcgctacgactacttcaactacacctccggcttcatccaccactgcaccctcagaaacctcaagcacgccaccaagtactactacgccatggggtttggccacacggtcaggactttctggttcaccacgccgcccaagccgggccctgatgtgccattcaagttcggcctcatcggcgaccttgggcagacgttcgactccaacatcacgctgtcgcactacgagtccaacggcggcgacgccgtgctgtacgtgggcgacctctcgtacgccgacaaccacccgctccacgacaacaaccggtgggacacgtgggcgcggttcgtggagcgcagcgtggcgtaccagccgtgggtctggacggcgggcaaccacgagctggacttcgcgccggagctgggcgagaccacgccgttcaagcccttcgcgcaccggtacccgacgccgtaccgcgccgccgggagcacggagccgttctggtactcggtcaaggtcgcctccgcgcacgtggtcgtgctggcctcctactccgcctacggcaagtacacgccgcagtgggcgtggctgcaggcggagctggcgcgcgtggaccggaagaccacgccgtggctcgtcgtgctcacgcactcgccctggtacaacagcaacaactaccactacatggagggggagacgatgcgggtgcagttcgagcgctggctcgtcgacgccaaggtcgacctcgtgctcgccggccacgtccactcgtacgagcgcagccaccgcgtgtccaacgtcgcctacgacatcgtcaacggcaagtccacgcccgtccggaacgccgacgcgccggtctacgtcaccatcggcgacggcggcaacatcgagggcatcgccgacaacttcacgcgcccgcagccgggctactccgccttccgggaggccagcttcggccacgccacgctggacatcaagaaccggacgcacgcctactactcgtggcaccgcaaccacgacggcgccaaggtcgtcgccgacggcgtctggttcaccaacaggtactggatgcccaccgacgacgacacaaactgacgatcaccgccccagagggaacaaattactgatagatcagcgtagcacgttcctgagctagccccgcccccttttatgttctccaattcagtaatgcaatgcgtttttataattactgatgaatgaataagaaaaatggctacgactgcccgccggtcgtcccaacc

SEQ ID NO: 643 - DNA, 985 bp, Zea mays
ccggccgggaaaaaaagcccgccggcacccgcaccacacaaccaatgccggctgtccccggcacgcgcaccagcaccaccacgacccatggccgacaccgccaacccgccgaccaagcccaccaaagcctccgcccccttcgtcgtaattgacgccgccagcgccaacaaggcccgcgacggtggcgccgatgccccgacaccgtcggcggggcacggccgccgctggctgcggcgggcgtgctgcggcgtggccgtcggcggcgcgctggccgcggcggcggtgctgtcgctgtcgctcaccgtgctcagggtgcgggacccgacgctgtccatggagtccgtggccgtcaggcgcttcagcgtgcgcctggacgccgcgtccccggcgcgcccgctgcggatcaacgtcacgctgtccggcgccatcgtggtccgcaaccccaactacgagtccatgcggttcggcgccagcgccacggagatcttcgtggacggcgcggcggacccgggccccgtcggcgtgggccgcgcgccgcccggggaggtccccgcgcgcggcgccagccgggtggccgccgacgtcgacgtgctcgtcgacagggtcgcgcccgccgtggtcgccccggtgctgttcggcggcggcgaggtgcgcctcgccacgcgcaccgccgtcgacggcaggctcagcctgctcggcgggctctacggccgccgcaccgtgcgcgtcgccatgcggtgccgcgtcgcgctccgcgtctcagccgcggccgtcgccgtcgccggcaaccccgcgtgcgtcgcggacctcgggcgctgacgtggtctattattcgtcagctgtagtctgtgggtgagcgggccggtgtagtttttgccctttctctttaccgccggcgatgaccggtggagatagttacggtggcagctataactgaactcctgtcggctagcctcgtttatagagcacaacttaatttgggcac

SEQ ID NO: 644 - DNA, 1962 bp, Zea mays
  misc_feature (479)..(480): n is a, c, g, or t
ttgggtacctcgaggccggccgggcgcttgtggacctgctcaagttcaagtcgcaggagggtgtcagagtgtgcctgcttgtgtgggatgataagacttcacatgacaagttcttcatcaagacgggtggggttatggcaactcatgatgaagaaactcggaagtttttcaaacattcctcagtcatctgtgttctctctcctcgatatgctagcaataagctcagcattttcaaacagcaggttgttgggactttgtttacacaccatcaaaagtgtgtgctggttgatacacaagccaggggaaacaagcggaaaattacagctttcattgggggcctagatctttgtgacggccgctatgacacacctgaacacaggcttttcaaagatcttgacacagtattccaaaatgattaccataaccctactttttcggcaggtgcaaagggtcccaggcaaccatggcatgatttacannttgcaggattgatggccctgctgcctatgatgtcttgacaaattttgagcaaaggtggcgaaaggcaacaaaatggcgtgaccggtttagaagagtatctcattggaaagacgatgctttaattaaactggagcgtatctcatggattttaatcccttcacccaatgttccggacgcgcggcctagtttgtgggtttcaaaagaagaggatcatgaaaattggcacgttcaggtattcccacgcgtccgctctggttccctaaaaggatttcctagtgattgcaaagcagcttcaaagctgaatcttgtgtgccgaaagaacctggtaattgataagagcatccacactgcatatgtccgagcaatcagatctgcacaacatttcatttatattgagaaccagtactttcttggttcttcatatgcttggccatcctatgtgaattcaggtgctgataatctggtaccaatagaattggccctcaaaattgcaagtaagattaaagcgggagaacgctttgcagtgtatgtagtgataccaatgtggccggaaggagtccctactgcagcatctgtgcaagaaatccttttctttcaggcccagacaatggagatgatgtataaaataattgcagatgagctcaaggcaacggacaataaggatatgcaccctgaagattacttgaacttcttttgtcttggaaatcgggaagaaccaccatctaatggtagtccagaatcagagaaatctacagataaaagtgcagcggccttagcttcgaaatatcgacggttcatgatctatgttcacgcaaaagggatgattgtggatgatgaatatgtcattctgggttcagcaaacatcaaccagagatccctggctggttctagagatactgagatcgcaatgggtgcataccagcctcattatgcatggtctacaaagaatggacatcctcacggccaggtatatgggtacagaacgtctctgtgggcagagcaccttggaacggttgatgatcgcttcaaggatccttcgagtttggagtgtgtaaggtttgtgaatcaaatagctgtagagaactggcaaaggtttacagcagaagaaatgagtacgttacaagggcacctcctcaagtacccagttaaggtggaggctgatggtaagatcagcccactgtcagaccaggagtgctttcctgatgttgggggcaagattctgggagctccaacttcacttcctgattcactgactatgtagtgttattacataaaaaaacttctttcagagttgaactttgtaattgtctaaaattggcgggtttatcgcagaacttgtactatatctgtaatcatcgatagttggcgcagggaaagttcaagatgttagtggtgctaagttttcccagcgtttgtaaatgaaccatatgataggatcctagacaatgcttccatttccattatgattatacaacagttttc

SEQ ID NO: 645 - DNA, 1279 bp, Zea mays
tccacgcgtacgctgtggttccctacaaggatttactagagattgcacagcagcttgaaagctgattcttgtgggccgaaagatcctggtaattgataagagcattcacactgcatatgtacgagcagtcagatctgcacaacatttcagtttatatgtgagaaccagtactttcttggctcttaatatgcttgaccatgctatgtgaattcaggtgctgataatctggtaccaatagatttggccctcaaaattgcaagtaagattaaagcgggagaacgctttgcagtgtatgtagtgataccaatgtggccggaaggagtccctactgcagcatctgtgcaagatatccttttctttcaggcccagacaatggagatgatgtataaaataattgcagatgagctcaaggcatcggtcatttaggatatgcaccctgaagattacttgaacttcttttgtcttggaaatcggcaagaaccaccatctaatggtagtccagaatcagagaaatctacagataaaagtgcagcggccttagcttcgaaatatcgacggttcatgatctatgttcacgcaaaagggatgattgtggatgatgaatatgtcattctgggttcagcaaacatcaaccagagatccctggctggttctagagatactgagatcgcaatgggggcataccagcctcattatgcatggtctacaaagaatggacatcctcacggccaggtatatgggtacagaacgtctctgtgggcagagcaccttggaacggttgatgatcgcttcaaggatccttcgagtttggagtgtgtaaggtttgtgaatcaaatagctgtagagaactggcaaaggtttacagcagaagaaatgagtacgttacaagggcacctcctcaagtacccagttaaggtggaggctgatggtaagatcagcccactgtcagaccaggagtgctttcctgatgttgggggcaagattctgggagctccaacttcacttcctgattcactgactatgtagtgttattacataaaaaaacttctttcagagttgaactttgtaattgtctaaaattggtgggtttatcgcagaacttgtactatatctgtaatcatcgatagttggcgcagggaaagttcaagatgttagtggtgctttttgagttatgctcctgtaagttttcccagcgtttgtaaatgaaccatatgataggatcctagacaatgcttccatttccattatgattatacaacagttttcaacatttttgctc

SEQ ID NO: 646 - DNA, 1469 bp, Zea mays
ctcgaggccggccggggacagttgtccaaaccaaatacattggggccctcgcggccgcccggcggcaagcaaaccgggtcggccagcagacactgccatgaggactctactaccggtggccgccggccgcgggaccgtcgcctgcgcggccacgcccgtcccccggaggtcgctgctcctctccaccgctgccgcaggtgcggcgctgcagccggagcaggtggctggaacgaggccgttgaggctgaccaggagcgaggccagcgccgtggcaaagcccaggaccttggccgacgaggccatctcgtgggcgaagaaagacaaccgccgcctcctccacgtcgtctaccgggtcggcgacctcgacaagacgatcaagttctacaccgagtgcctggggatgaagctgctcaggaagagagacataccagaggagaagtacagcaacgcgttcctcgggtacgggcccgaggaatcgcatttcgtcgtcgagctcacttacaattacggggttgacaaatatgacataggcgaagggttcggccatttcggcatcgcagtcgaggacgtggccaagacggtagagctcataagagcaaaggctggaaaggtcatcagggaagccggtcctgtgaagggcggcgagaccgtcatcgccttcgtggaggaccccgacggctacaagtttgagatcatcgagaggcctggaactccggaacccttgtgccaggtgatgctccgcgtcggcgaccttgaccgtgccataagcttctatgagaaggcctgcggcatggaactgctccggaagcgagatagccctgagtacaagtacacagtggcaatgatgggtttcggccctgaagacaaggacgcggtgctggagctgacctacaactatggtgtcaccgagtatgccaaggggaatgcatatgcccagatcgccattggcaccgacgatgtctacaggaccgcggaggcggcgaagctgtccggaggccaggtggtgcgggagccggggcccttgccagggatcaacaccaagatcacagccatcctggaccctgatggctggaaattggtcttcgtcgacaacatggacttcgccaaggaactggagtagccacgccaacgacctcagacgccctgcaacaggattaactcgcactgctgttggtccgtaattaaaatgaaagctactagtgaaacctcaaattttcatcatgcataaaatacagaaccacctttatacttgctcccggtcggtcgggccggcgtcctcgttcacgtgaacgatgacgatcagcctatggttgggagcgtttgcagcactttttctgggggcgctagagaacggggatgaatactgccgcgcctttgtaatctcgctttttgctcgatgcaacttaaaatcctgtccctgtctgtctatcacggaattaagaagcacgtgcgggagccgcaatttctgg

SEQ ID NO: 647 - DNA, 1634 bp, Zea mays
tagcgagtaccgtcgaattccggcccggcaccccccgccggtcgctcagctcaaacatccctactctcctgctcctcttcttcctcctcctctcgctctcaagcgcgtcttcactccggcctagctcggacggatcgacatcgaggggaaagggaataagtgggggcgccagcagatggatccatggatcagcagccagccttctctgagccttgacctgcgcgtcggcctgccgccgctcagcctccaccaggcgccggtggccgtcgccttggccaggcccaaggtgctcgtcgaggagaacttcctgctgcctcccaagaaagaaccagaggtggcggccgctctcgagtcggagctacggcggatgagcgaggagaaccggcgcctggcggaggcgctggccgcggtggtctccaagtacgaggcgctgcgcagccagcacacggagatggtggccgcgtcgtccgcgtcggagggcgggtccgtgtcgccgtcgcggaagcgcaagagcgagagcgcggacacggcgccggtgcagcgccttcaccagcagcacgcggcggcggacctgtcggagtgcacctccggcggcgagccgccgtgcaagcgcgtcgtgcgtgaccgggcggaggaggtggaggaggaggaggagtgcaggcccagggtgtcgaagctgtacgtgcgcgccgacccggccgacctgagcctggcggtgagggacgggtaccagtggcgcaagtacgggcagaaggtgaccaaggacaacccctgcccgcgggcctacttccgctgctccttcgccccggcctgccccgtcaagaagaaggtgcagcgcagcgcccacgacgcctccgtcctcgtggccacgtacgagggcgaccacacccacggcccgcccccctcgggctcgggctcgggttcgggcgccagcagcaagaacgccgcgaagccgccgtcgccgccgcgccgccaggaggctgctgtcgcggtgactgcggccgcggcggcgtcggagatggtccggcggaacctggcggagcagatggcggtgacgctggcgcgggaccccagcttcaaggcggcgctcgtgtccgcgctgtccggccggatcctcgagctgtcgccgaccaaggactgacggaccgcagacggatcggatcgagcggcgtgacacgagattctcgcctcagggctcagggtgtcttcgcacgcacgcggcaatggtcggccgaacaggagacgaggatctgcagcccagcaccagggacgagcagaccggggctgctcgcgcggccggacatggcgtggaccggtgtccagactccggagatcgtcatgccgacgacgtaacatgcgaaacgctactagtacaagaaacaacatccaagtgtacaatcccctgtactttgtagtcttgtttaggcaaactgttctctgtccatccaatcgatgaaacgagaacgttacaaattttttttactccgttcgataagatggcaatgggtacccgctacccaaaacccggtgggtttttgctttattagggtataagtttggatcaatttctctatccatgggtttgttaatgggttcaaatagaaacccacgggtacatgggcatgggtttgttc

SEQ ID NO: 648 - DNA, 3484 bp, Zea mays
  misc_feature (2371)..(2371): n is a, c, g, or t
  misc_feature (3198)..(3198): n is a, c, g, or t
tcgaggccggccggggaattcccggccgggtcgtcgagtgtcgagtccccagtccccagtccttatataactttgggtacctcgaggccggccgggactccaactctcaagcgtctctactcctcttcctcctctctctactctccaagttctcttctccgtcgaccgctctacacgtctcttgtcgacctggacaccgaggtggaagaaggaagcagtcagcagatggatccatggatcagcagccagccttctctgagccttgacctgcgcgtcggcctgccgccgctcagcctccaccaccaggcgccggtggccgtcgccttgcccaggcccaagctgctcgtcgaggagaacttcctcctgccgcctccaaagaaagaaccagaggtcgcggctctcgagacggagctgcagcggatgggcgaggagaaccggcgcctggcggaggcgctggccgaggtggcctccaagtacgaggcgctgcgggggcagtacacggagatggtggccgcggcggccacggcctgcgggaaccacccgtcgtccacgtcggagggcgggtccgtgtcgccgtcgcggaagcgcaagagcgagagcacggacaccgcgccgcccgcgcagcagctactgcaccagcactacccggcggtggcgccggaccagacggagtgcacctcgggcgagccgtgcaagcgcatccgggaggcggagtgcaagcccagggtgtcgaagctgcacgtgcacgccgacccggccgacctcagcctggtggtcaaggacgggtaccagtggcgcaagtacgggcagaaggtcaccaaggacaacccctgcccgcgggcctacttccgctgctccttcgccccggcctgcccagtcaagaagaaggtgcagcgcagcgccgacgaccccaccatcctggtcgccacgtacgagggcgaccacaaccacggccagcccccgccacaggcgcaggcgccgcacgacggctccagccctggcgccagcaagaagccgccgtcgccgccgaggccggtcgccgccgctccggcgccgctccaccaccagcaggtccagcagcaccagcagcagcaggcggttggcgcggtgaaatgcgagccgcccgtggccgcggcggcgtcggagctcatccggcggaacctcgcggagcagatggccatgacgctgacgcgggaccccagcttcaaggcggcgttcgtcaccgcgctgtccggccggctcttcgagatgtcgccgaccaaggactgacggaacggatcggatggattgggagattggcatcgcaggagattctggatcagattgtcttcgagcgcacgccgcaatggtcaactgcgcagcgctggcttggctgtcagagcgaaacagcggtaacagagcaagacacgaggggtctgcactctgcagttgtgcaggaggaggaacagacacaaggggaggacggcgcgcggccggacatggcgtggaacagagatcgtcgtcaccgccggcgggggtgtggtcgacgacgcgacatgcgaaacactacgtgctagctagcataggaaaaaacaacatgaaatcgtacaaccaaccaatccctcgcactgttttagttgttagctgtaggcgaaactgttcatccaattgatcaaatgaaacttattttttccctagcactatgtttcatgagaatgagaccaggaatgaaccaacttgagtttgaaaatttccataggggagtaataataacagaggtatactactggactgtgtagcaggcgcgactgagctgtgggccacccgcgcattcgcaaatgttcctgagtagtagttcgccgaggattgggtttgaaaagtaggcgacccagcgggatggcgcggggcccagatgccagagcagagtgatcaccgcgggctgaagttggccgtggcccacgtgcgacgttttgcgtccgtcggcgccgcgcgggagggaagctgggtggaaacgcaaggccgccgcggctggcggtggtggtggcccggcccggcccggccggtctcctgggcagagctgtgtggcttggctagtcaaacacgtgcgggtcggtccggcgctccactccacgactctgcgttccgcccacggtgccgtcggagcaccgcaagcatgccaattaccaaccgtcgaccacggcaccgtttgcgttggcattcaacaggtagccgtcgtcagttcacgggcagtcacacctttttcactaattaagaccagcgagtcagtagcccatggcccagcctctagaaagaaacgccatcacgggcaccagagtgcggtcgtctcgtcttcgtccagaggtctttcacgggaaggttcggaggtcgccgnccgtcgccatcaccgcacgactggccggccacaacgtggggcggtggacgaccggactgctccgccgcccaccagccgcctccccccgacccccgcttgcttgccgattgacccgccagccaggacgctgctgtaaggctccgttttttatttattatatacatgcataataatattgattattacttactatctactctgtcggccaaccgcgggcgccgcaatccatcacgacgaggaccaccaccattatctactgcaccaggcatcacttgttttctactcaacccgtgaagtctgggaagttccgcttgattcatcgggctggaaggaattgacgctgtattgtggctgttatatatggtgcagtagatgatgcgcatatagttttcaactaagggcatctttagttttaagcctaggaggtaaaatttatttcggtgactgaagtttaacatctatcatgtttggtcccaatcattaaaattattcagaatgtattaaatagctcacaagaagaccaaaatgtccttttaccattttctcactattaatataactgaaataaatgagaagcaaaatgtgaaatcaatataatttagacaatcttaaacacctctcaggacactagagactaaagcagtttagtctcgccgttcgataatagtgactaaaatggagaaactaatgtttagtctacaaccaaaaggctctaagcttagtgcttagtcagttagtctggtctggtacctgtcattttcttcgtgcacgttgtttgcttctttggaaaaatcagtctacttcgcttttggatgtattatggaacnatcgcgtggtcgtatacggaactacatagcctagtcaagcgcacgactgatctttttgaattcatcattttttaatcaaaattttacgtgcacatccccccactaaaaccactatcgtgtttgacctatgagttagcgccttaacctctgccatcaaagctactcgatttggtgtcatgacttacgacactgaagtccaatttaaacggcaacatgtagttctctcgttgagacagacctgatttatttctcgtctctatccctccctcccccaatccttctaacc

SEQ ID NO: 649 - DNA, 1667 bp, Zea mays
actccaactctcaagcgtctctactcctcttcctcctctctctactctccaagttctcttctccgtcgaccgctctacacgtctcttgtcgacctggacaccgaggtggaagaaggaagcagtcagcagatggatccatggatcagcagccagccttctctgagccttgacctgcgcgtcggcctgccgccgctcagcctccaccaccaggcgccggtggccgtcgccttgcccaggcccaagctgctcgtcgaggagaacttcctcctgccgcctccaaagaaagaaccagaggtcgcggctctcgagacggagctgcagcggatgggcgaggagaaccggcgcctggcggaggcgctggccgaggtggcctccaagtacgaggcgctgcgggggcagtacacggagatggtggccgcggcggccacggcctgcgggaaccacccgtcgtccacgtcggagggcgggtccgtgtcgccgtcgcggaagcgcaagagcgagagcacggacaccgcgccgcccgcgcagcagctactgcaccagcactacccggcggtggcgccggaccagacggagtgcacctcgggcgagccgtgcaagcgcatccgggaggcggagtgcaagcccagggtgtcgaagctgcacgtgcacgccgacccggccgacctcagcctggtggtcaaggacgggtaccagtggcgcaagtacgggcagaaggtcaccaaggacaacccctgcccgcgggcctacttccgctgctccttcgccccggcctgcccagtcaagaagaaggtgcagcgcagcgccgacgaccccaccatcctggtcgccacgtacgagggcgaccacaaccacggccagcccccgccacaggcgcaggcgccgcacgacggctccagccctggcgccagcaagaagccgccgtcgccgccgaggccggtcgccgccgctccggcgccgctccaccaccagcaggtccagcagcaccagcagcagcaggcggttggcgcggtgaaatgcgagccgcccgtggccgcggcggcgtcggagctcatccggcggaacctcgcggagcagatggccatgacgctgacgcgggaccccagcttcaaggcggcgttcgtcaccgcgctgtccggccggctcttcgagatgtcgccgaccaaggactgacggaacggatcggatggattgggagattggcatcgcaggagattctggatcagattgtcttcgagcgcacgccgcaatggtcaactgcgcagcgctggcttggctgctgcctccgttcactcttcgctgtcagagcgaaacagcggtaacagagcaagacacgaggggtctgcactctgcagttgtgcaggaggaggaacagacacagggagaggagggcgcgcggccggacatggcgtggaacagagatcgtcgtcaccgccggcgggggtgtggtcgacgacgcgacatgcgaaacactacgtgctagctagcataggaaaaaacaacatgaaatcgtacaaccaaccaatccctcgcactgttttagttgttagctgtaggcgaaactgttcatccaattgatcaaatgaaaattatttttccctgaaaaaaaaaaaaaaaagaatgagaccaggaatgaaccaacttgagtttgaaattttcaaaaaaaa

SEQ ID NO: 650 - DNA, 3087 bp, Zea mays
aattcggcacgccccatacactctggagtctggacttcacttcgtccccgtcgaacactccacgccgctctagcactctctgcgctctcccatcctcctcgctagccgtactcttcaccgccgaagcttctggttcctcatcgccgccgctacgcgtgagatcgacccgccgccgtcggtctttttccctgactggtaatctagtgttcattctcttaattcaaatggtttcctcccacggagcaagatgaggaaatattcaaactgctcttagccgtgtagcacgacaagtttgttgcagagctggtctacgacaggtggacagctgggatttcttggcactttgtcaagtccacgagtagaagtgtggtggaagattgtcttcgttcaagatgatgcagaggccactgctccgtccggaggagtactccttgaaggagacctcacctcaccttggtggtgcagctgctggtgacaagctcaccaccacctatgacctggttgagcagatgcagtacctttatgtaagagttgtaaaagcaaaggaacttccaaacatggacatcactgggagctgtgacccgtatgttgaggtgaagctaggaaattataaggggcaaactcagcatttcgagaagaagaacaacccagagtggaatcaggtctttgccttctcaaaggagcgtattcagtcatcagttgtggagattgtagtcaaggacaaggatcttgtcaaggatgacttcattggccgtgttatatttgatctgaatgaggtcccaaagagagtgccacctgatagcccgttggctccacagtggtatcggttggaagaccgaaatgggcacaaggtgaagggggagttgatgttggctgtttggatgggcactcaagctgatgaagcattccctgaagcatggcattctgacgcagcctcggtccctggtgatggccttgcaagcattagatcgaaagtgtatcttactccaaagctttggtatctccgtgtcaatgtcattgaagcccaggatcttataccaaatgacagggccaggttccctgaagtttatgtcaaagcaatgctaggcaatcaagtcctcagaaccagggcaccgagccggaccttgaatccaatgtggaatgaagacttgatgtttgtcgcagctgagccatttgaagaacacctaattttgagtgtagaggacagggtggccccaggaaaggatgaagtaattggaaggacaatgatttcactgcaccatgtaccccggaggctggatcacaggttgctaaccagccagtggtataaccttgagaagcatgtgattattgatggtgagcagaagaaagagaccaagttttcaagtcggattcacttgagaatatgcctcgaaggtggatatcatgtcttggatgagtcaacacattacagtagtgatttaaggccaactgcgaagcctctgtggaaacctagcataggcatgcttgagcttggtatcttgacagcacaaggcctgttgccaatgaagaccaaggatgggcgtggcacaactgatgcgtactgtgttgcaaagtatggacagaaatgggtgcgtactaggactataatcgacagcttcactcccaaatggaatgaacagtacacctgggaggtgtatgatccatgcactgtggtcacaattggtgtatttgacaactgccacctgaacggcggggaaaaggtcaatggtgccagggataccagaatcgggagggtccgcatccgtctctcgacgcttgaaactgatcgggtgtatacccactcataccctcttattgtcctgacacctggtggcgttaagaagatgggcgaggtgcagcttgctgtccgtttcacgtgttcgtcactgctcaacatgatgcatctgtacacacagcccttgctgcccaagatgcactacgtgcacccgctgtccgtgatgcaggtggacaacctcaggcgccaagccacgaacattgtctcgacaaggctgggccgcgcagagccaccgctgcgaaaggaaatcgtggagtacatgctcgacgtggactcgcacatgtggagcatgaggaagagcaaggcgaatttcttccgcatcatgagcgtcttgagccccttggtcgcggtgacaaagtggttcgatcagatctgccgctggaggaacccactgaccaccatactgatccatgtcctcttcatgatactggttctttacccagagctgatactgcccacagtcttcctctacctgttcctgataggggtgtggtactaccggtggcgtctgaggcagccgccacacatggacacccgcctctcccacgcggagactgcccaccccgacgagctggacgaggagtttgacaccttccccacttcccgcccgccagacgtcgtgcggatgcggtacgacaggctgcgcagcgtcgcggggaggatccagaccgtggtcggcgaccttgcgacgcagggcgagcggttgcagtcgctgctgagctggagggacccgagggccaccgccctgttcgttgtcttctgcttcgttgccgccatcgtgctgtacgtcacaccgttccgggtcgtggtcttcctcgcgggcctgtacatgctgaggcaccccaggttccgccacaagatgccgtccgtcccgctcaacttcttcaggcgtctgccggcgaggactgacagcatgctgtaggttgtgggcttgtggcagatgcctggctccattgctggttcagtggtttcacccgtcagttgcagctcacagatggtcactctcctaaggtagtgtatccgaaaacaatgaactgccagctatcttcgtgacttttgtagcttctctctgtcgcatggttggttatgtattcagatggttgtgaaccattcctgtagctaggtatgcgtgatgcatgatgcttgaaaactccgggcgttggttaagttattgctttacctacttgctcagcagcagtggtctgctaacgtggtcctctgctgctgcatgtgcatcgtgttgtttggtttccagctcaatttgtcagtttgccaaaaaaaaaaaaaaaaaa

SEQ ID NO: 651 - DNA, 3073 bp, Zea mays
  misc_feature (3044)..(3044): n is a, c, g, or t
cccacgcgtccgcgtccccgtcgatcgagcactccactcgactctctagtaccctcctctgcacctccctctctctctctctctctctctactgcctttgtttttgctcgcaagaaaaacccgaaaagaccttgcactttgtcaagtccgtgagtagaagtttggtgtaagcttgtcttcgtacaagatgatgcagagaccaccgctccgtccggaggagtactccttgaaggaaaccacacctcaccttggtggtgcagctgctggtgacaagcttacaaccacctatgacctggttgagcagatgcagtacctttatgtaagagtggtaaaagcaaaggaacttccgaacaaggacatcactgggagttgtgatccttatgttgaggtgaaactaggaaattataagggccagactgggcatttcgagaagaagaacaacccggagtggaatcaggtctttgcctttgcaaaggagcgcatccagtcatcagttgtggagattctggtcaaggacaaggatcttgtcaaggatgacttcattggacgtgttatatttgatttgaatgaggtcccaaagagagtgccacctgatagcccattggctccacaatggtatcggttggaagaccgcaatgggcacaaggtgaagggggagttgatgctggctgtttggatgggtactcaagctgatgaagcgttccctgaagcatggcattctgatgcagcctccgtccctggtgatggccttgcaagcattaggtcgaaagtgtatctaactccaaagctttggtatctccgtctaaatgtcattgaagcccaggatcttataccaaatgacaagactaggttccctgaagtttatgtcaaagcaatgctaggcaaccaagtccaaagaaccagggcattggcaagccggactttgaatccattgtggaatgaggacttgatgtttgttgcagctgagccatttgaagagcacctagttttgagtgtagaggacagggtggccccaggaaaggatgaagtaattggaaggacaatcattgcactgcagcatgtaccccggaggctggatcacaggttgctaaccagccagtggtataaccttgagaagcatgtgattattgatggtgagcagaagaaagagaccaagttttcaagccggatccacttgagaatatgtcttgaaggtggatatcatgtcttggatgagtcaacacattacagtagtgatttaaggccaactgcaaagcccctgtggaaacctagcattggcattcttgaactgggtatattgacagcacagggcctgttgccaatgaagaccaaggatgggcgtggcacaactgatgcatattgtgttgcaaagtacggacaaaaatgggtgcgtaccaggactataatcgacagtttcactcccaaatggaatgaacagtacacctgggaggtgtatgatccatgcactgtggtcacaattggtgtattcgacaattgccacctgaatggcggggaaaaggccaatggtgcgagggacaccagaattgggaaggtccgcatccgcctctcgacactcgaaactgatcgggtgtatacccactcataccctcttattgttctgacacctggtggtgttaagaagatgggtgaggtgcagctcgctgtccgtttcacgtgttcatcactgctgaacatgatgcatctgtactcacagcccttgctgcccaagatgcactatgtgcacccgctgtctgtgatacaggtggacaacctgaggcgccaagccacaagcattgtctccacaaggctgggccgtgcagagccaccgctgcggaaggaaatcgtggaatacatgcttgacgtggactcgcacatgtggagcatgagaaagagcaaggcaaatttcttccgtatcacgggtgtcctgagccccctgtttgctgtggcgaggtggttcgatcagatctgtcactggaagaacccgctgaccaccgtactgatccatgtactctttatgatactggttctatacccagagctgatactgcccacaatcttcctctacctgttcctgatcggggtgtggtactacaggtggcggccgaggcagccaccgcacatggacacccgcctctcccacgcagagaccgcccacccggacgagcttgacgaggagttcgacaccttccccacctcccgcccgccggacttggtgcggatgcggtatgacaagctgcgcagcgtcgcggggaggatccagaccgtggtcggcgacctcgccacgcaaggcgagcggctgcagtcgctgctgagctggagggacccaagggcgaccgcgctgttcgtggtcttctgcttcgtcgccgccatcgtcctgtacgtcactccgttccgcgtcgtggtcttcctcgcaggcctgtacgtgctgaggcaccccaggttccgccacaagatgccatctgtcccgctcaacttcttcaggcgtctgccggcgaggaccgacagcatgctgtaggcgcggcaggtgcatggcctcatcgctggccggtggtttcgcctctcagttgcagctcacagatggttgttgctctctcttaagtaagtgtatccggaaaaaaaggagctgctagctatcttcgtttactttttgagcttctctgtgttgcatggttggttatgtattcatatggttgtgaacctttcctgtaacaactggacgcatgatgcgtgactgtgtctaggtatgcatgcatgtgtgtgatgcttgaaaactccgagctttagtgtttattgctttacctacttcagcggcagtgctgtcagctaacaaggctctctactgctgcatgtgcatcgtgttgtttggtttgcagctcaatttaccgacttgccagttgtaattgggaaatactgatctggattttgcctagccgagagttctcttctacgcagactggaactatttgggtgccaatctgagcagaggcgggctgttgtacttgtgaacttaatagtgatgtcatggttgaatttccttccaaacngagctgatgcttgtcttcaaaacgctcat

SEQ ID NO: 652 - DNA, 3042 bp, Zea mays
ctaactcatttttctttgctgcttctggttggattcttgggcgattcgtcagaaaaagaaggagcaaagaatggtggtgctaggaagcaagttaatccgaaagacggcaagtgaagctttcggaagggccttggggtggtgccctctcgacaggcgtatttctggatgatccgaagctggaactgggaagttgatttggatggttgtctgtcttttgctggctagactgttcagttccttttgtggcttctgcctgtcttgttgggttgtaaataagaaagtcttatgtagtccttcgtaggccaaaacttttcctgttatcgtaggctcttcactgatctcgtgatagtggttagagtctagatagggtgctggccgtggttggtcttttggaggttttaccgcgtggtgcgcggttgtttcaaacttgcctatttcttattgaaatagggggcttcgcctcttcgtcaaaaaaaaaacctatttcgtttcttttttgtgaatcaaacgcgtttcaaacaggccgcaagtacatggggatctatgatctatcaccggtcagttgtcgttttggagaaccctgtaaagctcagctgccagcgctggcagcgtgatggactgatgggtttgtagatcacgccattcactcccgtccgcttgcacacgtcgcgaacgtcgatgcggctcgctctcggcggcagtggcagcgcgacaagtatgagcagccagctgaacctgtcgccggtgacctcccggatcctgagggcaacctcaaacccatcatccattgcagtggcggcgtcagcgatagctgcggcaggtgtgtggaggtctacaagcaccgcctgcagtaccaagtacggggactggaatgacggctgatcgccgccgccggtggcggtggcgctccccagtagaaggctgaggcagcgggcggccgatggaactggaagcacctggcagccgagcctctccaggagcttccgcgtcacctcccggctggtgtcatcagtgttcaagagcaggacgcgcaggccgttgaagttgtgctgaggaggagcactggtggacggcgagggcactccgaatctgccaccgatgtggtagaatccgccgccgcctgccggggaggaggcagagggtgatgccactccatagacgagctggaagtgcaggatgaggctcatgtgctcttcatgctggcctccggacgctggcgtggattcccaccacatcttgccgttcatcatctgacgacatcggtcagccaattttaagctcttgctatgtttctaactacatacatagagcaaacattgtttcgtacgtacatagagacagacagagctcacctgcacgatcttgttgcacgtagcgatgcttagccgcgtcttggagctggctgaactgatgctgacgctggtgcgtcttgtgattctttcttgaggtcgtgggctggacgagagcagtaagccgtttctgaagtgtcttgtgatcccaaatcggaacctgacgcacaccgtgttgcagccagagaagttgggggtgatccaatcaggaaggcctgagcctgacatggtctcttggtcacccaccggaacagtgtccacggcaaagcagaggtcatggcaatggcattcgcactggtccagcagaacgccaaccatgtgcagcaggaggtggaacactcgcctgtcgtcgccgaccacccagcatccggcgggcagagagctcatctccgcccgatgcgagaagccgagccccctgcagcgggcgaggcaccccgccacgccggccgcgtccttaaccagcgcgcgggggtcgaacggcctccgcgccaagctcacgccggcagccgtcggcgtcagcagcgccgccatgacgtcgtcggtcagcgtggtggagagggcgctgatcctggccatggcacccaccgcgaccctctgctcggtgcaacggaaggcctcgtcctcgtgctgctgcgcctgcatcagggagagcagccccgcgacggagtgcatcggcctcagcacgccgtcgcgcatggcgctctgcgaggcgtccctggccctggtggccaccgctgcgtcatgccgggcatgcaccaggaccctctgccgctcggccagcttgtgccgagtcagctgccactccttcagcaccgccgcgtgcgacagcgccacggctaactggtccgccgcaacctccacgatctccagctcctgcctgctccactctcgtgctcctcctcctccttctcctctgggtcctctagtcctgtgattcttagtggtcggagctggagccggaaggaccaagaccatgatcgcgtagctgacaccagctccctgcccatcggataatgaggatgatgcgtcgacgaagttggacactctgagcatcggcatccgtatggcagccgcacccgcgtgcccatgaccagacgtcgacgtcgtcctcctgagcgccgagcccggcctcagcaccttggcgttcttgctagccatgacggcggccacgtcagggtcagtgctgcaaatggccagcctcgtcgtcgggtcctggtggtcatcttcaggcagccgatgtaccaggtgcagcaagctggggccaccatcactggccgccgccgcagccgcgggcatccagacggcgcagcgggggcggccgagggcgtcagagaggtggaagacagcggtgcgcagcacgtcgggcgcgagagaggctccgccgtggcagccgcagcagacgtgcttcgtgatggcgcggacgatgcgcgtggcggtctcctcgcggcgcctgacgagggcgacgtcgcggtccagctggcgcgccttgtcccggagcagcgcctcgcgggtcttgaggcggagcagctgcgggacgaaggtggggagggagacggcggcgacggacgcggcgacggcggccagcgccttggcggcggtgatggccagcaggaggcggcgcgagtccgggcgggcgtaggtgaagatggcgacgaggtggacgaggccgcagagcacgagaaggcgccggacg

SEQ ID NO: 653 - DNA, 4870 bp, Zea mays
  misc_feature (4296)..(4296): n is a, c, g, or t
tgccgttcttggtgtaccaaccaccaggataagagcggagaaggcaggtgataggttgctttagtttttcctcggtttgataaagctagaaaccaactgccaactctggtctcgatcgtagagatgaggcgagagtacggtccaacgggtgacaacaagtcaagtatgagcgctcccttggtacaacgttttcaaacttaatttggcacgagtgcatatgtgactaaggaggtcctcgacagccgagcggcatttttctttcgattgttattcttgcatgattgtttgaaacgaaccattaaaggatgaaatttaggagctatgggcgaaaattcatcaccgtcggagagggcgtgcagggtgttcgctcgatcaggggccccaaatctcttgatccccaaacaaacatgtaagtctgtagtatatttatataacagaaagcctacattaatctttaattctttattgatccattagcatgcatgcttctattttatgaccgtgaattatgagtttagcctcgaatttttgccctggtgcagtgggacccagaccttgtgcggtgatcacatgaaacttcaaactacgagcctatcagtatcatgcacttatatataacactaaaagcgggtcgtgataagtgattatcctcgccggccgggtccgcgatgggcagttgtcgatacgagatctggttttttctccgtgtttggaagctagcaggtcatcagcggggcggtgagggtatcattagctatatatatataagccgttgaaataaaacaacaagaatatgctgaacaggaaggttgtggcatacagatgataataataactgcgtatcgttagtggctgcagaaccggccggtcaaattgagcgacacaattaattccttcgtggatctcagctcagggccgggtccaaaataaacttgacgcgtaactttccgttcgtttgtgaggggaaaaaatctagaccgctttgcggtttatctttttttttcccggttataagtataagagaaaataccaggtccagaatgtttggacacgtgcctagaaaacagtaggcaatgcctgtatatatacgacgcggctccagaaaggacggccgtcccttgccacgcgcccacgccgattctacacacgattttccgatgaggagccagggccaggcacaggcagacgaacggatacgcagcccggccacggccaaccaaggcgaggcggccgccagaaagtgacgggctgcgtctggaatcacacgccatgcttttgctcaaagccccccacctcaaagcgacgcgagcgcagggcagggggtgggggacaagtatcgcgcgcctgacccacgaaatagaagctgtgggaaaggagaggagcagcggcggtggggagggccagccagccactcgcagtcgcacactcgcaccacagaagcaagccacccgaacggaacaggaacgggaacggcgacgcactcttggcttctctgtgtcttcctgcatcgatagccagtacgtagtccactcggtggttcagtggagacccaagaacgaaccgtagacaaatcaaaagcatgtggattatgctagctgctcgactttggaaattcgctggaatgcttgtgctgcgttccgccagaacaaaacagactagcatcatccagagtgtgcgtgattcgtcgattttccacggaagagaaaaaaaagaaaactgacaaaacggggcggacggcccggcccggcccggcctgggcctgccttggaggccgcgtggcgtgcgcgtgcggtgtgccctaacgccgtggccgtcaaaagggacggcgcagcagcgctgtcgccgtccggtcctatccggtggagggctcttccgcgtcccagagaggccattaaaatcggccgcccccggggccgccccgtgcccctttcccaacctcccatcccataccaccccccttcatgtcgtcgccttcctccccgcgcacttgcccctgcatctctccgctgcccaccactccctcgcattaacgacgaaggctcatcatctctgatggaggtaacagtcggctaacacaccgccccgccccgcccctgttgtctgtcccttcattttctagcttagaagagtattcttgttccggtttcttcgttccgtcgagcgcggcattctgtgggtcgtgtggattttggcccgggggacgaggaggaggctggtcaaagatctgtggtcaaaaattgatggtggggttcatggaatgggtgcatgactggttgctgtgggacgccttcctggagtgcggagggatcatgaggccaccgattagatagcggctggggagcgagggaccacaggaggcggaggccgccgttagcaccccccaccaccccgcgccgcgagcaagcagccatgggggaagacctcgtcaccaccctgtccatggagaacggcggcggcggcggcggcggccaccacggcccctgcacgctcctctccatggacccgtccggccacctctccgcgccggacgaccgcgccgtcggcgtcatggtgcagaccctcatcggagggggcgtcggcgccggcgcccgcgcccacgccgtgtcgccctccggcgcgcctccgcccgacatcaaccagccgtggcagaccgacctctgcgacatgctggacgtcggcctcggcccgcaggtctacagcgccgaggccgtgctcagctgcgcccccaaggccgggagccggaaggccgccaagcgcggggacagcatctggggcgcctggttcttcttcaccttctatttcaagcccctgctgtccgacaagtgcaaggacaaggtcgtccgggacaacagcggcggggtctcgggcttcgacaagtccgacctccgccttgatatgttcctggtgcagcacgacatggagaacatgtacatgtgggtgttcaaggagcggccggagaatgctctggggaagatgcagctgaggagctacatgaacggccactcccggcccggggagccgcagttccccttcagcgtcgacagggggtttgtgcggtcgcaccggatgcagcgtaagcactaccgggggctgtcaaacccgcaatgtatccatgggattgaggtggtcaggtcaccaaatcttgtagggctcaccgaggcagaccttaggaggtgggcggacctgactgggagggagctcaatttcatcatcccacaggaagccagtgatttcgggacatggaggaccattccaaattcagagcttgagcttgagaagccacaccctgtcatgaagagcaacggcacccaaaacccaaagaaaacaggcttgaatctgtcgtcaccgtccaatcattcaggcgaagatggtatggatctctctccagttagcagcaagcgtaggaaggaattgtccccacaggccatggatgaggaagtattcttcccactgaattcttgccctcagaagacacaacaagatgtggagatgcactcaccaacgcagcctgctgcgtggctccatgagtttactggggtgatgagaaacgcctgtgggccagtgactgctgccaagtctatctatgaggatgaccagggctacttaataatggtcagcttgccgtttgttgatcagcagagggtgaaggtttcgtggaggaacactctgactcatggcattgtgaagatcgtttgtgttagtactgctaggatgcaacatataaggagacatggcaggatgttcgcgcttgccgatccttccccagagcattgccctcctggtgatttcattcgtgaaatacctctagctactcgtatccctgaagatgctaagctggaggcttgttttgatgaggctgcctcagtgctggagatcatggtcccaaaacgagggaatgaacctgaagaacatgaagttagggtctctctgcgaccccctcactacggagctaatgatctacttttgacctaagctatctctgcaccatgctacatcttctttgtaaccccagattaatgccaaatttagctgagaatcaaggtttcagtatgcttgttctctgcctaatgtttccagtacttgtgccatactatgtctcttcagcgacgaagacttgctgaagactagtttattctagcttctgtgttatgggtgtctttttaaccctcatgtttagattttgtactaagttcagttaaaagaaataatattctgagttgccactaaaaaaaaaaaaaaaaaagacaagggcgacggtcccctgtttcttatctctaacgtccaaatttacactgnattgcttgattcacttcaattatgaaggaaaaaaaatgggaccttagacataggcgttcctttgattaaacaagtagtagcggagaagggagattgtagtgctgagtgagcaagaacatacttctatgtatagattgcagaaaatgtatgaagctagccagtagccagctaatgctgagcctgcaactataaagtcaatgcttgtgcagatgtgtgtcctgtaatcagctgtaacgttttcaatgtggacatggcccttcgcaaatgatattgctcttgaagtatttctcaggtgcaacttttgtttgagatagctccaagtttcagctcaactgtagtttataatagcgatttaaatagttttaaaaatattttgaatttaaataataaacaaaatgacttagataaatattttatataggttttacaacttcaagcagcttttttctggtcacataatgacctgttctatcaactccattaaattttctagagctgtcgcaggtaaatgtgaaatgctggttataaaaaaaaaatctgaaacgtgattgtagccgtgttttaacaatctagg

SEQ ID NO: 654 - DNA, 2536 bp, Zea mays
catttggtgttatttggttgtggtgcgttattctgggctatttggcgcactagaaatgattggtgctttggaaaaaaatcatttacttgatccatctaacatcatttttctttgctgcttctggctggattcttgggctactcttcagaaaaagaaggagcaaagaatggtgatgctaggaagcaagctaatccgaaagacgacaagtgaagctttcggcagggccttggggtggtgccctttggacaggcgcatttctggttgatatggaagctggaacttggaagttgctgttgatgtttgtgtgtcttttgttggttagattgttcagatccttgtgtggttttgcctatatgtttgggttgtaaataagaaagtcttatgtagttcatcgtaggccaaaacttgttctgctatcttaggctcttcactgatctagcttgatagtgtttagagtttagataggttcatggccacgttcgatcttttgagatgatgtgccgcgtggtggcggttgtttcaaactttcctatttcttaatgaaataggggcttcgccccttcataaaaaaacttgaaattgacaatccaaaaacgcgcaaaatctataatagaaattggcattcctgtctgttcttaaaaaatatattaactcatcatgcatccagaactttgagcccgtaaacacgtttcggcactggtgatggataaaagaagtattaatttatcatgcatctagcacgtttgggtcgtgaacgaaaggtaaggtcaacgatttaaggtgatgagtcgtagacgagaggcgattgttgctgaagaagagcagaggcgtgacagtgaaaagttgtagaggttgaggtggtgtggtagtgtaacgaccggatcgaagtagagtttggctaactgtggaagatggtcgagcgagacgtataagcggcggtgctgtggacaacaatattatctacaacgtaaatcacatattttacacgatctactgtggttaacataaggttcttaaaatctttgagacagccctgatgctaactatggtaagatggacaaattatcgatattgttgcatttgctctaagcaaacttatagacacgctttaatctaatttccaataaaacgacctggcaagttctacgtaaaaacaggtcaaaaactctccgtgatcgtgaaataaattactgacgttgacgaagttactttaagaaaacttttagatatatatatttagatcatattttttcaatcgaataatatgacgagttatatttaggtgccgtttacattccaaaagttttgataattaaggaaaaaaaaacaataactttattagattttaagatgcaaaaaatctgtgttaaaatttctatgaaatatagtccctttaatctagggatgtacgtttttttagctaggttttcaaaatcgataacggcgtcttacatacagaaaaaggatcaaaaacctcaaataggcaacagtccaaaccctggtcaccaagtcaagcgaagcgaaaccatcccacgccgacgccatcacgcggcggcggtaatgggtctcgtcgtctccgccaccgcctcgtgcagcgacatcttcggccgacgccgctcctcgacgctgcctcccgcaactgctacccccacgtctagtaccccaccgctcacggatacaacaccggagccagagctcgtccgcgtcttccgccacttcgacgcggatggcgatggccgcatctcggtggccgagatgcgcgagtcctgcgggtgcacggccgcggaggcggaggagatggtcgctgccgcagaccgcgacggggacgggttcatcagcctcgacgagctcggggcgcttttcgaggacgaagacctgtcggacacgctgcgcgctgcgttcgccgagtacgacgagaacggcgacggcgtgatcaccgcggaggagctgctccgcgcgctgcggaggctgggtatcgtcggggaggagatgacggctgagcggtgcgcagagatcatcgcggcggtggaccgagatggcgacggggtcatctccttcgacgagttcaaggccatgatggccaccgagccggcggcgtgaaccatacgcgcccggcgccccatacgtcttcatcgagacgatctctgattgttcggaagttcggggttggtttgtgaagccttgttgttcggaaaagtagtttgagtttgctgtgagagcagtaaacgtgctgaaaatttggaggtatgcattgccctcagattttcgaggtaaactgaaaatttaacgtttgagccagaaaaaaaaaaaaaagttattttgatccttggaactatagaaacttgaattacctatacaatttcaatttggatggccccccagaaatccggtaccgatattttcctcccaaatccagttccgatatcgcttgggctgcttgccttagtttgacacgtttgctccttgctctcctcaatgatcactcggtgattgcaacagaaacatataatatcacaataacttatgtacaaatgtg

SEQ ID NO: 655 - DNA, 1519 bp, Zea mays
gcatccgcctctggtttttcagagcagcagtccaggcgcggaattgaattccggtaggatttgagagcggagcggagcggagaggagaggagaagaaggcggtaggcggggaagatggagatgccggcagggagcggggccccagcgctggcgcggcagggctcggtctactcgctcacgttcgacgagttccagaccacgctcggcggcgccagcaaggacttcggctccatgaacatggacgagctgctgcgcaacatctggacagccgaggagtctaacgccatggctgcggccgccccggccacggccacggccacggcggccgcatccgtggacgcgcacgcgcagcagcagcagcagcagcagcacggggcgcccatccagcgccagggctccttcacgctgccccgcacactcagccagaagacggtcgacgaggtctggcgcgagatcgtgagcctcaccagcggcgaggacgcgcagcaggttgcggctcccgctcccgctcccgcgcccgagcccgagcccgcgcccgcgcccgcgccgctgccggcgcaggcgcaggcgcagcagacgctggggtccatgactctggaggagttcctggtacgcgccggcgtggttcgtgaggacatgggggggcaccagaccctcctgctgcagccgcacgcgcaggggcttttctcccaggggaatgcggtcgcgccgcagaccctgcagctgggaaacgggatggtggccggggtcgtcgggcagggcctcggaggaggggtgacggtggcggctccgacgacgccggtcgtgttcaacgggttgggaaaggtggaggcgggtgatctgtcgtcgctgtcgccggtgccgtatccgttcgacactgcgctgaggatgcggaagggacccaccgtcgagaaggtggtggagaggaggcagcgccgcatgatcaagaacagggagtcggccgccaggtcgcgtgcgaggaagcaggcgtacataatggagctggaagctgaggtggcaaaactcaaggaccagaatgaggagttgcagaaaaagcaggttgaaatgctaaagaagcaaaaggatgaggtcctggagcgaatcaacagccaacatggaccaaaggcaaagaagctttgcctgcgccgcaccctgactggcccatggtagcctgctgaagcttgcacaaaattgaccgaagtcaagatcgtcgggccagatgtgcccgtgtgtatatatcagatgaagtcaagagtactgagtaccccgttacccctgtagaccgccgctacttcagagctgccgttcttgttctgtgacgtgggtagtctgcgcctgacagttcgctgtttaggttcggttgcgcgatcctcacatgaacaatgaggcgtgccatctaatttgtttattaactcactcctatctatggtgagattaatgcaagtaacctggagtatgtttggttgaaaaaaaaaaaaaaaaaaaaaaaaaaaaaaaaaataaaaaaaaaaaaaaaaaa

SEQ ID NO: 656 - DNA, 1738 bp, Zea mays
ggaggagtgcagtagtgtggattacggtggtgtaaaagaggagttatttttgtttgatctgctcgaccatttatagttgaactaccttcttcccaaaaaggtaaataagacgaaacataaacacacatacatagcagaaaagaatctcaattgagaaaactaataaaaactatacttttagtaaagaacttacatgcttttttctttcttttctgctagctaaggcaccgtcatcctttacttgagatgtcgacattgaaataactagaaggcagctactaagggtgtttttgtaagatttgtaagaggtgtatagtatcatcagttcggtagaactgagcagtgtgagcgacctagtcatgttcaatacagattcagattgtatagcctgctacaaatagtagattcatgatcaatatcttataatttaaaaaggaaagtaacataacaataagcacacagtactaaacatatttatgttgagctcaagtttcattatttgcataccacataaatatgttagaaggatacaagagcatgtagtgtttggaaaaattgccatgcacgaagtatggaatgtgtttattaattgtaaaatagtctacacataattgtcggcaaatcactgtgtatgtagatatataaatgtacatgtaggtttaattggtgcaagaactgatgtgcatattcacaggaaagaagcacaatcacaattaccatatatttagttttttgctcgtctcgtagagaaataacataaggcaacgcttattgaaataaatttttggtaaatgcgttcgggctcacaaaaaagtgacaataaaactacgatcctaaacctgaacatgaacaacagcgaacaaatacaacagcacaatccacaaatcctcaaatatgcgctcgaatcagacaccttcctgcaacaattgaagaaacgaagctaatacaaatcctggacagggagatgagagtatgaacctagtagtcatgtatctgaagtagctgcaatccccagataaggatccgggagcgaagcgacaatgttcacgcgcgaccacgcaagggagctgcatggtacggaggtcagccaggagccaacatgcaatgtggccattggggaagggtagcgaggtgggaccacatcgcatcttagaactctcgcttgacgccagggaaggacctggtcacattgacgaaagggttccatagctgcaggtggaggtgcttgccgctacagcgcttgatatcgagctcttcgggtgcgacgcgagaccagatcccatctcagaactccggcttgacgccacggaagggcactctgacgaaggggttcattaattgtgggtcgaggtgctcgccgcagcggcgcttgatgtcgagccccgcgtggtaccaatctgtcgaggcaaagaactccaggagaccctgcagcagccggcaaggtagagcgcggagatagacctgtagaggtccccgtggaggtcttcgatggcgaggagattggaggaaggtggtcagattgtagggggaggagggcgatggggaaggatggggggcagggaagggaaggagatgcttgacatggcaaagtctaggaaagcgtccccggttcattttcattctggaaaccttctgtggtctcatggagtggcgaaacgcggaccagctcctgaccttaggtacacgatctaacgactgagacattaagcgctgccgtggatagtctcattatgtcgaa

SEQ ID NO: 657 - DNA, 2313 bp, Zea mays
gtggacggcgtgcctgcttcccgactgaccggtttgttcgtttcgtctcgtgtgtgcctaccgggttaaaataaataataaataataatggtgacgatagtgggcgccctttatttgttacgtatcatcgatggagcagagagctatcagtggtccgggcccacgcggggttcacgctaattcactttcaccggccagggcgtgactgcgtgcggtcaatttcatcacagcaatttcagcaaagcctctccgagcgtcgtgtgacggtgacgtgacacggccgaccacgtctctaatccccatactagctaacggaacatctcctttgggaaactgtatccaggacggccaacggtcctcgctctactccagtcctgaactgccaccgcctccggcttctatttaagaaggcgccccccgccaccccgcccggcagcagctgacccgagccgcagatggtctctcccggccgctactagaggcttagcgttgagagccacatgttgagtgaacagacggcggctagcactagcagcggcgagcatcaggagaggagcgtcgtcgaggacaggcggctacagccggtgggggagaacgaggaggcggagttcagggacatccacgcgctgagcccgccgccgagccagccttcgtcgtaccgccggagcaggcacgcgtccgtcgggagcgacaccgcgtccagcgagcccttcccgaccatgagcagggagttctcggccatggtcgccgccgcagcagccatcgccaacggtgccgccgccgacaggctcggggaggccgaggacgaggagaccaacccgctggccatcgtgccggacagcaaccccatcccgtcgccgcgccgggcccggggcccgcccaccccaggcgccggcgccgcccacgccaacggcgacggtggggtgtccgtggggcaggtcaggaaggaggaggtggagtccaagatcgccgcgtggcagatcgccgaggtggccaaggtcaacaaccggttcaagcgcgaggaggtcgtcatcaacggctgggagggcgaccaggtggagaaggccggcgcctggctcaacaagtacgaggtagtcagtccatcgcatcgatctacacctccacactcactgactagcgtcgtccgaactgtccagtgcttgctgactgataccaacgcatgtaatgtgcagaggaagctcgaggagaagcgcgccaaggcgatggagaaggcgcagaacgaggtggccagggcgcggcacaaggcggaggcgaagcgcgcgtcggcggaggccaagcggggcaccaaggtcgcgcgggtgctggagctcgccaacttcatgagggccgtggggagggcgccctccgccaagcgctccttcttctgaaccctcccccaccgcccaccgggcctctcctccttcaccagttcctctgccctgctctgctcgtcgtcgccgcccgccgcctgtgcagttcagttgcatcgttcaccgcttcactccacgggatcagacagagtgatcagtgccgtgcttagctgtgtggaacgcttgttttagtgctgtgtccacatgtatgatttgtaaccttttcttctccctcctgtttatgtcagtacacgaaggatgtgctctgccggagtgttgagggcaagagctgcctgtattttgttgatatttcgtcatcaacagctgtgtatgtcagtacgaacaagataatggaagtccattaccactgtgtaaaaaaaaaaaaaaaaaaaaaaatgctgcatgcaccgacgagcttcactacttggaacttcagttttgctgttgagctagaaccacagtcgtgaggacaggtcaaagctgtttctgactattcgaacgtcgtcacctatcacctcagtgactcagtcgtgaggaatagtactactcatcatcaacatacagtatcctatccgaaagtgccctctgcaaaaaggaggcgggtgatagggctaggtcttcgtgtcgctgtattaataaattccgatccatacttccaataagcatgataatagtctaacaaaaaggtagtgctccatctgtttctagttatacattattatgggtacgtttgggacaactccagctctagtaaatttagtggagttagtggagcaattcattatgtgctccagaaaatcgtagagatagaggtgtaagcctttaaagatatttagataaatcaatttgtttattattagattaaaaatatttttgaaactatttaaattgatattacaaaatacagctccacaaatctagagtcatcttaaacacccctata

SEQ ID NO: 658 - DNA, 1429 bp, Zea mays
  misc_feature (1398)..(1398): n is a, c, g, or t
tgcacgcgggggtaaggctcggaattcggctcgagcggttcgagcgagccttttttggcctccgagccgcagatggtctcacccggccgcagaggcttagcgttgagagccacatgttgagtgaacagacggcggctagcactagcagcggcgagcatcaggagaggagcgtcgtcgaggacaggcggctacagccggtgggggagaacgaggaggcgggggaggaggaggaggagttcagggacatccacgcgctgagcccgccgctgagccagccttcgtcgtaccgccggagcatggcacacgcgtccgtcgggagcgacaccgcgcccagcgagcccttcccgaccatgagcagggagttctcggccatggtcgccgccgcagcagccatcgccaacggtgccgccgccgacagggtcggggaggccgaggacgaggagaccaacccgctggccatcgtgccggacagcaaccccatcccgtcgccgcgccgggcccggggcccgcccaccccaggcgctggcgccgcccacggcaacggcgacggtggggtgtccgtggggcaggtcaggaaggaggaggtggagtccaagatcgccgcgtggcagatcgccgaggtggccaaggtcaacaaccgcttcaagcgcgaggaggtcgtcatcaacggctgggagggcgaccaggtggagaaggccggcgcctggctcaacaagtacgagaggaagctcgaggagaagcgcgccaaggcgatggagaaggcgcagaacgaggtggccagggcgcggcacaaggcggaggcgaagcgcgcgtcggcggaggccaagcggggcaccaaggtcgcgcgggtgctggagctcgccaacttcatgagggccgtggggagggcgccctccgccaagcgctccttcttctgaaccctcccccaccgcccaccgggcctctcccccttcaccaattcctctgccctgcctgctctgctcgtcgccgcccgccgcctgtgcagttcagttgcatcgttcaccgcttcactccacgggatcagacagagtgatcagtgccgtgcttagctgtgtggaacgcttgttttagtgctgtgtccacatgtatgatttgtaaccttttcttctccctcctgtctatgtcattgtcactacgaaggatgtgctctgcccgagtcttgagggcaagagctgcctgtattttgttgatatttcgtcatcaacagctgtgtatgtcagtacgaacaagataatggaagtccattaccactgtgtaaaaaacaaaaaaaaaaaaaaaactgctgcatgcaccgacgagcttcactacttggaacttcagttttgctgttgagctagaaaaaaaaaaaaaaaaaaaaaaaaaaagtgttttctgctntagaggtccaccgacttacgtacgcgtgcat

SEQ ID NO: 659 - DNA, 1223 bp, Zea mays
cccactcgtccgcggccgctgggccgagccgcagatggtctcacccggccgctactagaggcttagcgttgagagccacatgttgagtgaacagacggcggctagcactagcagcggcgagcatcaggagaggagcgtcgtcgaggacaggcggctgcagccggtgggggagaacgaggaggagttcagggacatccacgcgctgagcccgccgccgagccagccttcgtcgtaccgccggagccggcacgcgtccgtcgggagcgacaccgcgcccagcgagcccttcccgaccatgagcagggagttctcggccatggtcgccgccgcagcagccatcgccaacggtgccgccgccgacagggtcggggaggccgaggacgaggagaccaacccgctggccatcgtgccggacagcaaccccatcccgtcgccgcgccgggcccggggcccgcccaccccaggcgccggcgccgcccacgccaacggcgacggtggggtgtccgtggggcaggtcaggaaggaggaggtggagtccaagatcgccgcgtggcagatcgccgaggtggccaaggtcaacaaccgcttcaagcgcgaggaggtcgtcatcaacgggtgggagggcgaccaggtggagaagtccggcgcctggctcaacaagtacgagaggaagctcgaggagaagcgtgccaaggcgatggagaaggcgcagaacgaggtggccaaggcgcggcggaaggcggaggagaggcgcgcgtccgcggaggccaagcggggcaccaaggtggcgcgagtgctggagctcgccaacttcatgagggccgtggggagggcgccctccaccaagcgctccttcttctgaacccacggatcagttcagttcagttgtcctgtgggtcggaccgttcaccgcttcactccacgggatcaggcacagtgatcagtgccgtgctagctgtgtggaacgcttgttttagtgttgtatccacatgtacgatttgtaacgtttccttgcttctcccgtttcgtgttttcgtatggtatctatggtattgcaaagtccatggccacgatagacagggaaagcatatgtatacaccattagaaggatgtgctctgcgcctctgcccgagtcttgaggacaggagctgcatgtatttttcaccaatataatggttgtgtatgtcaattacgaaaagatatgaacaccattaccaccgcgt

SEQ ID NO: 660 - DNA, 1593 bp, Zea mays
aacaccaatctgttcctctgttggttcgccgccctacgctggtgtggtgggcgctggccaggcaccgcctccggcctccagcttctatttaagaaggcgccccccgccaccatcctacccaccacccaccacacaccaccaccaccgcacacccggcggcgccaagcccttcgaccaggtagctgaccagcatcagctgagccgagcggcagatggtttcgcggccgctagaggcttagcgtcgaggaagaggaggaagcggcgtgccacatgttgagtgagcagacggcggctagcactagcactagcggcggcggcgtcgagcgtcaggacaggtggctgcagccggtggcggagaacgaggaggaggaggaggaacaggaggagttcagggacatccacgcgctgagcccgccgccgagccagccgtcgtcgtaccgccgggcgcgcggcggcgagccgtgggggtccgccgcgggcgggagcaggcacacgtccgtccgctccgtcgggagcgacaccgcgcccagcgagcccttcccgactatgaccagggagttctcggccatggtcgccgcagcagccagcgccgcagcagccagccgtgacgcggacagcgacgtcgtgggcagggccgaggaggaggaggaggaggagctggaggagaccaacccgctggccatcgtgccggacagcaaccccatcccgtcgccgcgccggggcccgccgcccgccgccccgggcgccgacgcggcggcgctggtggccgccgacgggcacggaagccgcgaaggcgggggggtgtccgtggggcaggtcaggaaggaggaggtggagtccaagatcgccgcgtggcaggtcgccgaggtggccaaggtcaacaaccgcttcaagcgcgaggaggtcgtcatcaacggctgggagggcgaccaggtcgagaaggccagcgcgtggctcaagaagtacgagaggaagcttgaggagaagcgtgccaaggcgatggagaaggcgcagaacgaggtggccaaggcgcggcggaaggcggaggagaagcgcgcgtccgcggaggccaagcggggcaccaaggtggcgcgagtgctggagctcgccaacttcatgagggccgtggggagggcgccctccaccaagcgctccttcttctgaacccaccggcctcttcttcaccagttcctctgtcttgccgccgccgcctgtgcagttcagttcagttcagttgtcctgtgggtcggaccgttcaccgcttcactccacgggatcaggcacagtgatcagtgccgtgctagctgtgtggaacgcttgttttagtgttgtatccacatgtacgatttgtaacgtttccttgcttctcccgtttcgtgttttcgtatggtatctatggtattgcaaagtccatggccacgatagacagggaaagcatatgtatacaccattagaaggatgtgctctgcgcctctgcccgagtcttgaggacaggagctgcatgtatttttcaccaatataatggttgtgtatgtcaattacgaaaaaatatgaacaccattaccaccgcgtaaaaaaaaaaaaaaaaaactc

SEQ ID NO: 661 - DNA, 700 bp, Zea mays
attggggtggggggcgaccaggtcgagaaggccagcgcgtggctcaagaagtacgagaggaagcttgaggagaagcgtgccaaggcgatggagaaggcgcagaacgaggtggccaaggcgcggcggaaggcggaggagaagcgcgcgtccgcggaggccaagcggggcaccaaggtggcgcgagtgctggagctcgccaacttcatgagggccgtggggagggcgccctccaccaagcgctccttcttctgaacccaccgcccaccggcctcttcttcaccaccagttcctctgtcttgccgccgccgccgcctgtgcagttcagttcagttcagttcagttgtcctgtgggtcggaccgttcaccgcttcactccacgggatcaggcacagtgatcagtgccgtgctagctgtgtggaacgcttgttttagtgttgtatccacatgtacgatctgtaacgttttcttgcttctcccgtttcgtgttttcgtatggtatctatggtattgcaaagtccatggccacgatagacagggaaagtatatgtatacaccattagaaaggatgtgtgctctgcccgagtcttgaggacaggagctgcatgtatttttcaccaatataatggttgtgtatgtcaaatacgaaaagatatgaacaccattacccccgccccaccgcgtaaactggaccgcttgcact

SEQ ID NO: 662 - DNA, 3141 bp, Zea mays
  misc_feature (1887)..(1887): n is a, c, g, or t
ccctggggatcggcaaaaggaaacgcgtgaatcgatggccatgtaaagcggcggttccccgtgcccaatgcctcaggttcctattccatctcgaattcggagtcttctctcgtccctgtccccctccagcaccgccgccgccgccaccgcgccgcaacctcgccatggcacgccctccgtcggcggccctcaagccgccgtatccggccttccaatcccatcccagcgatctcgagctcgtcaacttctatctccgtccctgggtcgagaccggcgtcaagaccggcgcgttcatccacgacgcagacgtgtacgccgctgaccccaactacctcacccgtcagttcgcgccggcggtggcccaggacggcgagcgggcgtggtacttctacaccccgctgcgccacaagagcgtccacgggacgcggaagacgcgcaccgtggccaccggcggcgggtgctggcacaacgaggcgaaagctaggcccgtgtacatggtctccaacgggatgcaccagattgcgcatcgccagagcttctccttcgtcgagaaggatggcggcgtgcgggtccgcacgggttggctcatgatggagctccgcctcgtcgaggacggcgccgccgggcagaaaccggaggaggacggcgccctcgggagtcgcgtcctgtgcaaggtgtaccgcagcccgcgcaaccccgagccaagcggcatcgaagccgcgacggcgcccgggcagaaggcggaggcagacgacgatgaatcttgcgacgacgaatctagcgacgcgacgttggacgacgatgacagctccaacgcgtcactagcggcggcatcgggacccaagagggaatccgacgaggtggaatccagcgacgcgacggtggcggcacctagtcgccatagcgcgccgaacgacgagatctccggccggtccgcggtggcgcccggacgcaaggaaaagacggagatcggggaggtctccaccgagacgtccgcggcggtgcgcaagaggagaaaggccgacggcagcagctcccctggcactccggtttctacgacggatatgcactgccctcggtgcggcacccatctcatgctaacactgaacatggcggagtccaaatcggaggcggggctcgcgaaggacgagtcggccaccgccgcgcctgatcaaggcgggacgggtgagtcttcacagaagaatgttcgggttcggttccatcagttcctgtgagatccagggttccttcctgcccagacaaatcctgggaaacagagccatagtttcttgtctgttatttggaagaacgaaataagaagattttagattaagaattcgttagaagtaaccgtgtctattgctgcaacggtgatgtaatcgtgaaaccaagacataaggcgtacgaatttacacaggcatgcaaatacagggatggatatgaaactacatttttgaaactatatttttaaagtaaccctctaacatggtatatatactcgtaagactttcttgacataattaaataaccctctcacatggtatactcgtaaggctgactccagcaatttctcctcttaaatctcctatttatactttttattcagatttaaatatctcgtcctcaatcattctcacccctatttctctactccctctatcattctctctattcagctcatcatctatcttttaattaaactatttgactttcatatatcagtttttgaaagtttaaaaatactataaatatttgtacagtaataaatattatgttaattaaatctaaaaataatctattgtgtaattattatcgttgattagtgaagagtgggaagattagagctcctcctctaagggctactttgggagcctcaaatccccttcnggatcggaggggattgagatggaaatgaactaattttctctccaatcctttccaatctcgaaggagatttgagtttctaaactagccctcaagggaaaatatttctctcaccccacgaagaaggctctcgaggggggcggttggaggcaggaggtgtctcctgccttgaatcttgtaggactgatttgatggtcaagaatcccgagaggatccataggggaggaatccccttacaattcaaatttgaaaaacaaggagattcctctcccatggatcctcaccaaatctagggggagccatgaggggagcgtttggaggtggtcgaaggcctctttggaacaaaggagaggtggacaaattttagaggattaaaattttatagaaaaatatcctaatgaccctttgaaacaaaggattaagtttctacaaatcttataaaattcctataaaatagtccattgtagtgagattttggagaatttctaacattaggtccaatctcttggaggtttttctttgtgtatacctatctcttctattcatatgttattcctacattgcatccaaatgctttcatgtgtttttatttatatagcattgcaagtgtcgtataactctatttctacgttttttttctattcttatattttgtcaatcctgcgttctcaagggacctagttgtggtagtttctcgagggtcgtacctacccaattgtgtttcttgaggtcagtagtagtagtaattgtacgatggtatgatggcttactttaggaagtattttctggagtaaatatcatcaagtagatatccgtataaaaagataagatggccttccaataacattctctaaagatctttaactaaaagattacccatgtttggatgcaataacaattgagctacacataaaaggatacatataagaagacaaggtgatctcacttgccaataacattctctaaagaatgtgttcaactaaaaaagaatagacagtcttcaaagtattaatcgagagagagagagagctccacgaacatcatattcgcatcaacatttgatttaatgaaaattcatagacaagtatatattgcaacaagcaaataaccctctatatggctctctggagggaaaacaatatggcataagaaggataatattgcttgaatttttcgactccaaataagatgaagaaaattattgaagttcgtcaccgttgaaacgacaaaaaaaaaacttttacctatgttgatttt

SEQ ID NO: 663 - DNA, 1496 bp, Zea mays
  misc_feature (1)..(1): n is a, c, g, or t
  misc_feature (6)..(7): n is a, c, g, or t
  misc_feature (16)..(16): n is a, c, g, or t
naggcnncggccgggnaaaaaaaaaaaaaaaagtggtttcaagcccatcatctcatgcgattgaaccagttgcgccgaaatttgctcatgctgatccaggctaaacggtccagtcaggtgagctcagcggctcagcccatgtaggcagtcagcctctcaggttgggagttgggacaccagatttaaagctccgtaagcatatgctgctgattcgccggtgatcccctccctccttcgccgtcgccgtcgccgtcgccgtcgcaccagcttggccgccgcctctggatcgccgctggactcgcttccctgacccagaagctacgatgaattacatcatcggcgcattcaagccgccctgcgacatcttcgtcacattcgccgatgagagaacccggaagcaggtccagatcaagaaggacaacgggaagactgtcatggtgccgaccttccagacccttgagaccatagccggagaggtgtcgatcgctccagtcccaggtaaaaggcttgaacacacgggtgtgaagattgaactgctgggtcagatagagctgtattttgacagaggcaacttctacgacttcacttcaatagtgcgtgaattagatgtccctggtgaaatatatgaaagaaagacttatccatttgagttttctactgttgaaatgccatatgagtcatataatgggacaaatgtcagattgaggtacatactgaaagtaacaattggcagaaattatgttggcagcattgtggaatcgcgggacttctgtgtaagaaactactctctagttcccacaatcaacaatagcatcaagatggaagttggcattgaagattgcttgcatattgaatttgagtacagcaaaagcaagtatcatctcaaagatgtcatcataggaaagatatattttcttctggtcagaataaagataaagaacatggagcttgagattcgtcggcgtgaatctacagggtctggtcctaacacatacgttgagactgagacactagcgaaatttgagcttatggatggcgccccagttagaggagaatcgattccggtgagactattcttgacgccgtatgagcttaccccaactcatcgcaacataaacaacaagtttagtgtcaagtactacctaaacctagtcattgttgatgaggaagaccggaggtatttcaagcaacatgagatcacaatgtatcgccttctagaaaccccacaatcttcataggctcctttccttgctttctatgagttggaaccagagctagaggcattttggtttaaccttgcacgaggacgccaaagttggtggccttacttttggtcccgccttgtacataactctcccgatggagcaatgcagttcttatgtaagagacataaaaatgcagttctaccatatggtgttgctttgttactgcctttgtttgaatctactcgggataaagtcatggaaatgtttgttccaaaaaaaaaaaaaaaaaaa

SEQ ID NO: 664 - DNA, 2079 bp, Zea mays
  misc_feature (8)..(8): n is a, c, g, or t
gcgcgcanttaaccctcactaaagggaacaaaagctggagctccaccgcggtggcggccgctctagaactagtggatcccccgggctgcaggaattcgcacgagaccattacctacatcggcctcctcgaggcatcgaaaaacgacgacgatatttcgcatcacacttccgtctggccaccgcaaagcaccccctctccccccgtcgccatggcgagcgataaccgcgcgtcgctcttccccttcgccgccgccgtccttgtggtgctcctcgctggcggcgccgcggcggacgacgcctccagcgacgacgacgctgggacttcacggacacccggctgctccaacaagttccagctggtcaaggtgaagaattgggtgaatgggactgaaggtacaacttttgttggcctaagtgcaaaatttggagctcccttgccaagagatattcatgaagcaaaaaagtcatttgctgtcctctcaaatccaattgactgttgctccaacttgacatcaaagttaacaagttcagttgctatagcaacacgtggggaatgtgctttcacggaaaaagcaaatattgctcaggccagtggttcgaccggtttactagttatcaatgataatgaagagctttacaagatggtttgcggtgagaatgacacctccattaatgtgacaatacctgttgtcatgataccacagtcagcaggaaagaagctgaagaacttattgcatcatggagcaagtgtggaagtgcagctatattcaccaaatcgaccaactgtggacctttcagcatgcttcttatggataatggctgtaggcaccatagtctgtgcttcactctggactgaatttgttacatgtgaacaggttgatgagcgttataatcagctgaccagaaaggatggacctgacacgggaacaaaatacagagaagataaagaggtcttcgagatcagcgcgaagggtgcttttatttttattatagtagcttcagttttcctcctcctcctgttctacttcatgtcatcttggttcgtttgggtgctaattgtactattctgcattggtggtattgagggtatgcatgcttgcttggtcacgcttctagctaggatttttaaggactgtggacaaaagactgtacaactccctgttttgggggaggtcttgatcttatctgttggaattgtaccattttgtgcggtgtttgcaattctctgggctgtgtatcgccatgcttcatttgcttggataggccaagacgttctgggtatctgtttgatgataactgtgcttcagatggcacgtttaccaaatatcaaggttgcatcggcacttcttagtgctgcatttgtgtatgacatcttttgggtgttcatttcacctcttatattccatgaaagcgtcatgattgcagttgctcgtggtgataacactggggaatcaattcctatgctcctaaggataccccgcttctttgatccatggggtggttatgatatgataggctttggtgacattatcttccctggattgcttgttggattcagctatagatttgacagagcaaacagaaagggtgtcttgagtggatattttctctggctaattgtgggatatgcagttggccttttcattacgtatcttgcgctgttcttgatggacgggcatggtcaacctgcgttgttgtaccttgtgccatgtacattgggggttattgttattcttggttggttaagaggtgagctttatgaattatggaacttcggaaaaagtccaggagaaaattttgtcaatgaaccatgacaacaaaatccagggaagatgtattcttcagcgtagtagatagcttgaggatgtttattaggaggcaccgtgtattgcaagatgttatgtttagcattatttcaaagaaggatgctattgtgtttgaaaaaaaatgatatacatgtaagatgcaagcatgtactcccacagtcgtaaaataacccaatataagtgccgctatatagttccaaaaaaaaaaaaaaaaaggggccccgggggccggggggggggggggggggcggcc

SEQ ID NO: 665 - DNA, 959 bp, Zea mays
aggccagggcacttgcaaaggatttatcctcccaaagagcaacgagagatagggattttgcttttgcatggttcattggtttgcggcgtcaaagagctcgttaaatatggacgtcctggatcactcggacgatgaggaggagcagcaggaccggtgcggcaccagcagcggcagatcaggctccaggctcggcgcgcgggcgcggcggcagaagcggaggtcaggcggcagccgccagaacctgctgctcatggactgcgtcggcggcaacggcggcgacggggacggcgcgttggaggacaccgcgccgctgccagactacgagctcttgtcccagtccgcccgcctccacgacgacgccaagaatccgcctccggcgctgctggttgcagaggaggaggagcagcagaaggcgccggccaagcaggggaaggcgtccccgccacagcctccgcccgtgccactgccacagcggcagcagaagccggcgtggaggctgatcgagtacgtgaggtcaaggaacaggtcgggcggcgcagggccgggggtcggtgggtgcggcgcctggtctgacggcgactccaagagctccgaggacggcgaggacgggggcggcgaagggaagaaagataagaagaagaagcggtcgtcctggctgccggaccccgaccgccggtggccggtgcagggattctactagcgcgttcatcgtcttcgcagtctagtaaaaccgtgttagtcatgatgcgcctctgactcatgcgttggtttggttgctccgggccctgtttggaagtgaagtttttttcatagtttttgagaaatactatagtatccgttaatattagagtattctggactattaatagattattagaaaatagagtttctaatatcatggtttttttaagtatttgatacatagttctggacctaagtttttaaaaaaaaaaaaaaaa

SEQ ID NO: 666 - DNA, 2791 bp, Zea mays
  misc_feature (932)..(932): n is a, c, g, or t
tggagtcttcggcgaagacaaaggcttccactccgtaactcatccttcgccgtcgctccgagcaactctccgtctttggtataatcttcactcatgttttatttgccaaaggggagaaagtagttagaaaagggcttatatctcactcaaagtatccgtttttggcgattcatgccaaagggggagaaagtattagcccaaagcaaaaggaccgcaccaccacccttattttaaaaggagttttcaaattggtatcttattgtattcaaaaagggggagaaagtagtattttcaaaattaatatctcaaaaccctcttgaatactaagaggagaatttattgagggggagtttttgtctagtcaaaggaaaagcatttgaaacagggggacaaaatttcaaatcttgaaaatgcttcgcaaaatcttattcatttacctttgactatttgcaaaaggactttgaaaggaatttacaaaagaatttgcaaaaacaaaatatgtggtgcaagcgtggtccaaaatattaaagaaagaaacaatccatgcatatcctatgaatatttatattggctcaattctaagtaaccttttgcacttacaattatgcaaactagttcaattatgcacttctatacttgctttggtttgtgtgggcatcaatcaccaaaaagggggagattgaaagggaatcaggcttacacctatttcctaaattgattttggtggttgagttgcccaacacaaataattggactaactagtttgctctagatctatgagttctacaggtgccaaaggttcacaccaaaccaataaaaagaccgaaacaggattcaaatatagagagcaaaagtcagctgaagtgtgccctagtctggcgcaccggacagtgtccggtgcaccagggactccaactttgaactgctcaccntcgggaattctggagaccgctccgctataattcaccggactgtccggtgtgccagcagagcaacgactacttcgcgccaatggtcgtctgcagaacgcattgaatgcgctacagtgtgcgccagagtcagagcagagactgatggcgcaccggacagcgaacagtgcctatccggtgcaccactggactgtccggtgccccagaagacagaagctccaacggtcggaatccaatggccaggtgacgtggcaggcgcacctgacagtgtccggtggcgcaacggactgtccagtgtgccatgcgatagcagcctccaccaaacggctagtttggtggttggggctataaatacccccaaccacccaccattcattgcatccaagttttctgacttcccacaccttacaagagctatagcattcaatacaagacacaccaaagagatcaaatcctctcccaagtccttagttcattccaaatcaaatagtgactagtgagagagtgacttgtgttcatttgagctcttgcgcttggattgcttctttttctcattctttcttgtgatcaactcaattgtaaccgaggcaagagacaccaattgtgtggtggtccttgcggggactttgtgtcccgtttgattgagaagagaagctcactcggtctaagtgaccgtttgagagagggaaagggttgaaagagacccggtctttgtgaccacctcaacggggagtaggtttgcaagaaccgaacctcggtaaaacaaatccttgtgtctcactctttatttgcttgcgatttgtttttcaccctctctctcggactcgtttcatatttctaacgctaacccggcttgtagttgtgcttaagtttataaatttcagattcgccctattcaccccccctctaggcgactttcaattggtatcagagcccggtgcttcattagagcttaaccgctcgaagtgatgtcgggagatcacgccaagaagatggtgatcggcggtgagaagtccgctacaagccacgggaaggctccatcaagggagtccgccaacaacaagaaggatggatccccttcacgcattcgatcgcacaagagtggcgagaagaagaagaaaatgaagaaagtggtctactacgagaccgattcttcctcgccctctacatccagatccgacgccgcgttcgtcacttctaagcgccaagagcgcaagaagtatagtaagatccccctacgctatcctcgcattcataagcatactccattactttccgtcccattaggcaaaccaccggcatttgacggtgaggattattctaggtggagtgatatgatgagatatcacctaacctcactccacaaaagcatatgggatgttgttgagtttggtgtacaggtaccatccgtaggggatgacgattatgatgaggacgaggtggcccaaatcatgcacttcaactcccaagccaccactatactcctcacctctctaagtcgagaggagtataacaaggtgcaaggattgaagagtgccaaagagatttgggacatactcaagacagcgcacaaaggagacgaggtgaccaagatcaccaagcaggagacgatcgagggggagctcggtcgcttccggcttagccaaggggaagagccacaagatatgtacaactggctcaagaccttggtgaaccaagtgcgcaacctcgggagcaaaaaatgggatgaccatgaaatggtcaaggttattcttagatcactcgtttttcttaaccctacgcaagtacaattaatacgtggtgatcctagatatacactaatgtctcccgaggaagtaataggaaaatttgtgagcttgaat

SEQ ID NO: 667 - DNA, 1553 bp, Zea mays
ccggccgggcccggggaaaactaaaccaacacaacatagtgtacgagaactgagagccttgggtctgactcctgatcttctagcacgccggtcagcacagccaccgttgctgtcggttaaagagaagctttcacaattttgccatgtcccggtcgagaacatacttaacatccatgatgttccaaatttatggcatgtcccacttattcttagaaaccaaaaggctcatgaagctataatcaaacaactaaaccttgctagatctgctggaccacctgaattacgagattggacagatatggctgagtcgtatgacaacctcaataactctgttaaagttgctttggttgggaagtatactaatctgacagattcttacctatcagtggtgaaggctctcctacatgccagtgttgcctgttcgttaaagccatctatccagtggattgcagcttcggatcttgaagatgcaactgcaatatctgcaccagatgcccatgctgaagcctgggaaactcttaaaggttcatcatgcattttgatacctggaggatttggggatcgtggaatttcagggatgatattggctgcaaaatatgctcgtgagaatagagttccatatcttggtatttgcttgggcatgcagatatcagtgattgagatttccagacatgtcctgggcctggaagatgcagacagtgaggagtttaacaaggatacaccgaatcatgttgttatgtacatgcctgaggtttcaaaaacacatatgggaaacacgatgaggttgggctgcaggagaacattcttcagcaaacctgattgtcttacatcaaaattgtacggaagtcctccacatgtagatgagcgtcatcgtcatagatacgaggtcaatccctcttttgttcccatgcttgaaagtgctggtcttcattttgttggttgtgacgaaagtcgaaaccggatggagattgtggagctacaagatcatcccttctatgtaggtgttcagttccacccggagttcaaatcaaggcctcgaagaccttcacctccttttacaggtctaataatggcggccactaaacaactgggagcaatttcgaatagctcgaatggctacgttggagcttctgactaatatggggatctccctctgggtgagaagcatgtcgcccgttgctgcagacacccaagttatttcttgtgcacattagatgtacaggaaaacaatctaagcctgaagcagagtgtctctctctcgaccacctgagtggcgtaagctaacggtcttacagtgtattggggtcgaacgtcatggttttgttgactgtcatttcaattgagcttaacagcagtcagtgctcccatccttgtgattccaattgagattaacagtagtaagtgattatgatctctcttgccgcttgagtggaagtgaaagacactaccatccagtttttggttgttatttgttctgattttttgtgtttgttttctatacaaatgtgaaaaaaacatagaaaaaaaaaaaaataaaaaaaaaaaaaaaaaag

SEQ ID NO: 668 - DNA, 1753 bp, Zea mays
cattgggtacctccggccgggagtttgccttcttcccaacccaacagaagcggctcactagtcccccccccttcccaatcgggctgcggcatatccccttctccgtcctcccgcctgccgccatgtcttcgccttcgccctcgccgccggcgccggcggaagaggagggccgggcgccgaccaagtacgtgctgatcaccggcggcgtcgtcagcggcctcggcaagggcgtcaccgccagcagcatcggcgtcgtcctcaaggcctgcgggctccgcgtcacttgcatcaagatcgatccatacttgaacacagatgctggtacaatgtccccctttgagcatggcgaggtgtttgttcttgatgatggtggagaggttgacttggatttggggaattatgagcgtttcatagatgttactctgacaagggataacaacattaccactggaaagatataccagtctgtcattgagaaggagagaaggggtgattatcttggaaagactgtacaggttattcctcatgtcactgatgaaataaaacagtggatacagtcagtgtcttcggttcctgtggatgggcagactcgtccagctgatgtttgtgttattgaattgggaggcactgtaggtgatattgagtcgatgccattcattgaagctttgcgccaattatccttttctcttggcaaggaaaatttctgcctcatacacgttagccttgttccagtattgggtgtagttggtgagcagaaaactaaaccaacacaacatagtgtacgagaactgagagccttgggtctgactcctgatcttctagcatgccggtcagcacagccactaataggatctgttaaagagaagctttcacaattttgccatgtcccggtcgagaacatacttaacatccatgatgttccaaatttatggcatgtcccacttattcttagaaaccaaaaggctcatgaagctataatcaaacaactaaaccttgctagatctgctggaccacctgaattacgagattggacagatatggctgagtcgtatgacaacctcaataactctgttaaagttgctttggttgggaaggatactaatctgacagattcttacctatcagtggtgaaggctctcctacatgccagtgttgcctgttcgttaaagccatctatccagtggattgcagcttcggatcttgaagatgcaactgcaatatctgcaccagatgcccatgctgaagcctgggaaactcttaaaggttcatcatgcattttgatacctggaggatttggggatcgtggaatttcagggatgatattggctgcaaaatatgctcgtgagaatagagttccatatcttggtatttgcttgggcatgcagatatcagtgattgagatttccagacatgtcctgggcctggaagatgcagacagtgaggagtttaacaaggatacaccgaatcatgttgttatgtacatgcctgaggtttcaaaaacacatatgggaaacacgatgaggttgggctgcaggagaacattcttcagcaaacctgattgtcttacatcaaaattgtacggaagtcctccacatgtagatgagcgccatcgtcatagatacgaggcccatccctctttcgtcccctgcttcacaggccgcccttcctctccctcgcccctcccctcctcttactccccttcactctcctctcctccccccaccccccccccccctctctctccttccccccc

SEQ ID NO: 669 - DNA, 1029 bp, Zea mays
gtagctgcagtacggtccgaattccgggtcacctcgcctccggcgcgggcgcgggcccccggggtccaaagtcgcgtctcccagcctccctccactgtcccacaccccaacactgttccagtccagcggctagcactagcagacagagcccctcctccccctagctcttgctcttccacaggcacagcgcaacgcttccagctagtctcgagacgaccggcagagatgatgaggcgttgcagcatcgccgccctcgccatcttcctcctcctcctcgtgtgctcctcatcctcctccaactgcgcggcagccgctcgcctcctgcctggcgccggacatctccggcctctccgccatgccgccgtgggcgccagtggcgacgagctttccgcgggctccgagacgatggaggcgtgcgaggaggggaacggcaaggacgagtgcgtgcagaggcagctgctcctcgacgcgcacctcgactacatctacacgcagcacaagggcaaaccgtgaccgtcagcgaggaggatgccgcagctgcagtggagcgaggagcttgcagctgcaggccaccgtctcggttcggcacttcgactctgctagtgctacggcccccctacggaaaaagttggtttgtggagggaatattttataatcacttgctagaatgctacctagattgctacctagatgaacgctgctgcggctaattaattaacatccggacggacgttgtcatccgtctacttagtactccctccgtttttttagttatcactggatagtttaattttgcactatctagcgataactaaaacaaaacgaaggaagtactagctagtatatatatggttgtgtacgtctctaagtcttatctaatatatgcatgcacatggtggtggacaaattaaataataacaagtataaccaaacctctcttcttaaaaaaaaaaaaaaaaaaaaaaaaaaaaaaaattaggtgacactatagaaggccggccgggctattgcaatcttgtgaattcagcc

SEQ ID NO: 670 - DNA, 1041 bp, Zea mays
ccggccgggcaccagcaagcagcagtctaccaccatcccaccaatctcccaaattaagccatccgtcaccagccagccaaccagcactcactcactagctacgtccaactcgtacacaacccctctttctctctatcttctctccatccatccatcctctcgctcgcccttcgacagctagctaagcagtacgacgtagtatactagcatttagcagttcatcaacgcgctcaacctagcacgacgtacggcgatgaggcgccgcggcagcaactcctcgccgcttgcggctgctgccctgcccctcctactcctcctcgtcgccggctgcttccactgcatggcagcggcggctcgccacctgccttctcctggcgccccagtccaagcgctggatcaccaagccgagaacggtgtcaaggctgcatcagctggtgcagacggcgccggcggccttgtgctccaggaaggtggcacgggcaacaacggcgacgacctctcctccaaaaccctcctcgagacgacgacgacgacgatgggagcggaggcgtgcgaggaggggaacgacaaggacgagtgcgtgcagaggcggctgctcgtcgacgcgcacctcgactacatctacacgcagcacaagggcaagccgtgaccgtcagcgacgaggacggtgcatgccgcggctgcagaaaatgaggagcggaagaggagtgaaaaaatgatggaccatcctcaaaccaaatatcctataaattcacgcacaaggggaaggggatagtaatctcatctgctgctgctagctactagtacatgcatcgatcgaccttctgcgtgtgctgtatatttctgccacgctgcctatatattagcatgcatcatcatctaggtctaggactgtctgatggtttcccgtatttgtaaacactgatgaacagtacctctctctctctctgcttcctgtaaccaccaagcttacttggtccaagagaacgtaacaacgcacatttgtttataaaaaaaaaaaaaaaaaaaaaaaaaaaaaaa

SEQ ID NO: 671 - DNA, 915 bp, Zea mays
tcgagggccgtgccgggccaaaaaaaaaaaaaaaaaaaaaaaaaaaaaaaaaaaaaaaaaaaaaaagcccgcccagcaccacactccaaagtccaaagtcgcgtctcccagcctccctccactgtcccacaccccaacactgttccagtccagcggctagcactagcagacagagcccctcctccccctagctcttgctcttccacaggcacagcgcaacgcttccagctagtctcgagacgaccggcagagatgatgaggcgttgcagcatcgccgccctcgccatcttcctcctcctcctcgtgtgctcctcatcctcctccaactgcgcggcagccgctcgcctcctgcctggcgccggacatctccggcctctccgccatgccgccgtgggcgccagtggcgacgagctttccgcgggctccgaggtgacaacccaagacacgatggaggcgtgcgaggaggggaacggcaaggacgagtgcgtgcagaggcggctgctcctcgacgcgcacctcgactacatctacacgcagcacaagggcaagccgtgaccgcgagggaggatgccatgccgcagctgcagtggagcgaggagctcgcagatgcaggccaccgtctcggctcggctgctagtgctacggccccccctacggaaaaagttggtttgtggagtgaatattttataatcacttgctagaatgctacgtagatgaacgctgctagctgcggctaattaattaacatccggacggacgttgtcatccgtctactagtactagtagtctagtactagctagtatatatatggctgtgtacgtctccaagtcttatctaatatatgcatgcacatggtggtggacaaattaaaaaaaaaaaaaaaaaaccactcacaagaaaaaaaaaaagcggcc

SEQ ID NO: 672 - DNA, 1344 bp, Zea mays
  misc_feature (8)..(9): n is a, c, g, or t
gtgcggcnnccctcggggcccccccggcccggcgggcgccccactccaagtccaaagtcgcgtctcccagcctccctccactgtcccacaccccaacactgttccagtccagcggctagcactagcagacagagcccctcctccccctagctcttgctcttccacaggcacagcgcaacgcttccagctagtctcgagacgaccggcagagatgatgaggcgttgcagcatcgccgccctcgccatcttcctcctcctcctcgtgtgctcctcatcctcctccaactgcgcggcagccgctcgcctcctgcctggcgccggacatctccggcctctccgccatgccgccgtgggcgccagtggcgacgagctttccgcgggctccgaggtgacaacccaagacacgatggaggcgtgcgaggaggggaacggcaaggacgagtgcgtgcagaggcagctgctcctcgacgcgcacctcgactacatctacacgcagcacaagggcaaaccgtgaccgtcagcgaggaggatgccgcagctgcagtggagcgaggagcttgcagctgcaggccaccgtctcggttcggcacttcgactctgctagtgctacggcccccctacggaaaaagttggtttgtggagggaatattttataatcacttgctagaatgctacctagattgctacctagatgaacgctgctgcggctaattaattaacatccggacggacgttgtcatccgtctacttagtactccctccgtttttttagttatcactggatagtttaattttgcactatctagcgataactaaaacaaaacgaaggaagtactagctagtatatatatggttgtgtacgtctctaagtcttatctaatatatgcatgcacatggtggtggacaaattaaataataacaagtataaccaaacctctcttcgcctttcttagtcccattcccatctttgttgcattattgagccatgcttggttgatggaagcaatttctcaacagtaacgccttggacatgagttagtcgttttgggttcgtcctaaagttaaactatttaaacttttaccaacgatatatatgtgatcaaattattgtaaatcaaaaaaattatatatcgtagtagttcaagtcactatgagtctaataactttatatttatattgtaaaatattatgaaacctttgatataatcatttaaaattgaaagcttagaataaacctaaaacgactaaaactcgtatggacggaggagggattacgtgcgaaacggtgcatagcgtgcagtgacaaaaggtaccaaacaaaaaagggacatgctcgtacatata

SEQ ID NO: 673 - DNA, 1317 bp, Zea mays
attaaaggccgtctcccaaccagacaaagcaagtactagcagtagcactgcgccgcagcaatggtggtttccctcgccgaataaatctcaccggtcgcgcttcttggcgtgttcctccgctcgcctgggcttcgatctccagccctcgcgtgagcgcgggtgcggccgcggcgccgtggtcatggcgacggaggagtgggagctgcgggaggaggacgcctacgcctacgagttcgagttcgacctcgagaaccccttcaccagccccgccgacgagccgatcgccagtctcctcgacgccgagggccaccacgcgccctctatctccgccgcggcctcggccacccgccgcgccgccgccgccttcatctccaaggtgcgtttcggcggcgagctcgccgtgcacccgcgcgtcgcctacctcgcgctcaactacgtggatcgcttcctctccaagaggcaattggcgtgcgagcagcagccgtgggcgccgcgcctgctcgccatcagctgcctctccctcgccgccaagatgcagcgcgtcgcaacattctccaccgccgacatccagagggacgaagacttcatgttcgacgcggtgaccatccgtcggatggagcgcgtggtgcttggcgcgcttgagtggcgcgcgcgctccgtcacgccgctcgccttcctcggcttcttcctctccgcgtgctatccgccgccgcagcaccccccacaggtagccgctgtcaaggcgcgcgccgtcgacctccttctccacgctcagcctgaggtgaagatggcggagttctcaccctccgtggtggcggcggcagcgctgctggccgccgccggagaggtcgccgccgcgaacctccacgcgttccaagccagcttggccgcctgtccctttgtaaatagcgagaagctgcgggagtgcggtgaggtgctggcagcggcgggcggcgtcgggcgggggcgagccgctccgagcgcggacacgcctgtgacggtgctcggtcaccagcgcagcgccagctccgcctcggagaccgactggattaacggcggcgacgcgaagaaacgctgcatgggcccaccatcgcaatgggggtaggcggcaggccgcaggccgagtcaagcgggtattgtcgcagctggatcgaagagtcggagattttactgcagccctgctcctttttttccaaattgtttttaccctttttcttttcccaattctttccttctactttaatgctctcgaggtaaagtgacgaggagtggtggtggtggctgtcatttactagtgttcctttttcctagcatgtc

SEQ ID NO: 674 - DNA, 4237 bp, Zea mays
  misc_feature (1837)..(1837): n is a, c, g, or t
  misc_feature (3288)..(3288): n is a, c, g, or t
  misc_feature (3305)..(3305): n is a, c, g, or t
  misc_feature (3358)..(3358): n is a, c, g, or t
caagttttatcattacttagaccatcaaaagtaatgttctaatactgcagacagttgcctattctaataattctgccacttctaaatgtatatatattcacatatatattggtctttctatatgtacacaataatggtccaattattgttgctccttccaggttccattttgagtttactcctttgcagtttatactctctgattgcttaactacttcactcaatatattattctgaccacttatattacttttatctatacgcgcgccgttactaatttgaaaatgagagctgttttctatcagcgtcaacaattttcaaccgagaaattgccaatttcttgcgtgttgggcctgagctgtcaaagacgcatgcagccaacagtcgtcgcgggaggcccaatttgacctcactgacaggtggggaccaaatcttctctctggcctctgcctcctgtccttcctctttcactccctccctctctcgcttttctcatgctctcgatctttacaaaaagaaccccgaatccccaacttttggtagcattgtccccggccccccttgctattaaaggccgtctcccaaccagacaaagctagtactagcagtagcactgcgccgcagcaatggtggtttccctcgccgaataaatctcaccggtcgcgcttcttggcgtgttcctccgctcgcctgggcttcgatctccagccctcgcgtgagcgcgggtgcggccgcggcgccgtggtcatggcgacggaggagtgggagctgcgggaggaggacgcctacgcctacgagttcgagttcgaccttgagaaccccttcaccagccccgccgacgagccgatcgccagtctcctcgacgccgagggccaccacgcgccctctatctccgccgcggcctcggccacccgccgcgccgccgccgccttcatctccaaggtacggggtgcccgcacgcgccgccgcattcgctctcgctgctctctcggttctctgtttgggatttccgctgtttcctgacccgatcggcctcgatcggtacaggtgcgtttcggcggcgagctcgccgtgcacccgcgcgtcgcctacctcgcgctcaactacgtggatcgcttcctctccaagaggcaattggcggtaaggactcgtcactcgcgagctatgggtctgttatctgtaaaggtttgttggggatttcggtctgatctaataatatcccctttggttccatcaagtgcgagcagcagccgtgggcgccgcgcctgctcgccatcagctgcctctccctcgccgccaagatgcagcgcgtcgcaacattctccaccgccgacattcaggtactagatttcggtgcctactgcttgcgatttggtgagcgattgctctggagattaaagcccattgcggtgtttttgtgttgcggttgccttgttgcagagggacgaagacttcatgttcgacgcggtgaccatccgtcgcatggagcgggtggtgcttggcgcgcttgagtggcgcgcgcgctccgtcacgccgctcgccttcctcggcttcttcctctccgcatgctatccgccgccgcagcaccccccacaggtagccgctgtcaaggcgcgcgccgtcgacctccttctccacgctcagcctggtatgtgcgccccgcccacgccctcccgtgccggatgccatggcatggcatccaagacaagaggaaccctgacattgtccccttgtgtttgtagtttgtactgaactctatttggtctgccttttgcagaggtgaagatggcggagttctcaccctccgtggtggcggcggcagcgctgctggccgccngcccgggagaggtcgccgccgcgaacctccacgcgttccaagccagcttggccgcctgtccctttgtaaatagcgtgagcatgagctttaaaccacgcggttttttttatttccattataagccgctttaaccgtcactaattgacgtaattacccgtgccacgtcaaacggacaagattgtccaggtcctttgggactggccgcttctggtgttccagttattatactaccgctcttcatcttttttaaacctgttttcctcggggtgtggagctaatgtggcaaattgaccgcccagtaaaaccttgctgcttttctcgctttcggcattaacaatgtgatcatcgtaatctacctcatcattttgacaaattgcacccctcatgattacctgtactgtaatgcgagatctgcagcaacaggtagttctcgtgctaactgtatgccgttgcgcaggagaagctgcgggagtgcggtgaggtgctggcagcggcgggcggcgtcgggcgggggcgagccgctccgagcgcggacacgcctgtgacggtgctcggtcaccagcgcagcgccagctccgcctcggagaccgactggattaacggcggcgacgcgaagaaacgctgcatgggcccaccatcgcaatgggggtaggcggcaggccgcaggccgagtcaagcgggtattgtcgcagctggatcgaagagtcggagattttactgcagccctgctcctttttttccaaattgtttttaccctttttcttttcccaattctttccttctactttaatgctctcgaggtaaagtgacgaggagtggtggtggtggctgtcatttactagtattcctttttcctagcatgtctttattttagcctagttatggtaatttttgcggcggtgctttggaaggtgaggacggtggatgaacatactgggatggaagagggggatgatgtgaaatggtaaaaaaaataaaaccaaaaggctggcatgttgctttgtcacctctgccgatctggtttctcttgcgtctgctttcgatgatgatttctcattatgcggtcgaatttctggcatgatatttctgttttgccattttcttgccgtgtttctatttcatagcccactgtagtaaaagttttaaccgttctaaaaacaattctttcaaaaccacaacgactgtagctggacctaaaaaaggagaaaaaaccccccggaaaccacaaaagcccagtggtcaacgggggactacagcggggccaggagagcgacgtgtcagggcagagtggcgcacccttgtactttacttccttttcaggctggcactggcaagccgctggatgtctgccacgtggatgcgttaccgcatcgccgtcgccgccctcgctcgagtacgtccacgttccacccttgctcgtgcatgcggtccgcatggtgctgtacgcctcntgacgtccatacgtagnccgcagcgtacggcgacagtatgactacgtgcacgcgtactgtatttaagaantgcggttttgtttgtgttctctatgtactctttaggaacgaactatatgactgagggctgcgaccatggtttacaaaaccgctaaaaaccggtggtaaataggtcggtttatcgaaaccgccgggtgcggattcggtaaaccactagttttttttccaaaattcgtttgaaatttaaaaaattgaaaaaattcataaaaaccgaaaaccgctggtaaaccggaccgataaatcgttatttgagaccgttaaaccaccaatttttgccggaaaaacgaatttaatgtcaaaattgagtatttagtggtcaatttagggtgtgtttggttgcgggacagtcaggacagggacgtcccctggcgtcctctctcgtctctccaattttgagggataactaaggacaacactaggataggtctgttccaacccctgaccctgaaccaaacaaccttatttgagggatcgtcccgtcccatcccgtcctgtcattacaaccaaacgcacccttagacaatattagtcttgtttactattatatactataagtgaagatgttatatgttatatgtgaagataaacccgtagctcaagtccagtttaggcatttagtggtcaatttcggttttatttcctgttcaagatggaatccgtagatcaagtagcttcggttcttctaataactatccgtctagacaagactcaatctagaactcttatctctagttcttttatatgtgttcctaatatttgcttatcaggagaaaagtccaacacttggtgaggtgcacatgcaatacataaacaccaaacacacataatggtatgttttttttgctttgtggataaatatttatttgtcgttcttgttttctcgctaatg

SEQ ID NO: 675 - DNA, 6376 bp, Zea mays
  misc_feature (5203)..(5203): n is a, c, g, or t
ctgcagactgacatgcatgcatgcatgcactgtggactatggttggtacatgtgtgtgtgtgcagacctgagatatatcttttaaaaactaactttatacacgcagtaacgaaatctgtgttttttttatctctagaatgagagaggagatcgatgtataccaaccgggtaggtgatgtagcagagggtacatgtatataaagaaaaggggttgatcgttcagagagtgggtggaggaagagaaagtgttagtctaaatatctgctggatttgtaaggagacaagggaaaagacaaaaaaaggtcagcttattatagattactattactttctctagtgcatttctagctatctaattaatttcataaaaaaagttaagtgtattgattcagaaaatttagaatggagtactgctactcccgcgagcgcaggcgtactcacattgtacagttccagcgagtggagtacttgggggcatctgttgttggtagtcattttgtactgggctgtagtattctcaaaagaaagaattgtacgtactagcctttctcagaactcatagcgcatagagtaattgattcctcaaacaattgatgtcagactaaaagaaaaagaaaaatgcttcctttttttttgatttctaacatatttcctcgacaggggtaaagaatgctcagcctttggcgtctttgggatcctggctcgctctcttttcccttctccggttctcccctgaaagcgagcagcggatagataaagctcgggtcggctttggtgccacgtactggccttcttccccttcgctctgacactgttcctcttccctcctcctcctcctcctccccccacccacctcctcctgctctttccccgtgtgtccgtcctctcctccccggcgggcggccatgactgctgtggcctccctctagcctcgctgggcggctgctgtgccagctctagaaagatacgacagctgttggccttcagctgctggcgctgctcgactgcactgcacaccatagagaggaagggagagagagagagagggagggagaggcagaggcagaggcagaggggggagtgtgtgtgtgcgtgtctgtgcctgccatgtgtgatagaaagaatctggaattgctttccaagtcattgaccgcccagttccagtttccttccccccctcgttttgtccccctcctgagcctccttgattcctgtgttgcttgctgttcctccctccctccctgcctgcttgtgtgtgttgttgctgttattccctgcttggctgttcatgcatcaagcaagctccccagcatctttctctcccatacatacccccttgtctgatgcctgcttctgcttctgcttgcccatcccctccttcattcttgacgagttaaatgcatgcctttcagcagattgctgcacacatccctctcgatttattgcctgccaccacacccctttttcttccgctatcttccttctcctagctagctagctaggtagacacacagtcacacacacatatcagtagtggtgtgtatatgatagtatacagcaagtgcaagatcatcaggcgaagctagctactagccgccctcctcagctcggaggcggcttggacttcacctagtatgttccaccatcagcaggagctcctacaggcagaagctgcggcggcagatcgggagagcagcatgtccaacaacctcacctcctccgcgcccggcggccccaacgcggcgccagctgctgctgcggccaccggcaataataacaagcgaaagcggagcctcccaggcaaccccggtaggtggtgggtggacgacgaccgaccgatcgatcgatcctgcttcttccctcctccctcgtcgtaattcgatccagtgattaatttatgagttgagttgagttggttctcggtcgctcgtttatgctctcttgacttgatggacggcttgaacatgtcgtcgtcgtcgtcagaccccgaggcggaggtcgtggctctgtctccggcgacgctgatggcgacgaaccgcttcttgtgcgagatctgcgggaaagggttccagcgggaccagaacctgcagctgcaccggcgcgggcacaacctgccgtggaagctgaagcagcggggcgcgggcaaggaggcgcagcggaagaaggtgtacgtgtgcccggaggcgtcgtgcgtgcaccacgacccggcccgcgcgctgggcgacctcacgggcatcaagaagcacttcttccgcaagcacggcgagaagaagtggaagtgcgacaagtgctccaagaggtacgccgtccactccgactggaaggcgcactccaagatctgcggcaccagggagtacaagtgcgactgcggcaccgtattctccaggtaaaattgaagtaactaactagagagaccacctttgctatgctagctagatagcggctagccgatccatcttccttccatttgcccgctccagtgtgtcagtgtgcacgcacactggccaacctgatcctctcttgaactcttctttcaccatttggaggtcatgcatgcatgatgatcgtcagcccttaaaaaaaaaaaaaaaaaatgcatgtggtgattgagatttcaactagtagatagggcactgattaattaaatgatgcgtcaggctagatcgataggatacgatgctagcagtagtagaggtagacaccagaccagagtgcagtgctgtggtgtactgcactggcaatggcactggggtcggctcggtttctgcctgctttgctgcttgcaaccagcgaagcgatgcagaagagagaaggatttgaaggttgcggattgggtgttggagaagaaaggcaagttgtccagggcgtcgtgcatgtgtgtccatggacagaaaagatggaccactttgtaactaagacctccgatcccccttggctcttttctttttgtccatggacgacgaggggaggcttcggaagcagctgttactgctgctagctgcatggtgaacggaacccgataataggcaatagggctcagagcttagcttgggcgcatgcgcgtgtctgattcatatattctttcgttcattttgttcgagctctgagagaagcccgagcaccgaaaagctagctagctagctacggggcatagggctgaggaagagagacctgcgacctccatccatggcgattggcgaggaaggaacgaggtgtagtggaggctggctgggagtgggacaggcatgtgattctctttgcagagccgaggcggccggctttctatctccgtcgctcgccccaatgctactccctatcctatgatcccctatccatgctgcctgctagagctagctgcatgactacacgcactgtcctcctctctcctgtgatgtcccttctctccccagtctttctctctctgtctctgtctctccaacaccagtcacacacggcagcattgcgttgctagcagcagcctaggcttgtagccatgacaggcaaacaagatcaaacgagatggaaggacgaaggaacttttgcttttagctttctctttctcttttcctttttttttttgcttccgatcgagctcgcctctgatcccggcagcacggacgggctacagctcctatgctgcagtctgcagcaggagagggtcgtaaagatttgattctcttcgtccttccttttctttttgcgtcgcatgcaatgcaacgcaacgtgtgcaggcgggacagcttcatcacgcaccgcgccttctgcgacgcgctcaccgaggagagcgccaaggccatcggcggcgtcaacgccatggcagcgccggtgcaccaccaccaccacccgatgctcttctcgccgccgcccgcgcacgtcatgcagcagcaggacgtcctcctcctccaggagcatcaacaccaccagcaccagcagcagcagcaggaggacgatgtcatgcagcagccgccgccgcagcagtgcaactacgccatgaagacggagatgccgccgtggccggcgatggcctacgaccacccgctgctgcagccgctctgcaacgccgccgccgcagcggcggcgcagggctcggcggccacgtccgcgccgcagctgcccgcggcctccgcgcacctgtcggccacggcgctgctgcagaaggcggcgcagatgggcgccaccatcggcggcgcgggctacacccagatggcgggtcccgcgacgagcgccaccgccgccttcggcctcggcctcccgggcctgcagaatgcccagcaccaccacccgcagcagcaagatggcggcggcggggtcatggcggccgggctcgcgaggacagccagctcccacggccgcggcggcgacgaaggcggcggaggcggatcaggcgacggcatgaccagggactttctcggcctgcgcgccttctcccaccgcgacatcctcggcctcgctggcctggactcctcgtgcatgggcgccatcaccgccagcgccagcatgggctgctacgagccacagcaacaacatacacagcctcaggcgccgcagcagcagcaaagcagcaacgaaccatggcacggcatggggcagccatagctagcttaggtcgtcgctacccattctggcaccaaagctactttctgtgcgtcttcctctcatcagccgtactacatcgccgtcgctgcttcaattctgattatcgctgccgccgcgcgcggtgcagaggcaaaactagctacggccggccgcccagagtgcaacgcgtggcttttgagtcgggtaatctcatcgtctcccgcccctcacttcggtcatcttttgctcctgttcatgctgtcatcccgtctgaacttttaaccacgcaatgcaagcaagcctgcaagctaggatgaggatgatagattggattggataatacacaagtacgcagggagttgtgtaattttttttcaggttggggaagaagatcgaccaacatgtaaactaataagctcggttcaattaagcagatgggaagaacaccatagctacgtgacagtaataataatacatgcatgcgttcatcgtctcttttgtctggtcactacatccatccatgtgtgcaattttggtgatataaaagtttctctttttttcccaaaaaccagtattatttggtggcattgacttgagagagtagattgtgaatgaactggagatggantccttggtgtagtatagtagactgcaggatccgtagatgagctgaggtgcattcttgggtctacgagacatgcatgtgtggcctaccggctgtgatatatactatttgttttcgttttatagttttgatactactgctcctacatgcattgcatgtgtgtggctgtctgtgtactgtgccgtgcaatcaggccatgcatgtactgcgcagtgctgggtactgttcgcccgtgacaaggttttgttgctatatattggacctatcgggttatgggcgcgcattattccatgcatggtgtgtgagagccaatatttgaaaagttacgatagatattatatatatactgccgtcttcttggatgcaactttagcatatgtgacgaaataatacttgccttttgacgaaataatacttgccgtttcgtttaaatattggtaatgtaacgggtaaccgataatattaaattatattgtttaagtctaaccataattaatatcacactataaatgaataccggcttattcaaacttattaccactgttattcgagtgtgaatcattataattaacatttacgttacatttcgtgaaccaaacgacacctcaatatgaattttattccctttttgtaacttgtgcctactgtgtggttttaagagttgtttttgaatttccttcttcgtttgcattctggtgtttgtgtttctaggtctttttactgatatgttatttgacagacacgaaatcccgttagggcatactcgacaaaaaaaatgttaataaagaataccagttgtacacactactggagacggcttcttcttgagtgttacatgcactcgacaaaggatcaaatgcactcggcaaactctttaccgagtatcacacttggagtgctcgttgaaccaatcatcgacaacagtttctttttcgagtgctagctaggactcggcaacgtaaagttgccgtcacggtggcaagggatggaggttttgccaagtgtctatgcaggcactcgacaaaccagctttatttgtcgagtgctgactcagatacactcggcaaataaagcttatgtgggcccccatacacaatctctttactccttgatgatcttgcttgttactaaacacccactttgttccaatgattcttgcatttgtggaggctctaa

SEQ ID NO: 676 - DNA, 2574 bp, Zea mays
gacacagggccttcttaccctttgcttctcttctctgccgctagggaggcgctgacactgttcctcttccctcctcctgctctctccccatgtcctcctcctccggacctcggcggccatgactgctgcggcctctttcgtccgtgcctgcgcgctgcatggcgtgctgccagctctagatacacactcctagctaggcagctgttgccttcacctgctgccgcgcgctgctcgatcgactgcacgtcttcacagttcacaccacagagcagagtggagagagaaagccaagaagccgtcaggggagagtagggagagagagagggtgaggagtcgtatgatagaaagaatctggaattgctttccctctcgttgtgtcccccctgcgcctccttgattattgagctgcttgctgctcctccctgcctgcttgctccctgcttcggcttggaggccttctcatgcatcaacctccttagcatctctctccccctctcccatacatacccccttgtctgatgcctgcttctgcttgccccatcctccttcatccttcacgagttcgtctctcgatttattgtctgccacacctcccttcagctagctatcttcccctagctagctaggtaccagtagtgtgtgtatatatagatagatttatagatatagacacacacaacaagtgcaagatcaggcgaaagctactagccgcccttgcagtcttggactccattcgtcgtcgtccttgggttctcctcctcacctagctactatgttccaccatcagcaggagctcttgcaggcagaagctgcagcggcagatcgggagagcagcatgtccaacctcacctcctccacgtccggcggccccaacgcggcgcctgctgctgctgctgctgccccgccggcgcccgcggcctccggcaacaacaagcggaaacggagcctcccaggcaaccccgaccccgaggcggaggtcgtggctctctccccggcgacgctgatggcgacgaaccgtttcgtgtgcgagatctgcgggaaggggttccagcgggaccagaacctgcagctgcaccggcgcggccacaacctgccgtggaagctgaagcagcgcggcacgggcaaggaggcgcagcggaggaaggtgtacgtgtgccccgaggcgtcgtgcgtgcaccacgaccccgcccgcgcgctgggcgacctcaccggcatcaagaagcacttcttccgcaagcacggcgagaagaagtggaagtgcgacaagtgctccaagaagtacgccgtccactccgactggaaggcgcactccaagatctgcggcaccagggagtacaagtgcgactgcggcaccatcttctccaggcgggacagcttcatcacgcaccgcgccttctgcgacgcgctcaccgaggagagcgccaaggccatcggcctcaacgccatggcggccgtgccggcgcagcaccaccaccacccgatgctcttctcgccgccgcccacgcacgtcaggcagcaggacgtcgccctcctccaggagcaccaccaccaggaggtcatgcagcaggagcactgcaactacgccatgaagacggagatgccgccgtggccggggatgacctacgaccacccgctgctgcagccgctctgcaacgccgccgcaccgcagagctcggccacgtccacgccgccgccgccgacgacgacgcagcttcccgctgcctacgcgcacctatcggccacggcgctgttgcagaaggcggcgcagatgggcgccaccgtcgccggcgcgggctacacccagatggcgggggccgcgacaagcgccaccttcggcctcggcctcccggacctgcagaatacccagcagcagcagcatcaggacggcgagatcatggccgggctcgcgaggacagcctcccacggccgcggcggcgaggaaggcggcggcggcggaggcgacggcatgaccagggatttcctaggcctgcgcgccttctcccaccgcgacatcctcggcctcgccggcttggactcctcgtgcatgggcgccatcatcagtgccagcgccagcatgaactgctacgacgagccacagcagcgtgcacaggctcaggcagagcagcagcagcaaagcagcaacgagcaatggcacagcatgggcagccatcaaagctaggtcgataaaagctactttcttcttcctctcgccagccgtcatcggtacgtcgccatcgctgcatctcatcgctgccgtcgctgtgcagaggcaaagctagctagggccggccgctcggtgcaccgtgccttttgctcatcttttgcttctgttcaggatatcatctcatgcatgtggtaaccacgcaagcgatcaaaccgttccgatcaaactctagcccggtccaaggatggtgatgacagattggtgatacagaggtacgcagggagttgtataattttttttttttgggttggcgaagagatcggccaacatgtaagctaagctccaatcaagggaagaaaaccatagctatatgtgacagtaataatacatgcatgcattcatcatctttt

SEQ ID NO: 677 - DNA, 2093 bp, Zea mays
  misc_feature (14)..(14): n is a, c, g, or t
tttctagttctagnacgcgagcggggggcgggaccatgtacagggtgtgcgtgggaggcggcaagatcgagaggaaggaggacgacccgcgcctgtggaggaggtgggattccgacgagcgctacatcttctccatgaacgccgctcacagcatccggaacacgtccagcatcagctacgtgtcgcgcgacggcgccgactcggtccccgcgccgctgcggctgtacgagacggccagggtgacggaggagaccttcgtggtggacaggaagttcaacgtgtcctggcggttcggcgtggaccccggcttcgagtacctggtcaggctgcacttctgcgagctggagtacgggagcgcggagcagcgcaggttcaagatctacatcaacggcaagaccgccgcggagaactacgacgtggtcgccaaggccgggggcaagaacaaggcgttccacgaggacttccttgacgacgacgacgccgcccccgcgtcggagaccgacacgctctgggttcagctgggctccgagtcctccgcgaccagctccgcggctagcgacgcgctcctgaacggcatggagatcttcaaggtcagccggaacggaaaccttgggcatccgacggttaggatcgggggcgtgagtggtggcctggaggacgacagacgaaagcggagccccaggtgggtgctggtcggcgctgctgcgggtctggtgatcttcgtctcggtcgctgctgctgtttacctctgtttctatctgcaccggaaggaaaacacaaacacttcagctgctaataagaaaacgaagacgaagacgaaggacgacaaccttccggctacgacgtcggcccccggtcttcgcgcagctggaacatttggcagctgcaggatgggccggcggttcagcatcgcggagatcaaagcggccaccatggacttcgacgagtccctggtgatcggagtcggaggcttcggcaaggtgtacaggggcgagacggacacgggcactccggtggcggtgaagcgggggcacgcagagtctcagcagggcgccaaggagttcgagacggagatcgagatgctgtcgaggctgcggcaccggcacctcgtctccctgatcgggtactgcgacgagcaggacgagatgatcctggtctacgagcacatggcgaacggcacgctgcggagccacctctacgggagcgagagcgagagcgaccacctccccgctctgacgtggaggcagaggctggagatctgcatcggcgcggcgcgggggctgcactacctccacacggggctggaccggggcggcgtcatccacagggacgtgaagaccaccaacatcctgctggacggcagcctcgtggcgaaggtggcggacttcggcatctcgaagcacggcccgccgctggaccgcacccacgtcagcaccgccgtgaagggcagcttcgggtacctggacccggagtacttcatgaggcagcagctgacgcagagctccgacgtgtactcgttcggcgtcgtcctgctggaggtcctctgcgcccggcccgtcatcaacccggccctgccgagggaccaggtcaacctccccgagtgggctctggagcggaagaggcggggcctgctcgagaccgtggtcgaccgtcggctggacggaggctacgacctggagtccgtcaggcagttggctgaggtcgccgagaagtgcgtcgcggatgagggacgggaccggccttccatcggtcaggtcctgtggcacctcgagaccgctctgcagctgcaccaagcgcatctgcagagctcatcagcctcagctgctgcgggtgatctggagccctctgatggcgcgtctgctagcaacagcatcaggcgcgccgaagaggcagcagaaaccgctggtgtgacctatggagatggacatggagatggggaagcggtggaactcagagttgaggtactgtaaacgctgtgtgtgtgtggttgccccagcaaatatactgaaatccttttggttcttcattccgtcgtactctgcaaagaaaatgcagtgttgagagttgctattctttcatcgatgtgcgagaat

SEQ ID NO: 678 - DNA, 1364 bp, Zea mays
aagatgcataggtgagttgtgtgatcatctagtaaaggattgcataccttcatttatcgtttattacgtgatgaaaagaacaagagatacaacatgatataagagaccttcataattgtacctttgaaggtcacttaagtgctcgagagcgataggtcttttgatgagctccagcacgaagatgctacaagtgcaagattacaaatgaccgacccagtagtggtgatactattatcctatttataggatggaggatatatacacattaccctagaattacatgaatgcccatccctctgtacaaagaaaatgtacgactggagacagagaattatgactttctacaaggaagaaatgtcatgtcttctcctcctttataacttccttattgttaactctgaaggaggtccagccctcttcagcattcgtcccttctccctgctttggcttgacattcactgatacagagccaaccgaaactttcaattgaagcacattgttcgaaggtccattcctaagaacatactaaaataataatttctatcaaatgtagaccttcaattcctaggaacatactaaaatactcagcacaatatatagttgagagagatcccttgttaatataaaaatgaagcaagtactgggacattgatatgctacaaagtttattaacataaaatgcttctgtaattccaaacgattaataggagattatttagccaaattaatagtagctatctaggtgaccagaaattgttcacactgtaacttttaaggctggttttgcaacccaaaatcccaccggtttcacggtcttttctctagggaaaaagctcgcacagattatttccatagatttgtccatctgtttgtttggaagcccatcatccgactgatattcgtccaggggaagccttccgcccgggggaaacagccctggcctcttccgaccagctacccgcgaccgcaactctagcctctagagctctcccctagcgacgccaatcctagcctcaggagctcttccctgagacccggctccatcgtcttctgtgacatcgtccccttctcctcgataagagtgcaaagtggaagcaatgcatgaagtcgacatgaagaagaaaaatgcaacgaactgtatctagtgcagtttaattggtgttacttgatgttggtgtttcgttgcattacagttttatgttatattgactatctgtttgcgtgaatggagatgacattgatggatggattagcttcgttacatattagatggtattcaaattaaactttgtgtgaatcatatttgtttgtgtgaatggagaccaatctgtttctgtgaaaaaaaaaaaaaaaaatttgcggcc

SEQ ID NO: 679 - DNA, 2532 bp, Zea mays
attgggtacctcgaggccggccggggtagcggttaccttccttttgctctactgctctctctgccttgccgttctctccctcgtcggcaatcagcccgcttcccgtgctctctatgctccccttccgttcgtagcctcggccttcgtctccctccatggacccgcgctaaatgcatcgcgagattccaaaccggtagcgtttctttctgctccatctaccgcaagatgtaagcaagggcctcacttgacacccggagtgggagaccatccagaatacatcctcagatcttcttgtctgagaaaaaaagggacgcgcttcaatggaggagagcttcgtgcccttgcggggcatcaagaacgacctccacgggaggctcgcctgctacaagcaggactgggccggagggttccgtgccggtatcaggatcctggcgccgacgacctacatattcttcgcgtccgcgataccggtcatatcgttcggggagcaattggagaggaacactgatggagtcctcacggcagtgcagacgttggcatccactgccctgtgcggcgtaatccactccatcgtgggagggcagccgctgctgatcctgggagtcgccgaaccgacggtgctcatgtacacattcatgttcagcttcgccaaggacaggcccgacctcgggcggagtctgttcctggcctggaccggttgggtttgcgtgtggactgccatcctactcttcttgctggccatactaggcgcgtgctccatcatcaaccggttcacccgcgtcgctggcgagctgtttgggcttctgatcgctatgctcttcatgcagcaggctatcaaggttggctgcgtggcttcatcgctgactatggtgttccactgatggtgctagtttggactggagtgtcttacataccatatggaaatgtaccaaaagcaattccgcgacgccttttcagtcctaatccatggtcccccggtgcatacgataactggacagtcatcaaggatatgacacaagttccactcctctacatcattggtgccttcataccagcaacaatgattgctgttctctactacttcgatcatagcgttgcatctcagcttgctcagcagaaagagttcaatttgaggaaacctccatccttccactatgatttgcttctcttaggcttcctgacgttaatgtgtggccttattggtatccctccatcaaatggtgtcattccacaatcacccatgcacacgaagagtttggctactctcaagcatcagctgcttcgtaaccggctagtagccactgcacgaaagagcatgagccagaatgcgagcctgagccaactgtatggcagcatgcaggatgcttatcagcagatgcagacaccactggtttatcagcaacagtctgtcagaagaggcttaaatgagctcaaggactcaacagtccagctagcttcgagtatgggtaacattgatgcaccagttgatgagacagtctttgacatagagaaagaaattgatgatctgcttcccattgaggtcaaggagcagcgcttgagcaacttgctacaggcttccatggtgggtggttgtgtcgctgctatgccactactcaagaagatccctacatctgtcctctggggctattttgccttcatggccattgagagcttgcctggtaaccagttttgggaaaggatcttgctgctcttcactgctcccagcagaagatacaaggtgcttgaagagtaccacaccacgttcgtcgagacagtgccattcaagacgatagccatgttcacaatgttccagacagcgtacctgttggtctgctttggaatcacatggattccaatagctggagttcttttccccctcatgatcatgctcctggttccagtcaggcagtacatcctccccaagctcttcaaaggtgcgcatctaactgacctagatgcagctgaatatgaggaatcgccggctataccattcagccttgctgcgcaagacatcgatgttgcattcggaaacacccagagtgcagaaatcctagacaacatggtcacaagaagccggggtgagatcaaacgcatcaacagcccgaagatcaccagctcaggtggcacgcctgtggcagaactgaaaggcatccgcagcccatccatttctgaaaaagcatacagccctcgtgtcattgagctctggcatgagcgcagccctaggacgccgtccatgctgggtgaaggctcaacaccaaagtgaatgaaagcaacgatacattgcttaagctattcaaccactggtcatcagttatatgagtggttttaaagtggtttcagtgttagtatccttatatgaagatgtcctctgatgagattactacttatgtgtatctccagtctctcttttttttgttctcctgattaaaggagtgatatacctgtaatctctgaactagcagaatattagagtggctacttgaaaaatcatgtcactagcatattatcattcaaagggcggccctcgcgatc

SEQ ID NO: 680 - DNA, 9012 bp, Zea mays
  misc_feature (293)..(294): n is a, c, g, or t
  misc_feature (4638)..(4638): n is a, c, g, or t
ttatctgcacattgcctatcagtgttcactgcacatggcctaataatttgatacagtattatctatttgtttattgtactttaaaaaatggtttgtgttttttttcctaaatttcatcgcagctggggcatgccggagctcgtccgtagggcagtgctggctacggatggatggtggggcctcggcgcgactctagcaggagctcgaaagtgcctccatggtagcacagttcaagtttctagttctgcttgtctgttgcgtgacgggtaaaaacgtctcctataccacaaatnnatggagatgaattggaaaacggaagcaaatacgttaaatggtagtagaatcaattaaaaatgtttgtagtcccttttctacgaaataattgtttggagtggcattgttgcgaagcagattgtttgtagtcccaataatacaattgtctcgcctggtgaagctgaaactaataatttttctcaactctttcttctgccatcttttctgagaagttttaccaaacgttttgtaaacagttttattttcataggcgaaactgctcacgcgaaccaaagccaaaacaaactgcctaactagtaaaactgaggtgtatcagacaagccctaggtacgtaggcaggcagttggatgatctagtccagtagaaaagagtgaacagtttggaccttttgtacttctattactttgaagatgagttcccccggttcctggtgataatttaaacaatcaacagcccatcatacttacagtcggtaaaatagaggacacaaactataaatgacactgtttatcgaatagagtttgaaatggaggataatatatgagatgagatagacgatctgatggaaatactaaataatcaacagcccatcacacttacagttggtaaaatagaggacacggactataaatgacactgtttatcgaatagagtttgaaatggaggataatatacgagatgagatagacgatctgatggagataccctaaaactagccatgcgtgcatgacaatttccttgtgtacctagctcacaccgaaagtgcagctgcaagagcctcactgtagcacaacctagcctgtcaccgcatttgcttgtcatgacctgcctcttttcaagcaggatttgtgctcatgtgttcatgcatgcatgcttccatattatcttgagagcattaagttcttctaaactggagaacaaaggtttcattcaattcgggaaacattcatttggtcggggaaacagagctgacatggttaactagacaaacattcttctcatgacaccagaccaaagcaacagtaagatactactgccttttgctaattaaatactcccgccaagtcagtcacgcatgctgggataaaaggtaaggtcaactcttgagccccacctgaagcctgaatcaaagttcacctctctcgggctcctgcccaccctggtttcttattggaaggttccccggacacatgaacaggatgcaggctcaaggggcttcatcaccttgtccacattattatatgagctagctgaacaactactgtattattataggggaaaaaagattatgatgcatgtgcagatcacactgaggcaacttgactcactgacctgtgactgatcatgtagcagatagtaggtgaatcttactagtattgcatagcttccacttttattttgtttcagtctgggtactgggatcatgtgggctgttgcctgcagtagtaaccagtaagagctgccggcatcctgcttcttgctgaagaaagtttttgctgtgtgcttaagaaagttaagaagtgtcgtatttcaatacaattacttctttggagatactaatccacaaagataaagatggcgtgctactaaaagctggagtttgacatccataggtgtttcctgaagggcgtcgtttattctctatagctacacacaagcaatttcgttgcttaaactttttgttcaaggaaaacaccacatgcacatccttccaagagttgctgcctttttcaccttaaatcctcatgaacaccctccaatgaacctatgagcaataatttgaaattctctagacagtgaccagagcacataggagaaaacaagcacatggaggggattagcaaaacggcgcgaggaagcttgctgggtccttctcctggtatcctcttcccccagacagctgacctagagctggacctggcagtatggctctgccctcccagggcaactgagccaaaatttagtattttccctcttgttttttttctgttctttttttaactgaacaatacactggtaaataaactagctgtgacacttgctgcagcagttacaggatcaggagcctacaggtcacacaccacactggaacccctcttgtgcctttttgctttccgtgtgctcagctcactcagcatccagcaagcctcccctggacagttcttgagcaatgcatatttttcagggtaacttttttgctttaaacgtttttttttttttgtaccaagatttcttttgtgaattggcagcggtgcccctcctccgccactgcctatatatgtgccctcaaccccgctccattgctctggtagctcttccctctgctgctctctctgagcctggcccttgccctcctctccctccgggaaccagccctgctctctatgctcctcttccattcatagcctcggccttcgtcttcctccatggatccgcgctaaatgcattgcgaggttccaaactggtagcacttctccctgctccatctgccgcaagatgtaagcacggcctcacgccctcacttgacactccgactggccatccagaatataccttcagatcttcctgtctgcgaaaagcgacgcccttttggcccgggcaatggaggagagcttcgtgcccttgcggggcatcaaggacgacctccacgggaggctcgcctgctacaagcaggactggaccggagggttccgtgccggtatcaggatcctggcgcctaccacttacatattcttcgcgtccgcgataccggtgatatcgtgcgggctaggattaggaattcggtatcaccatggtgccaaaatctcgaaactgactgcggcggaggtagttagtcctagtccttttgtttgttgttgttctgaagtttgttcttgcctcgcgcaagatcttgaaaaggagtggtttttggggtgtttcaggatcctggcgcctaccacttacatattcttcgcgtccgcgataccggtgatatcgttcggggagcaattggagaggaacactggtaaatggagggggtgggttcaaatttaagtactcggtggtgttagtttcggtgcagtgcgtgaggagaggagcttatttgtacttgtgcagatggagtcctcacagcagtgcagacgttggcgtccactgccctgtgcggcataatccactccattgtaggagggcagcccctgctgatcctgggagttgccgaaccgacggtactcatgtacacattcatgttcaactttgccaaggacaggcccgacctcggacggaatctgttcctggcctggaccggttggtaggtcatctgtgctgggctgactgagaaattcattgaagattggtttggtacaatgatggcattgtttgaattggttccttttcttcttgttgttgttgtcatgtttgcgtgcagggtttgtgtgtggactgctatcctgctcttcttgctggccatactaggcgcgtgctccatcatcaaccggttcacccgcatcgctggcgagctgttcgggcttctgattgctatgctcttcatgcagcaggctatcaaggttggtgataactgcaggccttttgaacccgttgctgctttccaggcttggaatgaaaccctgtgctgatgcagaaacctttttttaaggcgtgctgctgctgctggaccatagagctttataccaaactccagttgccttgcctctcgaaattgtgtagtactccagtcaatctgaatgctactaactagtggagaatctagtaggttgctcaaaggcatgtgcaagtgctggaaaaaaaagcacatggaagccaatggagatgtctctagcttctgtttttttttgtgccattggtcactagtgcaaccaaatatttcagtgtcctcagtttcgaacaaaagaaaagaaaaggtagataaaatcaagaaggcttgtttataaaaataaacggtgttttcctgcaaaaaggtttgtcaaaatatatatttttttaaaaaaaaaactaccataaattcatgtgtactgaagtaatttgcaagctgacttctctgtggccatctggatgtgcgagctcaccaatatgtgtgatggtcgcagggacttgtcgacgagttccgcgttcctgagagggaaaacacaaaggcactagagtttgttccatcatggcggttcgccaatgggatgttcgcaattgtcttgtcgtttggccttttactcactgccctcaggagcaggaaggcacgatcatggcgctatgggacaggtatccatccgaaaattgttcttgtcctgcaggcgcgcctatgagaaccataatactatatacttagtccagtagcaaatttctgatgatacnactcctctacctaggttggctgcgtggcttcatcgctgactatggtgttccactgatggtgctagtgtggactggagtgtcttacataccttatggaaatgtaccaaaaggaattccgcggcgcctttttagccctaatccatggtcccctggcgcatacgacaattggacagtcgtcaaggtattccaacactctcaaaaagattctaaacgttaagagttattcatgtgaaacaccactgcatattgattaagttctttgacatcgatcaaatgggcaggacatgacacaggttccactcctctatatccttggtgcattcataccagcaacgatgatcgctgttctctactacttcgatcacagcgttgcgtctcagcttgctcagcagaaagagttcaacttgaggaagcctccatccttccactacgatttgcttctcttaggtttcctggtatgcccagacgtgcacaaattttcagtaccaaattttggtgtttttctatacatttcgataaataacaacaatgttttgaactatagacgttaatgtgtggccttattggtatccctccatcaaatggtgtcattccacaatcacccatgcatacgaagagtttggctactctcaagcaccaggtgagtcatgaaatacttgaaaataccatgtgaacatctgatttctcactcacatggcaaacatttctgttcagatccttcgtaaccggctagtagccaccgcacggaagggcatgagccagaatgcaagcctgagccccctgtatggcagcatgcaggatgcttatcagcagatgcagacaccactggtttatcagcaactgtctgtcagaagagtacatgttctattacccaaaacttagtacttcaaaacactttattcagacaatttgtttacataacattttctatacttttttttaaaaaaaaacagggcttaaatgagctcaaggactcaacagtccagctagcttcgagtatgggtaacattgatgcaccagttgatgagacagtctttgacatagagaaagaaattgatgatctgctgcccatcgaggtcaaggagcagcgtttgagcaaccttctacaggcttcgatggtggtgggctgtgtcgctgctatgcccctgctcaagaagatccctacgtctgtcctctggggctattttgccttcatggccattgagagcttgcctggtaaccagttttgggagaggatcttgctcctcttcactgctcccagcagaagatacaagtaagtttatttcatctcaaaagatcagtttggttttggcgcatctaattctgttttttgcatatccacaaactgtgcaaaggcatgatccaatggattcaggaaataatatattatgctagatactgttaatttagctgctttggaagactgaaattcttaccaatgtactgttaaataattcccagggtgcttgaagagtaccacacgacgttcgtcgagacagtgccattcaagacaatagccatgttcacagtgttccagacagcttacctgttggtctgctttggaatcacatggattccaatagccggagttcttttccctctcatgatcatgctcctggttccagtcaggcagtacatcctccctaagctcttcaaaggtgcacatctaactgacctggatgcagcggtacccggcgaatcaccagctataccattcagccttgctgcggtaagctcagaaatacatcatctatcctggaaaaaatacatgagtcttgctcatcaacatggtattttggatttatttagtcatcttgcatttcccggccgctcaaatcttatgtatttcagcaagacatcgttgtcgcattgggacgcagccagagtgcaggggtcctagacgacatggtcacgagaagccggggtgagatcaaacgcctgaacagcccgaagatcaccagctcaggtggcacgcctgtggcagaactgaaaggcatccgcagcccatccatttctgaaaaagcatacagccctcgtctcactgagctccagcatgagcgcagccctctgggagggagaagcaggcctaggacgccatccaagttgggtgaaggctcggcaccaaagtgaataaagcaatgatgcattgcttaagctatgcaactactgggttactggccatcaattatataagtgattttaaagtggtttcagtgttagtatccaagatgtcctctgatgagattactactattcatgtgtatctctagcctctttttctttctttctcttcttttgtgttctcctgattaaaggagtgctatacctgtaatctctgaactagcagaaatattagagtaactactcgaaaaatcctgtcgctaacatattatcattcttcgattgttttaatatgtacatgaaattggtgggaaattatgcgcatgcatttccattgaactcaagcatgcatccggattctggaatactctagtgcttattctattgacgttggtgctggagcatggaatcattttttgcttcaaaaatgtatactgaacgtgtgattcaataaccaattcagtgaactgaaagttcagaaacggattcagaaaaacaaggataaggtcagaaatgactgattcagacatgatgctaaaagttcccaacatcataaaagtttttgacttgagagttgcgcatgcgaaaaacaaggataaggtcagaaatgactgattcagatagaaagatgattgcacagggagataccaatcgtgtggagtcttccactctacgtatctgcaagaggaattccatgctgactccggcagtaatttgctaggcaccaccacaagctgtaagacatggtatgattgtataggagacctgcatggccaaatggttcttctcaatgtcatgaatgccaagtacatctgctgaatacagccttgaaatcgtacttgctcatgctactatagagggaaaggctccttgtggtgggaacaactgcaacacatgcctgcagtaggtagaaagtgtagaaacttgagggtggcacccaagcacagcacagctacaatccatccttctctctactgcagccatgattccagctttagaagaaaccccctgcattggccctgaagcgttgacctgctgaagccaacatgtcatagccccaccatgaaattccctcaggatgcaggctcacctcattgcagcaggctaaacgacacgccccttgtcggcaattatggccgtccgtcttcctttcccggatcgacaattttcctcgagagcccgtgcgctaggactggtgatgggagtagctgatacaggcgatgaaactgtgctgaaagatgaaaggagtggcctcagcagaaggatctggtgaatgatgcgagggctcacgagaaagtagcggctggaattcaaaggcgtggcggcaaaaggcgggaggatcttcaggtccaggtccatggatgactcctggatgaaaaaacaaaatgcgaattgagatcagctccaggaactgtgtgttgtttgctccccgtcatttgacctgcagacagcaagtagtgtgccatgctctgacacgcaattcctgaaatggcccccagtaacccaggccacatctcattccatctactccagtcacagccattgaactcttcagcatccccatcagttcctttcgtgcgtccctccatctgttctggtctcgcttttttccggattctaaagagcaatgtgacaattccatagggatgtagattgcgccagtcaaaagcttgagacatcagatccgtgcacacacatcatccaagcgtctgcagatgtgaccatgaattattgggacgcaatgtgttattagctccactggaacttggacaggttttcctgagagaacgaacggctgaaacactcctgacatctgcagaactggacaacacttcaacgaaagaatgatgaaggcaactgctcccttcagtattaattaagcacactgctagcacttacttctgccaggataaggagacactttctaagattgcgaagctttagctgtagaaactgcccccatgctgcagatcatcaggtgggatcccccaaaaaacaaaatacttctggtgatcaaaaattaaaaaccattgccacaaatatgatcagagtgcacttctggaaatcatggctgtggttcagacacacagacggcaccgagaagcatggtaaaactcaacaattattagagtttatgtatgattcctctcatgaaagctgtggagtcatgaaaacatcaacagcaaaaagcctcaaacgaaaagggtactatccataaccactggggaagagttcaaaggcaccgaatatttc

SEQ ID NO: 681 - DNA, 2842 bp, Zea mays
ggggtaccctccgcacgagacccgtagggaaccgccggccgggccggggtagctcttccctctgctgctctctctgagcctggcccttgccctcctctccctccgggaaccagccctgctctctatgctcctcttccattcatagcctcggccttcgtcttcctccatggatccgcgctaaatgcattgcgaggttccaaactggtagcacttctccctgctccatctgccgcaagatgtaagcacggcctcacgccctcacttgacactccgactggccatccagaatataccttcagatcttcctgtctgcgaaaagcgacgcccttttggcccgggcaatggaggagagcttcgtgcccttgcggggcatcaaggacgacctccacgggaggctcgcctgctacaagcaggactggaccggagggttccgtgccggtatcaggatcctggcgcctaccacttacatattcttcgcgtccgcgataccggtgatatcgttcggggagcaattggagaggaacactgatggagtcctcacagcagtgcagacgttggcgtccactgccctgtgcggcataatccactccattgtaggagggcagcccctgctgatcctgggagttgccgaaccgacggtactcatgtacacattcatgttcaactttgccaaggacaggcccgacctcggacggaatctgttcctggcctggaccggttgggtttgtgtgtggactgctatcctgctcttcttgctggccatactaggcgcgtgctccatcatcaaccggttcacccgcatcgctggcgagctgttcgggcttctgattgctatgctcttcatgcagcaggctatcaagggacttgtcgacgagttccgcgttcctgagagggaaaacacaaaggcactagagtttgttccatcatggcggttcgccaatgggatgttcgcaattgtcttgtcgtttggccttttactcactgccctcaggagcaggaaggcacgatcatggcgctatgggacaggttggctgcgtggcttcatcgctgactatggtgttccactgatggtgctagtgtggactggagtgtcttacataccttatggaaatgtaccaaaaggaattccgcggcgcctttttagccctaatccatggtcccctggcgcatacgacaattggacagtcgtcaaggacatgacacaggttccactcctctatatccttggtgcattcataccagcaacgatgatcgctgttctctactacttcgatcacagcgttgcgtctcagcttgctcagcagaaagagttcaacttgaggaagcctccatccttccactacgatttgcttctcttaggtttcctgacgttaatgtgtggccttattggtatccctccatcaaatggtgtcattccacaatcacccatgcatacgaagagtttggctactctcaagcaccagatccttcgtaaccggctagtagccaccgcacggaagggcatgagccagaatgcaagcctgagccaactgtatggcagcatgcaggatgcttatcagcagatgcagacaccactggtttatcagcaacagtctgtcagaagaggcttaaatgagctcaaggactcaacagtccagctagcttcgagtatgggtaacattgatgcaccagttgatgagacagtctttgacatagagaaagaaattgatgatctgctgcccatcgaggtcaaggagcagcgtttgagcaaccttctacaggcttcgatggtggtgggctgtgtcgctgctatgcccctgctcaagaagatccctacgtctgtcctctggggctattttgccttcatggccattgagagcttgcctggtaaccagttttgggagaggatcttgctcctcttcactgctcccagcagaagatacaaggtgcttgaagagtaccacacgacgttcgtcgagacagtgccattcaagacaatagccatgttcacagtgttccagacagcttacctgttggtctgctttggaatcacatggattccaatagccggagttcttttccctctcatgatcatgctcctggttccagtcaggcagtacatcctccctaagctcttcaaaggtgcacatctaactgacctggatgcagctgaatacgaggaatcaccagctataccattcagccttgctgcgcaagacatcgatgtcgcattgggacgcagccagagtgcagaaatcctagacgacatggtcacgagaagccggggtgagatcaaacgcctgaacagcccgaagatcaccagctcaggtggcacgcctgtggcagaactgaaaggcatccgcagcccatccatttctgaaaaagcatacagccctcgtctcactgagctccagcatgagcgcagccctctgggagggagaagcaggcctaggacgccatccaagttgggtgaaggctcggcaccaaagtgaataaagcaatgatgcattgcttaagctatgcaactactgggttactggccatcaattatataagtgattttaaagtggtttcagtgttagtatccaagatgtcctctgatgagattactactattcatgtgtatctctagcctctttttctttctttctcttcttttgtgttctcctgattaaaggagtgctatacctgtaatctctgaactagcagaaatattagagtaactactcgaaaaatcctgtcgctaacatattatcattcttcgattgttttaatatgtacatgaaattggtgggaaaaaaaaaaaaaaaaaaggcccctagggccaaaaaaaaaataaaaaaaaaaaaaaaaaaggccccta

SEQ ID NO: 682 - DNA, 2944 bp, Zea mays
catgcctgcagcagttacatgtatcacaaagcccaccagtgacacaccccactggagccctcttgtgcttttgctttgcgtgcgcagagctcagcattcagcaagactcgctgcaacagttctcgagcaatgcattttttttcctcagataacttttttgctttaaatttttttctaccaagatttctctttgtgaattgacagtggtgtgcccctcccctgccacttcctatatatctgccctctaccgccgcgccggggctcggtagcggttacctccctttcgctctactgctctctctctctctctggaccttgccgttctctccctcgtcggcaatcagcccgcttcctgtgctctctatgctccccttccgttcgtagcctcggccttcgtctccctccatggacccgcgctaaatgcatcgcgagattccaaaccggtagcgtttcttcctgctccatccgccgcaagatgtaagcaagggcctcacttcacacccggagtgggagaccatccagaatacatcctcagatcttcttgtgtctgagaaaaaagcgacgcccttcaatggaggagagcttcgtgcccttgcggggcatcaagaacgacctccacgggaggctcgcctgctacaagcaggactgggccggagggttccgtgccggtatcaggatcctggcgccgacgacctacatattcttcgcgtccgcgataccggtcatatcgttcggggagcaattggagaggaacactgatggagtcctcacggcagtgcagacgttggcatccactgcgctgtgcggcgtaatccactccatcgtgggagggcagccgctgctgatcctgggagtcgccgaaccgacggtgctcatgtacacattcatgttcagcttcgccaaggacaggcccgacctcgggcggagtctgttcctggcctggaccggttgggtttgcgtgtggactgccatcctactcttcttgctggccatactaggcgcgtgctccatcatcaaccggttcacccgcgtcgctggcgagctgtttgggcttctgatcgctatgctcttcatgcagcaggctatcaagggacttatcgatgagttccgcattcctgagagggaagaccgaaaggcgctagagtttgttccatcatggcggtttgccaacggaatgtttgcaattgtgttgtcgtttggccttttactcactgccctgaggagcaggaaggcacggtcatggcgctatggagcaggttggctgcgtggcttcatcgctgactatggtgttccactgatggtgctagtttggactggagtgtcttacataccatatggaaatgtaccaaaagcaattccgcgacgccttttcagtcctaatccatggtcccctggtgcatacgataactggacagtcatcaaggatatgacacaagttccactcctctacatcattggtgccttcataccagcaacaatgattgctgttctctactacttcgatcatagcgttgcatctcagcttgctcagcagaaagagttccatttgaggaaacctccatccttccactatgatttgcttctcttaggcttcctgacgttaatgtgcggccggttccgcgtcccccccccggatggtgtctttccacaatcacccatgcacacgaagagtttggctactctcaagcatcagctgcttcgtaaccggctagtagccactgcacgagagagcatgagccagaatgcgagcttgagccaactgtatggcagcatgcaggatgcttatcagcagatgcagacaccactggtttatcagcaacagtctgtcagaagaggcttaaatgagctcaaggactcaacagtccagctagcttcgagtatgggtaacattgatgcaccccggccgggggcagtctttgcacatagagaaagaaattgatgatctgctgcccattgaggtcaaagagcagcgcttgagcaacttgctacaggcttccatggtgggtggttgtgtcgctgctatgccactactcaagaagatccctacatctgtcctctggggctattttgccttcatggccattgagagcttgcctggtaaccagttttgggaaaggatcttgctgctcttcactgctcccagcagaagatacaaggtgcttgaagagtaccacaccacgttcgtcgagacagtgccattcaagacgatagccatgttcacaatgttccagacagcatacctgttagtctgctttggaatcacatggattccaatagctggagttcttttccccctcatgatcatgcttctggttccagtcaggcagtacatcctccccaagctcttcaaaggtgcgcatctaactgacctagatgcagctgaatatgaggaatcgccggctataccattcagccttgctgcgcaagacatcgatgttgcattcggaaacacccagagtgcagaaatcctagacaacatggtcacaagaagccggggtgagatcaaacgcatcaacagcccaaagatcaccagctcaggtggcacgcctgtggcagaactgaaaggcatccgcagcccatccatttctgaaaaagcatacagccctcgtgtcattgagctctggcatgagcgcagccctaggacgccgtccatgctgggtgaaggctcaacaccaaagtgaatgaaagcaacgatacattgcttaagctattcaaccactggtcatcagttatatgagtggtttcagtgttagtatccttatatgaagatgtcctctgatgagattactacttatgtgtatctccagcctctcttttttttgttctcctgattaaaggagtgatatacttgtaatctctgaactagcagaatattagagtggctacttgaaaattcatgtcactagcatattatcattctttaattgtctataaaaaagcggcc

SEQ ID NO: 683 - DNA, 1555 bp, Zea mays
tgcggttgcagcctcttcaggatcatgacaatgaaaaggcgtcccggtcgaaaggacgctttgttctttgtctcgatcgccagagtggagacggcagataaacaccatgtgtagcacgtgcggcattccttgccattacaaaacaaacattcctcactcggccaggacgcacacggcgggagccctttttttaaataattcgaggctagttaactaaactttaaaactgtgtccacagtccacaccacaccacacacacaggagctaatagaacacgtttgcattgtgtgtgtgtgtgtgtgtccacaggccacagcacgagcgatgcgcactagtataaatgagcgcagggcatccccctcccctccccggcagtgcagctggaggagcacctcaccagtggacattgctccagtcccgcgttcgtctcctcccgcgaaataccttccttctccgggtacacagaagagagtccgagaccgctagctacattaacgctagtcccgcacacgcagagtacgtaatgatcccaagagcgccaggtctcttccgcctcgaggagggagtgggtgcccgtgcctcgacctcggcgccagcggcgatggcggcgcccgccggcgacccgcagctcgtcgggctccgcctcatcatccagccgtcgccgaggaagcagcagctgcccgcggtgctcaggaagtccgcggtgaggattgttaacccggccacggcgagcgcggtcaagtgccacgacgacgacgacagcggccggcgggtgttcgcggggctcgagttcctcaagcgctgctcctgctgccacagggacctggacgccaccatggacgtcttcgtgtacaagtaagatatcgatagacgagtgacgactcatcatccctctctctctctctctcgaacccggtgccgcgcgccgcagtccgcaggcaatcggttactcgtgtgcagggcagggggtttcaatttcaattgtttcttccttcccgcagaggagagcaaggcttttgcagcgccgagtgccggtgccgccacatagccaaggaggagcggcgggagatggagatgctgctcaggaagcgccgcgacgcgttccacaggcggcacgcggcggcggcggcgcccaagatgcaggcatcagatcggcgcatcacgctgcaaataaccgccgcacgatgatatatgtgggtgcaacttttttttttttgttgttgccctcttccgtccgctctacggtgtaccactacatacataataggagaggaggcacgatctctctctgtgagtgtggagtatgaaaaccgaacaacactggcagcttgcaacgggtagctcatgctcacttcctgaagaaccaaatctttttcagaccagatatatatcaaagaatatgattttttataatatataacgtagataagtgttttcaagttcgacgatttgctgatcgttctggctgatggacttggacgattagtcatgattagtcgaatggctcggtgattaatcgtgattggtctaaaccgacttagacgatcaatcgcga

SEQ ID NO: 684 - DNA, 1735 bp, Zea mays
ctcgaggccggccgggaaaaactatcttagcacagcagcaccggggccccgcggcgccggcaaatccaactttgataccactcgctgcctggttatggactccaccaggagcaaccaggtcgccggcagatgcagcagcaccatcgcgtcaagggctgccacggtcccgccgtcgctgaccatgccgcgcggcgaactcgctgacgccatcgtgggcggaggcggaggagcggacggggacccccgggccgccctcctccgtctgtctgctctcggggaccgcatggccgccgtccggggccgtatctccgcttctatctcgggcgaagcccggcctctctcctacgccgacatccaatctgtctcctccgagatctccgccgctgcccagctcgtcgtcctcaacgccgccgagctcctcgcttcctccgtcccctttcccgccccacctccacctcctccttccgccgctccctctcccgctcccgtccgagagatcccagttgtggccgcttccgcccaagagcaacccctggaggccgccaaggacgacggtggctacgaggtcgtggagctcgacgccgccgagctgctagcggagcacgtccacttctgcgagatctgcggcaagggcttccgccgcgacgccaacctcaggatgcacatgcgcgcccacggcgaccgcttcaagaccctagacgcgctctcccgccctggtcacggccagccgaagccgcccgttggcagcaacgtgcgcttctcctgcccctttgcgggctgcaacaggaaccgcacacaccgccgcttccggccgctcaagtcggcggtgtgcgcgcggaaccacttccggcgcagccactgccccaagctctacgcctgcgagcgatgtggcggcaagaagcgcttcgctgtcctggcggacctccgcagccacctccgccactgcggcgaggaggcacagtggcgctgctcctgcggcaccaccttcttccgcaaggacaagctcttcggtcatctagcgctctttgaaggccacacgccagcagttactaagccaaacaaggatgtggtgacagggcctacagagtccaccattgatgctatggaggaagggggatttgaagaaggcattcctgaccgggaggaggatgaagagggcggttatgatccagagttcttcaaggagtggatggatgagctcagaggtggtgctggtggctccaattggcctggaccagcagcagatggacattagcaatgttgcgagggttaataggaattattcggcaagccaaccaacctagttgtgatgttatgaatatgtcagcttgattgtctagcaagtcatcctcatacaaaaagtgtaagattcaggtgataaatattataattagtcctattgtggaagaatgtaaacaacaaatgagtctatgactattatcaagagagcagagctagtgctagaggatcccacatgagtggggttgagaggagggataaaccaaggcaagcctccccccaatgtggagagactgcttcgatcccgcgacctggtaactcagtgaagcagctctcaccagtcaccactacatcaggcctgctcctcaagagatgaaacttttttgttaaacttttgccaagaactctgactagaatgaacagcatgtagcttgaattcaatggtggctgcacttataagtgagtttcataaagtaatatttagtccggttttaaa

SEQ ID NO: 685 - DNA, 677 bp, Zea mays
ccccgcgtccgccccgcgtccggcaatgttgcgagggttaataggaattattcggcaagccaaccaacctagttgtgatgttatgaatatttcagcttgattgtctagcaagtcatcctcatacagaaagtgtaagattcagatggtttgacaagggacatctgcttacatcaagtgcccaggaggatcaataaagcctgaataaaggtgatagtaaagaaaagaggtgctttgggatagtttgtaggatttctctttaccattgtgtttgtgcgttcgttctaaccagtagcttgtatggtatggtgtgcgtgtgttgtttagttgctgttcactgggcctctcccttgccattctcggttgctttcatgttatcctgtgaatttgtgatctaccaggtaatacagtggagaaatgtgtcatgctctgtaagcgttctccttggctgtgtgggtcatggagttgccggttacggaggaagaaggatagcttgcaggaaaacggtggcaccagttccctgtgcgctgctgaggatgcgaagtattcgggggagttttagaaaaatactttggttttgtgaaacaatttggttttagagtgtcttgatgtgtttggacgcaacaaactttgtagttttgaaaatcatagtattgctaaattgtaggcttccttctatg

SEQ ID NO: 686 - DNA, 1776 bp, Zea mays
accaaagcgcgtcgtgtcgtgcaaatccaactttgataccactcgctgcctggttatggactccaccaggagcaaccaggtcgccggcagatgcaacagcaccatcgcgtcaagggctgccacggtcccgccgtcgctgaccatgccgcgcggcgaactcgctgacgccatcgtgggcggaggcggaggaggaggagcggacggggacccccgggccgccctcctccgtctgtctgctctcggggaccgcatggccgccgtccggggccgtatctgcgcctctatctcgggcgaagcccggcctctctcctacgccgacatccaatctgtctcctccgagatctccgccgctgcccagctcgtcgtcctcaacgccgccgagctcctcgcttcctccgtcccctttcccgccccacctccacctcctccttccgccgctccctctcccgctcccgtccgagagatcccagttgtggccgcttccgcccaagagcaacccctggaggccgccaaggacgacggtggctacgaggtcgtggagctcgacgccgccgagctgctagcggagcacgtccacttctgcgagatctgcggcaagggcttccgccgcgacgccaacctcaggatgcacatgcgcgcccacggcgaccgcttcaagaccctagacgcgctctcccgccctggtcacggccagccgaagccgcccgttggcagcaacgtgcgcttctcctgcccctttgcgggctgcaacaggaaccgcacacaccgccgcttccggccgctcaagtcggcggtgtgcgcgcggaaccacttccggcgcagccactgccccaagctctacgcctgcgagcgatgtggcggcaagaagcgcttcactgtcctggcggacctccgcagccacctccgccactgcggcgaggaggcacagtggcgctgctcctgcggcaccaccttctcccgcaaggacaagctcttcggtcatctagcgctctttgaaggccacacgccagcagttactaagccaaacaaggatgtggtgacagggcctacagagtccaccattgatgctatggaggaagggggatttgaagaaggcattcctgaccgggaggaggatgaagagggcggttatgatccagagttcttcaaggagtggatggatgagctcagaggtggtgctggtggctccaattggcctggaccagcagcagatggacattagcaatgttgcgagggttaataggatggtttgacaagggacatctgcttacatcaagtgaccaggaggatcaataaagactgaataaaggtgatagtaaagaaaagaggtgctttgggatagtttgtaggatttctctttaccattgtgtttgtgcgttcgttctaaccagtagcttgtatggtatggtgtgcgtgtgttgtttagttgctgttcactgggcctctcccttgccattctcggttgctttcatgttatcctgtgaatttgtgatctaccaggtaatacagtggagaaatgtgtcaaaaaaaaaaaaaaaactccggccctgtgtgggtcatggagttgccggttacggaggaagaaggatagcttgcaggaaaacggtggcaccagttccctgtgcgctgctgaggatgcgaagtattcgggggagttttagaaaaatactttggttttgtgaaacaatttggttttagagtgtcttgatgtgtttggacgcaacaaactttgtagttttgaaaatcatagtattgctaaattgtaggcttccttct

SEQ ID NO: 687 - DNA, 1274 bp, Zea mays
ccaattttgcaaccccacccacttacactcacttctagctctgttctgtacaacttcagggggggaaaatcatctaataactacaaagaatacagcaaacacaaacctagaacccaactatcgaactgtacagattaacagctacatggacaaaccacaaaagaatgaatgaaatcaccgtagaactacaataaccgtcttcttcaggatatacactttacatgtaaagacgaagttgctgctgtcgagtagagagccttaattacagaaatgaacttcagagacgcttcttcagagaaccacttaagtttccatgtatgtactgtgccgatttcctcagactgcttgttttgaggattttggatgctattgtgaaactctcctggcctaccattatccaaaatcaatgtcaaacatttgttgttgcgctgatccatgaccacttctcggatattgctaatagaacaagatgcatcaagagaaaagtatgggggatttgaatcataagggataccaccaaactgatctaggtcctcaatgcacaccaatatggagccttcaatgacaaagatggatctaataaaaagggagtcttcttcaacgtcattcctccagaacatcaacatagagtagagaaatattcccgtatttgcagttctgcgtataatacatttctcgaacaatttgacttggatgttctcccaactttgaaaatgtatcttgtggtttaatttggggaagttagttacgctcaagagccaaagtacatcttgcgcttccttggaagtccttgtgatgaatagatgagttgtatcatctgacatgtgtactctcagcgcctgtagtcccagcccaattgaaactttttctagactttgcagactatagctgcccaaaattcttggcatggtttcttgtccatcaaaaaccatatcaagtagtagcagatacaatttgttttgagaacttcgcagcaaggctacctctctttgaactaaaccacttgaatcctgaaacatgtgtgtgcaacaagctacttgttcacatgtttcaaacccatccttgtccgctatttccaagttgaagaaatcctcaagagtgttgtgttcgcctgtgttaattgtgcaaacagatgaattgttcttatgaaggatattagaagaatgacttttagagccttccttgtgagtactttgcttgggtcgcatgtcaactggccatttccttcaactaaaccccgctcagccacctgatcgtcattcatttggattttc

SEQ ID NO: 688 - DNA, 5000 bp, Zea mays
  misc_feature (1306)..(1306): n is a, c, g, or t
  misc_feature (1409)..(1409): n is a, c, g, or t
tgctattttgggcactttatagaaaaacccttcgttacagatgagactcgcatggtgtcattaaatatgcaccgtaacaaatatatagacaatttttctataatgtagtctttcagatgagactcgcttggtgtcgttaaagatttgcaaaatcacaaggggtcccaaggactgccaaaaacaattgaaatttcgaatgcccgcacggacacgcgttgccctgatccaattccaagatgcacgcgtgacgcttatatataattgcctccggcgcgctcgcggcggcgggacaacacaccaagaccaacactccttaggtcaagaagtaggagctgtaactacaagccaccatgctgctcatcctcgttttcctgctcttcttctccagcttggacctccaaataagtggagcaacgactgacactctcaccttgggccagtctctcccatggaaccagacgctggtctccaagggcggcaacttcgagctcggcctcttctccccgggcaagtccaagaagcactacatcggcatatggttcaagaaggtctccaagcaaacggtcgtgtgggtggcgaaccgggaccgcccgatccttgacccgtcggcctctcgcttcactctgagcaaccgcggcgagctcctcctccacgcgacgccatcgaacaccctgctgtggtcgtccaacgcgtcctccccttcgccgcgcaccaccgtcgccacgctccaggatgacggcaacctcgtggttcggagcaacgcgtcgtcggcccccgtggcgtggcagagcttcgaccaccccacggacacgtggctccccggtgccaggctcggctacgacagggcccgcggcgtgcacagcttcctcacgtcgtggaccgacgcggacaacccggcgcccggcgccttctccatggagatcgacccgcgcgggcaggccaagtttgatctgctcgccggcggcacgcaccagtactggacgaccggcgtgtgggacggcgaggtcttcgaaaacgtgccggagatgcggtcgggctacttcgaaggcgtcacgtacgcacccaacgccagcgtgaacttcttcagctacaagaaccgggtaccgggcatcggcaacttcgtgctggaaacgaacgggcagatgcagcggcggcagtggagcccggaggccgggaagtggatcctcttctgctccgagccccacgacgggtgcgacgtctacggctcgtgcgggcccttcggcgtgtgcagcaacacctccagcgccatgtgcgagtgccccacggccttcgcgccgcggtcgcnggaggagtggaagctggggaacacggcctcagggtgcgtgaggcggaccaaactggactgtcccaacgacggcttcctgaagctgccgtacgccgtgcagctnccgggcggttcggcagaggcggccggagccccgcggagcgacaagatgtgcgctctctcctgcttgcgagactgctcctgcactgcctacgcttacgaggcagccaagtgcttggtgtggaacggcgagctcgtcagccttaggacactccctaacgatcaaggcgtcgcgggggctgttgttcttcacgtccgtgtcgcggcctcggaggtgccaccgtctgcggcgcatcattcttggcgaaaatcaatggtgatccttagcagctcggtctccgccgtggtcctactcctggcgggcctcataatcgttgtcgcggtggcggtggtcgtgcggaagcggcggggaaagggcaaggtgacggcggtgcagggctcgctgctgctgttcgactaccaggccgtgaaagcggcggcgcgggatttcacggagaagctcggcagcggcagcttcggctcggtgtacaaggggactctccccgacacgacgcccgtggccatcaagaagctcgacggcctgcggcagggcgagaagcagttccgcgccgaggtcgtcaccctcggcatgatccagcacatcaacctcgtccgcctccgcggcttctgctccgaggggaacaagagggcgctcgtatacgattacatgcccaacggctcgctggacgcgcacctgttcaagaacagctcgggctccaaggtcttgagctggagccagaggtttggcatcgcagttggcgtggccagggggctgtcttacttgcacgagaagtgccgggagtgcatcatacactgcgacatcaagccagagaacatcctccttgatgaggagatgggcgccaaggtcgcggacttcggcatggccaagcttgtcggccacgacttcagccgcgttctgaccaccatgcggggaacgatgggctatctggcgccagagtggctcgcgggcgcgccggtcaccgccaaggccgacgtgtacagcttcggcctgctcctgttcgagctcatctcgggacgccggaacaacggctcctcggaggcagggtccaactccgctgtgtacttcccggtgcacgccgccgtcaggctgcacgcgggggacgtggccgggctgctagacgacaagatcgccggggatgccaacgcgaaggagcttgagagggtctgcatggtcgcgtgctggtgcatccaggatgaagaaggcgaccggccgaccatggggctcgtcgtgcagcagctggaaggtgttgctgatgtcggcctgccaccgatcccgtcacggcttcacatgctggcgatgatgaataaatgtgccgtcggtggggaagcagaggttgaaccctgttcaaatagcggtagcaaaatagacacagaagtttgaaggtactacgcaggtccgataggtaattgtagtttcagcatgcgagtcccattgttcatatgcctgtttgccgtagctgctaaactgtgattcttcgcaatctgtcgcgtgagttcctttcctgatcaaaccatcgcgcctcctgaggttttgaaccaactttacgaaaccgcccgttgccaaaactgcaaccccattcacttacactcacttctagctctgttctgtacaacttcagggtgggaaaatcatctaataactacaaagaatacagcaaacacaaacctagaacccaactatcaaactgtacagattaacagctacatggacaaaccacaaaagaatgaatgaaatcaccgtagaactacaataaccgacatcatcaggatatacactttacatgtaaagacgaaattgctgctgtcgaggagagagccttaattacagaaatgaacttcagagacgcttcttcagagaaccacttaagtttccatgtatgtactgtgccgatttcctcagactgcttgttttgaggattttggatgctattgtgaaactctcctggcctaccattatccaaaatcaatgtcaaacatttgttgttgcgctgatccatgacctgaatgtacacattgcagaacaaaatcaactttctgaatgaccactcagagtttgtgggggcaataaacaaaacaagaagcacaagcaccctgtgtccatgccatgaatatgataaggactaccatcataactacaatatttcaagactcattaaggtagcaagtcactacccatatatagcagcaccgtaaccacccagacagtcctcggaaaaccttctcatacagattaagaaaccccctaaaccctcgcaccacccatacatagcggtatcgtaggtcatgtgagcatgttaggggccgggacttagacatatgctttggtgtgggacaaacgaggcttccacggagaccccccctaaattttgataatgattaggcaggtaagagcagcaatacaacagccttgtaatagttgataatttgagtatcaatctaaggcaaaaagttaatttcctttcagaacacagtacataatgacggtaaagtcagaaacttatcattcctaagaaaaaagttaatagatggttcgcatattagattttagacaacatatatgatttcgtttgacggagttaagaaatggtatatgaaaataacaatgttgcaaattatcatacaatgaaccagagaatttagaatcgcaaaaaaaatgctacttaccacttctcggatattgctaatagaacaagatgcatcaagggaaaagtatgggggatttgaatcataagggataccaccaaactgatctaggtcctcaatgcacaccaatatggagccttcaatgacaaagatggatctaataaaaagggagtcttctgcagaagaaaaaatgtccaataaggtttcagtaacttggaagagcaatcaagaatattaagtaggaaatgatcaattggagttaagagtgaatatttaggacatgtgacagccaggagttcacatgattgtacctgtatacaagtatacagtagacatctacttgattgactaaatctactaagatttaacgaacgaattatatacacaaagtaatttcccttggataggagtacagggaaagcagctattcccgtgtccgaaccatgaacaggctttagatcccccaataatatcattatcgatgcttgtatatatttctctttctttaccctttttgctggtcgatcatattgggtttcaactctagcataccctaagtttcttgggactaaaaagatatattgttgttgctatataacaaacaatcacttatttgagaccacttaacattggacccatagttaatataaggctaaagaaataaactgaagaccagaccaatgtttgcagcaaaaaagtaattccaattatctactatataaaacaccaatttccagggtttccaccattgtcgtgctccccacatttaaatggtaaaaaaactataattatgtacaaatggagattcgaacaatggttgtttgcttcaaacccacatggccacattcacacccaccacccaacagaacacatgtctttatgttttatactctatacttataaatggaaaccgtagcaacgtgtgtgcactttggtagtttagttacaatgc

SEQ ID NO: 689 - DNA, 1971 bp, Zea mays
attgtgtctaatttataggaacgatgttagcgaaagtcaatttaatttggtgctgaacattgagttgcaacaaatcatcgatggagactgagtcaccgcaggcgaaagtcaatttaatctggtgctgaacattgagttgcaacaaatcatcgatagagactgagtcaccgcagctagaaaccactgtctcaaggtgctgaacattgagttgcaacaaatcatcgatggagaccgagtcaccgcagccagaaaccattgtctcaatttgaggagattttccatctatgtttgttagaaggcataatgctatttatctcttgtattcgaacatttggcaattaagaaatagaagattacttccccaatatcccttcttcctaatctcacctttcacggcttctggggaacaatcacttgctattactgactgacatgttcactcctcatatgtcagatattggtgattgatatatatgttgttcgtttccatgtaattgctgtgcactaacaatatcgaataatttgtacaccgtcacaatgcacgggcactcacctagtagtctaagaacatttttaaaaggctttcttaaatataaatctaaaatcttattttttatcatgcaatagtttctttatgtatgtgtgtttgggagagtttgttttgctccctatttttggtcagccagaaattcagaataaaatatatcaatatttaaagatccaactaaagaagctatttgagaaccattttactaaaatatctatttctattattattgatataaaatggtatatcaagaagttttttttgaagttactcttataggcagtggcatagtttataaaatgtctattattttaaaatatctatttctattattattttaatattacaattctttggttcataaatgatgttggtttttcctacaaaattaaccaaactttgggtagtttgactaactttatgaaaaagaaatatctataataatactaaacaaatacactaaaaataagttttatgatatatccaatgatactaatcgggtgccttcaatatatatgcacattctctataaattagattaacttatactttgatttgaggacaacgactttacaagctatttttggatgaagagagcattttgtaaagaaaaacattgcaacttcgtaataatccaaactatcgtgcggagtccatctaatctaatctaatcaaggttgacttgcgttgccaagtatcaacctggctagcgcgcgctgacatgattgctggtggagtactggttaacgtgaaaaccacgggcacacgggtaggtaaaactcaaaaccggtacgtcgtttcgtctgcatatgcagcatgcgtggtgtgtgcctagctgctgatgcgttgcacatctggccccagtcctcagtgcacactactgctggagcacacgcatgcattgaatggagctggcgcgggcgcagcgctgtgacgcacataccaccaggccgtgaggtcaccggcaactgcactgtactgtacgcaacaacgtgcatgcctgagggtcgccggcgggtactgcgcagctgcgccggccgctgacaggatcacgtagggggcacgtactatagtagcagactagcagcacgcaggccgccggtaccactccgagtgagcatagtgatgtactgatgtggctgggagacggccgcagacattattatggctcgctcgaacgctccatcgcttccgtgcgcgcagcatggctctgtgccatcgttctctgatgggcaggagcaggggcaggatccagcttacatatcatggtgccatcataagctcggacgcagtcgccatgccagcccatacgtaccgccgcgcgctactctgtatctctccggccggcctgtacgtaacgtcaaatcgacacgtactatgaaccctagcaaggaccagctggcgttgaagaaccgatatagaag

SEQ ID NO: 690 - DNA, 3178 bp, Zea mays
aaagaagggagcccagacaattcaaatccctactaaccgagggccgaggcttccgtttgaagactgggcgtgcggtcctcctccgggcggggctctcgcgcggagagatctccgagcatccttgctactcccgttgtacggcacgcgggagtggggatggaaccggcgatttcaaaaatttccctcccacccaatgatcaggtaaagggatgggtgggcaaggtacaggaaacactgtctctgttcccctgctagggaaggcactgtccctctccttgtaagttttcctgtgagctctctgctgctgttcaaggagctttatccggtgatagtatcaaagcaccaagatgaagtccagcgcggttactacaaagggcaaggctatatttgagctcaagcacaagctggtacaagctgttaacaagattgcagacagagacacttaccagattggattggatgagatcgagaagatggcggataccctggcccctgacatgattggccccttcttgtcatgtgtcattgatactgatgctgagcagaagagtgcagtgcggaaggagtgcatcaaggtgattggcacactggcacgactacatggaaacctattggcacctcacatggcgaaaatggtgtccagtgtagttaagcgcctgaaggacaccgattcagttgttagagatgcatgtgttgacacttgtggtacccttgcaatgtgcgccagaagttatggggatggtggtgcagcgttggtgacattggtgcgccccttgtttgaatcactgggtgaacagaataggtatattcaggctggggcagcactgtgcctggccaaggttatagatgagagcaattacttccctgggcctgtgctcccgcagatgcttgttcgtgttgttaagctgctcaagaacccccacttcatggcgaagcccgctgcgattgacttgataagaagcattattcaggctgaaggtgcttccacagagcaggcattatcatcagctctaacaagtattatggatgcgctgaagagtactgactggaatacaaggaaggctgcctcactagctctttcaagtattgcggtcagttctgggtatttggttacctctttcagaacttcctgccttcgctcccttgagcgtggtaaatttgacaaggtaaaaccggtacgtgacaccattatacatgcaattcagctgtggaaagctattccagggtctcatactcctgaaccatcagaagctggatcatcaacaaaagagaactactttggagaccatcatgacaccagaagtatacatgatggaggatcaagagatacttcttttaggagaacagatcatgggccttctgtatctgttattagtggtagttctctcagttcagcaaagcggaggtctcctttatctattaacaaagtagccataaacaatgctgcaaatttgcaacggatgaagactggtgattggcgtgttgaggtgtcagttccaaagcagagtatgataccgctggttaataatgacgagaagggatccagtaaagcctgcagcctaaaagatacaaagagaaatgcatatgaaagtgttgatgtagacagtaagtttgactatgacattgtagatgataaacaagaatgctcctctgtgtcagaagtagccagcaggagttttgagacaaagcatgtcactactgctcaggaatgcactgaagattgtgattcagcagaagttacagaacaatgtcccaggggtcgagaaagtaagagcataggctcaacaattacagatgttactactcatgacacacatagttgttgtctgaatactatgaatgaattggcccttgttaggaagcaacttcaagagatggagaggaagcaagcaaatttttttgatttgttgcaggaatttatggccagctcagcagagaacatgtcagtgctaaatttgaaggtgcacaacttggagaatgctgcagacaaaactgtatatacaattactcagagcgaaagccggtatcatcttcctggctccaagcattttaagaaccaaagcgtctcttctttgcctaggctttcgacttctacacctagatcatctatggatgttaactacaagccaccaccaaactcagagttgaaacatgagaagtggatgcgtgatctaccatctcggggctcaaacatgtgttgtaaagagggagctgattttcgaaaggatcatgttcgcagtaaagttaggaagcttgggcctgtgagcttagaggataacttgggaagatgtgatccaagcccagcaagaagtcgaacatcaggggttaaagggacttatccagtttcatttaccagttcctgtgaacaatctggactgcgaaatgcattgtgcacctcaaatcaacctggtgagtttcaagatactgatggcatggaacctgcatacatggaagccctgaactgtggtgattatgatgatctgattgacctaatggatagaactggaccagttctcgaaaagttgtcgtgtgagacgacaaatgagcttttgagggttatagctgaacaatttcttaataagaagttctttgacttggcactgccttggcttcaacagttagcagatttaagcacgatttataagccaactcaactttttgcatctgtgagagcacaaaaggagttcctttctgcattggaggaagctgcaacgggtggatctatggaaccagccttgaggattgcaattgcacagctcggatttaaactatccaaagcttttgaggttggcccatgcaggaaaatctcagccagaatgtgcagagaaaatgaaactatcatgaccaatgcaatgtgagatgtttcttgtctagtatatgctcaggccacgaaaacagtgctttagggagcttaagttaatttcttgtagcagcacaacctttgtaacttgtcgtatgatctgtttaattagcgtgtgaaaggctagaagatttcaatagaggttgatagtttggtagtttaaaacatgcgtgctttggttctctactgtaggactggaaacttttgctgtgtagcaatgtggcatgacttatgtttggtgctttcagacggggccgtacagatttttgcttgaattatctcactctgaaacactatcgtacctaacccaatgctttc

SEQ ID NO: 691 - DNA, 2210 bp, Zea mays
tcgggcaccccgtcgccggcggccggccgggaagcatcagccccccaccagttggaacctgtctgtatgcggcactgcggcgcccgtggggcccaccacggcgccgccggcagcgtcaccaacccccacccccacctccgccctcccaccggcactcccctcgcctgctccacgacgcttatgcgctcgcgtcccgctctcgccgcccacctccggcgcctgctcctcctctctccctccgcccacctcatcatcatccgccgcgccatggcatccgccgccgccgcgcaggcgcagccaggtggcgccccgccggcgaccgcggagtacgaggaggtgctggggcggctctcctcgctcatcacgcagaaggtgcgcgcgaacagcgccaaccgcggcaaccagtgggacctcatggagcactacgtcaagattctggagctggaggagtcgatcgcgcggatgaaagtgattcacgtcgcggggaccaaggggaagggttccacatgcacattcaccgagtcaatcctgcgatcgtgtggcttccatactgggctgttcacctcaccacatttgatggatgttagagagcgatttcagctagatggggttaatatttctgaagagaaatttttgaagtacttctggtggtgctggaacaagttgaaggagaagactgatgatgatattcccatgccagcctatttcaggttcctcgcgttgctcgcattcaagatattttctgctgagcaggtagatgttgctgttctcgaggttggcctaggagggaagtttgatgcaactaatgtggttaaagcacctgtagtttgtggcatatcttcccttggatatgatcatatggaaattcttgggaatacacttggagaaatcgcaggagagaaggctgggattttcaagaaaggagttccggcctatactgctccacaaccagaagaggcaatgactgctctcaaacaaagagcttcggaattgggtatctctctccaagtcgttgatcctctggagccccatcacctaaaagatcagcatcttgggctgcatggagaacatcaatatataaatgctggccttgcagttgctttggctagtacgtggcttgagaagcagggacataaagatacgttaccactcaatcgtactgatcccttaccagatcattttattagagggctatcaagtgcttctttgcaaggccgagcacagattgttccagattcacaagtgaattcagaagagaaggacaaagattgttctcttgttttttatttggatggagcgcacagtcctgaaagcatggaagtatgtggcaagtggttttcccatgtcacaaaggatgatacaaggctaccatcttctgtggagcagtctcatacatctaggtctcaaaagatccttctgttcaactgcatgtctgtgagagatccgatgagattgcttccttgtctcctggatgcatcaactcaaaatggagtccactttgacctggccctatttgtgccgaaccaatcacaacacacgaagcttggttctaacacttcagcaccagcggagcctgagcaaatcgatttgtcatggcagctgtcacttcaaacagtgtgggagaagttacttcaggataaaggtataaatactacaaaatccagtgatactagtaaagtttttgattcgcttccaatcgcaatcgagtggctaaggagaaatgcccgagaaaaccaatctacttctttccaggtgctggttactggctccctgcatctcgttggggatgtcttgagaataatcaagaagtgattcgccgctcgaaatccaaactggaactggactatgatctatggtctctcccaaggctaacatgattagcgaggggagacatttgaacggtgcttgcttattggtgccaaccaagctgcgagcttcttgtgttttttttgtggccacggtcgccttccactcgggaaaccaccgcgcccgttcttgtgaaggcatgaaataggatgatcgtgccaccatagaacataactgggaaatgaattcgacatggaactgggacagtctgtatactcacaaaataagatcgcatggggttttcttcttgaaatgcaaagaaaccactcattcttctccagagtagcaagaattcattcaaaaaaaaaaaaaaaaaagggccccttgtttttttctcccaatcc

SEQ ID NO: 692 - DNA, 2438 bp, Zea mays
  misc_feature (2)..(2): n is a, c, g, or t
anaaactcggaacccccggcgcggggatttaaagaaaggaaaccgttttcgatttccttcctacgcgtctcgcgttggcagcgcgatccttcggagccgacgaatcccaccaggccaccactgcccgcgccgccttcgcagacgacgcaactgacagtcaccgacgcgacgcggctcgcctcctccgcccttctgttcagcctcctcgcccgcgatggctccgggcgccgacgccggctacggccagtgggcggcggcgtgccccccgctgcggcggaacctgcagctgctttcgcccgacgaggttgagctagcaaaaatgctgttgaatgaaggccagattcacctgttcgaacactggcctgaaccaggtgtcgatgatgacaataaaagaggcttctttgatcaggttcgccgacttaattcaagctatcctggaggtctggtatcttacatccagaatgccaaaaaacttcttgcggattcaaaggaaggcaaaaacccatatgatggtttcaccccttctgtgccttcaggggaggttttgacttttggcaatgacaattttgtttcactggaaacagctgggataaaagaagcctgcaatgctgcatttgttcttgtagccggagggcttggcgaaaggcttggctacaaaggaattaaggtagcacttccccgggaaacaactactggaaaatgtttccttcaacactatatagagtctatcctggcttttcaagaggccagctgcaaaatggttgatgaggggtgccaaacaaagattccatttgttattatgacttctgatgatacaaatgcgctaactatcaagcttttagagtcaaactcctactttggaatggaaccatctcaagtgaaaatactaaagcaggaaaaagtagcgtgtctagctgacaatgatgcaaggcttgcattagacccaagtgacaagtacaaaattcagacaaagccacatgggcatggagatgttcattctcttctttattcaagtggcttgcttgaacaatggaagactgaaggacggaagtgggttctctttttccaggatacaaatggattgcttttcaatgcaataccatcagcattaggtgtcagtgccaccaagggttacaatgtaaattctctcgctgttcctaggaaagccaaggaagcaattggaggaattaccaaacttactcatgtcgatggtagaacaatggtcatcaacgtagagtacaatcagcttgatccactccttcgtgcaactggacatcctgatggagattcaaattgcgagacaggctattctccatatcctggaaatataaaccagttgatactggagcttggaccatatattgaggagctcaagaaaacacatggcgccatttctgaatttgtaaatcccaagtatactgattcgaccaagacagcatttaaatcatccactcgtctagaatgcatgatgcaagactatccaaagacgttgcctccctcagcaaaagttggattcacagtgatggatacatggcttgcttacgctcctgtgaagaataatcccgaagacgcagctaaagttccaaagggcaacccttatcatagtgcaacatccggagagatggcaatttacagggcgaacagccttattttgagaaaggctggtgctcagatagctgatcctgttgttcacaccttcaacggacaagaggtagaggtttggccacgcgtaacctggagcccacggtggggtctcaccttcaagagtgtcaaggagaaagtgcacgggaactcttcagtttctcagaggtcagctttggtcatcaatggtcagaacgtcttccttgaaggcctctcgttggacggcactcttgttgtcaacgccgtcgatgaagcagaggttaaacttaccggtcatatacagaataaaggctggactatccagcatgtcgactacaaggacacctcggagaaggaagagatcaggatccgcggatttaagttggagaagattgagcagctagaggtgaactacacggagccaggaaaccatagcttgagtgcatgaaacaaaacattcttggttgacccgactagcttcctaccgattgggaatagttcgcattgcctcccagattctgggaggccattgccagcataagttgaagctgttcttctccttgccaaagaattgtactccctcagttgcattttagttcaaaattaaactagtggacaacaaatatttaagaatggtggtagtaataaggagccaaatatttaagaatggaggtagtaataaggaagccaagtgcttcaccaatcattccaaattcaatattctttatgtatatccgtactatttcatagccaaacgttttctcctcaccagtgtaatcggagttgattatttatctgggatctgatgttcatgttac

SEQ ID NO: 693 - DNA, 2638 bp, Zea mays
cgacgcgacgcgggtcgtctcctcagccctcctgttcagcctcctcgccagcgatggcttcgggcgccgacgccgcggcgctggtgacctccggcgccgacgagtgggcagcggcgtgtccgccgctgcggcggaacctgcagctgctcgcgcctgacgaggttgagctagcaaaaatgctgttgaatgagggccagattcacctatttgaacactggcctgaaccaggcattgatgacgacaagaaaagaggcttctttgatcaggttcgccggcttaattcaagctatcctggaggtctggtatcttacatcaagaatgccaaaaaacttcttgcagattcaaaggcaggaaaaaacccatatgatggtttcaccccttctgtgccgtcccgcgaggccggccgcttcggcgatgacaattttgtttcactggaagcagctgggataaaagaagcccacaatgctgcatttgttcttgtagctggagggcttggtgaaaggcttggttacaaaggaattaaggtagcacttccccgggaaacaacaactggaaaatgtttcattcaacattatatagagtctatcctggttttacaagaggccagctgcaaaacggttgatgatgggtgccaaaaaaagattccatttgtcattatgacttctgatgatacaaatgcactaactatcaagcttttggagtcaaactcttactttggaatggaaccatctcaagtgaaattgctaaagcaggaaaaagtagcttgtctagctgacaatgatgcaaggcttgcattagacccaagtgacaagtacaaaattcagacaaagccacatgggcatggagatgttcattctcttctttattcaagtggcttgcttgagcaatggaagagtgaagggcggaagtgggttctctttttccaggatacaaatggattgcttttcaatgcaattccgtctgctttaggtgtcagtgccaccaagggttacaatgtaaattctctcgcagttcctaggaaggctaaggaagcaattggaggaattaccaaacttactcatgttgatggtagaacaatggtcatcaatgtagagtacaatcagcttgatccactccttcgtgcaactggttatcctgatggagatacaaattctgagacaggctattctccataccctggaaatataaaccagttgatactggagcttggaccatacattgaggagctaaagaaaacgcatggtgccatttctgaatttgtaaatcccaagtatactgattcgaccaagacatcatttaaatcatccactcgtctagagtgcatgatgcaagactatccaaagacgttgccaccctcaacaaaagttggattcacggtgatggatacatggcttgcttatgctcctgtgaagaataatcctgaagacgcggctaaagttccaaaaggcaatccttatcatagtgcaacctcaggagagatggcaatttacagggcaaacagccttattttgagaaaggctggtgcgcagatagctgaccctgtcgttgataccttcaacgggcaagaggtagaggtctggccacgcgtaacctggagtccacggtggggtctcaccttccagagcgtcaaggagaaagtgcatggcagctgttcagtttctcagaggtcagctttggtcatcgatggccggagtgtcttcctcgacggactttcattggacggcacccttattgtcaatgctgtggatggtgcagaggttaaagttactggtcatgtagaaaataagggctggactatccggcatgtggactacaaggacacctcggagaaggaagaggtcaggatccgtgggttcaagttcaacaagtctgagcagctagaggtgaactacaccgagccaggaaagcatagcttgagtgcgtgaaaagaaaacattcttgacctgactagcttcgtaccaaaatggaaatagctcacatctgggtcgcctcccagattctgggagggaggccaatgccagcgtagctgaaaccgttcttctccttcccccacgtacaacaaggagcaaagtgcttcaccaagcactcaacattctttatgtatatcttgtacagaactcctcttcagtgcaatcagagttcattgtttgtttgggatctgatgtttatgttacaattttttattttagaaaacttggcactgaatcaagtaataagtgtggtagtgtgtagaagtatagtaacgggctataagcctacttatgtggcattttttgtctgtgtggatgagagacattaaaaagtggaggtgggctctcatgcaagagtcagcttctatatgagctcttagataaaaggatgaaatagaaagatacactataatgatctaagagtcaactttgtagcctgctttagtatatgtgttcttattgttggctctacataatatggcaatgatttagagttcactgtaggagtggtataccggataacacatcttttttcgatagcatgtaaacaatggaataccctagttatatcataggaaatggagagcaataccctatgttgacatgagtctttgcaatccttttagggctggtttgttgacaaagaaatggagaggatgagggaagaa

SEQ ID NO: 694 - DNA, 1453 bp, Zea mays
aggaacccattcccaattcccctctccggccttcgccgccgccaaggcacgaagccagagcgcgacgacataaatcgtgggagcgcccgcctttgaatcggtttcccccacgccatgtcctccccctgcgtctcgcaccaacagcaggtccgtctccgtctccgcgctgccagccgccttcccgccccagacacggcctcgttcgcgccgcccgcgccccggcagcttcggatggcgcacgcggcgatgagcgccaaggcgcccctcggcgtggcgccgacggaggagggggccgggacgccggggcagcaggccgtgctggggtagatggtggaggatgccgccgtgtggtgcgccgtccacgggctcgtcatcggagatcgcgccaaccagagatcaggaacggtccctgcggttggcctggttcacgctccattctcgctgcttccagcgcgttttccggcatcgttcttcaatcaagcatgcgagctggctcctatcttcaatgagctcgtggatcgtgtcagcttggatggggagttcttgcaagctgctttgtctagaacaaagcaggttgatgaatttacttcaaggctgctagaaattcatgataagatgatgtctataaataagaaagaggatatacacttaggattgcaccggtctgactatatgctggattccgaaaccaattcactacttcaaattgagctcaacactatcccatcatcctttcctggccttggctcccttgtcagtgaacttcaaaggttgtacaaaatgatattccaccagaaagcatggatgccatgcgccctgtgcagcagcacttgccaacacggacaagcactccagcctccaaaatgaattaccttccaaaggatgcacagaacatggaagtgtctacaccagtacccccaataaatccggaaggaaatgatgaggacgagactccaaagaacactgtctctagaaatggtggtttcctgcagaatgcagttgggcaagacctagtccatcttggcgttgcaagaacagcaagtggttgcccttcggctgtcgcttccggtgttagcaccagacaccagcacaacagaatggatcttgatccagcatccagcagcgtggataatttcaaaacaccagaacttacaaaagaaaacggtctcgaggaggatgggaaaggagagagtagtatgtatgatgagaggcaacctaagagaaggaagcgtacccttatgaataatgagcaaatagatgaattagagaaggctctagtagatgagcctgagatgcacaaaaaccctgttctattgcagagttggtcagagaagttaagtctgcagggcccagagatcacaacatcacaacttaaaaactggtaaaactgtgtatcttaaccgttgtttgaagtttctttcttcaaaaaaaaaaaaaaaatttttgtgcttct

SEQ ID NO: 695 - DNA, 3073 bp, Zea mays
ctctgccactcctgctcacctccgccgaccgccatatcctcctctacatccaccgccgctgccgtataggtcccgtcccctcgtcgccgcggctgcgctggtggggagcggagcggacggacggagatccgcccgcctcgggctccgctacgccggctgaagatgatagccatggtgtctgctgttgaagagcttagttggttaacctctaaagaacttggtgagatgctcagggagtcagacaactttgttttgcagtccaagatagaagacggaggtccaaagcaagtacttgtggacatggaaaaagttgtgccctcgcttcctcttcatctccttgctgtatgtttggagcttgggcaaggcccggacttgacctatgtgcttcgtggcatccgttttttgcatagtttgtctgatctagcatcccgccatactagactggagcaggttctccttgatgatgtcaaattatccgaacaagtcatggacctgatattctttctactttctattcttgctgaacagaaggagaataacaatgttggtgcttctccgcttgtgcatgcgtcacttgtagcaggtagtcttcatctgttgacaaattacttctcttcccagtggcatgaacttgtccatattctgcttgcacatccaaaggttgatatctttatggacgtggcctttgatagtttgcatgaagatgtgaggctgttaagtatcagattatcatcaatgggcttcggtttctttcctgttggttctttggaatctcgtcttgctcacttcatctgtcaacagtgtgaagcatcattgcaatttctcttgttgttgtgccagcaaaagctatttcgagatcggattttaaaaaataaggaactctctagaaacggaggcatactgtcactttctcacactatactgaagttagttgtccctgaatgtttgaagcaatcaaccgaccttgttgcttctatttccaggctcaaggcaaagatactttctattctgttgcaactttgtgaggctgaaagtgtctcttaccttgatgaagttgccactaatccaaataacatgcggctagggcaaaccttggctctagaggttctaaatttgctgaagatttcatttggaagaaaaataaacattacttctgattctcatgacaagggtaagatttaccccatgggatctgtgcttatcagtgcattgcgtcttgttgatgtcttctctgatgattcgaacttcagatcattctttttgaccaacactgttccatttttaatccagattctagctgctcctcacgatgaatttgtttcgagttggtgcgctgtcaacttaccaacaattgaggaagatgcaagtctagattatgatccttttggtgcatctgaggtggcactattagcttctgataatatgttgactgaagctaaagctaactattcttgcccttttcgccctagcgtgccttcaatggcatatgcacagacaagaacatcatgcgtagtgaaaataatagcaaatttgcatgtttttattccaaacatatgtgaagagcaagaaagggatctttttcttcagaactttcgcacgagaccattacctagaacatcctaatcgaaaacagatctgccagcttctagtgattttaaggccactaaagtctgtagaaacttaggatttttgtctgattatgctaaaacattggttcctaatttgttaaatggggaagacttggtgttattaagtgattttgctgataagctacaatcttggtgtaaatcacaagttgcagtaaaggttgtacaaaatgatattccaccagaaagcatggatgccatgtgcccggtgcagcagctcttgccaacacggacaagcactccagcctccaaaatgaataaccttccaaaggatgcacagaacatggaagtgtctacaccagtacccccaataaatccggaaggaaatgatgaggacgagactccaaagaacactgtctctagaaatggtggtttcctgcagaatgcagttggccaagacctagtccatcttggcgttgcaagaacaacaagtggtggcccttcggctgtcgcttccggtgttagcactggacaccagcacaacagaatggatcttgatccagcatccagcagcgtggataatttcaaaacaccagaacttacaaaagaaaacggtctcgaggaggatgggaaaggagagagtagtatgtatgatgagaggcaacctaagagaaggaagcggacccttatgaataatgagcaaatagatgaattagagaaggctctagtagatgagcctgagatgcacaaaaatcctgttctattgcagagttggtcagagaagttaagtctgcagggcccagagatcacagcatcacaacttaaaaactggttgaacaaccggaaagctaagcttgctcgcattgcaaaagaaagggcggagaatgctgataaaccatctacttcccatcccggcgagtcttcagaaagtgccggggaggacaactatctaccccctgcaggtgtgatgactgttctatccaaaggtggtagcctgttgagcccggactgcactgagcaaacgtcgcaggcagagctatccccgaacacgacgatgatggtccgtccattcacgagatccttctcgttggaacccggccgcctcgtttcattagtcgacagcgatgggaaggaggttggcaggggcaagatcttccaagcgccagggaagagcacaacggagagccgcgtttgcgtggttgatgtcactgagctcaggaccgagaagtggagggagctcccccacccttcggaggcatttgggtggacgttccaggaggcggaggcgaggaatggtggcatcatcagggtctcttgggacgccgtcaggttgttccctgtagcgtagcaaggccgattgtataacaagatgagtagagggaaactgtggcctaagtaacattatgttaaaagctgtggttaactgtgttgtattcatgaactaattgttttgagcaattcaggtggttactgattttacatttttt

SEQ ID NO: 696 - DNA, 2153 bp, Zea mays
  misc_feature (2098)..(2098): n is a, c, g, or t
  misc_feature (2109)..(2109): n is a, c, g, or t
gcaaatagatgaattagagaaggctctagtagatgagcctgagatgcacaggaaccctgttctattgcagggttggtcagagaagctaagtctgcaggtattttacacttgggcattctcttcttaggtctaattactgaatgcattctcatttatgaaaaacacggccgtgcttttgtagggcccagagatcacatcatcacaacttaaaaactggtaaaactgtggatcttctttggtcgtctttatttgaagtttctttcttagaattctattgtactgttttttttgtgcttttcatctatagctgttcgtaacagtgttctcatgccaattccaggctgaacaatcggaaagctaagcttgctcgcattgcaaaagaaagagggacatttgagggagataatgctgataagccatctacccctcatcccggcgagtcttccgaaagtgctggggaggacaactatataccccctgcaagggtgatgactgctccatccaaaggcagactggtgagcccggacggcaatgagaaaacatcgcaggcagagctatcccccaacacgatgctgatccgcccattcacgagatccttctcactggagcccggtcggctcgtttcactagttgacagcgacgggaaggaggttggcaggggcaagatattccaagcgccagggaagagcccagccccagtggagagccgcatctgcacggttgatgtcaccgagctcaggaccgagaagtggagggagctcccacacccttctgaggcatctgggaggaccttccaggaggcggaggcgaggaatggtggaatcatgagggtctcttgggactccggcaggctgttgcctgtagtgtagcaaggcagaaacttttcgtcaggttgctgtataccgctaggcacaaggtgagcagagggagcctttggtttagggcgagagactggatcatgggattcttgggggcctaagtaacactgttaaaacctgtggttaactgtggtgtatccatcaactaattgtctcaagcaatgcaggtagagtagttactaattttaaaaaaaaaaaaaaaaggcggccgccaactagtgagctcaaccaatgctgagcgatggagttgcatgtaaataattcagcactagaggaaaccaaaggggctgcataatgaactttagcttttattgtgggaaaaaaggtgatagcgttcttcatgttcgatcaattaaacagcaccagtaaattgatcatagggatgtggacttgctgaggcttgagtatatatggtgttcctcgagcttccttaaacaagcatgaagtttgtaggcacttcatcacttgttggtgagctacagtaatcttgagcccgaccctataaataacatggttcttaggctcgttaccaaaatgagcattacattacaaagcagcttttagacatatattggccaagaagatgttggagagaaatataagtctcaaatgttgagtgatatgttgcttcgtgaattattctcaaacatttaatgacgaggccacatacgaatttctccattgatttttttcactaaagacaccatacactgacaatgatgagatattggagagaaacaaaagtctcacataattttcattgtatatcatttgtgagattccgaactattgtttttatacaggtcaacatgctttagtttttgttaccatagtagttgtgagtaaattggttataacaagctaacgagcatcaaaggtcgcttcattcaagataattttatgttgctttaacaaacaaacaaacaaacaaataggtttcttcatcggtagagacaacaaaggttgatgttctagtgattgatgtgattggtcagttttttctaaagcagatgaaaaaagattgttgcagcctctttcttctaggcgtttgcaacaccgtatctctatgccgcaatgtggttctctttatacattctgtggtggaggatattaatgttgctttagacatcctacacctttttgtagagacttttgtgctctagaataataaccataaatccaacactgtatctctctttatgacatcctacacctttttnaagtcaaaggnaagttgtctcctcggtttattgggtccttcaaaatcctaaagcg

SEQ ID NO: 697 - DNA, 1872 bp, Zea mays
acggcccatctggccatcagattagcaagaccaacaaatgcaacactgatacgttcccttagaacccacctcctatggccaccgtcgactgccccctgccctctcccgcggacctcgacgacaacggattcccggctctaccctcatcccccgctgcctgtagcagcggcttcgcggaggacttctaccgcagcggcaccgactggtcctccttacgcgcccctccgccgctggggccgcccagaaggcacccggtgtgaaggagagaggaggcggctcggccgtgcagagcagcctcttccaggcgtgggggatcgagaagccgcggcgggacgggcgtggggctggattcatcgcttgtgcagaggagcctcttccaggcatgggggatcgagagaccgcagagggagggtctcggggctggagattcctccccctcctcctccctttccggttctttgttggcaaggaagcggaggcgaggaagcaccgaggaggagcgggtggcggccaagaagcccctcgcgtgccccttctacaagaagattcctggcacaccattcacggtggatgcatttcggtatggacaagttgaggggtgctcggcctatttccttagccactttcatcatgaccattacggtggattaaccaagaaatggtgccatggccccatctattgttctgcactcactgcacgcctagtgaagatgtgcttgtcagtaaattccgagtatatctgtcctttggagcttgataccgagtatgtcatagagggagtgacagttaccttgttggaggccaaccattgccctggtgcagctctaatccacttccgactaagtgatggaaagacctgtctccacactggggattttagagcatcaaaaactatgcaatcgcatccacttctccagagaggccgagtaaatttggtttacctggacacaacatattgcaatcccaagtacaagttcccaccccaggaggatgttattgattttgttgtgagaaccactcaaagatatctaaagaaacaaccaaaaaccctcattgttgttggggcatatagcattgggaaagagaatgtgtatctagcaatttcccaagctttagaggcccatatatacaccgatgcatcgagaaggcggattctctactcatttggctggccagatttgtccaaaaggctatgttcatgcaatcaaagttcaccacttcatgttctgcccattggatctataaatcatgagaacttgaagaagtacatggagactcttaatggaagattcctagcggtgctggcttttcggcctacaggttggactttctctgaggcaactggaaagcatcttgacctaataaaaccaagctctaatgccaatgtaacaatctatggtgtgccttatagcgagcattcaagtttcactgagcttagggattttgtgatgcttctgaaacctcaaaagataattcctactgttaatgttggcaatgcgacaagccgagataaaatgcaagcacatttccgggaatggctgaagagcccgtgataaatatatcctggtcatgatttttctgtatcggcgtcaactcgactccactcaatgagtgacacagtcatggtacggaaaagaagtggatatatttttaaaggttggtttgcttggtactaaaaatgctatgtttagagtaccacttttcccaacattattccgagattcgttttgtggaacttatctcttttgagaggtaaatgtgttgtttctcgctagtctgaaaatttctttgcacggaaattgtaagatgaagaaatattgatttgaattactgtttatcaaatcccattatcagcgaaaaaacaaaaaaaaa

SEQ ID NO: 698 - DNA, 2453 bp, Zea mays
ccatcaggttagcaagaccaacaaatgcaacactgatggcgccccctccggccgagttccgggaacccacctcccatggccaccgtcgactgccccctgccctctcccgcggacctcgacgacaacggattcccggctctaccctcctcccccgctgcctgtagcagcggcttcgcggaggatttctaccgcagcggcaccgactggtcctccttacgcgcccctccgccgctggggccgcccagaagggcacccggtgtgaaggagagaggaggcggctcggccgtgcagagcagcctcttccaggcgtgggggatcgagaagccgcggcgggacgggcgtggggctggggattcatcgcttgtgcagaggagcctcttccaggcatgggggatcgagagaccgcagagggagggtctcggggctggagattcctccccctcctcctccctatccggttctttgttggcaaggaagcggaggcgaggaagcactgaggaggagcgggtggcggccaagaagcccctcgcgtgccccctcgccccggcgatccctggcacaccattcacggtggatgcatttcggtatggacaagttgaggggtgctcggcctatttccttagccactttcatcatgaccattacggtggattaaccaagaaatggtgccatggccccatctattgttctgcactcactgcacgcctagtgaagatgtgcttgtcagtaaattccgactatatctgtcctttggagcttgataccgagtatgtcatagagggagtgacagttaccttgctggaggccaaccattgccctggtgcagctctaatccacttccgactaagtgatggaaagacctgtctccacactggggattttagagcatcaaaaactatgcaatcgcatccacttctccagagaggccgagtaaatttggtttacctggacacaacatattgcaatcccaagtacaagttcccaccccaggaggatgttattgattttgttgtgagaaccactcgaagatatctaaagaaacaaccaaaaaccctcattgttgttggggcatatagcattgggaaagagaatgtgtatctagcaatttcccaagctttagaggcccatatatacactgatgcatcgagaaggcggattctctactcatttggctggccagatttgtccaaaaggctatgttcatgcaatcaaagttcatcacttcatgttctgccccttggatctataaatcatgagaacttgaagaagtacttggagactcttaatggaagattcctagctgtgctggcttttcggcctacaggttggactttctctgaggcaactggaaagcatcttgacctaataaaaccaagctctaatgccaatgtaacaatctatggtaggatttgttggttatactgataatacttttcctctcatttattgctaatgaatggtcaataagaacccaaactattccgaacaagatttttttagtataaacagtctggacttatcctttgtcaaatatagactgagtttattgatctcctgaatttaaaactcggctgtggagggaaagatcggtctcccggtattatattaagaagagaccgaaatatggtcccggccgagaaaattcccgaaccttggcccctcatcattagcgggccgtcaccgcccactctgcaacggcccaaccggagggtaacgcgcaagacgtaacccagaagcggacggagcacaacgaggggattttttaaccaagcccgaaatttgcccccgagggggatcgaacccgagacctgtctagggtgtgccttatagcgagcattcaagtttcactgagcttagggattttgtgatgtttctgaaacctcaaaagataattcctactgttaatgttggcaatgccacaagccgagataaaatgcaagcacatttccgggaatggctgaagagcccgtgataaatatatcctgatcatgtttttttttctatatcggcgtcaactcgactccactcaatgaggtaccgctgtataccatccttacactcacagttcactataacgcctcttttcttccctttatttgttggacttcaacgaatgttgattcttttatgccagtgacacagtcatggtacggaaaagaagtggatatatttttaaaggttggtttgcttggtactaaaaatgctatgtttagagtaccacttttcccaacattattccgagattcgttttgtgcgacttatctcatttgagaggtaaatgtattgtttctcgcttgtctggcatttctttgcagcggaactgtaagatgaagaaatattgatttgaattactgtttatcaaaacccattatcagcaaaattttgcctactattctgtcttccttttatttctccaaaacacttggggggtcgttttatggtttttatgcttt

SEQ ID NO: 699 - DNA, 2070 bp, Zea mays
atcgctctctcctttgcacccctagctagctagtactactgctgctcctccgacttgctcttcgcgcagcaggacggagaaacaagaaccatccctccccctaccggctaccgctgctactcatggtcgcgcgcactgcctcctggtgccgccgcgtatgatccagacatgaatagggcgcacagcagcagctccaagctcatcaacgagaagctcgtggaacaccggatctccactgcgaagcactgcccccactgcggcgagaaaatcgacagcaaaccggattgggtggggctgccggcaggcgtcaagttcgatccaactgaccaggagctgatcgagcacctcgaggcgaaagtgaaggatgaaggctcgagatctcaccctctcatcgacgagttcatacccacaatagatggggaggacggcatatgttacacccaccccgagaaacttccaggtgtgacaagggatggcctaagcaagcacttcttccaccggccgtccaaggcctacacgacgggcacgaggaagaggaggaagatacagacggagtgcgacgtccacaaggggggagacgaggtggcacaagaccggcaagacgcggccggtgatggtgaacggccgtcagaaggggtgcaagaagatattggtgctgtacaccaacttcggcaagcaccgcaagccggagaagacgaactgggtcatgcaccagtaccacctcggcgacctagaagaggagaaggagggggagctggtggtgtgcaagatcttctaccagacgcaacccaggcagtgcagctggtcctccgaccggggcgccgccgccactgccttggcagcaacggcggcggcagcggcggcggcggcgcaggagcagcataggagggatagtggcagtggcagctgctcgtctagggaccacgaggtgtcagccacatcgttcccagccggatacacagtcaccacggccgtcgatatgcagcagcatatgaagcagcctgcggaccatttcagcttcgcgcctttcaggaaaaccttcgaccaggaggttggtataggtggtgatcaggtgccatctaatcagcttggacgttcagagccgcatcatgccggcctggggcagcagccacacggcccggtgctcgcgacgaagacggctgtgcctgctacagctttcctgatcagtaggccatcgaaccctgtctcgactatggtgccacctgcaatgcagcacgcatcagttgttctcgatcatgatcagttccatgtgccagcaatccttctccatcaccatgacaaatttcagcaacagcaccaacagtcacagccacaacaaaagcttgaccgcagatctgccggcttggaagaactgataatgggctgcacgtcgtccacaagcacaaaaggagatgcttccattgctcacccccaagagacagaatggccttacccgtactggccacctgacaaccaagatcatcatggatagtagcaacagggacctggtaaatagtggcgatgatgtgaatgctgaaggaacactaaccgcaaccactttcactggaatggtttttgtctgcttgaatatgcagcgttgctttcttggagaatgtacacctacaatagtggggaaagaacagagaaaaaaacatatctctgtagatctccctcaataaagaaatgaggataaaactagttaacagtgtgagctctccaagacagaagagacaaaatggccaacgaaaagagaagggggaaagaccgacgggaggaaaggtactgtgtgtgctgacattgaagggatcatgtgtggaccgttagatgtattagagcaccttaatcaagtataactataatcagtttacagtttaccacagtttttttattcgtactacctgttttccaattgtaaaaactagtggcattgtttgcatgtacattaacccttttaatttctttcagtttctaaactgaaaaaaaaaaaaaaatggttagttcatgctaatacgcatcacgaagaaataaacttagtaagaagcgcataattccttccttttttggccccta

SEQ ID NO: 700 - DNA, 1212 bp, Zea mays
  misc_feature (31)..(31): n is a, c, g, or t
  misc_feature (92)..(92): n is a, c, g, or t
  misc_feature (1203)..(1203): n is a, c, g, or t
cttcggcggcaacggcgtgatcgcgagcatngagcactgcaacgacttcatgctgctgggcacggaggcggtggcgctgggccgcgtgggcnacgacttctggtgcacggacccctccggcgaccccaacggcaccttccatgcctgcaggggtgccacatggtgcactgcgcctacaactcgctgtggatgggcaacttcatccacccggactgggacaggttccagtccacgcacccctgcgccgccttccacgccgcgtcccgcgccatctccggcgggcccatctacgtcagcgactcggtggggcagcacgacttcgcgctgctccgccgcctggcgctccccgacggcaccgtcctccggtgcgagggccacgcgctgcccacgcgcgactgcctcttcgccgacccgctccacgacggccggaccgtgctcaagatctggaacgtgaaccgcttcgccggcgtcgtcggcgccttcaactgccagggcggcgggtggagccccgaggcgcggcggaacaagtgcttctcggagttctccgtgcccctggccgcgcgcgcctcgccgtccgacgtcgaatggaagagcggcaaggcgggaccaggcgtcagcgtcaagggcgtctcccagttcgccgtgtacgcggtcgaggccaggacgctgcagctgctgcgccccgacgagggcgtcgacctcacgctgcagcccttcacctacgagctcttcgtcgtcgcccccgtgcgcgtcatctcgcacgagcgggccatcaagttcgcgcccatcggactcgccaacatgctcaacaccgccggcgccgtgcaggcgttcgaggccaagaaagatgctagcggcgtcacggcagaggtgttcgtgaagggcgcaggggagctggtggcgtactcgtcggcgacgcccaggctctgcaaggtgaacggcgacgaggccgagttcacgtacaaggacggcgtggtcaccgtcgacgtgccgtggtcggggtcgtcgtcgaagctgtgtcgcgtccagtacgtctactgagccggacgggccgatgactctgctccctgctggcctgctcaggacgcaataatctaatgtttagagcttaccaagttttacagctctatcagtttacttttgtttgtctgctcttcgttttttaagaattatttctatttgggtgaattaatgagtgctttnctttctaat

SEQ ID NO: 701 - DNA, 636 bp, Zea mays
  misc_feature (561)..(561): n is a, c, g, or t
ctttctcatttcagcggacgcgtggggtgattccaccggtcatggcggctccgatccgagcacctccggcatgggcgggcgcgggttcctccccggcggcgaggccctagcagcggcctctcctggtgggcacggcctgccccggcgacgcggtagcagccgtcccggcccgtgcgcgggtgcggcggtcaaagggcgagcaggaccgacctggctcgggcggcaccagccactgccggcgcggggcacggccttcggcttaggcccctggaggctcggcctccagcgtgggcacgaccttggcgattggagcagccctcggtgcgagtgcgcaaccccggcgcgtgctccagcgggtgcgggcagcatccggcggcgcacacggcgcggtgggcgtggcccctgcctggctccccggtgacccacggcgtgcggccccggcggctcgggtgcggatccgacggctgcgcagcctctagggcgcggctccacgggagcgcggccccggcagcccctcggcgtgctgccttgccccgacggcctcagcctcggcggtgcggnggtggctccctgcggcccggggcgcggtggcccagccacagcagctcgggtcacggctcgcagcgcggcctcccc

SEQ ID NO: 702 - DNA, 1713 bp, Zea mays
  misc_feature (327)..(327): n is a, c, g, or t
tgcagttcctttattttcggcccaaggcaagaagccgtccggtccgtggtagccgatgacgaatgacggcgcaagaggcaagatggcggatctcggccgaactgtgttcccgcaagcaaagcgacccaacagcaccttatcccctcgttaacacctccccacatctcgttcctaatcgaaaaattttcgagctcaagctcaatcacttcggattggcggcgggcacgcgccggacgaaatggaagcggcaccatccgcccgcgccttctccccgtcctcgtctccctccgcgggggctagacccagccttcccctcgcgggcctggnctcgcgctcgcggcgcgcccgggtgctcgcggcgccgcccccgccccgcgccgtcgcctcctcccgcgcgccgctggtggtctccagcccgccaccgccggaggactccggcacgcacaaccccgcgcacgccaaggtcgaccgctccggccgcttctgcagcccccgcgccgcacgggaactcgcgctgtgagtcccggcgtttccccagcttcagctcctacatacttcggtttctcttcttctgtgctgcgttggagttgggcttcggctgtggttctttgctgctggaggtgaaccgctacttccgcgtctcgtgtcgcaggatgatttcctacgccgcgtgtctggagggaaccgatgtcgtccggctcttcgatcgcaggatcagcgcaagacgagaacccgggtttgttttcaacaaggcatgcctattgagttacaaccatatgagctttggcgggggaccgctcgaggttggaacggaggaggaggctgagaagctggccagtcagaacgataaggattcagccaacgaagcagatgtactttcagctcctccaaaacttgtttacaacaactatgtattacggctgtccagggaacttttagtggctgttgccagtggatgggataagcatgtggttatcatcgacaaaataattccccaggcttggaaggatgaacctgtggcaaggattcttgagctctgcattctacatattgctatggctgagatgacatcaaaaggaacaccccacaaagttgtcattaatgaggcagtagatctggcaaagcgattttgtgatggtggtgcccctcgggtaatcaacggatgccttcgaacatttgtgaaggatcatgttgatgttgcaggcacgagccaggaagctaaatcaaaatcatgattttttgcaaatactcatacaacaaaatggtggctgaagtaaagaagtacggagaaaaccttgctgtcttgagttcaggcgaataccttctgtctccaaggtttagccttcaacctaagggaatctaaaaggtaaacatgatggactcatcaaggagccacaacacgttcattcttttagaatgttcggttattaggtgaagtatacagagctgtaaactggtgatgcacattcatgcttcatctaaaacaaccgaaggttatggcttctgatagcggatagcctactcgacgcagatcgttaaatgatcagatattaagatgaccaggagttgtgtaaaagcttgatgcacatgtaaaatgttatatatacttggcattggctcattgcaatgggagaaggatattctagtttcataagttgatgtaagacatgtacgctcattttaggattattaatcgcatattgtgtttgcttc

SEQ ID NO: 703 - DNA, 2915 bp, Zea mays
cgacgggaggaggaagggggagggaaagggaaaggaccgggagaacgtgagaaggaaaaggagaggagggaacgggaggagaaggagaaggaaagggaggaggaagagcgggagagggaacgggaggaaaaggagaggaaggaaagggaacgggaggaaaaggagaggaaggaaagggaacgggaggaagaagagaggagggaagaggaagaagagcgggccaggaaggagcaagagaagcagcggaggagagagaaagaggaggaggagcgtgcacggagacgcgaggaggaagaaagagagagggaggaggaagaagaacggcggagggaggaggaagaaggtggaggcggacgtggtgacgagccagagagggaggaagaaggcggtgacaagccgccataccggttgtccaagaaactgaagaaacgctaccatgcacgtgccggtgtgttcagcaggagtggctgagtgagcagccgagcagagctggcctctgctccgtacaaataaacaggtggcctcgtacagatggccaattgccacatcaccaccactcgtacagagtaccacctgccagtcggctatgtatgtgtgttcgttgtgtcgtttgttaagctttgctgcatgctgagtttagattccgcttgtataaaacgtaccctaaataagcagacaagttttcaggctcaaaaaaaaaaaaaaaaaaaaaacgagcgggggcccggtacccacccatcctccacccaatgccgattcactgaatcatcagtagtgttcttgaaatcagttcacatctgaatagctattccaatgctgtcaaggatgtcgttaacggctttgacacaatccagcaatatgcaagtatcaagtaattataaccgatgatcgatcaggccggttatttttcttccaaatagtagttggcttaggtgtcaaatctcaggtaagttgtggatagaaacgtgagggttctgtgtctgcatcgaagccgagctaaattcgacaaaaccagaggagattggaggagattggaggagcgagctaaattcgacaaaaccctcgacagagttaaattcgacaaaaccttcgataaaaccggagtagattggaggaacaaaaccggagtagattggaggagagctgaattcctctggaataagatgcggcaaaaccaaaaggcatcgaaggcgagctaaattcgacaaaaccggagattgaaggagagctgaattcctctggaataagatgcgacaaaaccaaagggatttgaggagctaaatttgataaaactggtggggattacagtagctaaatttccttgaataagaaggaagaaggagaatttagccacttcaattccctctgattttatagctctgaaactagacactactaacctgttgttcccgttgctgtagctcttccctgtcatcgtcaaaatgtatcacagcctcaacttgtgtaccaacagaatatttgcatgaacatggttcaaatcactgtatcgtacaagggcaaatgtatcgcagagatttttagacatcagataggttatttcaagaaaagaacttgtttaagcacctgaacaattgaaccccgcgttctatcctcataaatcatctgggatgctatcttctcagcatgtcaatatccaaattttgggaactatgatcaaattcggaaagtcacaaaacaaactggaacctgaattctatatgtagcctggcactcgtgatatagaggattcatctacgacgcagcttttaggtgctgcacatatagcaaactgcgttggtcgtctgacggccatttcagtgtgcaatcagcgtaccagctgctccatgaaggctctctccacctacccgagatcgcgatcgtgtggaagacgtgggcgccgttgagggtcaaaatcttcttgtggcttgcctggaggaggcggctctggaccgcagacagacgacggcgtcacggactcgatgcgagaaccacttgccacctctgcaatacagcggaagaaacttgcgaccatctactggccacttgcagcttctcccttcgagtttgggatggcattttgtcgcaattggggcttcacagaccgtcgctaacggactgcagttcagtccttggttggtggcaaagagtgcgggagctgtggccaccgggcgccaggaagggcggtgattctctctttgcgttggtgacttgggaagtttggaaagagagaaatgcaaggtgcttccggagtgaggcatcctcagttgacgccgtagtttcttccgctcttggtgttgctagcgagtgggtgagagcgggcgcgaaagcccttggttgtattctgagcgagtagtcggctctgtgttgagctggttggccagctcttgtttttgtatttgtgttcgtactcttcttctattaacaaagatgcgcagctctcctgcgtattcgacaaaaaaaaacccgctgcaagctctggtgtgggtctcagcgacagcattcagtggattgtgtaaaataaaagacgtggaactatagagaacactatttgtagagtggagtttgaaatatgagatgatataatagatataatagatgagctgctggagagtaacaactagtagtgctcgcataccggataaaaaggggggcatacatagagatatccaagaaattatgtcatcacagccactagcagatactacaatgcctttctaatgtctgcatgggaccgtcattacccttgggacccccagccgttaggctgttagtttgtctggtgacgtgtagaaaaaaaactgtcccagcaatgctgagccgcaattcgcccaagctgcagttaaagcttttcacactagaggtgttgatgcaacaataggggcacgtttcagcctttcagtcaggcattgctgata

SEQ ID NO: 704 - DNA, 1660 bp, Zea mays
ccttcacttgtttcctctggcttcgattcttttattgtatagtggactacttaggagctttagcactgaccctcgtgaaaaaaagagctgggacccacctactatagatatagatatagatgggcctcgttcctttataatacgatctagcttgatccatcatcctcaaattatgataactgccttctagccgcagccggagctacttctaatccggaatccaaaggagtcgagcttttcgtactaccatcgcccgggcatcgctttcttcccactgctttcgtcctgttttattgctcctcctctcaacttattggcggccggcccgacggacgctgtagttcttgtgaatatcaatctaggcgtagggcttgcaagattcgcttcgtgccgttgggaaaacactggtatatgcttagcccttctcttccttgaggtttaagggggaaagatatcgtcttctaaactgaggagagttgtgtatcgccttagcttatctgctgccttgttttacgaatctgacttcaccctaaagaacaataagaagtcaatgggtttggtttctgaccgcacttctctacaggcatcccacccgtcctcttcctccagcagctcaaggtacgcacaggaaaccacatcttgaaccacggaattagccgtgataggtttcttcttccgctcggtactcatctaccctaatcttcccctcgcagtggattccactaggttcttaacctcttcccaattcttaaactgaaacctgcgatgtctaatccaactcggcacctaaccagcttgtcagcatcgtaagtttgcctcaacattccccctagaaatagaataagaatgtaaatctactttcatttagggatgatactttctttttttttctagaactagaataagtaagtatgctttggagtaaaaggattcgaacctttgcatgccggtaccaaaaaccgatgccttaccacttggctatactccaaacggtcggttcctggggagagggggaagggagaagcagggctcgaagaaaacgagccgtgcaaggacgcggggatatagcaagtaagctgcaaggttttccctttaggaccgactacaacaagctcgcgactctaatagaaactaagggtcagctctctgctctatttgcttgcaatgcgttgcctatcaaagtcggcgaacgcttccaccccctcttgcccttgttacgcaacacgccaacaaagaaccttggttccgttgcgccctgtactgtattccgaggcgaccatttcgcgcggttcgatccatttcccgatccgaaaaatccgataacgtacctatatgagtgggatggatggtaaatcatttgcagtctttttcggcaggacctagacacggaggttcgggaagtagcgcatgacagcattcactggtgaaaggactggcagcagcgagagcatcatagttgacatggtcggagctacagtccccatatccgtctctactctttctgtaattgactccctcccgctcccgtccatcaaaaagtgttatttcctccagctccctccgatgccggtagattagattaattcattgacaaaacccattgattccaagcaagaggatgcgcctagcgctagttgctcaatccgttgcttgtttggtg

SEQ ID NO: 705 - DNA, 1122 bp, Zea mays
  misc_feature (29)..(29): n is a, c, g, or t
  misc_feature (32)..(32): n is a, c, g, or t
  misc_feature (66)..(66): n is a, c, g, or t
tgctcttcgatgttacatggctggaactnttnggggaaggtttggcttggatgtgcaatatttatncaggctctgtgataacaaaaccaacttaatgacacccgcgcggccgcgcacgcgtgcgtgccaatctcttgaatctagggaccaaatcaaacctaggcggaatttgggcgtatgcctcttgcgtggatcaaaacaaatgagagcaagaaacttggagaaccatatgagatcagcaatggaaaagctggaatgtggatttgattttgttgaagtctggaaattggaaggtgacgagggcaggacaacactcaatgcaggagagaattccccaactaccaatggcgtgactgtgcttggggctcggcaagttcctgaagcgggtgcacttacagggcatcctgatcttatagatccactggttgataatgacttcgagacggttatagaaaaccttccagtgttcattactggagatcagaatgtcgcgtctgctaaatttgaggatgagatagatcttgctcttcaagaactgaaaaaatctcaggaagcggaatatagcgtggcggagcagaagctttacgcccagaaagaccacatcctctgtctgtacaggcagcttgacgctgaaagggctgaacttgcagatcccatgcccttgtctgatgcttcaaattatggtgcgatgctcgctaatgttctaagccgcgtggaccaagtcaagcgtgaggaggagaaatttaggtctatgctgaaagttgctggcggatttgcgaaagcaccacaaagcgtcaccagggagatgttcgggttacctgctgataagtagttgtaatagcagacttgcttggaacttaactatctgtagtttaccatagaaccaaacttcgctgtgctgttatagctgttgtagctgtatgagttgtgcatcctaccaactggttaccccataaagactggtttggatgaaaccagcaagtgctgcggatgcgcaggttctctatggacctgcgtgtactaagagtcgttaaatgtgacattctaaatggaccgaacctggacctccacattttccctaccagtttcatagattcaggcgataattatgttacactcgcc

SEQ ID NO: 706 - DNA, 1047 bp, Zea mays
ccaccgcccggggcgcccggcgtccccaactccaccgacgccgagcacaaccgttgtttccggctggtcctccactggccgctcctcagtcagtcccggattctcccttgggtctggagtggaatggaggttaatccgatcatggggtgatttcctcttttaactggatcagcgcagccggagctcaaaggtgcctgtggagtttattacatcaagaattttgggttcgacataatccccatgtcccccaataagtccggccatgcttcaggccgtgacgcggttttctggtccgatagaatgaacgaatatcttattgattcgctgcttcaccagcaagccattgggaacaggagtgagtccaaattctcatcggtggcatatgatagcatcatcaccggtgtgggtgagaggtttggcgtggtgatcgaccggaacaatataaaaaatcgcctaaagcatatcaaggaatcgttcaatgaatgtaggaacctccttggtgaagataatcggtttaggtggtgcccagagagcagaagattcaatgccgacccaaatgtttggagggagttgatcgagagaaaaccagaagcaaagaaatggatgatgaagacgattgaccattatgatagcttaatggatctatttggtaagaatagggagaaacgtcaagacgttgagaactcaaaaggtacctcgaagaaaaaggcgcgaacagaaccgccaaaggagatacttcaacgtactccattaaatcggaaggggtcagctcttgccgaaagttcagataagacggtggacaaatgtgagatccatgatgagataaaaacaaatgtggaacttgatttgtcagaatcgtgcagaactgataatggcattgttgccatacctgttcgtgcctattcatacggtaaaggtttgccctatgctcctgaaaattggccacgtcatggagacatatggcactggaaaggtggaagcagggcttctggagcaggccattgggctgacaggtatattatgccgccatcccgttttcgtggcgct

SEQ ID NO: 707 - DNA, 6835 bp, Zea mays
aagaccttcggcgacgaagcatagtcccaacaggtttaaaacatcccaactaatttagttaatttcttgttagttaactaataattagctctagagatttgaaagatcgataagttgataaaaatttatataccagttattttttaagaaattatattatatagtgtatgtgttaaaactagctaaccaaaaggtgtccatcttatcgatgacaaattgttaaagatcccccacgcaacaaggagaggtgtccgaggcctcccacctcataattccaacccactgtgtgtgccgctgtagcagcgcgcgccaccaccgtcaacttctccccacctcgccgccgtctagatttcgtctcctgggctcgagcaaccgaagcaggcttggggtgttctcggagagaatcgttgcctcggccgatgccggccctgatgtaggtttctgctctgctttgcccggtgccaacgtctctcccggagtagcggttccgccgccccatgatctgccagttggaacacatgggcgttcacggaggaggtatcgctgctgctgtcgccgttccgttccaattgcttgcttttcgtttcgtttcgtgggttgcgtagggtggtttggtacttggattcgtgtgaataacggggaacgtggcaggttgctctgctggacagtgaccgcatttggtagcggtggaggaagacgacgaagaggaggaggagtaggccatgaaggaggtggccgaggaaaggtgccttgacccgcagctgtggcacgcgtgcgctggcggcatggtgcagatgccgcccgtgcgctcccgtgtctactacttcccgcagggtcacgcggagcacgcgcatggcggcggggccgcggacctcgccggggcgcgagcgctcccgtcgctcgtgctctgcagcgtcaccggggtgcgcttcctggccgatccggagaccgacgaggtcttcgccaagatccgcctggtgccggtcgcgcccggcgaggtggagttccgagagcccgatgagttcagcgtcgaccccgcggacgcccgggagaagctttcttccttcgccaagacgctgacgcagtccgacgccaacaacggtggcggcttctcggtgccgcgctactgcgccgagaccatcttccccaagctcgactaccgggccgacccgccggtgcagacggtgcttgccaaggacgtgcacggggaggtctggaagttccgccacatttaccggggcacgccgcgccggcatttgctcaccacgggatggagcacgttcgtcaaccagaagaagctcgtcgccggggactccatcgtcttcctgcgcactgagcatggcgagctgtgcgtcgggatacggcgtgtcaagcgggtgtcctgtggtggcatggagtgcatgtctgggtggaacgccccggggtatggggccttgtcggcattcttgaaggatgaggagggtaagatgatgaagagtcatggtgggtacatgagaggtagggggaaggtgaagatcacggatgttgtcaacgccgcaagtctagcagcgagcggacaaccatttgaagttgtgtactacccgagagctagcacaccggagtttgttgtgaaggctgcatcggtacagaacgcgatgaggaaccagtggtgcccggggatgaggttcaagatggcatttgagacagagtattcgtcaaggatcagttggtttatggggacgatagcttctgctcaggttgctgacccaatcagatggccaaattcaccgtggaggcttcttcaggttttgcttgatcacatgtttccaatacttgtatgcaatactgcattgtgagctgatgcgtgttatttttgaaaaaaaaaaaaaaaaagtgttattttttagcttacctatggtatctcccattccatctcccatttcaaacttacctttgtgaacaatgcggtctatagtgcaaaaacggtgttttgtacagcttttgggtgaactggctagcgcggacaacacatagtgtatagtgctcaactgtttgtagcccacctgaagcatctggaagcctttatattactagacaaaaaaatcaattatgaaattgggcatctgaggaattattgggacatgcttaaaattatgaaattggacatcttaagaattattgggagatgcttagatgggcgaaaatccacatctctagctgtgttagactagtatggggacaagttttctacagttcttaaccataaagaacaggttagaaaacacaattttactactttacctatataacaacaatgaactataccatctgtttgattcagttactttctcttctgaatgtatagttttcaaatttttagtttgttttgtcagtctcttctggtcaatggtcactgagatcagtgttgtcaccttctacaacattgttttccatctccatgtatcctaccatcataggtgacagattcagtttgcagcgtctttcagctacatagtgtttttgtgtgtctgtttccgcacaatttggaagctggtaaacatcgttttgttagcatcaggaggcattagggaacattggaggttttgtttgagacacttaccaatccttcctcacagacgcgatctgctttatatgtgtctagctaaaattgaaatgtggggagtgaactgattaacattcacatatttctaacaaaacatccatttatatataggtctctcggtcctggactcctgcctgaatcagttggtcctttttttccaagttaatggcaataccttacatttgcctatatgatcattgcccttataagattggtagctgatctttaactgcagcatagcattgtacatccgtacattgagagaaatccaggcaccaacaataatatcgatatagcattagtttacccaattcgcaacctgctgttcttcgtctgtccttaccctagcacattttcgtttcttggaattgccttggtacatagcttgacaggcaatgtaggaatgcaattttaggtgtcttactagcagtgttaagcgaggcatttgaagctcaccagcttatattgtcagatgttatcaattatagcagatgcagaaagaatttacttttgaacactgaaagaatttacttgtgaaattggcacacagtttattgttatatgatgcttcctttgtccttattgtgtgcgctatgtctttttgccactcttcacacagttgagaatttactgcaggtggcatgggatgaaccggacttgctgcagaacgtgaaatgtgtgaacccatggctcgtggagatcgtatcaagcattccaccgatccacctgggaccattttctccacctaggaagaagctgcgggtgccccaccatccggacttcccgttcgacggccagctgttgaatccgattttccacggcaacccactcggtccgagcaacggcggcggtgctcttcgctgtttctcggacatcgctcctgcaggcatacagggagccaggcatgctcagttcggtctaccactaacagaccgccagcttaacaagctgcacctcggtctgttccaaggcggcggttttaagcggcggcttgacgctatcactccaccatgccctatatccaggggctttgtgatcggcagtgcaccggtcgacgagagcgtctcttgcgtgctgacgatcggcacgccacgggccgcagagagatctgacgacaggaagaaaccacatctaatgctgttcggaaagcctatccttaccgagcagcagatgagctctagagggtcaagggaaacactctcccctgaggccactgggaacagttccgatggcagtgttcagaaaacgggaaacgtatccgatggctccggctcgtcgatctgcatcggttcctcgtcccgaggccgcgaggcttctaggctcgggttcgaatttgaagccgggcactgcaaggtatttgtggagtcggaggatgtcggtcgcaccatcgacctgtccgtctttggctcgtacgaagagctgtacggtcagttggccgacatgtttggaatcgagaaggcagaggtaatgagccacctttgttaccgtgatgctgctggcgctgtcaagcgtactggcgacgagccgttctggtgagtgtttatttaccttgtatataatataatcagtgtctactacgtactactagtacgtttaaaccgtgttgtctgtggcagtgacttcatgaaagtggcacggaggctcaccatagtagagagcaccgaggggaggctgcagaaacctctcgtcgagtacatggcttgattgcatgactgttcgataaggcactctgaagcttgaggaagactgaagcttggagcgaatatgttttcgtttgcgtttgtctgccgtgaagcggaatcgcgatgtctgtctcgtcgtgtgaaagaaactcgtgtatcggattttcgtctgtcgtgacttggtcgttagaactctgtcgtggtcagttgtgttgcgcttgcgcttgggtcgaagttgatagatggcctctttgatgaactagcttggaataaagttcgagttgtggttagggaatgccagtgccatggcaattcagttgtcgttgtcgatttagttaaaaaaaaaaaaaaaaaagctgcagtttgatagcacttgccaagatatgttgaacttatcgtggttatgttcatttcctcagcgtgaaaatcaccaaactgagttaggacccgtttgtttgtttaggattggaccagaattcattctaacttgtcaaaacttatataaattagagaaacaatctagccagaaactgtttcgggccttcaatccgtgaaaaacgaacagggtcttaggcgggttccaacaggtcgctaccacccggcacccgctcgtgtggcaccactgacggccggtacccgatccccacggctcggtcatcggagccgacctgccgaccgaacgttcagatccggtcctatgaatttgattttgaggttctcagcggaggactcatcgtaatggaccctctaaactatatgtaaaattttatgatatttaaatatatatatacacattaattttacttgcaaacaaaaacaaacatattgatatgttaaatttagcatgtcaaataattatcgagaaataaagtctaataaaataacaatgtatttgtatcttggagctaaggctatctatagaagcttatatatcctcatcttcatattcaaatttcactatgcaaacattaccatctaaaacctaataaaaaaacaagtaaatgaacatgtgcactgaaattaatttttaaaatatctaaaatgctagacaatatgcagcagtacagattggcacttagcaggtaatttacctaaatacctaaggactttcatggtcggtcactaaatttaaaaagagccactggcgctggtcgatcgcttgaagccctgaatcctgatcgtctgatgcagtgatgcctgcccctgaatcctgatcgtctgatgcagtgacgactgcccctgaatcctgatcgtctgatgcagtgacgcctgcccctgaatcctgatcgcctgggtgacctggcgcgcacggtagaacgcctggacgacaattgcgcggcggactagcggctaggttgccaggacagtgcgcgtcccgcgacttttatgtgtttcaggctttcagcgtgtgagttgggtcatcggcaagcagccctatctctactattctattaaatgttaggccactttcctttctagcccttcagtggtcacctctgttggtcttagggccagccctacgaacgttagggtcaatatcaaccatattgggcttggaatttgtcactattggtcgatatcgacccaatcaatcgataccaaccacctggtgacacatcgtgttttctgattgatttgtaatatttttgaatttcaaaagattcaaaaaagtcatagaacatagtctataaaaagatgagtgtttgaattcactgacgcatacttatttctctaccacctctttatagttttccgaccctcctttccattcgagtaaagtattgttgagatatcttcgtctaggtcgacatgactcgtccagaattccagattaaaaggtgttgcaggcttgcagccgaccagtctatcccgggccctcgaccaaacgaagaccctactaggactctaggaggcgagaatggccgtgaccgagcgtgttgctcgtcccagtcacaggagctagccgacacgcgactgaacaagggctggacccaggatcctacacacggagggcctatttgtttgcttgaatcagagctatccatgccacggtgcttctggatgacttcttggccctatccacggtgcttaacgcaccctgtcgcctggcttccaagaaacgaaatcaagtttgttttttaagagctgactcgtcagtgttttttcagagcttggcactggcgtaggtgttcttcttgattgggggcctccttgttccctttgtcgttatcgtttggcggaggcatcgccagaaagcagtctctttctgtcgcttcttcgacgtcggagatagccccggtcaagccatggctcgaatcatcctcgagcaagtcaaggacgggcgtcggttggtgaccaatgactgccaccagagccaaagacgggcttccaccacttttgtcctggggtgtctattgaggcgccgccttagggttgatttggtgacaaagggatcccgggtcaccaaatcagcccttagagcggtgacacgccttttcaagcatcacttctctgccttgcttctggtggagcatgtgggttgcgtgcaaag

SEQ ID NO: 708 - DNA, 1202 bp, Zea mays
ccacccgattgggtaccgggccccccctcgagtcagctacgtagccccccccccatcgctcctgcaggcatacagggagccaggcatgctcagttcggtctaccactaacagaccgccagcttaacaagctgcacctcggtctgttccaaggcggcggttttaagcggcggcttgacgctatcactccaccatgccctatatccaggggctttgtgatcggcagtgcaccggtcgacgagagcgtctcttgcgtgctgacgatcggcacgccacgggccgcagagagatctgacgacaggaagaaaccacatctaatgctgttcggaaagcctatccttaccgagcagcagatgagctctagagggtcaagggaaacactctcccctgaggccactgggaacagttccgatggcagtgttcagaaaacgggaaacgtatccgatggctccggctcgtcgatctgcatcggttcctcgtcccgaggccgcgaggcttctaggctcgggttcgaatttgaagccgggcactgcaaggtatttgtggagtcggaggatgtcggtcgcaccatcgacctgtccgtctttggctcgtacgaagagctgtacggtcagttggccgacatgtttggaatcgagaaggcagaggtaatgagccacctttgttaccgtgatgctgctggcgctgtcaagcgtactggcgacgagccgttctgtgacttcatgaaagtggcacggaggctcaccatagtagagagcaccgaggggaggctgcagaaacctctcgtcgagtacatggcttgattgcatgactgttcgataaggcactctgaagcttgaggaagactgaagcttggagcgaatatgttttcgtttgcgtttgtctgccgtgaagcggaatcgcgatgtctgtctcgtcgtgtgaaagaaactcgtgtatcggattttcgtctgtcgtgacttggtcgttagaactctgtcgtggtcagttgtgttgcgcttgcgcttgggtcgaagttgatagatggcctctttgatgaactagcttggaataaagttcgagttgtggttagggaatgccagtgccatggcaattcagttgtcgttgtcgatttagttaaaaaaaaaaaaaaaaaagctgcagtttgatagcacttgccaagatatgttgaacttatcgtggttatgttcatttcctcagcgtg

SEQ ID NO: 709 - DNA, 1224 bp, Zea mays
ccggccgggaactgttcgtacgagtactgtgtgactgagccgcaaggaaaacgcaggcagactcagccccagatttcttttccgttcccctgctcccattccgccccggatttcgatttcgtcctcccttcgccgcccgcgccaagactttcctctgccggggctgcaccggcagcgcggggtcgacaacagctcgagatccggtgactgatctcctttgtttctcgggcatcttgctagtcttcttccagattgcttcctaataatgatgacacatgaatgggctgccaatttggctcttgctggtctgagcttggcgccgcttgtggttaatgtaaacccaaatgtgaatgtggtactgacagcatgccttactgtctatgtgggttgctaccgttctgttaaaccaactccaccctctgagaccatgtccaaggagcatgcgatgcggttccccttagttggaagtgctatgcttttatcactgtttcttctattcaggtttctctcaaaagacttggtcaacgctgtgctcactgcctactttttcattctaggcattgttgctctctctgcaacactgcttccttctataaaacgttttcttccaaaagagtggaatgataatctcattgtctggcgtgctccacttttccactcactctcggtggagttcacaaagtcccagattgttgcttcaatacctggatttttcttctgcttgtggtatgcgtcaaagaagcattggcttgcaaataatgttctgggtttggctttctgtattcaggggattgagatgctgtcattgggatcatttaaaaccggagccattctcttgggtggactttttgtgtatgacattttctgggtgttcttcactccagttatggtcagtgtggctaaatcttttgatgctccgataaagcttctgtttcctactgcggatgatgcacggccattctccatgcttggccttggtgacattgtaatacctggcatttttgttgcacttgccttgcgctttgatgtctcaagaggcatcaagaagcgttacttcaacagcgcattttcgggatacgccgtgggtatggcggtgaccatcattgtaatgaactggtttcaagctgcacagccggctctactgtacctcggccccggcctcgccgggttcgtcgccgtacactgtctctggtacggagaagtgaaacagctgctggagttcga

SEQ ID NO: 710 - DNA, 1454 bp, Zea mays
cattgggtccctcggccgcccgcgaaacgcagacagacgcagccccagatttcttttccatcaaaacaccccccgttcccctgctcccattccgccccggatttcgatttcgtcctcccttcgccgcccgcgccaatactttcctctgccggggctgcaccggcagcgcggggtcgacaacagctcgagatccggtgactgatctcctttgtttctcgggcatcttgctagtcttcttccagattgcttcctaataatgatgacacatgaatgggctgccaatttggctcttgctggtctgagcttggcgccgcttgtggttaatgtaaacccaaatgtgaatgtggtactgacagcatgccttactgtctatgtgggttgctaccgttctgttaaaccaactccaccctctgagaccatgtccaaggagcatgcgatgcggttccccttagttggaagtgctatgcttttatcactgtttcttctattcaagtttctctcaaaagacttggtcaacgctgtgctcactgcctactttttcattctaggcattgttgctctctctgcaacactgcttccttctataaaacgttttcttccaaaagagtggaatgataatctcattgtctggcgtgctccacttttccactcactctcggtggagttcacaaagtcccagattgttgcttcaatacctggatttttcttctgcttgtggtatgcgtcaaagaagcattggcttgcaaataatgttctgggattggctttctgtattcaggggattgagatgctgtcattgggatcatttaaaaccggagccattctcttgggtggactttttgtgtatgacattttctgggtgttcttcactccagttatggtcagtgtggctaaatcttttgatgctccgataaagcttctgttccctccgccggtggtgccacggccattctccatgcttggccttggtgacattgtaatacctggcatttttgttgcacttgccttgcgctttgatgtctcaagaggtatcaagaagcgttacttcaacagcgcattttcgggatacgccgtgggtatggcggtgaccatcattgtaatgaactggtttcaagctgcacagccggctctactgtacctcgttccaggtgtgatcggattcgtcgccgtacactgtctctggtacggagaagtgaaacagctgctggagttcgacgagtcaaaagctgaggcggaggaaggcggtgcagaaggagagcaagatggtgatggttccaaagccagcaaaaaggtggactagcatgatttagttccgggaggtaaaaaagaggacagggagacatttttcgtgtaaggtcgtcttgcagctagctagctaaacgggcttgttgccctctctaatacttacttgataacttagaaaatggttcaacatgatactagttttttggtcc

SEQ ID NO: 711 - DNA, 1702 bp, Zea mays
cacacccccagatttcctttccatcagggcattgggtcccccgcggcggggcgggattttaccttctcgcccgtccccgaattcttcctcctcccatcccgtgcagccggcctcaccgccggcgacgggacgcggagacccgggctgccggtaccgtcagccgtgctccttcctctcttcgtcgcccccgccaaaaccttcatctgccggggctgcaccggcggcgcggggacaacaaaagctcgagatccggtgactgatctcttcgttcctcggttcactttgatattccaacaaaggtcacattgctagactcccagattggttcctaacaatgagggcacatgaacgagctgccagtttggctcttgcctgtctgagcttggctccacttctggttaacgtaaacccaaatgtgaatgtggtattgacagcatgccttactgtctatgtgggttgctaccgatctgtgaagccaactccaccttctgagaccatgtccaaggagcatgctatgcggttccctttagttggaagcgctatgcttttatcactgttccttctattcaagtttctctcaaaagatttggtcaacgctgtgctcactgcctactttttcattctaggcattgttgctctctccgcaacactgcttccttctataaaacgttttcttccaaaagagtggaatgataatctcatcgtctggcgggctccattcttccactcactctcggtggagttcacaaagtcccagattgttgcctcaatacctggatttttcttttgcttgtggtatgcgtcaaagaagcattggcttgcaaacaatgtcctgggattggctttctgtattcaggggattgagatgctgtcattgggatcatttaaaactggagccattctcttgggtggactttttgtgtatgacattttctgggtgttcttcactccagttatggtcagtgtggctaaatctttcgatgctccaataaagcttctgtttccaactgcagacgctgaacggccattctccatgcttggccttggtgacattgtaatacctggtatattcgtcgcacttgccttgcgttttgatgtctcaagaggtaccaagaagcgttacttcaacagtgcatttttgggatacgctgtgggtatgacggtgaccatcgttgtaatgaactggtttcaagcggcgcagcctgctctactataccttgttcctggtgtgattggttttgtcgctgttccctgtctgtggtatggagaagtgaaacagctactggagtttgacgagtcaaaaactgagtcggaggaaggcagtacagaagaggagcaagatgatgatagttccaaaggcaacaaaaaggtggactagcaggatttagttccggaggtaaaaggacaggaagacagttttcgtgtaatgtcgtctggcagctaaaaaaacgggtctgatgaccctctaataccggattcgctcgccttacttaagaacttagaagaaatggttcagcatgatacaagttttattttattttttgtttcattttgcggattatttgccctgggctggagagtgggaattgaggggaacaaaatagatgctgttactcgcgatgtactccctgattcgttaaggaattcaccagaactttgacttggccgacgcataaaaaaaaaaaaccaaaaaaaaaaaaaa

SEQ ID NO: 712 - DNA, 1674 bp, Zea mays
ctcgagccggcggacctcgattccccggacacccccttcccccactccccccgttcccctcctcccctttccattttaccttctcgcccgtccccgaattcttcctcctcccatcccgtgcagccggcctcaccgccggcgacgggacgcggagacccgggctgccggtaccgtcagccgtgctccttcctctcttcgtcgcccccgccaaaaccttcatctgccggggctgcaccggcggcgcggggacaacaaaagctcgagatccggtgactgatctcttcgttcctcggttcactttgatattccaacaaaggtcacattgctagactcccagattggttcctaacaatgagggcacatgaacgagctgccagtttggctcttgcctgtctgagcttggctccacttctggttaacgtaaacccaaatgtgaatgtggtattgacagcatgccttactgtctatgtgggttgctaccgatctgtgaagccaactccaccttctgagaccatgtccaaggagcatgctatgcggttccctttagttggaagcgctatgcttttatcactgttccttctattcaagtttctctcaaaagatttggtcaacgctgtgctcactgcctactttttcattctaggcattgttgctctctccgcaacactgcttccttctataaaacgttttcttcccaaagagtggaatgataatctcatcgtctggcgggctccattcttccactcactctcggtggagttcacaaagtcccagattgttgcctcaatacctggatttttcttttgcttgtggtatgcgtcaaagaagcattggcttgcaaacaatgtcctgggattggctttctgtattcaggggattgagatgctgtcattgggatcatttaaaactggagccattctcttgggtggactttttgtgtatgacattttctgggtgttcttcactccagttatggtcagtgtggctaaatctttcgatgctccaataaagcttctgtttccaactgcagacgctgaacggccattctccatgcttggccttggtgacattgtaatacctggtatattcgtcgcacttgccttgcgctttgatgtctcaagaggtaccaagaagcgttacttcaacagtgcatttttgggatacgctgtgggtatgacggtgaccatcgttgtaatgaactggtttcaagcggcacagcctgctctactataccttgttcctggtgtgattggttttgtcgctgttccctgtctgtggtatggagaagtgaaacagctactggagtttgacgagtcaaaaactgagtcagaggaaggcagtacagaagaggagcaagatgatgatagttccaaaggcaacaaaaaggtagagtagcaggatttagttccggaggtaaaaggacaggaaaacagttttcgtgtaatgtcgtctggcagctaaaaaaacgggcctgatgaccctctaataccggattcgctcgccttacttaagaacttagaagaaatggttcagcatgatacaagttttattttattttttgtttcgttttgcggattatttgccctgggctgttacttgcgatgtactccctgattcgttgaattcacccgcgcgcagacttgaccgacgcatatattcatcacgtatacacgc

SEQ ID NO: 713 - DNA, 472 bp, Zea mays
agcagtggtaacaacgcagagtcctttttttttttttttttttttttttttttttttgtacctgcctccttacccgctttccaaaaaccctatctgtcattgcattgccgtggtttcgcacctcctacgccaatacttgcttaaataaattctctagggaagtagggcttcaaggaagtagacaaccacttatcgttatcggggaggatggacggttgtcccttcttctcaatagaatccgatagacaagaatcgaaagcagctgatttattcctcaagtaagtcagttgatgattcaattccttcaaggcaagagtggggcatctagatcgattcgttttccggttgttataccgcgaatagaaagaattctgattatctgttgaggcaagctattcatcattaacaggaaagcccgcgtactctgcgttgttaccactgcttaagggcggaatccagcacactggcggcg

SEQ ID NO: 714 - DNA, 2935 bp, Zea mays
ttttttgtactactccgatcacatattcacatctgttaagcaatcatgttattgcagctttatatacaactttaaagatagcatctttgtgtgccttttgataagattatgactctctttttttttcctttttaactgcaaacagagttacgaggggtataagcaggagcatgataagaaggtcagtctgttgaggaagcaagaggtgaagggtgtggattacttgaagatggagaagaacaagatggagattgagagcctggagtccaagatgctggttgccaaccagtccatcgagaccaccacttctgagataatcaggctcagagaatccgagctatttccccagcttcttgagctgattgctgggttagtacaatctcctttcatcatccatcctgactgcatctagtagtagtagtaatattctagggtgcttcacatgttagctacttccacttgtacctgtcgttttgcattgcatatgagcatgggagtaaggtgggacatatggtccatggtttgcgaccttctacccatgctcaagtgtaagctactgcctcacatcttattgccgtttttctttttggctttgtaaaagtaactttgtcactatgcaaggtaccttctattaatttgaacaaaccttaaagtatttatgagctagtggagtcctggaattttgactgttctgactgaatcttctgaccgttgatctcaggctgtcaggcaccattacctgatcagcatgggcatcagagaaccttaaaagggggcgtccattgtttgcaactagagtagttctatgctccaactagcctcccaataaatatcagcaaaccttttgttgaactcaggctgtagctcccctttcttgagaagtttggttttgccatcattgtcatgcgtgcttgtttttttgtgaagtgcagcttgatgagcatgtggaggggtatgtacgagtgccatcaagttcagacccacatcgtgcagcagctggagtacctgaacaatgctcggaataccaacccgacttccaatggccaccggcaagcagctcttcagctcgagatagaggttgacaggtggtattcagccttctgtagtctggtgaaatcccagagagactacgtctactcattgaccggctggcttcgtctatccctgttctgccaccacgacccactgactaaagctcagaactccgatatctatggcttgtgtgaggaatggcagctagccatcgacagaatcccagataaggtggcctcggaagggatcaagactctcctgacagtgattcatgctgtcgtcattcaacaagctgaggagcataagcagaagaagaggtcggagtctgcattcaaagagtttgagaagaaggcagaggagctgagagccctggagtcaaaatatgtcggcgctgaaggttacagagaaatgtcacgaaaatcatcggtagctgacaagcgggcgaaggttgaggctctgaggagccgtgccgacgaggagaagatcaaatacgagaagagcatcggggtcaccagagcaatgaccctgaataacctgcagactggcttccctaacgttttccaggcgatgacgggcttcgccagcgtgtgcatggaggcatttgagtcggtgtacaacttcaagcggagctcggacccgaagaggctgctgacctgaagcaatgttgtataaaatgtatacagtcctaggtttttagtaacaatgataccttgcaacctttgtctggctgttatcaggttctaatggcgcaaaaaaaaaaacaaccccgtcaagttcaattacaccaagtaattgaaacttgaggccttgttttcctttttggttgagataatctcttgcctcggatgcaggttccaaaaggctcagctttgttttttcaatcggaagaaggtttgaactgtttgtttgcttccagcagctaatgacctgttgtttgtagcttcatgtcacgagctgagacttggatgggactggtaactgtagtctgtgcaattcagaaatgggccacacctgttgtttttccagcgcctaaattatatttctggtgatatggtcagtgaattctaattgaggcttttcagcttcaatttgcaagttcaacaagaggactgaaccgcacggcacacctgcctatccaatctcctataactttttttttctttcgaaaagttataccctctatgaagatctgaccctaagccacaccccctatgaagatctgaccctaagcagtggagagtgggacacccaggaaggataatcccttggcaccagctattgggtacttgatttcaattccctgaatgcatttgagaatcaaggcaacacaagttagtaatgtgaaccttcgacctgatctaaagtgtcaatatggagaacgaaggtcatagaaatgcaaacggaaatgatgtgtaatggagtaacacgacacaatggtgtatgaaaactcatctttcttgtcttgacattttcattccatctcccattacactagataaatttataagcatacattctgctccttaacagaaggtagaacgaaagttcttcggaggctaagcaatacgaaactattgcccttaaaaagatactttatagggaagatgaactgtctttgtacagaattatctaaaaaaatgcacaagtagcaatagctgggaccttatagggataatggaacgaaaataaggtcccctacttgtgcatagacgaagtttctttgtatactgctttgatcgaagattagcttcgtctgccagtggaaacgttcttgaaatacactcgtttatgccgaagcaacatgcttcgtttgtcttccactatatacctgaaacacaattatgtaatacaagtgttttgaggaccgtcggcaatgtaggccctaacagtagctcctagcagg

SEQ ID NO: 715 - DNA, 2169 bp, Zea mays
cctacgacttcgacctcgtcctcaccgaggtcgccatgccctccctctccggcatccagctgctctccaggatcgccgccgccgccgagtgcaagaacatccccgtcatcatgatgtcatcccaagattctattggcacggtgctcaagtgtatgcagaagggtgcggtggacttccttgtgaaaccagtaagaaagaatgagctgggtaacctgtggcaacatgtgtggaggaggcatgcaatgaattgccagacaaatggatcagaaaataatgcagccagcaatcatgtaagtaccaatgttgctaatgggtcaaagacaggagaaaacaatgatgaggaaagtgatgcccaagtgctccaagtgaaagtgagaagaatgtgcgttccaaatgccttaatggtattacttctgcaaaggtggctgagcaaataatggataatgccttgaggatcacggatgcaagttcacgtcgtccaaccaatcttggcaaagatttggctatgactgaaccagcagctgatagaaaatgccaatctttagtgatggaaaataatgctgtcaaagaaaagaaccctggtgaaaagtcgaagagtgctgtaataggtcatgctgattcttacccctcccaatttctcgagaccaacttgggaaaacaacagtatcgtaatggttacaagaatcaagaattcagggaaaaagatatctttaatcactccaattcttctgccttctcgagatatggcaatagaaggatagaatcatcaggtgagatacagtttcttccttctcgttgcattgttgggcaagagcagcatgttcatggcaaggacccagttttccaacccaatggggtcttgctgcctcccaatgaccataatacaggtgagagtacaaggcaagctcgaattactctggacagtagcatggagggtgctgacatcatttgctccagtagtgctagggaagatgctggtgcaagtagttcttcccatagaaaggacagtatgagccatccctcatatgggtttgtacctgttccaattcctgtcggtgccatgatgccctatcattgtggtgcaattctgcagccagtatactacccacagggtccacttatgcactgtaattcatctgcaatcaacaaggcaacaattcatcaaacctctggccaatctaactaccgtgaagattgtggtagtggtagaccatctcaggttgatgaacacaaacagtcagaggaaaagcaccagttgcatcattcaagacaaattcatcgggaatcaggacaaccagttgacatggttagagctcacatggatcatgctaaccagagtgcaagctgcagccgggatatctgtaaaggaagcggatgcacgggtagcggtgaagccgataccaatgcgaacacgacggttgccctagagagtggcaacgagagtggcatccaaaatagtgacaggtctcaccgagaagctgctttgatgaagttccgcatgaaaaggaaagacagatgcttcgataaaaaggtcaggtatcatagcaggaagaagcttgcggagcagaggccaagagttaaggggcagtttgtaagccagaagctgaaagcagctatggcaacggaagccgaaactgactcgtgacgggcgctagtccagaactgtaattttggttcttcccttcgcgccaggtgtgggcgattggactggtaagtctgaaggctggcaaaagtttttttttcttccttccatggttagcctttctgtacaaaggtgaactccacgtcgggtgtttgttggcatccaagccttattttttgcgaggtacatcaagttgacaaaatgttcggagggatagggtgaaaacggtgcaagcgccatatttcgtccatacgcttaggtgtttgtggagtgtgaaagcagagcctgtacagcatattcaccacccattctgttgccattacaattgtagtaacttgtaattactactatgacaaaagtagacactgttgtagaacttacagccagcaggtcttttccatatgggacagtagcattttatttattaattggttgatcatatgaggacagtcctgaatgcaggacagttaagatttgtttgatcccatccaatcatccagcattttgcttgccttaaaaaaaaaaaa

SEQ ID NO: 716 - DNA, 2094 bp, Zea mays
  misc_feature (107)..(107): n is a, c, g, or t
  misc_feature (126)..(127): n is a, c, g, or t
  misc_feature (241)..(241): n is a, c, g, or t
  misc_feature (707)..(707): n is a, c, g, or t
gcacggtgctcagtgttgcagaaggtgcggtggacttccttgtgaaaccagtgagaaagaatgaactgcgtaacttatggcaacatgtgtggaggcggcatgcaatngaattgccagacaaatggnnatcagaaaataatgcagccagcaatcatattagtgccaacgttgctaatgggtcaaagacaggagaaaacagcgacgaggaaagtgatgcccaaagcccggccggcaagggggnatacctgaaattcatagtgttgaggcggtacaagatattcgtagagatgaagtggctggctcatccaaaaataacgaactacaaaataagtcttatgatggagtaaacacaaaagtggatgtgtcaaaatataccaatggtgctccaagtggaagtgagaagaatgtgcggtccaaatgccttaacggtattacttctgcaaaggtggctgagcaaattatggataatgccttgaggatcacggatgcaagttcacgccgtccaacaaatcttggcaatggtttggctatgactgagccagcagctgacagaaaatgtcaatcttccggtcatgggaaaataatgctgtcacagaaaataaccctggtgataagtcgaagggtgctgcaataggtcatgctgattcttgcccctccgaatttatggtgaccaacttggggaaggaacaccatcttaatggttacanaaaaccaagaattcagggaaaaagatatctttaatcactcgaattcctctgccttttcaagatatggcaataaaaggatagaaccatcaggtgagattcagtttttcccttctccctgcgtcattgggcaagggcatgttaatggcaagaacccagttttccaacccgatggggtgttgctgcctcccaatgaacataatacaggtgagagtacaaggcaagctcgaatttctctggacagtaggacagagggtgctgccatcctgtgttccactagtgccagggaagatgctggtgcaaatagttcttcccatagaaaggacagtatgagccatccctcatatgggtttatacctgttccaattcctgttggtgccacgatgccgtaccattatggtgcgattctgcagcccgtatactacccacagagtcctcttatgcactgtgattcagctggaatcaacaaggcagcaatccagcatgcctctgggcaacctaattaccatgaagctcccggtaaaccatctcatgttcttattgaacacaaacagtcagaggaaaaccaccagttgcatcattcaagacaaattcttcgggaatcaggagaaccaattgacatggcgagagctcacgtggatcgtgctaaccagactgcaagctgcagccaaggtatctgtaaaggaagtggatgcacatgtagtggtgaagccgatatcaacgcaaacacaatggttgccctagagagtggcaacgagagtggaatccaaaatggtgacaggtctcgccgtgaagctgcgttgatgaagtttcgcatgaaaaggaaagatagatgcttcgagaaaaaagttaggtatcatagcaggaagaagctcgcagagcaaaggccaagagttaagggacaatttgtaagccaaaagctgaactcagctacaacaacagacgcagaagctgactcgtgaccggcgtcaagtcatcactgtaacttattcttcccttcccaccaggtgtgggcaatcggacttgtaagactgaaggctggcagaagttttttcccttccatggttagcctttctgcacaacgggtgaactcttgtgtcgggtgtttggtgccgttgtggccttatttttgtaaagtgcatcaaattgacaaatgttcagaggggaatgggttgggggtttaggaaaacggtgcagctgccagatttcgcctatgtacttagatgtttgtgggggtgagaaagcagagcctgtacagcttattcacccattttgttgccattacactagtagtgacttgtactatgacaacagtagacattgttgtacagccttaccagtcagcagcgggtctttctcattttatttattagttattaatcctgtgggt

SEQ ID NO: 717 - DNA, 540 bp, Zea mays
  misc_feature (513)..(513): n is a, c, g, or t
ctcaaaagatcacagagagagaaaacgaaacgccgctccctcgcctcatcccttccctcctcctgcatcctacctccctggtacccgtcacgttcaccacgttcgcccgctcattcaccggcggcgtcgcccagctcggcctcccgccgcccacggaggccaggtccccgggccgcccgctcggtccgccacagaggcaagcttctggaggcttctcatatctatatgagccgttatggtggttgggaatgataactatgattctaggcgaggtagccaattttgcagcatatgcatttgcccctgccgtacttgttactcctctaggagctctaagcatcatatttagtgcagtgctcgcacacttcattctgaaagaaaatttgcacatgtttggcgttgttggttgcatactatgtgttgttggttctgttggtatagttttgcatgccccaaaggagagaaaaattgattctatgaaggaaatatggcatcttgcaacacagccaggtnttattgtttattcatgcgtggcagtgg

SEQ ID NO: 718 - DNA, 1641 bp, Zea mays
  misc_feature (1607)..(1629): n is a, c, g, or t
ctcaaaagatcacagagagagaaaacgaaacgccgctccctcgcctcatcccttccctcctcctgcatcctacctccctggtacccgtcacgttcaccacgttcgcccgctcattcaccggcggcgtcgcccagctcggcctcccgccgcccacggaggccaggtccccgggccgcccgctcggtccgccacagaggcaaggcatggtggcgtctttagacaatgtgaggggcttgactttagccatgtcatctagtgcattcattggttctagctttgtgatcaagaaagttggattgaagaaggctggggataatggggtgcgtgcagcttctggaggcttctcatatctatatgagccgttatggtggttgggaatgataactatgattctaggcgaggtagccaattttgcagcatatgcatttgcccctgccgtacttgttactcctctaggagctctaagcatcatatttaggtagagctttactgtcatcgtagatttccttacacctagtgttgcgttcctggttaatgttttgctcatgcagtgcagtgctcgcacacttcattctgaaagaaaatttgcacatgtttggcgttgttggttgcatactatgtgttgttggttctgttggtatagttttgcatgccccaaaggagagaaaaattgattctatgaaggaaatatggcatcttgcaacacagccaggttttattgtttattcatgcgtggcagtggcctgcgttctttttttgatatttcgggttgttgagcgctctgggcacagattgatgcttgtttacatagcaatctgttcattaatgggatctcttacggttatcagtgtaaaagcagttgccattgctttaaagctatcatttggtggatcaaatcaattcatctacgtccagacatggttcttcatagtagtagtcactatttgctgcttggtgcaattaaactacttaaacaaggctctggactcgttcaacacggctgtggtttctcctgtatactacgtgatgttcaccattcttaccattgttgcaaacatgatcatgtacaaggactgggcctcgcagactgcaacgcagatcgcaacacagctatgtgggtttgtgaccattgtcgcggggacttttctgcttcacaagactagggatatgggaaatccaccaccaccaccacctgaccaaatgtgcctgcaagaagccggggaatgtgctccacggtcaatgaccagttctagctgaacacactaagatgtcaaaatctcacagcctctatggactgaattggaattttgagctatatggtgacctttgtagatatattaggaaggagtaaagattggagtgcccagcagttggacataccgatgaagttttacgtttctgcaaaagaaagaatgaactgtatgaaggcatcggaatcttgtgaagacatgagattcaaactagctacctaactttggtaaatagcttgttatgccattttaaaacgatcatgatgctcaagaggcagggcgaattaggcttctctatactttttgtgataattaaaccctagttacaaatttaactttacccgagtgtccaatatnnnnnnnnnnnnnnnnnnnnnnnaaaaaaaaaaaa

SEQ ID NO: 719 - DNA, 1351 bp, Zea mays
  misc_feature (1322)..(1323): n is a, c, g, or t
aaaagatcaaagagagagaaaacgaaacgccgctccctcgcctcatcccttccctcctcctgcatcctacctccctggtacccgtcacgttcaccacgttcgcccgctcattcaccggcggcgtcgcccagctcggcctcccgccgcccacggaggccaggtccccgggccgcccgctcggtccgccacagaggcaaggcatggtggcgtctttagacaatgtgaggggcttgactttagccatgtcatctagtgcattcattggttctagctttgtgatcaagaaagttggattgaagaaggctggggataatggggtgcgtgcagcttctggaggcttctcatatctatatgagccgttatggtggttgggaatgataactatgattctaggcgaggtagccaattttgcagcatatgcatttgcccctgccgtacttgttactcctctaggagctctaagcatcatatttagtgcagtgctcgcacacttcattctgaaagaaaatttgcacatgtttggcgttgttggttgcatactatgtgttgttggttctgttggtatagttttgcatgccccaaaggagagaaaaattgattctatgaaggaaatatggcatcttgcaacacagccaggttttattgtttattcatgcgtggcagtggcctgcgttctttttttgatatttcgggttgttgagcgctctgggcacagattgatgcttgtttacatagcaatctgttcattaatgggatctcttacggttatcagtgtaaaagcagttgccattgctctaaagctatcatttggtggatcaaatcaattcatctacgtccagacatggttcttcatagtagtagtcactatttgctgcttggtgcaattaaactacttaaacaaggctctggactcgttcaacacggctgtggtttctcctgtatactacgtgatgttcaccattcttaccattgttgcaaatatgatcatgtacaaggactgggcctcgcagactgcaacgcagatcgcaacacagctatgtgggtttgtgaccattgtcgcggggacttttctgcttcacaagactagggatatgggaaatccaccaccaccaccacctgaccaaatgtgcctgcaagaagccggggaatgtgctccacggtcaatgaccagttctagctgaacacactaagatgtcaaaatctcacagcctctatggactgaattggaattttgagctatatggtgacctttgtagatatattaggaaggagtaaagattggagtgcccagcagttggacaaaaaaaaaaaaaaaaaaaaannaaaaaaaaaaagaaaaaaaaaaaaaaaa

SEQ ID NO: 720 - DNA, 1472 bp, Zea mays
gggtacctaaaaagatcacagagagagaaaacgaaacgccgctccctcgcctcatcccttccctcctcctgcatcctacctccctggtacccgtcacgttcaccacgttcgcccgctcattcaccggcggcgtcgcccagctcggcctcccgccgcccacggaggccaggtccccgggccgcccgctcggtccgccacagaggcaaggaattggttcttttagtacttgacagaaataaatatattccaggcatggtggcgtctttagacaatgtgaggggcttgactttagccatgtcatctagtgcattcattggttctagctttgtgatcaagaaagttggattgaagaaggctggggataatggggtgcgtgcagcttctggaggcttctcatatctatatgagccgttatggtggttgggaatgataactatgattctaggcgaggtagccaattttgcagcatatgcatttgcccctgccgtacttgttactcctctaggagctctaagcatcatatttagtgcagtgctcgcacacttcattctgaaagaaaatttgcacatgtttggcgttgttggttgcatactatgtgttgttggttctgttggtatagttttgcatgccccaaaggagagaaaaattgattctatgaaggaaatatggcatcttgcaacacagccaggttttattgtttattcatgcgtggcagtggcctgcgttctttttttgatatttcgggttggtgagcgctctgggcacagattgatgcttgtttacatagcaatctgttcattaatgggatctcttacggttatcagtgtaaaagcagttgctattgctttaaagctatcatttggtggatcaaatcaattcatctacgtccagacatggttcttcatagtagtagtcactatttgctgcttggtgcaattaaactacttaaacaaggctctggactcgttcaacacggctgtggtttctcctgtatactacgtgatgttcaccattcttaccattgttgcaaacatgatcatgtacaaggactgggcctcgcagactgcaacgcagatcgcaacacagctatgtgggtttgtgaccattgtcgcggggacttttctgcttcacaagactagggatatgggaaatccaccaccaccaccacctgaccaaatgtgcctgcaagaagccggggaatgtgctccacggtcaatgaccagttctagctgaacacactaagatgtcaaaatctcacagcctctatggactgaattggaattttgagctatatggtgacctttgtagatatattaggaaggagtaaagattggagtgcccagcagttggacataccgatgaagttttacgtttctgcaaaagaaagaatgaactgtatgaaggcatcggaatcttgtgaagacatgagattcaaactagctacctaactttggtaaatagcttgttatgcc

SEQ ID NO: 721 - DNA, 1991 bp, Zea mays
aacctcagtagtagcaggacgtatctagagccatttctacacgagatagagattaataaaaataggagcggagagagaggggcaggaaataaacgaggatctcaaccacacgcaacacaagaagctgacgaagggctaatcccccggaacccgttaacgctgtgggagtgtgagcccacccggccacccgtttcggctaatccaccgctcgccttctcccatcgccatgcctgccgcttcctggtccgcgcccaccacctccttcgcgccggcgccggcgccgccatgggggccgtggaggaccaaggcggcgcctttacccatcaggacgcttccccgccgagtgcttctcaacgcagttggcgaatccgccatggttgctgctggtgacacattgcttggtttgtatgagaaagagcggttaggcctgttgcagtatgccgacgacgagtctaaagaagagaggtactgggaaaccttggatgctgatttgcgttactggaccagatccctgcgcccagtgcaggtatacttaagtggtatcctggtcatattgcaaaaacagagaaagaattgaaggaacaattgaggctcatggatgtcgtcatagagatccgtgatgctaggattcccttgtccaccagccatcctaagatggactcatggctaggcaaccggaaaaggatcatagtcttgaatcgcaaggacatgatctcaactgaggatatgaatgcatgggctacttactttggtaatcagggcatcaaagttgttttctccaatggccagctgggtatgggtacaatgaaattaggtaggatggcgaaatcagtagcatctgttgcgaacacaaagagaaaggagaagggattgcttcctcgtccggttcgagctggaatagttggatatccaaatgttggcaaatcttccttgattaatcgcttgctaaaacgaagaatgtgcccagcagcacctaggccaggtgtcacaagagagctgaagtgggttcgttttggaacagacctagagttgttagattcacctggaattttacctatgcgaattagtgaccagacatctgcaatcaagcttgctatatgtgatgatattggagaaaggtcatacgattttgctgatgtggcggcgattcttgtgcagatgttgataagacatcctgcagtaggttctgaagcatttcgaagacgatataagattgatgtagatagtgagtgcggtaaaacgtttgtcacaaagctctctgttcacttgttcaatggagacacaagccaggcagctttccgcatattgtctgactacaggaaaggcaaatttggatgggtagcgctggagagacctccaacatgaacaagcgggatatcatagatccttagataaaagacatgtgcttgttcatgtagtatcacacaatttagtgtcgttcattggaccactctcgacagttttcactggacctgcacctatacgaggaattaattcagaatagctgtccatctgatgatctaaagacaaaacttaagaaatgctcctgctgttatcagacagtccagagcaaacgagctgatttgtatgatctattgaatgagctcaactatgtttctatgtaacggaattaggtttgagaaatgaaagattgtatgtctcctaatttagttgctcatgtactttgttcttttaggaaaagttgctcctgtacttctggatgattcattagattcgggaactggtgtaacattttaggcccagacaatagacatccctctacagtttcagtttccctgcttttaagttttctgcaaaaaaaaaatatatatattttctcccttctaaactataagtcgttttggcttttcttagtacatgatttttaccagtataatttttagtatatatctagacataaactaatatctaggtgcataacaaagctaacaaaattgtatatcactatgtatttagaaaaactaaaatga

SEQ ID NO: 722 - DNA, 2270 bp, Zea mays
acctcagtagtagcaggacgtatctagagccatttctacacgagatagagattaataaaaataggagcggagagagaggggcaggaaataaacggggatcccccccggccggccgggaagaagctgacgaagggctaatcccccggcacccgttaacgctgtgggagtgtgagcccacccggccacccgtttcggctaatcccccgctcgccttctcccatcgccatggctgccgcttcctggtccgcgcccaccacctccttcgcgccggcgccggcgccgccatgggggccgtggaggaccaaggcggcgcctttacccatcaggacgcttccccgccgagtgcttctcaacgcagttggcgaatccgccatggttgctgctggtgacacattgcttggtttgtatgagaaagagcggttaggcctgttgcagtatgccgacgacgagtctaaagaagagaggtactgggaaaccttggatgctgatttgcgttactggaccagatccctgcgcccagtgcagtggtatcctggtcatattgcaaaaacagagaaagaattgaaggaacaattgaggctcatggatgtcgtcatagagatccgtgatgctaggattcccttgtccaccagccatcctaagatggactcatggctaggcaaccggaaaaggatcatagtcttgaatcgcaaggacatgatctcaactgaggatatgaatgcatgggctacttactttggtaatcagggcatcaaagttgttttctccaatggccagctgggcatgggtacaatgaaattaggtaggatggcaaaatcagtagcatctgttgcgaacacaaagagaaaggagaagggattgcttcctcgtccggttcgagctggaatagttggatatccaaatgttggcaaatcttccttgattaatcgcttgctaaaacgaagaatgtgcccagcagcacctaggccaggtgtcacaagagagctgaagtgggttcgttttggaacagaccctagagttgttagattcacctggaattttacctatgcgaattagtgcccagacatctgcaatcaagcttgctatatgtgatgatattggagaaaggtcatacgattttgctgatgtggcggcgattcttgtgcagatgttgataagccatcctgcagtaggttctgaagcatttcgaagacgatataggattgatgtagatagtgagtgcggtaaaacgtttgtcacaaagctctctgttcacttgttcaatggagacacaagccaggcagctttccgcatattgtctgactacaggaaaggcaaatttggatgggtagcgctggagagacctccaacatgaacaagcgggatatcatagatccttagataaaagacatgtgcttgttcatgtagtatcacacaatttagtgtcgttcattggaccactctcgacagttttcactggacctgcacctatacgaggaattaattcagaatagctgtccatctgatgatctaaagacaaaacttaagaaatgcccctgctgttcttagacagtccagagcaaacgagctgatttgtatgatctattgaatgagctcaactatgtttctatgtaacggaattaggtttgagaaatgaaagattgtatgtctcctaatttagttgctcatgtacttctttgttcttttaggaagagttgctcctgcacttctggatgatccattagattcgggaactgatgtaacattttaggtccagacaatagacatccctctacagtttcagtttccctgcttttaagttttctgcaaaaaaatattgtctcccttctaaactataatcgttttggcttttcttagtacatgatttataccagtataatttttgctatatatctagtcataaactaatatctaggtgcataacaaagctaacaaaattgtatatcactatgtatttagaaaaattaaaatgatctataatttggaacaaaaaagagtactacggttcatacaaaccattctggcctagtggccatcaaaacatagaacaaaaacatcctttttgccctccctttttaaacttcagaacttgcacttcttatttcttgtgcagttacaaacggtatgtcatttttacaacattttgccattctattcggtacaggatatacgatacaagcttctcatactgttagcttctcaccagagttcaaagggcggcattgcggacgcgtgggcggacgcggggcggacgcggggcggacgctggg

SEQ ID NO: 723 - DNA, 688 bp, Zea mays
ctagaacatcctaatcgaaaaccgtcttggtggctgcaattctatgaatatgcagttatcgcaattgcctttagattgtaaaaggctgacttatgatgctcttgaaggagctaacgtcactccgacgtccttttacaacattggtgatcttgagattcaagataatctagcacgaggtagacattggtattcatgagccattgcttctggacatcctgcttaatgccttaacaacaataagttcagatcatgttggtattaagcaagtacagtttggagggtcagagtttttgaactggagcgaggacttgaagacagaagaagttggatatagtgtgtgcaaaatctaaatagcacaatcccgagatttgcagaagcagctacctttttagctaaacgcaaatgcaacatctggttcgaagctagggttttaaccaccttgatcctgcaaacgagaagaagaaaatggtgacaacacgatgaaaaattgacgtccaaacatattaacttctgcttgaaaagaggttgccgtctgtcaggaacatgggatctgcacatgagcaattggaaggctgaaagagcagaaggttgagcgggaggagtaatctgtgtaattgagttttgtttgtgattaggcctattgggccaagggtttgggccgtctggccttgtaaggagggtgtacgta

SEQ ID NO: 724 - DNA, 1441 bp, Zea mays
gacgtcgtgccgagcgcacctgttactgctgcacttgctgctttgcacacgcactactgcactgcactagccgcgcctcgcaggtcgcgtcaagcaagcgcaggttcagtcctcatcgcgaaggggccagatatgctgctatctgcgtttctcggcaattgcctgttcagctacccgccgccgcctcttctacccgcaacaacggctgccccgagaccgagcacgcgtctcccggttccctttcctgctcgcctcaggcccgcgtccctcgtcgcccgacggctgacggcggaggcgggggaggcgctgagcgcgttatccgccgcggagggcgacgacgaatacgaagcggagctccaggaggaagggtttccgagctgggcgggcggcggcgaggaggaggactacgaccacgaccccgaaatcggagacattatgggggactacttcgacgaccccaagaagggccaaacccgcatggaggataggataagaaagaaacgccacaagatcgtgcaaaccaagaccggctctccaaaccccatgaaggtcgtcttcaacaaatttgacttctccaattcctatatatggttcgagttctacaatgttttgttgccaaaagatgttacgttgatttctgattctctgcgatcatggcatatagttggccgtcttggtggctgcaattctatgaatatgcaggagctaacgtcactccgacgtccttttacaacattggtgatcttgagattcaagataatctagcacgagtatgggtagacattggtattcatgagccattgcttctggacatcctgcttaatgccttaacaacaataagttcagatcatgttggtattaagcaagtacagtttggagggtcagagtttttgaactggagcgaggacttgaagacagaagaagttggatatagtgtgtgcaaaatctaaatagcacaatcccgagatttgcagaagcagctacctttttagctaaacgcaaatgcaacatctggttcgaagctagggttttaaccaccttgatcctgcaaacgagaagaagaaaatggtgacaacacgatgaaaaattgacgtccaaacatattaacttctgcttgaaaagaggttgccgtccttacaggactctgctagctacacatcaacacatcattggtaatccttctgcatacatgtaataatataatataactagattatctgatgtccaacgtgtattgactctacttagggctgaacataatacttatggctcgttagttcgcttggctcgacttagtttatttcaattttgttacgagctaagttagtattttagctcggtttgttaacgagccatctcgttagctcaaacgagctatcatttatcaacaaaataaagtcttcacttaaaaaaaaaaaaaaaataagtgattagttatatt

SEQ ID NO: 725 - DNA, 2663 bp, Zea mays
gggtagaggagaggcaagaaaatgatgcggttatctactcccgctcgcacatgcttcccctccacgttgccgcctccgcaactaccgcctccgcaactaccgtctcggtcaccccacctcctcgcgtccgccctcgctccccgctcggcggcgtggcgccgcgggctccctccccctcctccgcccgtggtctccgccatgcgccggcgcggtcgccgcagggccgcgccccctccggccgctgccggcggcggcggcggcggggagctcgctgcctccgattcccaggagaagagagctggtacagacctcaagacactagctacaagattttggaaagtcgctgccccctactggtggtcagaggataaaactcaagcaaggctgaggcttgctgctgtgtttgctctcacattaggaaccacagggattagtgttggatttaacttcctcggccgtgacttctacaatgctcttgctgataaggatcaagagaagtttaccacacaactgctctactatctgggtgcctttgctggaggaattccgttctttgtcttgagagactatgcaagagaaactctttctttgagatggcgatcttggatgacaagttattatatgaagcgttactttaaaaacagaactttttacaagattcaatctcaatcaataattgacaatccagaccaaaggataaatgatgatctcagcgcattcactggaacggcacttgcattctcgctcacacttttcaatgctgctgtggacttggtatcattcagcaacatcctctatggaatctatccaccattgtttattgttcttgttgtgtactctcttgggggtactgctattagtgtcttccttggtaagaatttggtcaacttgaacttcatgcaagagaagaaagaagccgattttcgttacggacttgtccgtgttagagaaaatgcggaatcgattgctttttatggtggtgaggaaaatgagttacaacttttattggatcggttcaggagggcttttgagaacctaaggaattgctgatagcttctcggaatctggagtttttcaccaatggttatcgatatttgattcagattctgccagctgcagttgttgctccaatgtacttctcagggaaaattgagtttggagtaataaaccaatcggtgtctgctttcaatcatattcttagtgatttctctctcattgttttccaatttcagtcaattagtgcattctcagcagttatcgatcgtctaggtgagtttgatgatctattggatggaaacgagtcctctctatcatctcaacgtgatagcattgatgggatcaacattgttttcaaaagcagcggtccttgtgttcctagttctaatggatcgctaacacagtctgatccatgcatggttctggaaattcataacttgacattgttaacaccaagaagtggaaatgttcttattactggcctcactatggaactaaaagacaaggaccacctactggtgatgggacctagtggaagtgggaagacgtcgctgttacgtgctttggccggcctctggactagtggaactggggagatcatataccacgtgagaggttctacgcagcttcaaaaaccaaatccaagttctgataaaccatccagcatgaatttaaagggcgaagaagaatcgttgcaaagttccaagcaaagaagagataatggcatattcttcgtcccacaaaggccgtatatggttctggggacacttcgtcaacagttgctctatcctacgtggactgaagaggttcaacactcaccagataatgatgataaaaactcagcagatcctcttccttttctgtccgaagtctccacatcagatctggtcggtgccaaatccgaggtgccctcgacagctgaactgatcgaagtccttgaggacgtcaagctgggttacatattgcctcgtttcaacggcttggactctacccatgactgggccagtgttctttcgctgggggagcagcagcgtctcgcgttcgcccggctattacttgctacacccactttggtcctgctggacgagtcgacaagcgcactcgatgaagcaaacgaggctcatctatacagtcagattgaagctgccggcattacctacgtaagcatcggccaccggaaaacacttcacaagttccacaacaaggcgctgtacatttccatgtctgattcgacggacaccaatccacgcaactgggagctaaagcccgcggacaagcttccagctgaggagccatcgcagttcccttcatgataatctcagcatttgtacccctggttgctgcttcctcatttttcgtccgttatttggcccccaatcagaagtatggctcaactgtaatgtaccgccatagtgctgcaagctgaagttggactgtttcaggatgatcgtcaaggttgctgccatgcatgctacgacgacccgggccgccggacatgatagctctcatgtgcactcagaccttagagaacagaacagtatagaatgtacataactcggatgcaagtacttatggtcttggtgttggtaatcgttgatctgtactacgctcttaatgctctgattcttttgttggatgatgaagtgctaggaatttcagttctgact

SEQ ID NO: 726 - DNA, 982 bp, Zea mays
attggggccccctcgagccggcccgggaccctacactctacaagtccaagttcacgccaccaccaatgtctgcggccgtggcattggcggtcatcttggccgtctacgtcgtcctcaggtatatagcctctccgagaggcaggtctaagcctctgaaccttccacctggcccgcgaggatggccggtgatcggaagcctcggcgcactggcaggcgcgcttccgccgcaccgagcgctggccgcgctagcggcgcgccacggcccgctcatgcacctgcgcctcggctcctaccacgcggtggtggcctcgtcggcggacaccgcccggctcgtcctcaaggtccacgacctcgccttcgccgaccggccgcgcacggccgccggcgaggtcgcctcctacggctacctcggcatcgtgcacaccccgtacggcgcctactggcgcatggcgcgcaagctctgcgccaccgagctcttctccgcgcgccgcgtggactcgttcgagcgcgtccgcgcccaggagatgcgcgcgctcgcgcgcggcctgttcgagtgcgccggccgcggcgccgtcgcggtcagggagcacgtggcgggcgccacgctgcggaacatcctccgcatggcggtcggggagaagtggtcgggctgctacggtagccccgagggcgaggcgttccggcgcacgctggacgaggcgttcgcggtcaccggcgcggtcagcaacgtcggcgagtgggtcccgtggctgggctggctcgacctgcagggctgcgtccgccggatgaagcgcctccgcgcgcagtacgaccgcttcttcgagcagatcctcgacgaccacgaccacaagaagacgcggcgggagcgaggccgacccggcgccggcgactccgcggcggacgatgacctggtcgacgtgctgctgcggctggtcgaggaggacgaggacaggccggagacgacggaggccagcaagctcac

SEQ ID NO: 727 - DNA, 1957 bp, Zea mays
  misc_feature (364)..(364): n is a, c, g, or t
ttaagtatatccttggtgaggatctcaatattttggcgccctggcggccgccagctcgccccctcagatacgggcctgcgccaaggtctgaggcaacagtgcgcgaagataaccacgcgggagcggaagctcggctggcgtgcggtgcggcccggcccggcccggcaacgaaggcgtggtgcagtcctggccgacgcgcagcacgaggcggtggctcggcaggtgtgcggactcatcctcactcatcttgccttcgctttctcggagctgcaacgcctgcccgtcgttggccctcatggtcagcgagacaagagcaggtacaaaataaaaaatgagaacaagtagtattgagaaagaaaatctnctggagctagttttgtctattaaattcctttataactgtttttacatgcttatctaaatagttttcttagagcatctctagagtactctctattttaactctctatttattttttcataaaaattaaaactctatatgtagtattttactccaacagactcttcaatatacaagtttgacgagttagatgattaatctgttgaaaagttattctactattaaaatagctaaaatttgacttaaccagtcatttagctagtttattggagatattcttatctatattttatttatcttcaacacatgtaaaatgtattttattctagatttttagatatatgtatttatcatatttttaaatattactgtctaaacaataaaaatagataaagagatgagtgtgttttttatataaaaaatgaagtttataaaatatttcagagacaataaaatcttctttaaataaaggatagatgatctttagtaatgtatttttggagacagtgtttagagaaatgtgacggttaagaaggccgtgattttatgacctcgttaccatcacctgctattttggcgggaaaaagcctttttctcccgcgccttttcccattcccctccagtctattaacctttcagtgtctccactcgcacttccgcgacgcgcaacccaaagcaaacgcaccgggctcgagccaatccaccacccagccatgcctcccaagcgcaagtccccggcgacgattgcccctgccgcggggtccccgaggaagacgcggagcatggttgctgctgctgctgcagggaagcgggcaacggagcctgctccggcgaaggcagtgccggccaagaaggaagacgaggcggcggttgccgagttgaaagggaggaagaggggcaagaaggaagccgaggcggtgacggtggccaccgagccgaaagggaggaagagggacaagaaggaagccgaggcggtgacggtggccaccgagccgaaagggaggaagaggggcaagaaggaagccgaggcggtggcaccagcggcagaggaggaggatggggttgatgtggcggctggagcgaagcgtgtcatcgtcgaggcctgcactcagtgcagacagtttaagatccgagctcagaaggtgaaggaggacctggaaagttatgtttcgggggtgtctgtgataatcaaccctcagaagccacgccgtggttgccttgagatacgtgaagaaggcggtgaagtgttcatatcactgctgaacatgccacgccccttcacaccaatgaagaagctcgacatggacaaggttatcaaggacatcgccaagaagatctcctaaaccatgttggctggctatggctcggcggcaccattttgtgattgaaatattcaatctaagatcgtaatcttcaaagggtacggtgtaccttaggtgtaggttccaatcagtggcgtttcctattgcattggccatgtgcccatgtctcgtactcgtacctatgcttgtcctgcattgctggggcatatcgttttctgttatatgatatatgccctgaaaattccttgacttccaaaaaaaaaaaaaaaaagcc

SEQ ID NO: 728 - DNA, 1801 bp, Zea mays
  misc_feature (1800)..(1801): n is a, c, g, or t
cactactatcatttgggttccctcgcccccctgcttcattccgttcggatacaccgtctcgtttctctctcctcccctcgcccgtcttccctcctgtgcgagctcagctcacggtcctcccacccccacgagcgcctccgcggcgaggaagagataatcagcaggcggagcggggggcgcgccgatggatctggagaggtcgccgccgccgtcgccggcggaggcggccggggccgcggcgtgctccatctgcctggatccggtgctcgcctgcgtcgcgggccggtccgtcgccaagctgcaatgcggacacgagttccacctagattgtattgggtctgcattcaatgcaaaaggagcgatgcaatgccctaactgtcggaagattgagaaaggtcgctggctttatgcaagtggacgtcacccccctgctgatattgatatgggtggctgggtgactagcgacaactatgatatcacctccgagcttccttttggatttcaatggtgtccctttagtggattcacccagctagcatcaatgtttggggtgcgtgaagctgagccaacttaccacacaactggagatcactcaagtgctgcaagcagttcacttgtttgcccatatcttgccctgcgtggttttctccatcctgttcatgtgccttctacttctaattctggtgctgaaagcacttcatttcatcggcactcaactggcttggaaggacatgtcactcctgatttgaacaatgctccagttttccatgctaccgagtcaagaaatcatgacagtgagcacagacatttgagtaatcttcctgtatcaggaactcctgaatattctatgactccatttgggataggagtaccaagatatgacagtggcagccaacagggattccgatcatatgcacatcatcatcccctaatccataggctgacccctcgcagcggaagcaatctggtggcaccattagggtcagttccagccgtcgtggcagagactagaggccatggccatggtgcaccgggccatatgtaccagcactcatctgtgcagggcagcccgttccctcctaccaccagaagggttaggcccagagccttgacgattacgtctttcatcgcagcgacttcctcagctgagattgcagggccccttggccacgggtttcccgctcctggagccgtgaacaggagcgtttctgatgccgagggcatcgaccgagcgtacacatggggccgggagggatatgatctgttcccttggatccctgctgaatggggcaccttcaatcccatgcagaaccatgcgcatggaagctttaccagaaggcctgctggggagcggatgccgcagagtcgccccgagaacggataccagccacctgtgccctcttcacagaggatgccaccgttcttgtgatcagacgaggctgcctctccaattgctgtgtataaaattatttgattcggggcttgcagagaacaacgagcgaatatcgaccgcacggcagcatcgaaactggtcggctatgggacctgtgtgtgtgtgatgtttatgatgatgccgctcgtatttttagcgctttcggtccagcagcgctcaggtttcatcgagcactgtcgtttgtcctgactgatatggtgttgcgttgagaaggactgtttgagctaaactgcatctctggtcccgggattcgaaagcaccgcgtgcagctataggatttgttcgtcacatcacgttcgtgtatatggctggccctggccgtttcatgtcaaaaaaaaaaaaaaaann

SEQ ID NO: 729 - DNA, 1971 bp, Zea mays
gccacgcgcctgtcgttctcgtgcatgctcacggtcccccacgcccacgagcgcctccgcggcgacgaagagaatcatcaggcagagcgggggtggggcggggcgcagatggatctagagaggtcaccgccagcgtcgtcggcggaggcgcccggggacggcggcgggggcggggccgcggcctgctcaatctgcctggatgcggtgctcgcccgcggcgctggtcgctccgtcgccaagctacaatgcggacacgagttccacctagattgtattgggtctgcattcaatgcaaaaggagcgatgcaatgccctaactgtcggaagattgagaaaggtcgctggctttatgcaagcggacatcgcgcctctgttgatattgatatgggtggctgggtgaccagtgacaactatgatatcacctccgagcttccttttggatttcaatggtgcccctttagtggattcacccggctagcatccatgtttgaggagcgtgaagctgagcttacttatcacacaactggagatcgctcaagtgctgcaagcagttcacttgtttgcccatatcttgccctgcgtggttttctgcatcctgttcatgtgccttctacatctaatcctggtgctgaaagcacttcatttcgtcggcatgcaactggcttggaaggccatgccactcttgatttgaataatgctcaacttttccatgcgaatgagtcaataaatcatgacagtgagcacagacatttgagtaatcttcctgtatcaggaattcctgagtattctatgactccatttggtataggactaccaagatatgacagtggcagccaacagagattcagatcatatgcacatcatcatcccctaatccataggccagctcctcgcagtgggagcaatttggtggcaccaccattggggtcgattccagctgtggtggcagcggcagagacagcaagaggcagccacatgtaccaacactcgtccgtgcacggcagcccgttccctcctaccaccactagaagggtgaggccgagagccttgacgatcacatcgttcatcgcagcgacgtcctcaggtgagatcggaggcccccatggattctccgctcctggagccaccatgaacaggagcgtctctgacgctgagggcatctctagacccattgaccggccgtacaatgcatggggccgggagggcttcgctccgttcccctggatccccgctgaaggcgagtctcactggtggggcaccttcaaccccgtgcagaaccatgcgcatggaggctttagcagaaggcctgctggggagcggatgccgccgcaggagccaaagccacccggagaacagctatcaggctgtgccgccgtcacagaggatgccgccgttcttgtgattcgacaaggctgttcctacgtccgatcgctgtatataaaaagaagtattcggttcgggacctgagagagcacattgagcgaagatcgactgcactgcagtctccagcgttgggacctgtgtgatgtttatgccgctggtatttcagcgtttttctttttccctccggtccagcactctggtttcattgagcgctgtagactgtctgtcctaactgatgtgttgcgttgaggaggacgatttggaaacgtgagcccgaagctgaactgcatctctggtcgccggggctaaaaaatgccgtttgctgctatgaaagttgtatcgatttgcggccgcaggtcgcctgcaaatttgttagaacaggtgaaatttagtgaacacaaatgttggagacctgcggcgtttacattttttttgttggttaccgagattgtatttaaaggtcgtgatgcgccatcaagcgattgtgatggatcaatttatctccctattgtagcaatgggttttttttgaaaccgatggatgtatatgtcactagaagtaaataccagacaaatatagttgtattcc

SEQ ID NO: 730 - DNA, 3085 bp, Zea mays
aattgaaacaattgacagaattggagcgcattagaagaaagattggcgaggttttctgccttgtttttgatgagtaacaaggacgacagtaagtgatgattccatggccggctgtgccactgcagccggtaacagagacaaccttgggtgcagctgggcattcttcattggtcaggtcaccatcaacaggagttgaggttgaggggtacagagccacatggatggctgagggggccatctttgtcagaggattctctattggcaaagcaggcctattgggaattgtgataagattcatgttggtctttccattttgggcaaggcttctgctaggcagacgatgttggcgtggtttgttgggcacttgggctttctattttgggctgtatccttgctgtttgcttcagactttttagtgtcacacttggccaccggtggtgaaggctgtgacatgaggaagatgaagatgctctcacatttaaatttctggtggctgctgacgacatttccacccccacaggccacaacgttgcctgtccccacgacatgaccatgaattggcatctccatgactggagcccagaaattccagaatcccattgtctcgccatgtatggctcgagttgcaactcacatttgattggggtgacagtgacaccactgtctctccatgaccgaattgcttcaaacattagatcagtgtcacaccatggtctacctagcttcttgtttgcatgaccacactctgtactctggaagcagcaatatttcacccacttagtcaaaaatgctgtatacctcctcagcactaaaaccctggggcctgggccttagaacagaagacttgaccaagtactttgatttgcacaagcatttggtttcttacatccatgccaggttctaggaagagggaagacttgtccccgttggcgcataacttgtatactatgcctagatcaagctgcaggaagacagaatcactgatattttgcaataatgtagcagacatctgctgtttcatgactagggtcctccctgccaatcacgggctatttgttgtagtaacttgtcccgtgtctcattgctaaatggcatgccctcatgccacacatttggatgaggtacttcattccacagttcccatgcagcaacctttgtttccatgtgagccctgaacatgtccagttcatcccgagctgctgcattggcctcaaggggcgtccattaaacaaaccgtcctcatcaacatctatgacagcatccaatgggaagccctcaacatctatgagatcctcgccatggcctttggagtcttcgatggacaagaggcggccgtagactcgatcgacgggtcttcatggtagcccttgtgaccttcggcgaaccgtgcatccccaacagctgtgttggcctcaagatggcagtaactgatttgttttgtttgggactaggtgcatctgcagtctgcacccatatgggacgatagactttggcgctgccttaaatatgaaaaactgatctgcttgatggtttcattggctagtccatgcgtactgaaatattgtctgttacaaatctctgcctgattttctttcgctttgttaaaccacaaatttccctctcgttcaattactgcaggctgacccctcgcagcggaagcaatctggtggcaccattagggtcagttccagccgtcgtggcagagactagaggccatggccatggtgcaccgggccatatgtaccagcactcatctgtgcagggcagcccgttccctcctaccaccagaagggttaggcccagagccttgacgattacgtctttcatcgcagcgacttcctcagctgagattgcagggccccttggccacgggtttcccgctcctggagccgtgaacaggagcgtttctgatgccgagggcatcgaccgagcgtacacatggggccgggagggatatgatctgttcccttggacccctgctgaatggggcaccttcaatcccatgcagaaccatgcgcatggaagctttaccagaaggcctgctggggagcggatgccgcagagtcgccccgagaacggataccagccgcctgtgcccacttcacagaggatgccaccgttcttgtgatcagacgaggctgcctctccaattgctgtgtataaaattatttgattcggggtttggcagagaacaacgagcgaatatcgaccgcacggcagcatcgaaactggtcggctatgagacctgtgtgtgtgtgatgtttatgatgatgccgctcgtatttttagcgctttcggtccagcggcgctcaggtttcgtcgagcgctgtcgtttgtcctgactgatatggtgttgcgttgagaaggactgtttgagctaaactgcatctctggtcccgggattcgaaagcaccgcgtgcagctatggatttgttcgtcacatcacgttcgtgtatggctggccctggccgtttcatgaccgctcgattcctctgccagcgcagcagcgccgctattgtttttttttaaaaaacgtgctgcctcgcccactgccagtttcgcaccatgtttgttgtgacttttatccggctgatgttgccctctataatattctacaatattttgtctctatatattagagctgcagtagttcgaacagcaggggtaccgagctgcaaccaaataggatgtcgaagattaacacccagatgttcgtcacgtgctaaatagcggtcgtgaacctaagctggagtttattgaagtataataaactctatgtcgtatttatctttatctatctagatgatatcagagatcttgtgtgacttgaattatgttgtcacactaaataatgtgtccgggttttgtccgactttatcgtaaaataaattagaaactcaacctcttttcacgacttttctcccaaaccgagttaattgtcgaccacttcggatctctgtttcgaagattgaaaggattgttgcactttggaacacgtactttactggaccaactcatgtacatgattaataattagtgttcggataacgagcagttgaaaatattgataatacatacttaatca

SEQ ID NO: 731 - DNA, 3284 bp, Zea mays
gattaggcgagataatggccctcttgggtactgtagcatatatataggcatataagaatatattgggctttaacaatgtccatgaattgcatctcaatgactagccacccagattccaggatcccattgtctcgccatgtatggcttgagctgtagctcacatttgcttgggttgacaccactgtatctccatcacgccgttcggctgcaccgctgcacttattttcactgtgccgtggctcatcagcccaaacggctgcagccaaccagcagccaaacggagtgatgacaaaatcacttcaaacaatagatcagtgtcacatcatggtctacctggcttcttgtctgcatgacccactctgtactctgggagcagcaatatttcacccacttggtcaagaatgttgtatacctcctcagcactaaaaccctgggccttagaacggaagagttgaccaagtattttgatttccacaaacatttgttctgttacatccatgccatgttctaggaagacggaggagccatcacaattggtgcaccaactttgtacactttgtctagaccaagctgcaggaagacagaacaagcactgttattttgcaacagcctttgtctctgaggcgtttgccgtttcatgactttggtcctctgtgctacacatggcatttattgtagtaagttgtcctgtgtctcattgttaaatggcatgccctcattccacacatccgcatgaggcgcctcattcaacagttcccatgcagcaacctttgtttccatatgagccctgaacatgttcagttcagcctgagctgccgcattggcttcaagaggtctttaatcaagcaaattatcctcaagatctgtgacatcatccaatgggaatgagttgctgctatcatgagcgagcacagccatgatgacaggcttgaaacttgatttgttctcaccactccagtgcaatccatagtgaattaattgccacagtaacccatcgtttgggtccatgtcagatactcagatgacctgccatcccataggaccactctgatgcatttagcaagtgcgtacgaggaagcgataccaggaattgtggctgtcattagcataacatgttctttatgagttgtttctacttgagaggcatctcctcgaacatttggcctgcatcaatgactccaagctctaaatgtggtcatgagtaatcaacatcagtgagttcgcttttggcaacctgcacagtgatcaagttgattccttcacatcctactcaccctgatgtggtatgtgctaccgacaactcttgattaagccgtgctgcctcatcgttccaaagaggcatatcatcaacaaccacccaaggcctcaccggagggacatataagccatgagcaaccttgtctgtctccttggatgttagaccaagcggctgcaccgccacccactgcatgtcaggagcccaccttgtttactgagttgagctgcagtcatctgttgatacgtggtgccaattgatcccaagtggacgtactggcgatccatgtgctctaggatccgatccaacctgtcctttattttctgcgtgctaccactattgcctccaactttgtagtcctgagtttttccatttgatatatttaagatgataaacaacaatataaagttttagcaatatattaattgtgtactagagcttatcgtctcacaaaaaccatatcttgtgcgtgcgtgcggcacatgcttatcctctagtaaaaaagaaaagccctggtttcgatgcacaagaaaatacgacaatacgtcgagagagtatagttgcactaggcgataagaggaatatgttaagaattatacaagattcatcgagtacctcttttcctttttcttgtaggcaccttaaaattagaattttgcttcgtttttttacaggatgttttctatagttccaactcccaatggattcttttagtgcccttgctttgtttgtcgagaaaaaagatctctaagaacagcatagggccttgcagttttctgttaacctactacgtttcctcaatctttgaacaaatgtttgcctgattttcttttcgctttgttaaaccacgaattccccttaccctcttatacgatgctgtaaaaactgcaggccagcacctcgcagtgggagcaatttggtggcaccaccattggggtcggttccagctgtggtggcggcggcggagaccgcaagaggcagccacatgtaccaacgctcgtccgtgcacggcagcccgttccctcctaccaccactagaagggtgaggccgagagccttgacgatcacatcgttcatcgcagcgacgtcctcaggtgagatcggaggcccccatggattctccgctcctggagccaccatgaacaggagcgtctctgacgctgagggcatctctagacccattgaccggccgtacaatgcatggggccgggagggcttcgctccgttcccctggatccccgctgaaggcgagtctcactggtggggcaccttcaaccccgtgcagaaccatgcgcatggaggctttagcagaaggcctgctggggagcggatgccgccgcagagccaaagccacccggagaacagctatcaggctgtgccgccgtcacagaggatgccgccgttcttgtgattcgacaaggctgttcctacgtccgatcgctgtatataaaaagaagtattcggttcgggatctgagagagcacattgagcgaagatcgactgcactgcagtctccagcgttgggacctgtgtgatgtttatgccgctggtatttcagcgtttttctttttccctccggtccagcactctggtttcattgagcgctgtagactgtctgtcctaactgatgtgttgcgttgaggaggacgatttggaaacgtgagccgaagctgaactgcatctctggtcgccggggctaaaaaatgccgtttgctgctatgaaagttgtatcgatttgcggccgcaaaaaaaaaaaaaatttgttagaacaggtgaaatttagtgaacacaaatgttggagacctgcggcgtttacatttttttttgttggttaccgagattgtatttaaaggtcgtgatgcgccatcaagcgattgtgatggatcaattcatctccctattgtagcatttgtgcattgcgagttagcaatgggttttttttgtaaccgatggatgtatatgtcactagaagtaaattccagacaaatatagttgtatccatgctaattgaccaaaaaaaaaaaaaaaa

SEQ ID NO: 732 - DNA, 2229 bp, Zea mays
cgggagcatctccatccatccctggcccggccgccgtcgcagtcccagtcgccctcctcttcgtctgtggtctccaccccgcgcacacgcacagttcgtcgacgcgagcgagggccagccgtccagggcacggaagtgggagcccgcagcttctcgtcggcggggggtgggggctgaggtgagccactcccctccccgcttattcggatcctctctcgcccaatcccccggtcgcgggagtgatctagtggtttcgtggtctgcggcgcggcggggcggggttcgagatggaggacttgctgaacacggagatcgggaagaacgactatgactggcttctgacaccccctggaacacctcgtgatcctacattagatgctgctgagaaagctccatcaccaattgtgactaaacatactgttaccagatcatcctcgacaactagagcatctaggctttccacttatgagacagagaatgggcatttgacatttcccactaggccagcacggagtatatctgtctcttgccgggcagttcaatctacaccaaacaacatcaggtcatcaatcctcaatgcaaacatttcctctgttaattcaagatctacaacccaaagcaagcggacagctactcttactgcatcaaagccatctgttgcatcgtcacgtccagtgccaacacggtcttctacacctgtcgaagcccgtctgtctacaccaacccatactcatccacctactccagtgaaaaagcgtccttctgtgtccaactctatggccaactccgctgttgccaagaacacgtcagcaccatgctcaagatcatcaactccaacctctcggtctcgaaccttgtccagttcatcttcaagcagtacaagtgcagtgagccgtcccagctcatcctctggtaaagttcctgcaataacttatagcagttcttcatcaagtacagtttcttcagtgagccgtcctagctctcggtcatccacacccactcgtcaacctgccatgcgttcgtcaacaccatctgctaggcggatttctggtagcaataacatgacatctaatggcagacccttagccagcagtggtcggagttcagcaccttcctcagcgccatcatctcgtccaagttccccaaatacacggacgcaagctccagttcacccactaggtattccagattttccaaatgaaactccaccaaacttaagggctaaactgccagaacgaccactctctgctggtagagtacggccaggtattacttctggtgtcaggtcaaccccaaatcctgaaccggtcctctcagtcactgtaaaaaagatgtctgtacctgctattactcgaagtaagttctcagatgtacaatcaaagacatctcttaccaatagtcaccaaagtaggccgagcgaaagatctcttttggaaggtcaaacaactagaacttcgcggtctgtcgcagctgcagacaatggattcggtaggacgatatcgcggaagtcacttgacatggctatcaggcatatggacattcgacaaaatttgggtggcatccgtggtgcatctctattccctcatagcattcgctctactactaccaagagccggccagctagagcctcagatccaggccattccatctcaaatggtgaccgatgcttcacagataacggcagtagcaacgggcacttctctggagattctaatggcactctttcacacaacggcggcagctcaattggttcccctgatagtggaaaaaaagaggttctgagtgaactggatatatatgccaattcacgatacgatgcgatgttgctgaaggaggactccaagaacatgagttggttgcacagcgtggacgacaagtctgaccagagcccagtgtttgatcataggttcgagccgctccctgagccattcggtccgctatgagctgtttatactagtcataaagattccactcgctttgttcgtcacttgctgttaaaggttttatgcttgtctctttctgtttggcctatctcccccatcttttttatagatctgctagggcagataaagatcgtggggtttgtacttgttctcctttgatagctggagtctcgatttcgagtgacttgtgcgggaataacatatatactcaattcccatccttggctatcattttgattatgtttgaagtttcaactgtttgcagttggatgatgtggatcacaaa

SEQ ID NO: 733 - DNA, 4473 bp, Zea mays
gacggttcgaaaaatgaaacggatgaaagagaagactcgagagggggaaaaaaggaagggtatgtgttaaaccgcggagcaaagcacacgcatccgtccctgtcccgtctcccgtcgcagtcgccccttcgtctgcggtctcagtcccgcgcacacgcgcagtttctcgtcggtgcggcgcgtgggctgagggcctgaggccaaccactccgcttccgcctattcgagcattcaactccctcaggtcccgggccgtctccggcggccgctccgacggatcctctatcgcccaatcgcccgacggcccgagtactagacgttgcgggattgatttagtgattgttgctctgcggcgggggttgagatggaggacttgctgaacacggagatcgggaagaacgactatgactggcttctgacaccccctggaaccccccgtgttcctgcattagatgctgccgagaaagctccatcctcaactgtgactaaacatactattaccagatcatcctcgacaactagagcatctaggttttccacttctgagacagagaatgggtattcgacgtttcccactaggcctgcacggagtatatctgtctcccgccgggcagttcaatctacaccagtgtctagcaacagcaggtcatcagtcctcaatgcaaacatttcctctgttagttcaagacctacaaccccaagcaagcggactgccactcttactgcatcgaagtcatctgttccattgtcacgtccagtgccaacacgctcatctacacccgtcaaagcccgtctgtctacaacaactaatacttgtccatatactccagtgaaaaatcgtcctcctgtgtctaactctacggccaactctgttgttcccaagatcacgtcagcacaaagctcaagatcatcaactccaacctctcggtctcgaaccttgtccagtccgtcttcaagcagtacaagcacagtgagccgtcccagctcatcctctggtaaagttcctacaattagtcgtaccagttcttcatcaagtacagttccttctgtgagccgttctagctctaggtcatccacacccactcgtcagcctgcaatgcgttcatcaacaccatctgctgggcggatttctggcaaaagtaacatgacatctagtggcagacccttagccagcagtggtcggagttcagcaccttcatcagcgccatcatctcgtccaagttccccaaacacacgaacacgagctccagttcgcccattagatattccagattttccaagtgaaactccaccaaacttgaggactaaactgccagaacgaccactctctgctcgtagagtacggccaggtattacttcgggtgtcagatcaaccccaaatgctgaaccagttctctcagctcctgtaaaaaagagtctgtgcctgctatcactcgaagtaagttctcagatatacaatcaaagacatctggtcaccaaagtaggctgagcgaaagatctctcttggaaggtcaaacaactagaacctcacggtctgtcacagctgcagacaatggattcggtaggacgatatcgaggaagtcacttgacatggctatcaggcacatggtatgttcacccctcacatttacattgaattgaacaaggtcttatgtttttcttagggttctacctatgtgatagggccatcacatactgatagttttctttcaagaaagagtttctactatttttgtctgaaaaaagagagttggtttcacctgtatgcatgaaagattacaacaactgtcatgtttttgtatgaaagtaattttatagccgcaaatttaaaatactccctccctccttttgtatttgatgttggttagatgggggagggagtagtaaacttgaatattttaaataatcaggtactccctctgtcccattatatagttcgttttgccttattttttttgtccatattcaaatggataacaatgaatctggagttctagatacatatataatacacatacattaaagattaaatattgtatgaatccattaacactctaaaatgaatactatttttgggacggggggagtatgttttagaagaacctagagtcacacctagttttttttttgggagaacacaaacaggtgaatttgacctcttggatcttcagttggcagcattctctcttgttattttaattttcgtaagttggtgctcctttttggtgggttacttgtgattttatcattttataagtagcatagattttcgttctgagaagaaactaaatgacttctttatcataggacattcgacaaaatttgggtggcattcgtggtacatctctatttccccatagcatccgatctactactaccaagggacgagcagctcgagcctcagatcccggccattccgtctcaaatggtgaccgatacttcacagataatggcagcagcaatgggcacatctctggagattctagtggtgctctttcacgtaacggtgggagctcaattggttcccctgatagggaaacctttgcgacaaaagatgttctgtgtgaactggatatatatgccaattcaagatatgaggcgatgttgctgaaggaggacaacaagaacatgagttggttgcacagcgtggatgacaagtcggaccagagcccggtgtttgatcataggttcgagccgctccctgagccatttggtccgctatgaactgtttatactatccgtgaagattccactcgctttgttcctcacttgctatctctttctgtttgatcgcccacctcccccatctatttataaatctgctataacagataaagatcgtggggtttgttctttctcctttaatagctggagtctcgatttcgagtgaccaatgctggaatccaatgtacggaccaacatatatactaaattctcatcctcggctatcatttttttattatgttttaagcttcaactctctactgttggatggatgatctggatcataaagccactttgttctcagcccccatacgttgatttttaatttggactgagcccggtcgtgttgcacaaacatgttcgagtttaaagacgagctgacatgcctttgctggaaaccgagtgaactagacaaatggtcagccagttgacctattaactccactttgtcgctgcgaattgtgatagtggctcaaccactctaagcaatcattctaatatcctgagctagagcaggtccctgcatttgtagttcttttatttgccccaggtaaagttttgccacgagccccttctcattgaagttgacctatctgtcgtcaaccttgggctaaaattcagacgttcttgttatattatcatctgcttaatttattctcgtacgggtatgtttcatttttgctttggctcgcgagtgtatccatctgcatccaggctgctgaaaatacaggagtgacaaagttgatagggacataaattgctgctgccatgagcccatacatgatactgcggatctgatatatggaccacgagtacacattcattctgttatgtgtaatgtgttagagagccttagaccatgagatgggaccgcttgacccaccaccttcaacccttcaaatattcaaaagttgacagtaaccttccttccacccctgaatcctttgccacactctatccttcaattatgcaaaggttgctccgcaattgccgatatggattggtaagcccaagtacttgtcacggaacgtttcctagttcaactgcagctcccccactacctgcctgcttgcactggttactaagtagtatccgggctgagcaaaattttcgagttgtccctgttaatcattttactcgagcaggcctcgtttttatttagcctttaggacttcctctaatttcactgtatgttttctggttgcccggaccatgatgagtgaatcatccgcaaagaggtgggagatgcttggggctctatttcatgtcttcactcctccagccagtccattatttttcagcctgttgtagcaatatcgactgaaagtcctatgtttatttttgataatttagacaactaatgcattaacctctacttcagtgttgtaattaagatggaataaagtttataccgaggttgagcaagggtggcacaggcggagatggtggaggcgggcgcaagatgatcaagtgtccaattcttagaaaatacgatacagtaaaacaaaatgcatgtgctacttataaaattataagctgggctattttgcgttactgatcaagacgcaatagagtatatgatcgagttcaggatcaatagtcatactattacgaattacgaatactattacgagaggaactctagttagcgaatatgggctagtggcgtgctattgtgttgggaccatatgcattctatttaggccttatttaggcctaaatggagtgacgaatctagccgagaatatc

SEQ ID NO: 734 - DNA, 3645 bp, Zea mays
ttatctatatggaacataaagaaaatagttatctatatatttctagcaaggtaacaataaaaaacagcgtatagttttatctttgttgttttatggtctttcggatcgcatgcaagacacagatttcttgaaaacagtgtacacctgatttcgtcctcctaaaactcatttcatatcccttatcattaatacaccgccaaatcatcaaaaacactgacatgccagtctacttagagagtttttgttttgaaaagtcaatccattgtagatgacgtggtgcatcatgaatctatttcacaaatttggtgaaataaatctatttctcatattattattaatgcctatagaactctcactgagaacagtatcatatttttgttccagcaagcttgcacgctggtgtgcgtgcttctccaattttggcgaaagatctgttagaagcttggcgcgcgcattataacgggcgacgttcccgctgtaatttcggtgcccaaatgcggtcatttgacacggtcttcccgtcttcctcaagcagacaacgcaacccagccacaaagcgttggcaaaccattgatggaagcaggagcaagcgcacgcgttcgagaaccatgcacctcaattttagcaacctcgcacaaaaactgcatgcctaattataccttcttggcccctcctcccccgctggaacgcatgtgtttgcttcccatcgctcctggcttccccgtcgagcgagggagccacattcttgcttccattgttcgctcaaacgcttggtagctcgatcggcgccgttgttcttgggccggccggtcgagccgaatggtcatggcagcgccagtgccgctccggcggcggcgggcgctcctggtggtagcgacgttactcgccgtggtcaccgcggcgatggcgcaggactataaagatggtggcggcgacgactacgaggaggacgagaagaagaagccgcagttcaaggcgcaggaggcgcgcgccggcgtgttcctgacgtacacgttcatggagcgcgccaaggagtacccgcacctgaagaaggcggcggcgcagccgtacgcgttcaaggccacggcgacggtgctcaacaccatgaccgaggacctcaaggcgtggcagatgttcgtgggcttccagcacaaggagatcctcgtgtccgtcggcggcgccgtgctgctcgacggctccgacctccccgccaacgtgtccggtggcgccacctttgcgggatacccaatggccgacctcctcaactccatcgagacggcgggcgagccgtccctgatcgagagcaagattgagatcaccggcacccaattcggcgtgaaggcccccgggaagcccatgcccaagaccatcaagttgaccaaccccgtgggcttccggtgccccgcccccaaccacaaaggtacgacgcgtcgtcatttcgccgccatgtctgtctgtggctgtgtggtatggcatgtcacgtcggccatggcctccaccaataacaaaaactgcaatgcaatgcaattgcagacagcgtgatgtacgtgtgctgcgtcaaggaccgcaagttcaaggcgaagaaggctaacagcacgcggtaccagacacggcggaaagcggacctgacgttcgcctacgacgtgctgcaggccaacaccaacaactaccaggggcaccgggccatcgacaactggagccccatcagccggctggacaactggaacctcacctgggagtggaagcgcggcgagttcatctacagcatgaagggcgcctacacgctgctcaaggaaggccccgcctgcatctacagccccgcagcgggctactacaaggacatggacttcacccccgtctacaactgcgagaagcggcccgtcatcgtggacctcccgccggagcgggagaaggacgacgccgtcgggaacctccccttctgctgcaagaacggcacgctgctgccgcccaccatggacccgtccaagtcgcgggccatgttccagatgcaggtgtacaagctgccgccggacctgaaccgcacggcgctgtacccgccgcagaactggaagatctccggcaagctcaacccgcagtacgcgtgcgggccgcccgtccgcgtgagcccccaggagttcccggacccgacggggctcatgtcgaccacccccgccgtggcgtcgtggcaggtggcgtgcaacatcacgcggcccaagaagcgcgcctccaagtgctgcgtctccttctccgcctactacaacgactccgtggtgccgtgcaacacctgcgcctgcggctgcggcgacgacaccgcgacgtgcgacccggacaagcgcgccatgctgctgccaccggaggcgctgctcgtcccgttcgacaaccggtcggccaaggcacgggcgtgggccaagatcaagcactggcgggtgcccaaccccatgccgtgcagcgacaactgcggcgtcagcatcaactggcacgtcatcaacaactacaagtccggctggtcggcgcgcatgaccatcttcaactggcaggactacaccttcaaggattggtttgccgcagtgaccatgggcagccacttcagcggctacgagaacgtctactccttcaacggcacgcggatgggcgcccccttcaacaacaccatcttcatgcagggggtgccgggcctcgcttacctcgagcccatcaccgacgcgaagacgacatcggaacccaggcttcccggcaagcagcagtcggtcatctcgttcaccaggaaagacgcgcccaatgtcaacattcccagaggggaaggcttccccaagaggatctacttcgacggcgaggagtgcgcgctcccggataggatacccaaggtgtcgagcgcgcgccggcgggctgggaccgcgagcctgggtcagatagccatggcggcggcgctcgtgatgattgtggcgctagtggattccttgtgcctatgatgactgaaaacttctttggttcatagaggatttgactgacctagcgcgctgcatttgttgaacacttcattcattaattggaagggacaacttttttcactccagttcagagatcataaatgatccccacaaaatggaggaacagcattctacaaacgagagcacacaagcatccaagtggaaactgatccggattgaacagtggagggtgggatgaacatatattctggattggatccaacaaatgtttgtgaggatcatacgggtatgatgatgcttgtgagttgtgtgtaagggggaaagggcatgtaacatttcaaggctgtggtattattggttggacgtctatgctcattgggtttacacttttatttcactttctttgagttacacaaaagctcacgagtttgtgtatgcatattccgcgtaggtagtcttcatctacagaggaggttgttttaattttctatgcactctacagtgcaaaaatatattttacacacccatatgcataatttgctggccttaggttgcttccaacgggtcacctatgaatgcaaaaaatgaataataaaattgtgctattcatgcatacaacaaatcctgcgtgtactcgcgcaaaatgcacgtcctccgacggcgtcgtgcattttcgcgagctctcgcggtcacacaa

SEQ ID NO: 735 - DNA, 3015 bp, Zea mays
  misc_feature (533)..(533): n is a, c, g, or t
  misc_feature (621)..(621): n is a, c, g, or t
  misc_feature (2911)..(2911): n is a, c, g, or t
cgatgataagtctaaataagatgaagggtgaaggcctagaaatgtttctctcggatcccccacataaacattgaacctcttttaggttgcaatataagtttttacgtgagaatatgctttttctgtgagataaattgattttcattagattaaacacaatatgtgttccaaagaagccataacccaaattataacaaaccctatagtaaacccaaagacaaactgcttcgtaaggaccaccataaccgtagcctattaagggcatgtacaaccagagatctttgatcggttttttagatataagggacaactaagagacaatatgatagaatctttaacccctagattataatgtagttaagatacaataagtatagaaaatagtgaagagacagacgcttcacgaagagctcatctcttaaatttttttgtttaacccttagagttttcttaaaaaaaccctcaactaatggggttgtgcatgctctaattaaactggctcttgtttcctattcctctattgccttttgacntatattcgctcttgaagagtgttgttgacaataaagttgcttgtgatgagacttctcttatccagccgagtcggaaattcaattcganccttttttttataaccatgcaaaaatgtttagtactacctccgttcacaaatatatgacattgttgattttttttaaaactttgaccacccgtcttattcgaaatatttatttaaaaatataaaataaatcataacaaaataaacgataactcaagttttttaaaaaaaaacaagtgtcaaagtaaaaaaaaaaatcaacagtgtcatatatatagtatatgcaggtggcgcgaaacagcggaacagttggggacggcaccttgacacatgtctgcgaaaaaaagtgcattttcccttgacctgaagctagtagacgttgacctggagtcctttatgaaggctgcttgctcagttgctctcactgctagttgccaagggcagcgagctgcttgcttattactgtcctattgtctgcctccacctgccggtacgaatacgaactcgcatcatgctcggtgctccaaccaaagcctctttgatcatctcctctccgcccttttcactttttactgtttgtgtatctccattctctagatatctatccttagctatagctgtatatcgaacaaattaacgtgcgagcaagaagcaacagtgttgtttcagttgctgtgtagggcagcgagctgcttgcttattactgtcctattgtctgcctccacctgccgcaagcaagggatgtggaacagcagatcacacttcgccggcgggcaggacaacgacggcaacgacgaccagccatacggatacggatacggtggcggccagcagtatgaagcaaccggcggcaagaaacgagcgtcctcgaggctgaagaagagcagcggcagcaagaaagacgacgagtacaccaagtacgcaggcaacagcaacgaggccgacgacaaccgccgcaacaggccgaacgacgacaataactacaacggcggcggcggcaaccactacagcggcgccggcgccgcaataggtgcgccctactacggtgctgctggcgccggcggctacgggagcagctctccctactacggcaacgccgctgtccacggcaccggcggcgacggcggcggcggctacgcaccgtacaacaacgctcccgccgccttctgggctccccaggacggcaccaggtcgcccatgtttatcagcactagggaggtgcacgtgtacggcgcgcctggcgggtacgacaactacgatggcagcaacaacgacgaccgccagaggaggagaggcggcggcggattcttcgggcccgcgttccatgccgtcggccgcttcttcgaccgcaagttcggcttcagcgacagggactgaagcgcacatacgccggcgttgccatgcattgcaacatgtatgctcgcgggcatctcgtcaatcgacgacagatctatctgccatctgcatgcgtgcaattacactacctagcttcttcgtccgcgtactagtgccctgctatcgttagctagagctcactgctcaccaccaggagccgtttattgcatcaaagtatttattccgagtgtgccatccagtgtcgtatttggtttccgttgtgatggagatgaaccgtatgtatacattaatacatgcatgtctatagcagaatgcaaatatgtatatgtgtggtgtgtgcttgctgctgagatttgtgtgcaagggcagcaagctagtgtgtgtgctatactattttgtttgtagacagtgtaataattatattatgtatatggtagtggtaattgtttaagatagggttgcgaaaacctttgaataatacgtacacagtgcatacacaaaaaatactcatatacatgcacgcgcagtaaactctttgaatacgtacacacactctagtactctacccttacaaacatctccaaaaaaattggctgacggatctcttctcaaagtcaaggatacttctattctataagtacaatccggatttgtgtagctatacctttctaaggtttccactaaggaaaaccatagaaatgtttcccttagtaagggaaatcagatgagtcatcatcttcttattcatttttttcatgtagttgatatgggttgatctactagcactaaatcatccttcgtgttttgatagtaattgttatgggcatgaagaatatgtggtcattacaccaaaatttatggaataaacacatggtgacatggcatggtttctcagattaaatatgccgtaagtattggatcaggactactcatctaactctatttttttttacgaatcgtagtactgacgcagacgctcatatgttatatatgtangcacactcaaccccagcgaataactttagtttgtggtgactcctccttattggcaaaaatgattagattcacgtgctcgggtgggcggtgaaatgtttaagaag

SEQ ID NO: 736 - DNA, 1433 bp, Zea mays
actgagggcacttggtgctccaccgatcatagtggcacttgcagctcagggtgcatttcgtggatttctggatacgaggacaccattgtatgctgtgggtgctggcaacctattaaatgcattacttgatgtggtacttatttttccacttggtctaggagtaagtggtgctgcactggccaccgtgacctctgagtacttgacagcaatcatcctcctttggaagttgaatgatgaagtagatctattgtcatggaatataattgaggatggagtcatccgctacctgaaatctggtggtctactaattggcaggacaattgcagtattcttgacactgacactagctacatccctggctgcaagggaagggcctgttccaatggcgggctatgagatatgcttgcaagtgtggttaacaatttctctgctcaatgatgctctagcccttgctggccaggctctacttgccagcgaatatgcaaaagggaattacaagcaagcccgcacggttttatacagagtcctgcaggttggtggtgtgactggttttgtccttgctgcttccttatttgttggatttggatctttgtccttgctgtttacagatgatccagcagttttagatgttgcacggtctggagtgtggtttgtcaccatttctcagccggtgaatgctattgcattcgtggctgatgggctctactatggtgtttctgactttgcttatgctgcatattccacgttttttgcgggagcggtctcatcaatattcctactattagctgctcctaattatggtctcggtggcatatgggctggtcttactctatttatgagtttgcgtgcagttgctgggttctggaggtagttagggagcaaaggtggaccttggaatgttatcttatctggtcagatagtaagtaaaacaaagatatgaccagattcgattgttcaattgatctcccaccggtagcaggtcggtagcaagaaatgtgcatcctgctgcaggccatatatagctgacaagcaatatatagcaagaaatgtgcatcctgcgtgacagggagctgatgcatctctgtggaagatgtacgcttgtagttggtgttggatagctgggctatcttgtggctgttgtacgggctcacagctttcaactgtgttgtaccatatactgtacaagaaagatctgttcagttataacgaaagaaagaaaactggcttcaaatagaatacaaaaggctgtgtaacgaaagaaagaaagccgagttcaaatagaaaatcccttcatgtaaatttcgttctggaaatcctccttgtgaatgaagctttatccaacattctaggattggtaaatctggtaatcattatttgtgtcattatgtaactcaatgatggtcagaaatataataatctgagttggttcttcc

SEQ ID NO: 737 - DNA, 3558 bp, Zea mays
ggattaatcgaacaaggccttagttgggacaaaaactatgttgttgttgtttattttattgatatcataaatataataacacaaaagccatttattttaagtatctatttaatataacaaatattgataatatttgacgtatatttaattaaatgtaaaattaaaatataacgttgtgctagaattgtattatttggaagaagtatagcattattcaatggaagacttactcacgttttgtgaaaacactaaattaacttgaaaatctaaaaaatgaattcaatcgagattcaattcgtttttgaaaagctcgtacaaaaattacaaatttgaggaggaaagatatttttgctcaccgacaggtagggcagatggcagaaggtggttccaatagccagcaaatgggtcccgctcccgcttcaggttgccggccaatcagatcgaagagctgtatctgcgcgtcgcatgcccagggcatacacttctcactgccatatggtccaatttaattctggacccacacgtcatagtactatcggagaacacgggagttgcatggttggtggcgccacccgggcgcggaattaacgtaaattgactgtgctcgctttggaagagactcttcgtccgagagaaggaagaacacggaaggagggacagaagtaaattaaagaaatacaaatatgcaagagagatagagctcagatctctcgccacagttcaacgccccaatcctgcctcttagtccaacccggcaaccccaacctcttggtgcttcccaaattccaactcccaagcccttggtgctcaccaagattcatcttctccccccaatctcctccgcagggaaatagttgttttggtttccgactcccctgctgcatagcataggcactcattcctccctttcgacagcaagcaattttgtgttctcagttgtagattgggcgagattttccttccatccgtgggtgattcaggcattaggattcaatcggcacaatttgttcctgtatccgctcttgccaagaatttcccatctccctgtttgctttctgatccatcttcgatgcgctaagaggcgagatgaatacgaattactcggctctcccattgacttccccctccatcgagctccaacccaacggggccaaatctagcgccgccgccaatggcgtcctcaacggccacgctaagatctccaggcaggattcgttcttgggcgaggtggaggacgacggcggcggggccggtgagcacgacgagctgccgctcatcgggcgacggccctgccgggccgccagaggggtccgacgtgaccgccgccgtgttcaacctcgcgacatccatcatcggggccggcattatggcgctcccggctaccatgaaggtgctcggagtcgccgctgggctcgtctcgatcctggtcatgggggtcctgtccgagatcaccgtcgagctgctcgtgagattctcggcccactgccgcgcgctatcgtacggcgaaggtcgtgcacagggcgatgggccgcccggcgagcatcgtggcgccagatgtgcgtcatcatcaacaacgcaggggtcctggtggtgtatctgatcatcatcggagacgtgatgtcagggtcactgaagcacatcggcgtcatggatcagctggttggccatggcgagtgggataaccggaagctgctgatcttggtggtccttgtcatcttcctcgcaccattgtgtgcgcttgagaagattgactcactgagcatgtcatctgccgcgtcggttgcccttgccgttgtgtttgtggtggtgtccagcatcattgctttgatcaagatcgccgagggcaagatcagtatgccgaggatgggtccagatttcagctcccgtgcagcaatgctggacctgctcgtcgtgattcccatcatgactaatgccttcatctgccatttcaatgtgcagccgatctacaacgagctcaaggagaagacaccacagaacatgtacaaggttggcaggatcagcaccgtgctatgcgtggcggtgtatgccctgactgccctctcggggtacctcttgttcggcgaggacaccgagtccgacgtgctcaccaacttcgacaaggatctcgggataagattcagctctctgctcaactacattgtcaggatagggtatgtcatccacctggtcctcgtcttcccagttgtccacttctcgctgaggcagacagtggaggcgctgatcttcggggagctggcaacccctagcaggaagagaacattcacattgacagtggtgcttctagcactcatctaccttggctcgacaatgatacccaacatctggatggccttcaagttcaccggagctaccacagggctggcgttgggtttcatgttcccggccctggtggcattgaggctggacaaggaagggagtcgcttgggacatggggagaggctccttgcgcttggtttgctggggctatcaattcttgttagcgtcatcggagtcgttggaaatgtatacaccttgaagagtaagtctgaatgacctccccaagatggcaagttgatagctagggttagaggaacctttgcatcatgaagacacatggtgtgttgctacaactggcatacagatcgtgtaaacatggtgactatacactaggtcaaaatgtattacattcgagagagcctcagcatcctatatccgttttttacttcagaggtttaactgtggaccattctcgagggaattctttttgtacttcggaccagattgttttcgatgtatcgatttcattgtgttcttacatgagggctctagagtcactctttgatcagcaaccaaaaaaaaagattggttctgatgtactttgaggagatttttgtttccctatgtcagtaagttggtctgtttgggggcatacaattcttgcactttttttatactaaaccttcatctaatgacgcacgatattgtctgccgtgttatgaaattcaagaagtttgcagcattacattttcattttctggttgttggttcatattgtctgcttcaagctctaaaatttgtgcagcatttttcatgactgtatattctcattaaacacgctgtatttactatttagaaatggtttcaccaaagttgcaaacagtgtacatagcacttgtcaaaattatattaaaaatggcatatgtgagagtttatgtacaaggttcacgcaaaagtcaggtgcgaagtcgattagatttgtgagttaaagtagaaactttcgggtgcaacaaagatacattgttcacactaacatctcaaaatctgaaacaagatgtgagttgtcttttacattcttgcgcaaaataactactcttgcgcaaaataatgttgacactagatgcagatgaataaactgtcgactatactatttacatataccatgtttggatgtagatattgaagtatgaaattgagaatcgaaattagtttttttaattatgttgtttggttatacatggaattgatgcggatgaataaactgtcgactatactatttac

SEQ ID NO: 738 - DNA, 1724 bp, Zea mays
attaaatctcattcaatccactaggattgagagcaaatatagggtggggcaagcaaggcaggcggagcgggcaagggcaagcgagggatgagaatgagggccgtggtgatcacgtgcgccggcgggccggaggtgctggaggcgcgggaggtggaggaccatcccgcgctaggcgaaggagaggtgctcctcgaggtcgccgccgcgggcgtcaatcgcgcggacaccgtgcagcggatgggccggtacccgccgcctgccggcgcgtccccttacccggggctcgagtgctccggcaccatcctcgcgctcggccccaacgtcccctcccgctgggccgtgggcgataaggtttgcgcgctcctcagcggcggcgggtacgcggataaggtggtggcgccggcggggcagctgctgccgatacccgagggggtgtcgctgacgcacgcagccggcttgcccgaggtggcctgcaccgtctggtcaaccgtattcatgaccagtcacctctcccccggtgaatcattccttatccatggaggatccagtggaattggtacattcgctatacagattgctaagcacctcggaattaaggtttttgtcactgcaggaagtgaagaaaaactagcagcctgcaaagctttgggtgccgatgtatgcattaactacagaactgaagacttcgttgaacgtatcaaacaggaaaccaacggaaagggtgttgatgtgattctggataacattggaggatcatatctccagcgcaacctgaatagcttaggtgttgatggtagacttttcatcattggcttccaagggggcatagcagctgaagtgaacctgcaagctgtgcttgcacgccgtttgaccatacaagctgctggactgcgcaacagaagccttgctaataaggcagagattgttagtgaggtggaaaagaacgtgtggcctgctgtcgctgctggcaaagtgaagccggtgatttacaagacgtttccgttatgtgaagctgctgaggctcataggttgatggaagctagcacccacatcggcaagatactgctgctcccatgactgcacctgtggcgtttgcgctcttgctctcggaggagtcagttcaaaaacatatgcaattcctgagactgtgacaacctgcacggatgttgtactggtgtcgcatgtcttttttatatatatcttgtagtactagattggatcttttaccccgagaaattatcttgtcaattggatccttaaagtgctgatgacatttttctgtgagctatgatataataaatctggcagatagagccactacagcacgtcaaaaaaaaaaaaaacaaaaaaaaaaaaaaaaaagtacctgatgccagtgtactgttgatgcagtctacggatactcggggaggatatgctggccctgtgatcgatgacgcgcggctaacgatcgagttgctgattgctgaacatgagttagcacaggaattattaagttttcttcccttcttaataagttaatatgctggtaaatgaaatatttgtacccaataggaagtgctcatgctaccaatggaaggaattgcatgtatcgataatccaatatggattattaagtttcctgcccaaaaaaaaaaaaaaaaaaaaaaaaaaaaaagaaaaagggcgctacgactcatagaggatcccgcacgcgggcgcgtgcgtcatagctcatctatagt

SEQ ID NO: 739 - DNA, 3227 bp, Zea mays
tcttcagtctgtaggctgttcagttatgaagaactgaaacttgcaactggcaactactcccctggtaattccctccgacagcagcagagtttttacttccgttgtacatgttcctttttacaatttttttttaagaaaagaaaaaaaacttaactttgtttcatggtgatgcagatatgttgattgggaagggtggaaccagccaagttttcaaggcacgactcgacgatggaacgttttgtgccgtaaagattctgaaaccctcggtcgatgcagtacatgagtttgttacggagatcgagaccgtgagcagcctgcagcacgagaacatcgttgcgctgaggggattcagcttcgagaactacaaccttgtgctggcatacgattacatgccccaagggagcctggacagagctcttcacggtaagggtcaaaatgtaaccatctctcgctagctcgcctcttatctgtatgttgccaatttgccattgatcttcagggaagaatggtggcacggagtttcttgtttgggagagaagaattaggatagcgatcgacgtcgcaagagcagttgaattcctccatcttggcggtgtcacccagtctgtgatccatggagatgttaagtcttcgaatatcctcctttcagaggattttggggcacgggtaaacatttgaattcagtttgcaaatacatggataatccaatttcaacggtggtcaatatgttaatcctggttgtgacatcaccacgctttggaaatttcagcggtccgatttcgggttagcgaagcgagtgtctgcatcgactccccacctaacgtgtaccgacatcaccgggactttcgggtctgtatctatcaatcagcctttgggtttgctgttgtgttgtgttggataacaccaagcgtgaggtggttaacgagtgcatgcatgcaatgcaggtacatggcgcccgagtacttttcacacgggacggtcaacgagaagatcgatgtctatgcgttcggagtcgttctgctggagatcatctcaggaaggagacccattacgccgggaagcacgaagggacaagagagcctggttggttgggtaagtgcttttgctttgtgatgttatcctagctgtttgtgttttgttctaatggccaaatggtggtaaaacaggccaagcctttgctgtgcggcggcggaattagagagctggttgatccgttgctggggaggaacgagtacgactgcgatgagatggagaggatgacgctcgccgcctcgctttgcacgaggacatcttctcgctctcggcctgagatgtcactggtaaggaactccgttgcaagaagaagaagaaggaggaatggcttgcgttgcatgactctttctgacccgcgaacgccctgcgtaaccacaaccaaccaggtcctgagactcctccagggcgacgacgaggcgatcggctgggcgagggcgcaggtcacggccagcttcgacgggtccgacgaggaggctgcggcggcggcccctgacctgaacatgcagtcgcatcttaacctcgcgctcctcggggtggaggtggaggacgacgacacgctgtcgcagtcgcagtcgcaatgcagcagcaccgtggacacctcggccgacggctactggagccggtcctccagtttcgactagcgctgcggtctgcggggtctcttttagtagtagtagtagtacgtttatgtacagttggtggcaattggtgagttgattgttcttgtgagtgttgctaatttattagcttggagttggttctgttgtgtggtagaagatcttaaaaaattagttcagattcagcagagtgttgatggcaatgcaatttgttcagattcgtgttattaccatctttgcgggccatgattccaaccaagttgcattgcatttctcttgtgggcctgaacgcagcgcagcgtgttgggcctaaactgcctgtgaaaggctcgctgccagaaaacagaggtcggacgtcggagttcaacgcgcttgtgagcgaaggcgcgacgacgtcatcacaacacattccaccggcgccaaaggccaaagcgcgtcgtttcgtgtctgtccacgtcatcgacagctagcagctgcgttgccaaatctttgttcatgtcgatcccttcatcgttttcgttttccgtcgattgttcatagtacgacgacgacgacgacgcctgtcgttccagaacttgattcccacgtttacatgctacatctgatctctatctacagcgcacagagactaactaggcggccttgtcgccgtacagcaggcagaattcgtcctcgcagttgccggcgccggcgccggcgcgtcctcctcctcctcctcctcctccccgtccccgccgcgtgacgaagggcatcagcgccagcgacgtgacgaagcgcgcggacatggaccgccggtgcgagtgcgacggctgcgggtgcggggtcgccagcggcgcggcgacgcgggcggcgggaggaagcgccagcctcggactggtcggcggcggagggacgtcgccggctgcaccttgctgcttggggatgcccggctgcacctcccacttgaacgggacggtgccgggcctcttgaacgattcgtccaacgtcatggctggcggtggcggtgccgggcctgctctctgccggctgctctccttgctctggcttgtcagcggacgcacacacgagctgtataaatacacgctacagaaactagaactggaacggagggggtattaaacagaaggacagggcgattttttttttctgacggaaatggaaagccatccgggacgaagctgtcggggcagacgcggtggtggtacccagctccagccagtgtcgctcgccggcaatcacgcgcgctccagccaagtgtcgcttgctggcactcggtagtcggggtagctactagcaccgttgaccacccgaagcgaccgtccgaaaaaaaatagccatggatggacccaacctgacactagccatggatcgaaaaaatagcacatgatcctacgtttgaacaagcagcatatacatgcatgtgtagaaccgagctccgccgaatcttcaaatcattggcccaatcaggcccatcgtcgacgtgtctaccaggtacattctagcagcccgcagaatttaatctgcagacaagatacttatatagaatgtgagaggacacaactcctcaacgggacaaaa

SEQ ID NO: 740 - DNA, 1516 bp, Zea mays
  misc_feature (45)..(45): n is a, c, g, or t
cattgggaccctcgaggccggccgggggagtcatcgcattcgttnctaatctctcttcttccttgacgaacaccaccatttccttcctcggcttcgtttcgtgctttcctcaacctccccacttccgtggcgcgcagtttgtccgctgcttcacggaaattcctacgggacctgtatatattcgctgcgcaggcggccccgcctccggccgttgttgtctccgctcaccccgccagtctcccggcgtcccaattccaggaactttcgtcgcgtcaggtgatgcttttagcaactacaagcatagaacaatgttgatgcactatgatgtggatagaagtgaggaccggcaaagtgaggaggttcagtcagcatacagaagggacagtgacattggtgaggaaatgataataagtagcgaagagcaaaatgatgaaaatgaatggagctgggtgaaccaagatagagatggtggtcctcttgctgaatcggtttcttcacttcatatgacacagcaagtccttgaaaatgagatacaaaaattatcagaacttggcaaagaacttgaggcggaggaatccacttctggtaacaaagaccaagatgtgatcgttttgccgtatgcagaggtcgatatgttgaaattgaatgagaagatggagcatcttgaacaaaaagtgaaagaagtgtcaaacaccatcagagagaaagacttaaggctttccaagcttcaaatactgatcggtactgcagatagggcaacggtggaggaggcagcagctagcatcgaccagctagagacagagttcgagcaccatctccaggagatactggaagctgaaatccagtatctggtgatgctgaaagcgaggcagaactggcaggtccgggcagaggaccagatggccttggaggagcacagggcgtctgctgccggggacaacaccaggatgctgctcaagctacgagagacggagagcaagatcgtgatgttgaaagagcaggtggacaagctggaggtccgggagaaggatctctaccggacgaccgaggtcctgaagatgcagagcaggaccttcaaagtgtccctctttggcctcgtccagctgataatgatgtgcctgtccctgaagatgttcttcgcgcaggtctcggcgccgtttgacgaggttgtgccgacatgatgatgccctgcctcgtttggatgcattcgtatccacatggattgacgtgctcagttggtgttctcttccgtctgtaacttcgttcgccgggtttgtgatgtcttaacgtgtatcttactgtagctgtaggcctgtagccagcacccagcaggtagtatagtttcttagtcgtacattgaagtgcaggttgtgatgatgtacatcagaagctacgcgtgttctgtaaaaactaataatgtaggtctgtgcataaattgggttcgattgacaacttggctagctgacggtctgcagctaccaaatcatggattaattagacaaaaaaaaaaaaaaaa

SEQ ID NO: 741 - DNA, 4499 bp, Zea mays
cgactaggttggtcgatcggtacagctaccaactaatcgtatgtccagcagctatataacctggataaagcatggcccaataaaactccacaaaagcgggcttctgcgactggcaaagcccgaagaccagcaattccccccgcagcgcccccacacggccttctcttttctactaggagttcagattacggtctacagcgggccgaacccacgttccgtcaaaccgcagacaaccggtatctggaacggaatcccccccggttcccagcatcatcgtgtgctcgtgttaactactcttcttcttcttcttcttcctcggccggggacggacatcccttttcttccccggcttcgtttcgtgctttcctcaacctcccctcttccgtgccgcacagtttatccgctgcttcacggaaatccttacggggctgcatatactatattccctgcgttccaggcggccccgcccccgccccccaccggctcttgctgtctcctctcgcacggtcgcaccccgctagcctcccggcgtcccaatcccaggaacttccgtcgcgtcaggtgcgtgtggtttctccgccgctctaggttggtccggtttatttcggaatttcccgtgaaatttctggtttgttgtgaccgagggcgacgtctcgtagtgtagtatatatagtttcgtggaattctgtgttttgctggctgcttacgaggattgttcatttgatggaggagtgtgatgaaacacagaacccaaccctgggagctggatttcaggagcttcagccacattcacaatcgggcttccttgtctttcatttcagcacataggatttagacacacaaaaaaaaaaagagagatagaggtgaaattagcatgcctaaattggagtttacaactagggcagaaaatttagaccagtatcctccagagccgcctcatgattctgatccgaatcagggcaaggtaacctcaatttggagatgcagatagtcaaatacgttagctgatttgcgcctcaacaacattacaacaccaacttcaacttttggtattggcattaggacagagaatcctgtgctttcccctccaaagttgcctttcgatgaaaggcagtggtcgatagctctccctctcccctaaaggcattaggaccactagataagttgtttgtagagacgccaccaaggaagcggtgcagattaaggaggtggagaaagagtaaggaggcaacctcctgacaacccgctgcagttcaacatcaatttttttttggtgctagcgatgggctggctggctattcgctaggtgtaatagggctgaagaccgctggagattgtaatagggaaaagggtttagggtgaaggattttttggctttgcaggaaaagggcgcaaggcacactgaagggctattagggacaggggacacgcttccttcgctgaaccttacttgatagcatctgatgcgcgcaggtgatgctttcagcaactacaggtgtaggacaatgtcgatgaactatgatggggataggagtgaggaccgccaaagcgaggaggtccagtcagcatacaaaagggacagtgacgttggtgaggaaatgataataagtagcgaagagcaaaatgatgagaatgaatggagctgggtgaaccaagatagaaatggtgatccttttgctgaatcggtttcctcacttcatacgacacagcaaatcctcgaaaatggtaaaaaaaaagatcttaaccttattcatgtttctcatgcactttaaaaaaaaaaaacaaaaaattgcttgtgtaccttcttacactatgtaattttcaaccatgttcgaaatgtgtcatgacttgtttaatacttttgcttaaggaacacagtatatgtacagtgtttttatggtacatggaaacttggaatttcatggagttacagctttgctggctgaagtaacttttccagaccacacctttctttttaagtcttgcttttcttcaaacatgtccatgcttgctttggtcatgcgccatgcattatttactaaacatgttgttttgtccagttatatcaggttgttttgtccggttatatgtgacgatagtttgctcacacctcccccttctaaagaacgagtaattgtgtcttgttcagtgctgcatttgtcaaaatacacaaaagctcatgactatagagctccctgccttgcatttactatttttctttcattccatagacacagacaacgatccttcctggtattatgaagcatgctttccacatcagtaacaaaatttgctctcacatcattttgaaaataaaagaaaaaataatcattggttgattcacaatataagataagggacaggtgtgcacttctggagtattttgatgcttttggctagttctagttctaacggatcaccaaactatagtggttcttggttataacaaagctgtgtcatcccagttattagtgaaatattcttgaaacatatcgcttgattggtgtggttatttaaaaattgtttagtctttgagctctagtttatgtttgtattaaccacctctttttttgtgtgtgctgcttagagatacgaaaattatcagaacttggcaaagaacttgaggcggaggaatccacttccggtaacaaagaccaagatgtgatccttttgccgtatagtgaggctgatgtgttggaactgagtgagaagatggaacatcttgaacagaaagtgaaagaagcatcaaacaccatcagagagaaagacctgatgctttccaagcttcaaatactcatcggtactgcagacagggcagcgctggaggaggagttggaggaggcagcagctagcatcgaccagttggagacagagctggagcgccatctccaggagaaactagaggctgaaattcagtgtctgttgatgttgaaagcgaggcagaattggcaggtccgagcggtggaccaggtggccttggaggagcacagggcgctgtctgccggggacaagaccagaatgctgctcaagctacgagagacggagagcaagatcgtgatgctgaaagagcaggtggacaagctggaggtccgggagaaggagctcaaccggacgaccgaggtcctgaagatgcagagcaggaccttcagagcgtccctctttggcctcgtccagctggtaatgctatgcctgtccctgaaggtgttcttcgcgcgggtctcggccccatttgacgaggttgtgccgacatgatgccgtcagctggtgctctcttctgcctgtaaattagctcgccgggattgcgatgccttaacgcgtgtccggctgtcttactgtagctgtagccagtaggtagcacagtttcgttacactgatgcagtgtaggctgtggtgaatgacgtcagaaactacgcgtgttctgttaaaaaaaattactgcaggtctgtgcataaattgggttggattggcaaaaaaaaaaaataaatgtttgcagcttactgagaggtttcttactcctatatggaaagagtttgccaatttccccaagacgaagacaagtgggatacgcgccggcgcgcgtatgcgatctacctcgtctgggctgtgttgactgtgggaaacgcgtgcaaaagtggcagcggcagcacgcgctgtggggctcatgggctgcggccgagggcgcccatcgggcccatacatgtgtaggctcgccgaacggaagaacaagcataggcccaccctcggatatgcgcccagttttacactaaaattatttccgtttttatattttttttcggaatcaaaaatgaaaatgataacttcgaagaccataacgacatcaagcgaaagctcagtaaaaaataccccaattacggtcgaaatctgacatacggtcggtaaaaatcgtggcggggcttggctggcttattgtagctaaaaacacggtaccagctgaacagcttctcagctaaaagcactgcagcaactgcaaaacaaacggtaccagcagccgcagcccaaacagttctattaactagccggacagctttaatatgtagcctcaattgacttcaaaaatgcacataaatcatacatccatataaaaatagtaataatatatgaatatacacaaatttatgaaatgttaaagaatatctcacagagtattaaagaaatatcccacaaatataagtgcattcatataattagaaagtcataacacaataccttataaaacaaagctatccgattgaaaacccggttataacagttataaccatcaaaaaccataaaacaataccacacatcatactatagagcatagaactagccatataatttgacccatcataatataaataacaatttataagacattttaatataaggcagaaggtcacaataaatataagacaatgaaatacggcaataaaagtattatcatgtatttaaataaagcaatattaagtctagtagcatatgactatagaatcaagatg

SEQ ID NO: 742 - DNA, 1340 bp, Zea mays
agcagatcattgtctcttgtgctctcgggaatgtaccttgggtcagttacaggacttgcattttcccccttgctgatacataagttcggttggccatcagtcttcttttcatttggatccctagggcttgtttggttcacgacatgggcaaccaaggcatatagttccccacttgaagatcctggaatcagcgctgcagaaaagaagcttattgctagtcagagcacagcaggcgaacctgttaaaacaattccatggagattaatactatcaaaaccacctgtttgggcacttatagtttctcatttctgccataactggggaactttcattttgctcacatggatgcccacatactacaatcaggttctgaaattcaacctcatggaatctggccttatctgtgttcttccctggttcaccatggcggtttctgcaaatgttggtggttggattgcagacacacttgtcagcagaggagtatctgtgacaactgttcgtaagatcatgcaatcaatcggattcttggggccagcattttttcttactcaactaagccatgttaattcgcctgccatggcggtgttgtgcatggcttgtagccagggaactgatgcattttcgcagtctggtctatactcaaaccatcaagatataggccctcgatatgcaggtgtactgcttggtctttccaacacggctggggtcttagcgggtgtatttggcacagcagcaacaggatacatcttgcagcatggttcttgggacaacgtattcgagttatcagtagtgctttatctggtagggactttggtatggaatgtattctcaactggcgagaagattcttgattgaagggtgtatgtacacagtgtgcttacagttcgtagtgacaaactcatttcggatcgacaacttgacccctggacataatacacttcaagataacaaatgtgtcatcgcgcagcacgagaagtatcaacctctacatcccggatattaaattgcctggttgtgatgttgctctggtagagacgatttgaagcatatggaattatggatgagttgagcgatgcacccgttccgagcatgccactgtatattgtgttgagcataggtatcatgtacagcatggtagaaagattcgtcatacagagtagttttttttttacttgtacaatttttccctcttgaatagtttgttcctgtaacagcccgacgtagataaaaacaaggaaacctggggatgggggtactactaatgcaaacatttggtgaatatttatccaaaaaaaaaaagggcggccgctcgcgatctggacctagtggcccctagggcc

SEQ ID NO: 743 - DNA, 4442 bp, Zea mays
  misc_feature (1610)..(1610): n is a, c, g, or t
  misc_feature (1640)..(1640): n is a, c, g, or t
  misc_feature (1708)..(1708): n is a, c, g, or t
gtatttttattactattattattattatctatagatgcacaaacacataaactccagcatgatgcataaattatttaggtgtcatttgtctaattattcactcttaaatatagctattcacatgttataataaatagagacaaaatgtataaggagatcaactcttttctcaatatttacaaattgggtattacaattagactatgcactataaatgaatgacccatcgattagcaatgactagtgctaacacattagttgttaagagtcatcagactctgatgcattggctaatgaccaaatgttagacaatcaaatggtgcatagagaaggttgttgagggtgtaacgactatgggtctatttggttcaactgtatattcctaaaaaatatgattatagttgtgagctgtgagaaagttgttgcgagttgatggttgcgcgaaagctaaaatagccttggttgaaacaactatcaaatatggatcctataagagcatgatagtttagtaacatggttgataggaatctaaaaaatctagggtaggaggtgatgctgaattcaactagaggaatatgtagatttttaggaacatattctgttgttgtacctatttagttgagatttaagaattttagtagcaaatattttttataaagtagaaccaaacacatcatatatatctccatgggggctataaataggaacccaacaggctatttgagtggtgtgggagacgaggaacatatatagtgagttgaggctcatttatagtagctttggacacccaagtgctcaagaaaattagtgtgaatgctttgtaaagtgcttaagttagttaaaccaccgcttatactgctcgctctaggtttaggcgcaatttttattgttgtttgtaaaccacttgccacttggtgcttgcacgcactatggttgtgctcggagtggcttgtactcttgtgatatcatgccaattgcatttgtggtgtggctgctatattgtactagagggaactagtctcatgcagtttcggccaaaacttgattgtgaatacgctagggagtggtttggaaaaggctgttctagagaccaacttgcacatgggaaaagcttgagaccatccatagagttcaccgaatgagagttaggctcttgcataggcatccttgtgatgcgttccaaggaggatagggaaaactttcatgcttcttgatatcttaataaaaaatattgacaacgttaaatgagagcttagatctgtactgtcctttaagctttcgtgactatattatataccttggtggtgaagatgttgttgctgctaatggtacaaagtcattaataagtgactgaggaagagctcaaagtagatgatgatgaatgcgccgagacatagcactgcttgactttgatggaagacgaccattgtggaagttaggagcaatcgtctccctcctctccagatgcaatagatggagagactacgatgatggcgcaacaaccaaaagagacaaaatcctaactacatacgagaggagtctagggcttcatatgagagaagaacactttacgggttttcacctccaagactgacattggcacttgcctnaattaccaccagggacttaggatcctcatnctctctcgtcatgaagagcttccacaacaagcttaataaaattgagttcaagttagagaacatgtggngctcttttcatcatcaaaatttaccataaaaaattctttgaatttaccgaaaacaaaataggcccatgaagcccaatagggtggatcgcctgccgtgtttgtaaaaatcgttaaaataagaggtggaagggattcgagccatggtctgctactctgcttgggtaaaagacgtaggtgcacttgtgttgtacaatagattttatattgtaaagatatataacctataaattttaaaaatataatcgtactttatccatttcgtactcgcattgatcctactatggtgaattgggagcttgttatattatgaacttgctaacttttgaacttcaagtctatgaacttatgatattcattaatttgtaatattgtgaacttgaaaaaatagtatgaattatgaatttgttatattgtgaatactgaacttatgatctttgtcaactttgttatattgagataactttatgttgataaatatcgattgaattttagatttcgattgttatagttatattttccgtaccaaacctcccttttcgatattttcaaaatactgataccattttttgtctctagagttactgtttttgttttattttcaataaaaatatataaacataaatagtttttttatttactgtccgtcctccagcccgcccccaaagccgtccaaattccagtcttttccccgcagcaatagactggtcaccactcacgagagcagaaaacaaacaatgcctctttacctgctcgccgccggcgcgcttattgtcttcctctacgttatcaacaaccgcaggagcagcaagctcccgccgtctccgccgtcgctaccactgatcggccaccttcacctcatcggccgcctcgcgcaccgatccttgctagagctgcagcttcgctatggcggcggcggcggtctcctcttcctgcaactcgggcgtaggccgaccttggtcgtgtccactgcggccgtggccgcggatctgttcaagaaccacgacctcgccttcgcctcccgcccacgcagcgtgggaggggataagctgatgtatgggtgcagcaacgtgtcgttcgcgccttacggcgagaactggcgccggggcaagaagatcgcggtggtccacctcctctctccgcggcgcgtggaatctttcgcgcccgtacgggttgccgaggtagccgcgctcgtcgcacggacacgccgcaccgcggaggctggggaggccgtggagatgagggagctcctgtacggctacaccaacgcggtggtcacccgcgcggccaccggtgccgctggggcaacagcagagaagctgaaacagctgatggggaactccgcagcgctgatggcgggcttccaacccgaagacgtgctgccggacgcaccggcgaggtttgtgagatgggcgacgggcctcgataagaagatcgaagacatggccgaggcgtgggacaagttcctgtccgatatagtggccgcacacaaggaaaaggggtgtggcgacgcaggggaggaggctgaggacttcttggatgtcttgctccggctgcgggaagaaggcgcagatgggctcgagctcacagacgatcgcatcaaagctaccatcgaggttatcttcgcagaaacgctcttccagtatctcatcaagaaatgtttactgccgataatccaatattgttcatctcatccgtactcgattcttgagtctgcaggacatgatagctgctgcaactgaaacatcatcccaaacgctggaatggaccatggccgaactcattgccaacccgcgggtgatgagcaagctccaaggcgagatagcgcgagtcgtcagcgccgatcagacgaccatcgctgaaccggacctgaacaaaatggagtacctgagggcagtgttcaaagaggtgcttcggctccacccaccagcgccgctcctcgtcccgcacgaatcaacaacgcccgcggttgtgcagggctacgagatcccggccaagacggcgctcttcgtcaacgtgtgggccatcgggcgggaccctgctgtgtgggacgcaccggacgagttccgcccagagcggttcgtgggcggcagtccctcggtggacttcagagggaccgactaccagttcatcccgttcggcgccggccggaggatctgccccggcatcaacttcgcgctgccagtcttggagctcgcgctcgtcagcctcctgcaccacttcgaatgggagctccccgccggcatgcgcctggaggacctcgacatgggcgaggcgccggggctgacgacgccgcggcggattccgctcgtcctagtccccaagcgcaggacgctcgttcagacattactgcagtagcacaaggaatttgatctgcctccctgagtaccgaggtttatctattgagaagttgtggatcaaacaaaattcaagaacacagattaccttacccaaaaaaaaacgcacaagaacactcaattgcagaaagaaatcggtctcttgttgaccgcagtacttgagttcattctccctggattaagttggatagtttggtttttcacatttatagtcttgggccagaataaagagatgaatgtaaggtagcaggctagcagctatcacagtggaagattgttcatgtaatagagtaccgaacgatttagccatattaggcacgagaactgttcatacccccacccctccaatatgattgtaatgctcgagggggggcccggta

SEQ ID NO: 744 - DNA, 2971 bp, Zea mays
  misc_feature (2470)..(2470): n is a, c, g, or t
tgcttctcagaatacactaaaaacagccaacaagcagaagctgtctttcatcagcttctcagataagctgtttttttaacaaacagcagctgtgtcaaacagggtcaacagtggatagtggcgcatggttgaaaatagcataaaagccgaacaaagtcacttcctttctcgaggccggccgcagcaatagactggtcaccactcacgagagcagaaaacaaacaatgcctccttacctgctcgctgccggcgcgcttatcgtcttcctgtacatcatcaagaaccgcaggagcagaaagctcccgccatccccgccgtcgctaccgctgatcggccaccttcacctcatcggccgcgtcgcgcaccgatccttgctagagctgcaggttcgctatggcggcggcggcggtctcctcttcctgcaactcgggcgcagaccgaccttggtcgtgtccactgcggccgcggccgcggatctgttcaagaaccacgacctcgctttcgcctcccgcccacgcagcgtgggaggggataagctgatgtatgagtgcagcaacgtgtcgttcgcgccttacggcgagaactggcgccggggcaagaagatcgctgtggtccacctcctctctccacggcgcgtggaatcgttcgcgcccgtaagggccgccgaggtagccgcgctcgtcgcacggacacgccgcaccgcggaggctggggaggccgtggagttgagggagctcctgaacggctacgccaacgcggtggccacccgcgcggccaccggtgccgctggggcgacagcagagaagctgaaagagctgatggggaactccgagcccgaggcgctgatggcgggcttccaacccgaagacgtgctgccggacgcaccggcgaggttcgtgagatgggtgacgggcctcaataagaagctcgaagacttggtggagtcgtgggacaagttcctgtccgatatagtggccgcacacaaggagaaggggggtggcgacgcagaggaggatgaggacttcttggatgtcttgcttcggctgcgggaagaaggcgcagatgggctcgagctcacagacgatcgcatcaaagctaccgtcaaggttatcttcgcggaaacgctcttctagtatctcatcaaaaaaatgtttagtaccaataatccaatattgttcctctcatccgtactcgattcttgagtctgcaggacatgatagcggctgcaactgaaacatcgtcccaaacgctggaatggaccatggccgaactcattgccaacccgcgggtgatgagcaagctccaaggcgagatagcgcgagtcgtcagcgccgatcagacgaccatcgctgaaccggacctgaacaaaatggagtacctgagggcagtgttcaaagaggtgcttcggctccacccaccagcgccgctcctcgtcccgcacgaatcaacaacgcccgcggttgtgcagggctacgagatcccggccaagacggctctcttcgtcaacgtgtgggccatcgggcgggaccctgctgtgtgggacgcaccggacgagttccgcccagagcggttcgtgggcggcagtccctcggtggacttcagaggtaccgactaccagctcatcccgttcggcgccggccggaggatctgccccggcatcaacttcgcgctgccggtcttggagctcgcgcttgtcagccttctgcaccacttcgaatgggagctccccgccggcgtgggaaaagcggacctcgacgtgggcgaggcgccggggatgacgacgccgcggcggattccgctcgtccttgtccccaagtgcaggacgctcgttcagccagcgctgcagtagcgcgaggaatttcatgtgtctccatgcagtggcggaaccagaaatatttaagagcttgggtaaaaaataatacttatactgtaaatatgtagctttgtctaatttttacctgtgtttaactatattttactacttgttgtatgtgtataagttcactagcaataatggaggagcctatgctcttgcccccacttggtccgccaccgtctccatgcgtacggaggtttgtctattgaaaagttaaggatcaagcaaaattcaagaacactgattacaaaaaggaaagaaaaaaatcagcacaacaacacgtttgagtgctagaatcccagaaaagaaatcactctttagtcttttttttttttttgaaaatccttcactctttagtctttggccagaataatgagatgcccatgcatgacaattgccctacaccatcattagctgctaccagaatagaaattgttcatgtaagtgattgtaacagcgagtttaataaaacagccaacagccagaagtaagaacctctacagcctctctattagcccactcatatagttagctctccattattaatgtagtacctcatttatctctctcacaaactcaaactctcttggtttntgtatataagccgactgtaattaagacggctgagcctgcttctcctctttttcttcatctctcctcaacacaagcatttagcctgcttacaacccttcattatacttgctttaataaagtacccaatgatttagccatacaaggagaactgttcatactgccatgtggttaaggcaagcgcatgcatgcgtggacaacctcatccaatctctatctctactactttaattgggcactttcgtgcgccgccctccctcgaccgtgttctgcgtccgtcgctcacaacaatcgttgccccacgtcccttggcgctcgcccgcaacaaccaccacctcctcacgaagggcccctcagtagggttgaaaacgggcagaaaaatctcgacccgactcgtaccacttttgtcacacccggttttagaaggcaaacctattgcaaaccatgtacgtgctaggatcagcaattcacgtacacaacaattacatagttggacatcatcac

SEQ ID NO: 745 - DNA, 1829 bp, Zea mays
agcaatagactggtcaccactcacgagagcagaaaacaaacaatgcctccttacctgctcgctgccggcgcgcttatcgtcttcctgtacatcatcaagaaccgcaggagcagaaagctcccgccatccccgccgtcgctaccgctgatcggccaccttcacctcatcggccgcgtcgcgcaccgatccttgctagagctgcaggttcgctatggcggcggcggcggtctcctcttcctgcaactcgggcgcagaccgaccttggtcgtgtccactgcggccgcggccgcggatctgttcaagaaccacgacctcgctttcgcctcccgcccacgcagcgtgggaggggataagctgatgtatgagtgcagcaacgtgtcgttcgcgccttacggcgagaactggcgccggggcaagaagatcgctgtggtccacctcctctctccacggcgcgtggaatcgttcgcgcccgtaagggccgccgaggtagccgcgctcgtcgcacggacacgccgcaccgcggaggctggggaggccgtggagttgagggagctcctgaacggctacgccaacgcggtggccacccgcgcggccaccggtgccgctggggcgacagcagagaagctgaaagagctgatggggaactccgagcccgaggcgctgatggcgggcttccaacccgaagacgtgctgccggacgcaccggcgaggttcgtgagatgggtgacgggcctcaataagaagctcgaagacttggtggagtcgtgggacaagttcctgtccgatatagtggccgcacacaaggagaaggggggtggcgacgcagaggaggatgaggacttcttggatgtcttgcttcggctgcgggaagaaggcgcagatgggctcgagctcacagacgatcgcatcaaagctaccgtcaaggacatgatagcggctgcaactgaaacatcgtcccaaacgctggaatggaccatggccgaactcattgccaacccgcgggtgatgagcaagctccaaggcgagatagcgcgagtcgtcagcgccgatcagacgaccatcgctgaaccggacctgaacaaaatggagtacctgagggcagtgttcaaagaggtgcttcggctccacccaccagcgccgctcctcgtcccgcacgaatcaacaacgcccgcggttgtgcagggctacgagatcccggccaagacggctctcttcgtcaacgtgtgggccatcgggcgggaccctgctgtgtgggacgcaccggacgagttccgcccagagcggttcgtgggcggcagtccctcggtggacttcagaggtaccgactaccagctcatcccgttcggcgccggccggaggatctgccccggcatcaacttcgcgctgccggtcttggagctcgcgcttgtcagccttctgcaccacttcgaatgggagctccccgccggcgtgggaaaagcggacctcgacgtgggcgaggcgccggggatgacgacgccgcggcggattccgctcgtccttgtccccaagtgcaggacgctcgttcagccagcgctgcagtagcgcgaggaatttcatgtgtctccatgcagtggcggaaccagaaatatttaagagcttgggtaaaaaataatacttatactgtaaatatgtagctttgtctaatttttacctgtgtttaactatattttactacttgttgtatgtgtataagttcactagcaataatggaggagcctatgctcttgcccccgaaaaaaaaaaaaaaaaaaggccccgccgccccccatctggcccgtgcccccgcgtccgcggacaggactgagggc

SEQ ID NO: 746 - DNA, 653 bp, Zea mays
gccggccgggtccaaaaagggggaagcggcactgccgtgtcgtctctctgggcgactccgccgccgccgaaaaaccaccaattgccccctcaccccgccgccgccgttgcctatccgcaccaccttttctccttcctctatccttctctttctccatcttgcgattgaacctctggcagcatcggcgccatccggtcggcggctgcgtggatccggggcctccagaacaatgtgatcattgaggaggtgaacaagggcctgaacccaggaatggtggttctgcttgtggttgcaagcttcctgctgctcttctttgtggggaactatgcgatgtatgtgtatgcgcagaagacgctcccgccaaagaagaagaagccggtgtcgaagaagaagctgaagagggaaaagctgaagcagggggtctctgcgccgggagagtaaacggccatgctgccgatcctcccgtccagagctcctattcacatgattattaaagaaaaaaatttatatatatataccagctggagccgtagtgttggagtaactttgttctgtagatgctctgtctttaatggtacatctgtattggagactttaatggcctgagccgagctagtatgcttcctgtttcgtacaaaaaaaaaaaaaaaaaa

SEQ ID NO: 747 - DNA, 3576 bp, Zea mays
tggtttttatatatatgacatataataaattttgttttaataaagcacaaaatatatgttttctattgattaggtgagtatgaatatgtagccaacaaccaaggctcaaacactcacttatacataattttaactttttttatataaactcttttattatagtagtagagaagagattatagaagtgcaggttgattttaaagaaacgtagaagttttttgaaaaatattgacgcgggacgaccgttgaaactggtgctttaatatagtaaaaacttagttcttgatttttatgtctatattcaactaaatgacaatatatagatacataaataaaatatatacattaaatattgtatgagtccttaaaaagctaaaataaagtttaatttgggacggagggagtacaagacaagtgaagaaaatacgccatgataaacactcatgcacactgatctggctcaaaacaaaaatgatgcacatacacgtatatataaacagcaataaacaaagctaaggaaattaaaggaaaacggtggactagaaacttccaaatcgaacggcacacaaaaatcacaacccggaaagggaccagcagcgcaaaggtgagcgagctttccttcggaactcagaactctcgtgctcacctcatccgttcgacaaatccacacgaatcctctgattcagagcagggtgttggcattgatcagacgcctgccatggcggatcagttcgtggattcggcggtaagtctcgagttcttccctccttgatccttactgtggtatgggagaccaaagcaagttcgagttcgaatgtacagaactgaaggtcagaagcggcactgccgtgtcgtctctctgggcgactccgccgccgccgaaaaaccaccaattgccccctcaccccgccgccgccgttgcctatccgcaccaccttttctccttcctctatccttctctttctccatcttgcgattgaacctctggcagcatcggcgccatccggtcggcggctgcgtggatccggcgcctccaggtgcggatccgagtcctaccttgcccggatctggtgtcctctcggccgggtgggcttcgatgctcggcccggctctctggcgtcgtgcactggcaggttacccttatgctcgcgcgagcccccttggctaaccagtgagggtggacggtgttactcgtgagacggcggcagctgtttgttgcgatttctgacttgtagcagtaagcgatccctggccggagttgtagctgattttggtccacctggtttgaatttgatgtgcggaggattggatctgtagaatttgtgcaggacttctacgtggtcaataggtcatatgataactgtgttcgtttgaaaaatgcatgtttcaattgtgtcctagaaaagaaaagagattgctgagtgcttttatcttgtaagtgagctttgatatcatatcggcgtactagcaatttgcataagcggataagcttgctaactgttacggccttacaggtctagagctttatgactatcatatatgtgtgtcatgtttgatcaatatggcgttcagtgttttagttatgctcaatcctctaggtagccaatgttatctgttataataaactgattagttcgatgcctttaaatcttgtgcactttataaatttattacaaggttaccagcagactatctgtctgtctacctgctttgatgcacactggctaatcgctgtttgtatgtgtaatcctttagtttttttaagttgccttttagttgatgctgaggggctgtagtttgattattatcgagctgctatcagttgatctctgtgctaactaatctgcatatttgattttaaatggtgactgtagtctgtatgcatatcacttcagttctccacacctgctctatgaacctatttgtgaagattttgtaggattgctgattgccttactgatagattcaattaggcctcatctttgtgttttttactagtctttgcagttgtggataacagttagcacaagcgctctataatagagatattacttatattttcatggttctgcgcatttggtctgccaatttgtaaaggatatacgtgtttatctattgttcgattatcctaaatcctaacctttatcatatcatcttgcaaggcccatgcacctagtataccactcctgtcttcagcatcttgtctaattttctcatgtactacgctgcatgtgtttcagaacaatgtgatcattgaggaggtgaacaagggcctgaacccaggaatggtggttctgcttgtggttgcaagcttcctgctgatcttctttgtggggaactatgcgctgtatgtgtatgcgcagaagacgctcccgccaaagaagaagaagccggtgtcgaagaagaagctgaagagggaaaagctgaagcagggggtctctgcgccgggagagtaaacggccatgctgccgatcctcccgtccagagctcctattcacatgattattaaagaaaaaaatttatatatatataccagctggagccgtagtgttggagtaactttgttctgtagatgctctgtctttaatggtacatctgtattggagactttaatggcctgagccgagctagtatgcttcctgtttcgtacaagttcttgaaatgctggtgatggcgcatggctctagagaaaaactcaagggagctgagccagcgaaacatgatctacctctacctctagagttaccaactatatgcagttttaagagctgcagtagtattatttttggagtaactcttatgttactttgaaatccttaaaaaacaaacaatttagacatggagtttaaaagtatctagctttcgtgcattgttttaggtggtgctagcacaagagagagagacacacatttgctcggtgtaatacgcacatgacacatggaggcgaatcttctatcaggtgcttggaaacttggattgacctcggtgcaaaactgagcacccgcggcaaagaactgttccaaaatataattcatattagactaaatatatattaattaattaaccaaaaaatgtagtctatacatcattcattcgagtgtttagaaagaactactttctctgtatcaaaataaaatttgttttaccttaattcatacaatacatgatatatgtgttctttatatatttatatttattattatttagttaagtataaacataaaagtcaagagctaaaactaatacactattttagaatggagcgagtatattttaaaatggagagagtaatattttgtctatgcaaatgactggtactcaataaacagccagccgtgcatctttacagcgtgtttggattgcaagtttggtcactgctagagccatccgaacctgtatctgatcctccattgatgtttggtttgcatcacagaaggatattgtccatcatcaccctgttttgttcataagacaatatgcgggatcaatcaattccgtatgaaatctccagacggactgctgccggatcaagtcatgtcgaatgaggctatccgtgaaaccaaacaccctgtttgt

SEQ ID NO: 748 - DNA, 759 bp, Zea mays
gggaccctcgaggccaaaaattaaaggaaaacggtggactagaaacttccaaatcgaacggcacacaaaaatcacaacccggaaagggaccagcagcgcaaaggtgagcgagctttccttcggaactctctcgtgctcacctcatccgtccgacagatccacacgaatcctctgattcagagcagggtgttggcattgatcagacgcctgccatggcggatcagttcgaggattcggcgaacaatgtgatcattgaggaggtgaacaagggcctgaacccaggaatggtggttctgcttgtggttgcaagcttcctgctgatcttctttgtggggaactatgcgctgtatgtgtatgcgcagaagacgctcccgccaaagaagaagaagccggtgtcgaagaagaagctgaagaaggaaaagctgaagcagggggtctctgcgccgggagagtaaacggccatgctgccgatcctcccgtccagagctcctattcacatgattattagagaaaaaaattatatatatataccagatggagccgtagtgttggagtaactttgttctgtagatgctctgtctttaatggtacatctgtattggagactttgagaccttgtttcagcaactgatgaatcttagcctgagccgagctagtatgcttcctgtttaaaaaaaaaaaaaaaaagcggcctgcggccgcatggttctagaaaaaaactcaaggggagctgagccagcgaaacaaaaaaaaaaataa

SEQ ID NO: 749 - DNA, 1129 bp, Zea mays
gtagaaaaaaaacattcgtatctcagtcgagagatgtgtgtagaatacctttttttttttttttttttttttttgcctgccctcgggagcttcctgctcacccactagtcggtcgctgcgctagctaataaaggcacaaactcaaaaactcatgatggcccaaaacgaaaccactgacggtgtcctgttcaaagtctgcacacggcccacagtttcgctcggcatggaaatcatgacaacaacacgccaaaacaagaaccgagggcgggggatctcacaccgcggccagcgataccagcggcgtcttgttgacggcgtccgtggcctgcgcgtacagggaattgtgacgcaggatcagcttcaggcccttggcggcctcggactcggagggcctcgccgccaccagaaccctccgcttcatagcgtggtggcggctgttgtagtagttctccgccagcgcggacgcgtccaggcaggaccaggccgacccccgtggggcgctggccgcccacatgaaccgcctggaggacgggtccacgagggactcgcggaactccttggctccctcgcatggcaggccctctgccatggctttgatcttgagcgtgacgctgtttgacagcaccacgaccttctcgttgctccggaccctactgacgaggagggcgcagtcgaggacgcggtcctcgggtctgggagatatcatatccgcgagcgcggcggagcttcgagggccgaacaacgccatcatcgggttgaaggagccggagctgatctcgatctcctcgtcgatgcgctgcgctgaaggggtcgcgggcggggttggtgctaccgggaacatgtcggccgagctctggacgtggatccaccagctctcccttgccatgcactcctcgatccattgcaggatggaggtcgccttcgttgaccgtctgaacaggccctcccgctgcttcatggaatccaactccctgatcactgtaaagagaaacgtatgtactgcctcagttaccaaaacctttggtgatgtctccagagcatttcaggatgagtttgcacaacatttacacaacagctgtatttgctctgagcttaccaatccttggtatgaacaggcgagttcctttta

SEQ ID NO: 750 - DNA, 4922 bp, Zea mays
  misc_feature (4303)..(4303): n is a, c, g, or t
tttttataccactggacttcatcaatcatggtggggcctgttactgtcatgcagatgttgtagggtctcttagtcttgggggaaatctgtttcgctttctttgcaaatgcactggttgaaccgtatcaaatgcttatgtgttgtgcttttgtaacgcaaatgttggttgatcaagggtgattcttgattttgcaataaactactttcacacaattttatttatcatagtgttgtttgttgttttatatctatgttttatactaacttttaatttccgtgccaacacacgagcatatacctataataaataatttcggatgaatcggatatcgagacatgttaccttaattatctaatataattttaggtcttcagactagcatctaaactagtgtttagataattcagatttggatagatcaatataggttcgcattcgggtaataggtatcactttttttcacatcccctagatgggcgtaatgcgtatgggcgtgcagtaagctgtaagcatgtcagacaggggtcacagctgctttcacattagcacggggacgggggcagaccggatctacgggattgactgactggttcgcgtcatgaccgcacgctttctagcctagccagcgtttggcgtgggtgtcaattctgctggtggtgaagcattcaacacttcggtagagacgaaagagagagagagagagagaggataacgtattctaatcaactttgtgcacgcactaatctttcttctgctcgtcgccagctacatatttgaagaaaaaaaacattcgtatctcagtcgagagatgtgtgtagaatacgtccacaagacagagtcaaagacactgcctgccctcgggagcttcctgctcacccactagtcggtcgctgcgctagctaataaaggcacaaactcaaaaactcatgatggcccaaaacgaaaccactgacggtgtcctgttcaaagtctgcacacggcccacagtttcgctcggcatggaaatcatgacaacaacacgccaaaacaagaaccgagggcgggggatctcacaccgcggccagcgataccagcggcgtcttgttgacggcgtccgtggcctgcgcgtacagggaattgtgacgcaggatcagcttcaggcccttggcggcctcggactcggagggcctcgccgccaccagaaccctccgcttcatagcgtggtggcggctgttgtagtagttctccgccagcgcggacgcgtccaggcaggaccaggccgacccccgtggggcgctggccgcccacatgaaccgcctggaggacgggtccacgagggactcgcggaactccttggctccctcgcatggcaggccctgcgccgcgggcaacgcaacacaaccaggttcagttcgaacgcacacagcaagcaggcagggttgggtttgggtggttaccgtactaacctctgccatggctttgatcttgagcgtgacgctgtttgacagcaccacgaccttctcgttgctccggaccctactgacgaggagggcgcagtcgaggacgcggtcctcgggtctgggagatatcatatccgcgagcgcggcggagcttcgagggccgaacaacgccatcatcgggttgaaggagccggagctgatctcgatctcctcgtcgatgcgctgcgctgaaggggtcgcgggcggggttggtgctaccgggaacatgtcggccgagctctggacgtggatccaccagctctcccttgccatgcactcctcgatccattgcaggatggaggtcgccttcgttgaccgtctgaacaggccctcccgctgcttcatggaatccaactccctgatcactgtaaagagaaacgtatgtactgcctcagttagcaaaacctttggtgatggtctccagagcatttcaggatgagtttgcacaacatttacacaacagctgcatttgctctgagcttaccaatccttggtatgaacaggcgagttccttttaagccttttagcagcataatagccttcctagactcgtcatcaagaagactgtctgtattagccaccatggtccaggttttcatgccttctccagcactacctgattcgtggccattacactgcccagcataaagataggtaatgtcagatgcgatactaaaaacagaaggcattcatatgaagcatacagatacaatcactccaacaacttactgagagatcgttcaatttatcttctaacttgatcgccaagtcaccagcagcaacgccagctggtctagcaacagcacaggtacaatcatgcgagctagcaggtctcaaaggagaatttgacacaagagtctggaaggggagcctaccaacaacccttttctttgtgaccgcactttcaactcgtgtaaggtttccagacatgtcccttgttttccgagctgcagaagatagtggtgtcaagttctccttgtctgagcagaatgcttccagatcttggtctaagtcgactgagaggtccttgggaaaacacttccttgctttcatgcctcctgaagatataggagtcaagttctccttatccgaatagaaaacatcaaaatctactgtgtggacttttttggacttcgatgataattcacattgcttcttatttgagctattctctgttgacactgaattatctacccttgacccaagaactttcttcttatttgaagcatttgctgctgacactgaattatccatccttgtaccaagaactcccctaacaacggtcttcaccttagaggcaggagtcacgttctctttgtctgagaacagattttcctgtctcacaggggacatagcctcgtactttctcggagccagcactgagttttccctatccagaaggatatcatctttgaattccagatatgaaatgggcatacactcctccgtttggctcttcagatatttttcatcagttggaattaatgggttaagattctcagagacaggttcatttaatttcatctgatctccagtgttcagcatggagttctcattttcagaaaagtcgccatgatctaaattgagaggggaaatagaatccatcaactgttgggaaatggtaggctttaaaactatattgctcctctccattattatgttacctgatccattgggggtgatttcatccttgtccagtgggcagatctcttcaccttcttcaattccatcagtatccaaattgtcaaatagattcccacgaatggtcccttcgagctgacagttcccagggccctcagtaatcttatttgggtttatattctcgctttttgagagaccttcctccaagttaagatggttcaagtcatcgtgcttcacttctggtattataagatatcctgaaagaagctcagattctgtatgaacactagcaacattccattgtggaatttccttgtcggcgaacacatcatctttgaaatgcaaagggagagcagaatctaataagcctagtttcttctgcagctcggcaccaattggatcttgtgggatataattatcaggttttctctcgttcatatttccctccatgatcatgctggccgggggattcatgtcaacgttatcttcagcaatcaactcttccttttcttcagccttttcaatttcagaaataccaaataaagctatacataccgcacattctgtcccacagctctgagaacatacaacaatatcattttggtctcccttctgaaagctatggctcagagtgctgcttctctcgctgctcctgcctgtgtcaacacgaagtgatttgactgacttcaacttggacctcttggacactttgtttgaggcatcctcctgctcgcctgactggattgattttccagcatttgtcagtgtgcctggcatttcctgtatgatcaacgaaccaaaagattctgaaatttgattcttgtcgaccaacttttcctctgtcactccgtttcttttctcatgaaattgggaaagtgaatgctcttccacaaaaaaaggttgaaggaactcagacaatggaggtgctgagggggccactttggctggaaatgcaatgtcttcagacacaatttgttcacttgtatcctggatattagatcagacagttagcaatcatttccagaaaatggatccaaagctgaaagtctatacgataaaaagtaagaaaacaacagcaatataactcgtgtaaacaactttagacatgaaacaaacagtaacacctaaaactattgaaaattaaaaaaaaaactgacatacatgttaaactgtaaaccaatgntattagctaacttgagcatagatgaattttacaagtggaattggatattggatatatattgtcagctgaatagctgatcacatagtttgtgctgatgcaatttatagttgacttggttacacaaaattaaggtcacaaaatttggtcatatgcaaaggatagcacatttaagtgttgatatgctctgacttcaacatacaaaataaatgcaagaactgtgtttaacttgtgaaatacaacattcatagaagcagccaaatgaattcacatgtgcaaaaatgtttgctttacacaagctgaaaattacacacacctaccataaaaaatcttttgttaagctaaggaaaaaaaactctggggtaaaccaccctaggcttttttttaaaaaaatcatttgtcaaactaagcaaacaaacaaatagaatgtaaaaaactcgatctgtggggatatgacaaccccaaggtattgcatcaagaagaaaatctcaagcaggtcaagaaaacacccgaatccctacctcacccataaacaaataaatagtatgtcatttcagataaatttaacttagcacaatagaatcaggagcatagaaaataatatgtatcaaatagaggttcg

SEQ ID NO: 751 - DNA, 1280 bp, Zea mays
  misc_feature (1228)..(1228): n is a, c, g, or t
  misc_feature (1250)..(1250): n is a, c, g, or t
  misc_feature (1262)..(1262): n is a, c, g, or t
ggagagcttcttaccttgatttatctggtgaggatgtaatctttgatctctctctctctctctctctctctctctctctctctctctgtgtgtgtgtgtgtgtgtgtgtgtgtgtgtgtgtgtgtgtgggtgtgggcgcgcatgaagctcccactcattgtacaatcatatggtgccctcttcttcaaactgagggactacaagatgatgtattctgtattccctctgtcccaaaataagttctcatcttgtaatttgagtcaactaatcttaactttgactagatttacagaaaattatatcaacatttttttatttatttccaaataggttttctttgaaaatatatgatgtgattaatctaatgatggtattacaaatattagtatttgtatgtatatatggtcaaagttgatattgtttgactcctcgaaatgcaaaatggagacttattttcggaccaagtactccactgaaagttatgttgatccgggaatctgaaggcaatggatagaatataggacatgttgtagaatctgtaccgttgggccatgaggaaagtgagaaaagtgggtgcattgttgggtgattggtgtaaaagattgagatcagggattttccttagtctgaccttagtgcttaacagttcacgagtactcaagagcagccaggcacctatgaattctccattggtcccatcctcatgtgcccgtgtgtttcagagatttcagtcctgaaagttatgaatgaacatgttgtattttgtgagcatcagctcacgtgattgccattggacaaaaacgtgataaaagtgttaatacttcctatttcaatatgttttgtccattcggtgtcattactctaataggaaagacaaagcagagacatggagaagttgaacacaagtattacagcagtacagcactggacaacaaaattaatctctaagcatggtcttgaaaccattagcttctttgattggttttccattgctttgttcaccatgacgggaatttcttacacagcttcatattacagataagtgatcaagaggggaggaccaccgtacaataatacagttgctgagtaagagtattcatccccttgccatcatgtaataatttatttacaatatttattgttcttggtaacatggctgctttatttttgacaaaagaaaagaccttgtcggtttctgcattgttaaacaaaaattgtagcgttattntctctcatttttttactggtgnctgataactgtncctttccgaaacatcagc

SEQ ID NO: 752 - DNA, 1208 bp, Zea mays
ccggccgggccgggtaaaaaaacacgggacaggtaaattggatctcgctcgaggaccggccggcactctcgatcacaggaattcacgtcgatcgcttgagttagtttgcagccaagatgaacgacgccgatgtcgggaagcaggtgcagcagatggtccggttcatcctgcaggaggccgacgagaaagccagcgagatcagtgttgccgccgaggaggagttcagcatcgagaagctgcagctggtggagtcggaaaaacggagggtgcggcaggagtacgagcgcaaggagaagcaggtggacgtccgcaggaagatcgagtactcgacggagctgaacgcggcgcgcatcaagctgctgcgggcgcaggacgacgtggtgaccgggatgaaggagagcgccggcgacgcgctgctccgcgtcaccaaggacgccaacgcctacaagagggtcctcaagggcctcatcgtgcagagcctgcttcgcctgagggagccggcgctggtgctgcggtgccgagaggcggaccggagcctggtggaggcggtgctggaggtggccaagaaggagtacgccgagaaggccaaggtcaacctccccaagatcatcatcgacggcaaggtctacctgccgccgcagaggaccagccgcgacgcgcacgggccgtcctgctccggcggcgtggtgctcgcgtcccaggacggcaagatcgtctgcgacaacacgctggacgccaggctcagcgtctccttcaggcaaaagctccccgagatcaggaagaaactcttcagccagcgagtatcgtcctaatgttttttttttgttactctgatcgattgttttctgaaataaaccagaagcggtccgatcctacgaagatacacaggtcctgacattgggtgaagcccgtatgtgcacgtttcggatttcgcaacatcgatttgagcttcaacagttcttcgctagcttgtcggtagaggcggcaatggctgaagttgagtctgtatcccggtggataggggacctccgcgaccgttaccctgagtcgagttgtcacagtctgtatctatcgctcctgaaacctgaggggcctgtattgtttgtcaagcactttgtttcttctcttctgtttgtagcctactatatccactgaaatctaaggggcctgtattgtttgtcaaaaaaaaaacatactaacccgccgcc

SEQ ID NO: 753 - DNA, 2223 bp, Zea mays
  misc_feature (17)..(17): n is a, c, g, or t
  misc_feature (20)..(20): n is a, c, g, or t
ggcacgagcgcctcttngcnccgggagcccgtgctcgggggcccccggccggcgcggcgtggccagcgctgatttcgagggggtcgggctgtgtttcttcggcgccgcagcaggcgcggagggtggtcccatggtgttggaggactcgaccgcgtctgcagccacggtcgaggcggaggccagggtcgcggctggtgggaggagtgtcttcgccgtggactgcgtgccgctgtggggctacacttccatatgcggccgccgtccggagatggaggatgccgttgctatagtgccgcgattctttgacttgccactctggttgctcaccggcaatgcgatggtcgatggcctcgatcccatgacgttccgcttacctgcacatttctttggtgtctatgacggacacggtggtgcacaggtagcaaattactgtcgggaacgcctccatgtggccctactggagcagctgagcaggatagaggagactgcgtgtgcagctaacttgggagacatggagttcaagaaacagtgggaaaaggtctttgtggattcttatgctagagtggatgacgaggttgggggaaacacgatgaggggaggtggtgaagaagcaggcacaagtgatgctgctatgacactcgtgccagaacctgtggcacctgagacggtgggttcgacggcggtcgtcgctgtcatctgctcctcacatatcattgtctccaactgtggagattcacgggcagtgctctgccgaggcaagcagcctgtgcctctgtcggtggatcataaacctaacagggaggatgagtatgcaaggattgaggcagagggtggcaaggtcatacaatggaacggttatcgagttttcggtgttcttgcaatgtcgcgatcaattggtgacagatatctgaagccatggataattccagtcccagaggtaacaatagttccgcgggctaaggatgacgagtgccttattcttgccagtgacggcctctgggatgtaatgtcaaatgaagaggtatgtgaaatcgctcgcaagcggatacttctgtggcacaaaaagaacagcacaagctcatcatcagccccacgggttggtgactccgcagactcagccgctcaagcggctgctgaatgcttgtcaaagcttgctcttcagaaggggagcaaagacaacattactgtcgtggtagttgatctgaaagcacagcgcaagttcaagagcaaaacttaaccgtgacaagcgtagcaacaagttgctaagaacctatagattcggacagtcccaagttcggtcattttagttcgctgctttagtgcattgcttagcccagttccttatttttctcagttctttttaagccatgccaagggctgtattccccgtatacggtacagatcgcgaaatccctatcagggatggtttggtgatatcagggtttatatgttttcctgaccgtggtgactgtcctgttttcattcttctttcttcgctgccctgtattcattttgtcaagctggggcaggcatccaagtatttggcaatgtatatttgagcttgcaggatacaaaggaaacgaattgttatgaagggtacgtatcctgcctgcctgaatttgggaatctatcaactgcatcagctggtaatataagtatggactcgcaatctggatactggtggagagaacctaatggtccagaagggctgagttgtgctaaaaaagtttgaggcaacaaccgtagtgtacataagtttctactcaacttctgcatggtaaagttttatgacaaaaaggatcatattaatgttgaaaaaatccttacggttaatgaagctaaagatgtcccctgaaaataagcaagatgaaactatgtaaagaaatatgctaagcaagtctacttagagttttacacaataattaacagtttagcacaaacaagggaacaactagataagcaacaagaataattaacagttcagagcacagacatcctagaaccatagtttgggaaccttattttctgaaggatcatagtttggaaatcccttggaaaattgaatttcccaaactagccctcattaagagagataaggagcattcctaatggactgctgtgtaattgactggatgttagactgccactttactcatcatggagctcttttgaatgtgtgtgtatatatatatatatatatatatatatatatatatatatata

SEQ ID NO: 754 - DNA, 1122 bp, Zea mays
cgctaatcgctacccttcgcctttgctgtgctgctgcgtgactgcgtctcgtgtcaggctgtcagctagctttggggttgggggcggggcagtggggccctacggccggccatggccgccgcggcgaacacacctcagtgtcaccggccgtggcagctggtggtcccagcgagagcgagcgcgagcgcgagcgcgagccgccgcactagccggccagccgcagcagcaggagtgggggctggcggtgcgccgaacgcatggacgtggatgccaccgccacctgcagctcggcggacagtgagggccaaggccggtgcggccgaggcgcggccgtcgtcgccgccggacgccgtgacctacagcgcgagcatctccacggacacgcccctccacgaaccccccggggtctccttcgacgagtacatccaggaccgcgcgcgcgtgttccgcgccatgttccccgacgagagcaggagccagcgggtcggcgacggggaatggcaggtccacatgctgccgctgcagttcctcctcctcaccgtgcgccccgtcgtcgtcatgcagctgcggcaccgcgccggcgggctcgacctccgagtcacggagtgggagctgagggggctggacgtcagctacgcgccatccagcttcgacctcggcgtgagcgggtcgctgtacgccgaccggagcaggagccgcgggtgccggatgaggggccacctggagatcgccatcacctgcgtcctgccgccgcccctgcgcctcgtgccagagaccgtcctgcgcggcgtcgccgaatcggtacctagctctcgccaggcatccaaaatacgtagtcctcgtccggttccttgaaaactggagcccagtaacgcagtgcaggtcctgtcgacgctggcggagaagatgaagcgggacgtggacgtcggcctcgtcgccgacttcaggaggtttcgccgggagaaggcagcagcgtccagggccacgccgacgctgggcgcgacggcatcggacagagacgaagcctctgagtctgaatcctagcgtggtgtgtgtggacagtggactgcagcttcccttggcttgtacacagagagtagtgaacatgattcatttacatct

SEQ ID NO: 755 - DNA, 1364 bp, Zea mays
gcggcacgagaccattacctccgacaggcaatccgacccagaccagaccaccccacttaccaaccagagcgacaagcccgaccgcccgcttccttgcaaacgaaacaaaacaaaacaatggcgacagcgagtgagatcgcggcggtgggcgtaataggcgcggggcagatgggctcgggcatcgcccagctcgccgccgccggcggctgtgccgtacttctcctcgacgccgaccccactgccctctcccgtgccgtcgtctccatctccgcctccctacggcgcctcgccgccaagggccagctctcccaggccgcgtgcgaggactcaataaagcggataaggtgcgtctccgccgtgcaggatctcagggacgcggatcttgtgatcgaggccgtcgtggagaacgaagacgtcaagaagaagctattcgtggagctggataaggtcacgaagccctcggccatcctcgcctccaacacgagctccatctccataacccgcctggcttcagctaccaaacgcccctctcaggtgataggcatgcacttcttcaaccctcctccggtaatgaaactgatcgagattatccgaggagccgatacgtcagatgaggtgtttgctgctgtcagatctttctccgaaagactcgggaagtccgttatatgctcgcaagattacccaggattcatcgtgaaccgcatcctcatgccgatgatcaacgaggccttctgggctctgtacaccggagtggcaaccaaagaggacatcgacgcagggatgaagctgggcacgaaccacccgatgggcccgctgcagctcgccgacttcatcggcctggacgtctgcctctcagtacttcgggtactccacagcggcctgggagatagcaagtacagcccctgccctctcctcgttcagtacgtcgatgctggccggcttgggaagaagcgtggagtaggcgtgtattcgtatgggcacaggccttcgtccgtcaggccaaagtcgtctctgtaggcgtgagagcaaactgttgggcgaataaaaccaggtgcgtgttgcaattgcacgtcagagaaaaagggagcacagcctagttcagaggtactcagtcggacgcttcaggtcgtgtagattcgtaatggcagggtttgctgctctatgtagaaaagatggttcagtgtttttaatctgataagtggaagtcatgaaacatttccgcagtttgcgttctgctcgagagggtgggagaaacagaaaagctatacttcttttgtattgtaatcctctgtaaactacaaacagacagatctcactctctgaaccggtaaaggaaaccaatgagtttctattgtgaaccaaaa

SEQ ID NO: 756 - DNA, 836 bp, Zea mays
tttttttttttttttttacacaatacgctttatttatctcttaaacatctaagactcaatgtacaaattaataaaatctatggatcaattttctagcttggtttgcatggtgctcgatcggacgcttaattgaagtggttttggaaggttcattcagtgaaacatgtcgtggctactcctgctgaaggttgatcccatgccggagtagatctgcatctgggtgagaatgtgctcgaagttgtcattagacttctcgatggggtgtgtatgggtgccctcgtatgtggtcaccaccacgccctcgtcccttgacagccgctgcacctgcttcttcacgttgcacccttggtgtgtgcatctgtagtagcttcgtgggaagttgttgttcttgacggccttctggccgtacttcctccagcggtagccgtcgtcgaggatgtcgacctggctgcgcgtctggaaggcgaaccgcgggcggcgctccttcttttcccctttcctcctggccgccgccggcctgtcgtccgcctcggcctccttctctccactgccagctgcggctggacctggaccgccaccaccgtccttgctggagtcgtcgttgtgggacagccgctccgcgacgaataatgaggacggcgacgaggatccgccggcggcgtgcacgtgcccgctgtgctggcctcggtcgtggtcgcgccgcaagccgctagcgctgctggtggcaatgaagttgtaggagctgggggtgccggcagctgaagagggctgcgcatgcgtcgccgtcgtcccaaacagcatgtgataattctccatgctcgcttaaatagtttgcg

SEQ ID NO: 757 - DNA, 1271 bp, Zea mays
ccacgcgtccgcgtcctcctccggtcacgcacgcagctagcttacccgccccgccactataaaaatccacctccaccccaccgcgcgtctacagttccacacacgcgtgcacgggcgggcaagcaccagaaaggaaaggcggaggccgcgcggcgggcgccagctgcagccaagagcccactagtagtagtagtagctagttcaccaccgcctgcttgcctcctttactttgccatatttgctagcgtttcctggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccaagacaacaaagagttgcgggataagcagcgcaacctccagtctccaccggaggcgccaccggacctgaaccgctgtgtccctccttggccgcgtagcctgccggcaccgagcaatgacatggacgtggagacggagctgtacataggattacccggcagggagcgctcctccaaccgggactctgattgaaccacggattttcagttcgatcggctaaaaggaataagctccctgaaattaaagcatcgaagggcacacgtcaatggttttatttgcaacttttgtatgcaaacttgtacttgaaaagtaaaaaaaataaaaataaatctgtagtatgtggatgcaagaaacggctggttagctagctgcaagccttctggggcctgaaaatgaaatccacccatggatacacccaaccaagcttgatgcgctacttttcttaaaaaaaaaaaaaaaaaaaaaaaaaaaaaaaaaaaaaaag

SEQ ID NO: 758 - DNA, 3381 bp, Zea mays
agatacaacattgctcctactaaatgtcattggacaggcgtaaaacatatcctttagatatctcaatggtacaagagattttggtcttttttacgcaagaggccaggactcgactttaattggatatacagatgctggctatctttcagatcctcacaatgccagatctcaaacaggctttgtttatttatatggtggaacagctatctcttggaaatcaaccaaacaaactttggtagccacttccacaaatcattctgaaataattgctttatatgaagcttccaaagaatgtgtatggcttcgtagaatgattaatcatatactacaatcttgtggtataggttctctagaatcacctaccattatctatgaagataatgcagcttgtgttattcagatggaaactggttatattaagagcaatatcactaagcatatagctccaaaattatttttccctcatgaattacaaaaggatggagaaataaatatattgcagactaaatcatgcgacaatctcgcagatttattcactaagtccctaccttactccacattttcaaaatatgttgaaggtataggtatgagaagacttagagacctgcaaaattcagggggagtaactctcacggatacataacaagttcacatcatattgcactcttttctttatgtggtttttctctcacaaagagtttttatcatataaagtttttaatgagacaatattaatacaagcgtataccatatcactcttaattttcccacagggtttttgtaaggtgatatgaggtatagtagaaattttaaatgcaggattttcatttgatggactcaatcaagggggagtgttaaggataaaatgatttcgtccacgtcagcaatccggaggaagaaacacacttaatatcaaaggtggagattaacaagatcgacggtcattagttaataggattagtggtaataatattcctttctgtaaatcctgttcccgaacaggcacccctctccctctctcctacgacgaggaaaccgtacttagcgaacggacaagttttctgtcgtttcactgtgtttatgcacaccaccattgaatgaaaaggatgcgcatcatttgcttcagtcccttcgttttctaacagaaatatgggctattttgctttaggtgttggtaggccgtttccgactaaagcgaagtgaacagccacgtggatgtctgctggagcacgacaaagcggccggcgtgacgatcagagtgcgattgtcggtgccttggtcaagtgttttgccagacgaaaatgcggggcgggaccctgcctcacgccgtcgcgtcctgcgtcgctttgttccaccgcaagtctgcatctttctttcgttcttctttcttttcttgttcgctgctctcgagtacgcatcattgatcattgccttttgccatggacacaggacacatcaactatccggatacacgaaaaaacaaaggcaccatgcatattgtggtttttcaattcattaattagatctgcatgcagttggtcatctggtttggtccggactgtcaaccgtggcgtgtgaatgtgattatgccaaagtggcgtcgcggccggcaccggcagtctttcaaaccatacggtcgtcgtcgtcttccctgcgcgggctgcggtcctgctccatagttgctttgcagccaagccatgtctcgggcaccgccagcttatctcctcgccacaaagcaaggaatccaaagcaaaggcaacggcggccaagttagtagctaggtttacagccaaaacacggcgatcctaaaaccacaacccaaaaccggccggccggcccgcggccggctcccgcgcacgcacacgcacacaaacctgggctctagcctctagctcactccccgcgcgcaatggccaacgcagctccaactcccacgcaaacgaggcatgtctcgcggccgattcctacaggcctcgtgcccgtggccgtgcttgtcgccgccgccgccggcctcctcgcgctgctgccgtcgctggcccaggcggtgtgggaggtgccgcacctcttcctcctaggcgccgtcatctccttcggcgtcttcacccagagccagaggaacaacgacgccgacggcagtggcaatggcaatggcaacgccgccagcgccaaggacagcccactggcgtggaacgcgcggtaccaccccgacgacgaacccctcgtcgtggtcgaagatcacgcggtgccgcgcggcgacgacgacgacgacgggctggaaggcgcgcgggagaggccgctttccctgccggtgcggaggctgaagctgaagcctgcggctgcgtcgcggtcgcaggagtccgaaaccggcggcgatgccagtgacggtttcggtgaggagacggatagctgtgcgtcgtcgtccgggttttgggccggcgcgcgcgccgtcccttcgccgccctctgttctcgacgcccaacagtgtgaagaacgaccgttctttgtccaacacagcgccagcaagtcccgtgggtgcagtgccgcgactccggctccgggtgcgcccaccgtctcgaggggcttcgtccagtggtgccatccttcggtgcccggcgacaagcagccgttgagcgacgacggcgaggtcaccgactgggataatgaggatgccgacgggtcgtccgatgagatgacagcggccgtgtcgtcagaaaggtcggtccctggggacttggcctcttgtgccagtgactgtaacgacggcgacggcgacgacacgtctgtggatgaagagcttttgaagctggcggcgaaggcggagccggacagggaggaggaagtggacaggaaggccgacgagttcatcgccaaattcagggagcagatcaggctccagaagcactagccggacatgcatacatgctctgctgagtgccgacacacgtaatgccactgctggtccagcacgaaggagaacgcagtggtagtttgttcatctatctatcccagcatgttattatctgtatcattttattttatttttttgttgctccgatgcaacaacaaggagccaaaaacatggtgtacatgaaatgcatattgagcactgttttttttcggtgcatttatatagatttcgcgtatgcctgtcattgccactgccaggcatgaacgcgcgtgaggcagttgggatttgggaggagttaggatgaacaacaactgccctgcagcaaaaatctttgcgacttcgctggaatggaacagtccgcgcgacgtgcacaagcacagcacaacccgcaggagccttctggtgcatgcaaggagcgatgccctgctgccgagtgccgatgcaggacatcaatgaatgctgtgaggaaaaac

SEQ ID NO: 759 - DNA, 1179 bp, Zea mays
tccaagttttccacttctcaactacttacaagagctctaggcattcaattctagacacactcaaagagatcaaatcctctccaattccacacaaagccctagtgactagtgagagtgatttgccgtgttcatttgagctcttgcgcttggattgcttcttttctttctcacttgttcttgagatcacaactccattgtaatcaaggcaagaggcaccaattgtgtggtggcccttgcggggaagttttgttcccggctttgattagagaagagaagctcactcggtccgagggaccgtttgagagagggaagggttgaaagagacccggcctttgtggcctcctcaacggggagtaggtttgcaagaaccgaacctcggtaaaacaaatctccgtgtctcacttgcttattcgcttgggatttgttttgcgccctctctctcggactcatttatatttctaacgctaacccggcttgtagttgtgtttatatttgtaaatttcagtttcgccctattcaccccccctctaggcgactatcaattggtatcagagcccggtgcttcattagagcctaaccgctcgaagtgatgtcgggagatcacgccaagaaggagatggagaccggcgaaaagcccactacaagccacgggagcacttcatcggaagagtcccgcaccaaaaggagggagaagaagaagagctcctccaacaaagggaaggagaagaaatcttcttctcaccacaaagagaagaaggaaaaatcttcttcccacaagccgcatcggaaaggcgacaagcacaagaggatgaggaaggtggtctactacgagaccgacacttcatcaacatcgacctccgactccgatgcgccctccgtcacttctaagcgccaagagcgcaagaagtatagtaagatccccctacgctaccctcgcatttccaaacatacacctttactttccgtcccactaggcaaaccaccaacttttgatggtgaagattacgctaggtggagcgatttaatgcgatttcatctaatctcgctccacaaaagcatatgggatgttgttgagtttggtgcgcaggtaccatccgtaggggatgagaactatgatgaggatgaggtggcccaaatcgagcacttcaactcacaagcaacaacaatactcctcgcctc

SEQ ID NO: 760 - DNA, 3222 bp, Zea mays
  misc_feature (467)..(467): n is a, c, g, or t
  misc_feature (1607)..(1607): n is a, c, g, or t
atcccataatggaagacaatggtttggatgacagtcagctggtcagagctcccaaaactatcatgaattaatgactgaaagctttatcctaacgtttcatgatagattaagggcttgtttggttcgctgcctaactttttctgcataaggttagttcttcaattcggacgactaaccttagacaaagtatgacatagttagccatgaaccaaacaggccctaagctcttaaatgcaaacaattggaaaagcaaagagaaacaaccatacacagtaactgtgtggattcatatctaaggggaaccaacaggagacggtcaagacaggtgattgatgggtgagtagatgtatcaaatgacacttgaaaacaaatgaaacaacaagaccaacatatacattgagtagaattatcacaataaggaacaatgttatcaaatcatctagtcaatcctagttgccttgggaccnaccagttgattagttgtagaccaccctggtcagtcctaatcgtcctatatatcaggactaccaaatataatctaatatcatgtatgttttggagtacaaatcaagcataaagataactctagggtagtggctgcatgcctgtaacacccaaaaccttgttttggattttattttattttatttaaaaaaaaaactttccaaaggtcttcttttataatgtcttctaaaagagttttcttacctctaaaagttatatcttctaaaaaacaaacgtggcttctaataaaatattaaataaaatgacccctataaagaaggaaagcatcctttgttgcattataaatttggaactattttctaacgagtttaaattaaaatactccttaatacagattacacattggagtttattttaaaataattatgggtgcacactatattttcaaagaatttgtcaaaatggataatatatatatatatatatattattccagggaatgacttgcatctcatgctgggatttttgtgtgtacatttatatttggattttcaaagctcaatatagatttaaagtgcattagaagttgaaactgaaattaggaaatgaaataaaaaaacatgaattagaaaagttaaaaaaaagagagatgaaggtcacgtgtgctggccaccgaacccaatccctttccaaattccaaatgccatagccgacacctcttgccccgccgtggtgtttttttttttttttttattctcctagccgaaggttgcatcatcacacatcatggctgatgtcatccctattgctccatcactcgatgacatgtggggaccttttgctagaactcctgttcttgtgcttcatctcgccatgcccaggagacggagccatcgcgatcccaacggaaacaataaactcgcaggtttgttgggggtttgttgccagaacctcgcatgcacggggcatataaacagcaccacccctacggccatcatatccttccatacctcacgcacgccacaaagagagcagagaggaaccgagagccgccagagccaatccctgttgtcgtcgggattatgaagtgagctacgagtcgccttggagggccgtcgggatgtcctggttgtgtgcgattngtcgtcgggcatgatgaatggtcggatgctgctggattcctcaccggagctcaggatgcatcccggatccgcccgcgacgtagtcagcaccgccgacgtcttcaccgccggtaagacatcgtactcggtgttcgtcttgtccccagcatcgcgttgagcatactagattttgttctggtactcggagggttgggcggagtcctccggtgatgctgccaccgtggtcggcaaaatcgcgtggctgtgctactccggcaatggcgctgccgtgttagcacgctggcaccgccgttcgcaaccgtcgggtgttgaagatgccccgggtctattggatctccatccgatggatgagatccgatctgagcgtatccattcgtgctgggtcgttgaaagggaattaggcttacacctagttcctaaatagttttggtggttgaatcgcccaacacaaacaaattggactaactagtttgctctagattatatgttctacaggtgccaaaggttcatctataactatactaaatcgactgtccggaataccgtagattattccggacaggagaagctttttggaaaaacaggccaagcgcggaccgtccgggcccttgcggcggaccgtccgcgacacaagaatgaccctcggacagaaccaatgcaaaaacacaagtttccactacggactgtccggaggaaaagcaaagaccgtccgagccctcgcgcggaccgtccggcctcaggcgcggaccgtccggtcggtaagaaaccgaaaaacccgaaggtgacgggttcggagaaatgaattatagggggcctcgcggaccgtccggggtgcacgaccggaccgtccgcgactggctctgtctgacatctgacgacgcattaaatgcaatatagccgttgatatagccgttactgctgaccgttgcattttcagccgttgatctacaggggcggaccgtccgcaccaggagggcggaccgtccgcgctcagcagaatggcccaacggctaggaagtggttggtggctataaatacaaccccaaccacctccattcacttcatccaagcattccaaccttcaacattcaatacaagagctagcaatccattccaagacacattcaaagcctccatctctccaagtttcacaattgagaaaagagatcattagtgattagtggcttgagagagaaagtgatccgtgtgttatttgtcgctcttgtcgcttggctttttcaatcgtgctttcttgattctttcattgcgatcaaactcacttgtaattgaggcaagagacaccaaacttgtggtggtccttgtgggaactttgtgttccaagtgattaagaagagaaagctcactcggtccgagggaccgtttgagagagggaagggttgaaagagacccggcctttgtggcctcctcaacggggagtaggtttgcaagaaccgaacctcggtaaaacaaaaaaaaaaaaaaaactcttcatttgcttgcgatttgttttgcgccctctctcgcggactcgtttctttatttctaacgctaaccccggcttgtagttgtgtttatatttgtaaatttcagtttcgccctattcaccccccctcta

SEQ ID NO: 761 - DNA, 2035 bp, Zea mays
gagcccaagcaaaaggaccgcaccaccactaattttaaaattggatattttcaattggtaaatttcaaattggtatcttattgtgttcaaaagagggagtaagtagtatttcaaaaatgatatatcaaaaccctcttgaacactaagaggaggatctcatttagggggagttttatttaagtcaaaggaaaagcatttgaaacagggggagaatttcaaatcttgaaaatgcttcttgaaatcttattcatttacctttgactatttgcaaaagaactttgaaaaggatttacaaaagaatttgcaaaaacaaaacatatggtgcaaacgtggtccaaaatgttaaaaaataaagaaacaatccatgtatactctatgggtatttatattggctcaatttcaagcaacctttgcactgacattatgcaaactagttcaattcatgcacttctatacttgctttggtttgtgttgacagcatcaatcaccaaaaagggggagattgaaagggaattaggcttacacctagttcctaattaattttggtggttgaattgcccaacacaaataattggactaactagtttgctctagattatatgttctacaggtgccaaaggttcatctacaactatactaaatcgactgtccggaataccgtagattattccggacaggagaagctttttggaaaaacaggccaagcgcggaccgtccgggcccttgcggcggaccgtccgcaacaccaggatgaccctcggacagaaccaatgcaaaaatccaagtctgcactacggaccgtccggaggaaaagcaaggaccgtccgagacctcgcgcggaccgtccggcctcaggcgcggaccgtccggtaggtaaggaaccgaaaaacccgaaggtgacgggttcggaaaaatgaattatagcgtcctcgcggaccgtccggggtgcacgaccggaccgtccgcgactggctttatctgacatctgacgacgcattaaatgcaatatagccgttgatatagccgttactgctgaccgttgcgttttcagccgttgatctacaggcgcggaccgtccggaccaggcgggcggaccgtccgcgctcggcagaatggagcaacggctaggaagtggttggtggctataaatacaaccccaaccacctccattcactacacccaagcattccaaccttcaacattcaatacaagagctagcaatccattccaagacacattcaaagcctccatctctccaagtttcacaattgagaaaagagatcattagtgattagtgacttgagagagaaagtgatccgtgtgttatttgtcgctcctggcgcttggcttttgcaatcgtgctttctttcttgattctttattgcgatcaaactcacttgtaattgaggcaagagacaccaatcttgtggtgatccttgtaggaactttgtgttccaagtgattgagaagagaaagctcactcggtccgagggaccgtttgagagagggaaagggttgagagagacccggtctttgtgaccacctcaacggggagtaggtttgcgagaaccgaacctcggtaaaacaaatctttgtgtcacattccttatttgcttgcgatttgttttgcaccctctctctcggactcgtttatatttctaacgctaactcggcttgtagttgtgattatttttgagaatttcagtttcgccctattcaccccccctctaggcgactatcactcttgcttgcggtgccgagctgaggcgttcgccacttgcccaccatagatcatgaagcagtcgtggacctcggggaactctcctgccttgtgatcctccttatcgtcgtcgcgggccctgccaccctccgcaggtggtccggccttgtgaaagtggcaccgaagcatggcgcactcctctagggtgtgcttgacgggctcctgatggtaggggcacggctccttgagcatcttgtcgaagaggttggcgcctccaggaggtttccgagggttcttgtacacagcagcggctac

SEQ ID NO: 762 - DNA, 901 bp, Zea mays
gtgaataagttatacaggtgccaaaggttcacacttagccaataaaaagaccaagaattgggttcaacaaagagagcaagggataaccgaaggcagccctggtctggcacaccggactgtccggtgtgctaccagacactacaccggacagtccggtgcaccaccggacagtgtccggtgcaccaggggacttcacgctgaactcctcaccttcggggcttcccggagccgctccgctataattcaccggacatgtccggtgcacaccggactctccggtgagccagcggagcaacgactacttcgcgccaacggtcacctgcagaagcattaaatgcgcgccagagcgcgcagaagtcaggcacgcgcgaagtggcgcaccggacactctacagtacatgtccggtgtgccaccggacatccaggcgggcccagcagtcagagctccaacggtcggaacccaacggcctggtgacgtggctggcgcaccggacactgtccggtgtgcaccggactgtccggtgcaccatgcgacagacagcctccaccaaacggctagtttggtggaggctgtctgtcgcatggtgcaccggacagtccggtgcacaccggacagtgtccggtgcgccagccacgtcaccaggtcgttgggttccgaccgttggagctctgactgctgggcccgcctggatgtccggtggcacaccggacatgtactgtagagtgtccggtgcgccacttcgcgcgtgcctgacttctgcgcgctctggcgcgcatttaatgcttctgcaggtgaccgttggcgcgaagtagtcgttgctccgctggctcaccggacagtccggtgtgcaccgggacatgtcggtgaattatagcggatcggattcccgaagctggcgag

SEQ ID NO: 763 - DNA, 2111 bp, Zea mays
tctgtctccttctatgctatgactaatgtgttttttcaagagaatttcaaacaagtcataggaatattgaaagggaattggagtcttcggcgaagacaaaggcttccactacgtaactcatccttcgccgccgctccaagcaactctccgttcttgggggagaaagcataagaccaaagagggagaatgtaactcgaagggctctaatgattccgtttttggcgattcatgccaaagggggggaaagtaagagcccaaagcaaaaggaccgcacaccaccaccaatttcaaaaatttcgtgtttccaagaatattataaattggtatcctattgtgttcaaaagggggagaaaatagtatttccaaaatgatatatcaaaaccctcttgaacactaagaggtggatttcatttagggggagttttgtttagtcaaaggaaaagcatttgaaacagggggagagaatttcaaatcttgaaaaatgcttctcaaaatcttattcatttacctttgactatttgcaaaaggactttgaaaaggatttacaaaagaatttgcaaaagcaaaacatgtggtgcaagcgtggtccaaaatgttaaaaataaagaaacaatccatgcaaggattcttattggctcaattccaagcaacctttgcacctacattatgcaaactagttcagttatgcacctgttatatttgctttggtttgtgttggcatcaatcaccaaaaagggggagattgaaagggaattaggcttacacctagttcctaattagttttggtggttgaatcgcccaacacaaataattggactaactagtttgctctagattatatgttctacaggtgccaaaggttcatctacaactatactaaatcgactgtccggaataccgtagattattccggacaggagaagctttttggaaaaacaggccaagcgcggaccgtccgggcccttgcggcggaccgtccgcgacacgaggatgtcactcggccagaaccgatgcaaaaatccaagtctgtgctatggactgtccggaggaaaagcgaagaccgtccgagccctcgcgcggaccgtccggcctcaggcgcggaccgtccggtaggtgagaaaccgaaaaacccgaaggtaacgggttcagagaaatgaattatagcggcctcgcggaccgtccggaccaggcgggcggaccgtccgcgactggctctgtctgacatctgacgtcgcattaaatgcaatatagccgttgatatagccgttactgctgaccgttgcattttcagccgttgatctacaagggcggaccgtccgcaccaggagggcggaccgtccgcgctcggcagaaaggcccaacggctaggaagtggttggtggctataaatacaaccccaaccacctccattcacttcatccaagcattccaaccttcaacattcaatacaagagctagcaatccattccaagacacattcaaagcctccatctctccaagtttcacaattgagaaaagagatcattagtgattagtagcttgagagagaaagtgatccgtgtgttatttgtcgctcttgttgcttggctttttaatcgtgctttcttgattctttcattgcgatcaaactcacttgtaattgaggcaagagacaccaatcttgtggtgatccttgtaggaactttgtgttccaagtgattgagaaaagaaagctcactcgatccgtggatcgtttgagagagggaacgggttgaaagagacccggcctttgtggcctcctcaacggggagtaggtttgcgagaaccgaacctcggtaaaacaaatccgcgtgtctcacttacttattcgcttgcgatttgttttccgccctctctcgcggactcgtttctttatttctaacgctaacccggcttgtagttgtgattaactttgtaaatttcagtttcgccctattcaccccccctctaggcgactatcaattgttacacacactgaaggagtcaccattgaattggaacctaccttggagcaagagattcgtaaaggtcaggttggtgatgctaaaattcaagagattaaggatctgattactgaaggtcgagttccggaa

SEQ ID NO: 764 - DNA, 2038 bp, Zea mays
  misc_feature (164)..(164): n is a, c, g, or t
  misc_feature (1494)..(1494): n is a, c, g, or t
cgaccacctcgaacgtgagggtctcccttcggaagttggagggcgtcccaaagcagacgggaagatcgagttgtccgaggggctggacgcgcttcccggggatgatcccgtgtgaaagggaattgggcttacacctagttcctaattgattttggtggttgaantgcccaacacaaataattggactaactagtttgctctagattatatgttctacaggtgccaaaggttcatctacaactactaaatcgactgtccggaataccgtagattattccggacaggagaagcaggccaagcgcggaccgtccgcgcccttgcggcggaccgtccgcaacaccaggatgaccctccgatagaatcaatacaaaaatccaagtctgcactacggaccgtccggaggaaaagcgcggaccatctggacctcgcgcggaccgtccggcctcaggcgcggaccgtccggtaggcaaggaaccgaaaaacccgaaggtgacgggttcggaagaatgaattatagcggcctcgcggaccgtccggggtgcacgcccggaccgtccgcgactggctctgtctgacatctgacggcgcattaaatgcaatatagccgttgatatagccgttactgctgaccgttgcgttttcagccgttgatctacaggggcggaccgtccggaccaggcaggcggaccgtccgcgctcagcagaatggagcaacggctaggaagtggttggtggctataaatacaaccccaaccacctccattcacttcacccaagcattccaaccttcaacattcaatacaagagctagcaatccattccaagacacattcaaagcctccatctctccaagtttcacaattgagaaaagagatcattagtgattagtgacttgagagagaaagtgatccgtgtgttatttgtcgctcttgtcgcttggcttttgcaatcgtgctttctttcaatctttcattgcgatcaaactcacttgtaattgaggcaagagacaccaatcttgtggtggtccttgtgggaactttgtgttccaagtgattgagaagagaaagctcactcggtccgagggaccgtttgagagagggtaagggttgaaagagacccggcctttgtggcctcctcaacggggagtaggtttgagagaaccgaacctcggtaaaacaaatccgcgtgtctcacttcattattcgcttgcgatttgttttgcaccctctctcgtggactctattatatttctaacgctaacccggcttgtagttgtgatcatttttgagaatttcagtttcgccctattcacacccccctctaggcgactttcaattggtatcagagccacggtgcttcattagagcctaaccgctcgaagtgatgtcgggagatcacaccaagagggagatggagaccggcgacaagcccactacgagccaagggagcacttcatcggaagagtcccgcaccaagaggaaggagaagaagaangactcctccaaacggaaggagaaaagatcttcttcttcacaccacaaagagaagaaggagaaatcttcttcccacaagtcgcatcggaaaggcgacaagcacaagaggatgaggaaggtggtctactacgagaccgacacttcatcaacatcgacctccgactccgatgcgccatctgtaacttctaagcgccaagagcgcaagaagtttagtaagatccccttacactatcctcgtacatctagacatactccattactttccgttccattaggcaaaccgccaacctttgatggcgaagattatgctaggtggagtgatttaatgaaatttcatctaacctcactccacaaaagtatatggaatgttgttgagtttggagcacaggtaccatctataggggatgaagactatgatacggacgaagtggcccaaatcgagcacttcaactcccaagctacaaccatactcctcgcctctctaagcaaggaggaatacaacaaggtgcaagggttgaagaacgcaaaggaaattgggacctata

SEQ ID NO: 765 - DNA, 2264 bp, Zea mays
ctcaacgcctcttgaactttcttgactaggtattccctctctctctcgtcaactgcgctcaccctgcgctccggaacctggtagctgtcgcccgttccgtcggctcttcctcccagcgcactgcgcggccccaagctacagatcttgctcttagcgccctgcgcggccctgagctacaggttcttctccactgtcgcctgttccgtcagctattcctcctagcgcactgcgcggccccgagctacagatcttcctcctagcgccctgcgcggccccgagctacaggctatttgtgttgacgacatcttcagaaccttggtgaagctttgaagaattagtggcctatacaagaccaaggaatcttgtcctttctttgcgacatgagtacgcgcaacagttatcatctacccaccacctatccaaggagattatatgttctacaggtgccaaaggttcatctataactataccagatcgactgtccggaataccgtagattattccggacaggagaagctttttggaaaaacaggccaagcgcggaccgtccgggcccttgcggcggaccgtccgcgacacaaggatgcccttcggacagaaccaatgcaaaaacacaagtttccactacggactgtccggaggaaaagcaaagaccgtccgagcccacgcgcggaccgtccggcctcaggcgcggaccgtccggtcggtaagaaaccgaaaaacccgaaggtaacgggttcggagaaatgaattataggggcctcgcggaccgtccggggtgctcgaccggaccgtccgcgactggctctgtctgacatctgacgccgcattaaatgcaatatagccgttgatatagccgttactgctgaccgttgcattttcagccgttgatctacagggggcggaccgtccgcaccaggagggcggaccgtccgcgctcagcagaaaggcccaacggctaggaagtggttggtggctataaatacaaccccaaccacctccattcacttcatccaagcattccaaccttcaacattcaatacaagagctagcaatccattccaagacacattcaaagcctccatctctccaagtttcacaattgagaaaagagatcattagtgattagtggcttgagagagaaagtgatccgtgtgttatttgtcgctcttgtcgcttggctttttcaatcgtgctttcttgattctttcattgcgatcaaactcacttgtaattgaggcaagagacaccaaacttgtggtggtccttgtgggaactttgtgttccaagtgattaagaagagaaagctcactcggtccgagggaccgtttgagagagggaagggttgaaagagacccggcctttgtggcctcctcaacggggagtaggtttgcaagaaccgaacctcggtaaaacaaatccgcgtgtctcacttacttattcgcttgtgatttgttttgcgccctctctcgcggactcgtttatatttctaacgttaacccggcttgtagttgtgtttatatttgtaaatttcagtttcgccctattcacccccccccctctaggcgactttcagcccctaccgccgcccggggccgttgggaagctgtctgctcgatggcgcaccggacagtccggtgcacaccggacagtccagtgccccctgccacgtcatcactgccgttggattctgaccgttggagcttctgacttgtgggcccgcctgggtgtccggtgcacaccggacatgtactgttccttgtccgatgtgccagtatgggcacgcctgccatctgtgcgcgcagagcgcgcatttattgcgcggcagagagccgttggcgcggagatagtcgttgcaccggagtcgcaccggacagtccggtgcacaccggacagtccggtgaattatagtggacgggtcgttggcttttcccgaagctggcgagttcctgaggccgacctcccttggcgcaccggacactgtctggtgtacaccggacagtccggtgaattatagccgagtctcctctgggaattcccgaaggcggggagtttgagtttgagtcccctggtgcaccggacatgtccggtggcgcaccggacagtccggtgcgccagaccaggggtgcctccggttgcccctttgctcctttgttgaatccaaaacttggtctttttattggctgagtgtgaaccttttacacctgtataatctatacacttgggcaaactagttagtccaaagatttgtgttgggcaattca

SEQ ID NO: 766 - DNA, 651 bp, Zea mays
cccacgcgtaacctcactgcctctccctccctcactcagccaaacctgacatcagcctattacaagcgtcagtagagatcttccagatggccatggccaagcccccacttcagacggccgcgatcatccttttcgtgctcctcgcgaccgcgtcgtgcctccacaccgtcgacaccgccgctttagggttttgctggggcaagtgcagcgctcggtgcgcgcgggcaagcgcgcggcgggcgtgggccgcgtgcatgagctcatgcggcctctgctgcgaggagtgcaactgcgtgccgcgcgacatccatgactgcccctgctacagcaacatgttcaccaccggccccaagaagatgcccaagtgcccctgagactgagactgtgaggccggctcacactgcgacatccatgggactgcgactgctgcctacaactacgatgtgatccatgctggaccagacaaccagttatgcatgttatggatccggatacttatttggttttgttagattttttgttttctttgttcgcttgtgaataagtagaatgctgaatctactatgaatatttgtattttgtttttagcattaagctagttaagattaataaaaattaaatatcaaatttgttctatataaaaaaaaaaaa

SEQ ID NO: 767 - DNA, 2436 bp, Zea mays
  misc_feature (1)..(1): n is a, c, g, or t
ngacgcattacgcatgtatgtaaaaaccattttttttaccttttgacggttccattccaccgtcgccttgcgtaagcagcaaggtataatgatgctgctggataaaacttatctgccagaggcaaataacacgctataaacctccgacgcggagccagccagtagccagtcacctccttcaccgcgctcgcccttctttataacacacaaggtgtgtatacgtggccgtggggtggtgcagatgggattagccatttcgaagataatccaatgaagagcattctaaggggaagggatgcatgggatatttgtaacgcaccttgtacgtttatgtttttctgtatttctgtaggatgttggagaagctatttggtagctaactcgatctatttatttatgctgaaagttctaccagcatccaatccgtggctctgtgtgttggtacaaaacttggataaagagagtgaaatttaagaataactgttgcagatagtcttagcgggtcactacgggcagcactaacatgcagtgtatcacgcacccacaagaataggtacggctggctgctgcctcctcggcccataatggccgtgtcccttctcgacagacattaaggctatttttagcagatctcctatcacatttcctattttatctttacactataaacaatgttaaacagtggttaaacagtgttatctatagttttatgttctctgttttacactacccatctggaggcagtctaatagcgccatcatcctccacaggaatcagacaatcacggtggctaaccacgccacatgtggatcgctctctagaggattgctgacctcagtcgggtggagggccggtgtgtgtggcgatgagatcctcacttccagggtggatgagttggggtcgtctgtggggtggtgtggtgtggtacggtgagacgccatgaatataaaggagaccggacacgagcaagcggcacctcactccctctccctctctcctcagccaaagttgacagcagcctacaagcgccagcagagctcttcccggtggccatggccaagcccccgcttcagacagcaatgatcatcctgctcgtgctcctcgtggccgcgtcgtgcctccacaccgtcgacgccgttgctttagggttctcctggggcaagtgttgcgttcggtgcgcgaggacgaccacgcggcgggcacgggaggcgtgcatgagctcctgcggcctaaaatgcgagttttgcaaatgcgggcctgcgatgccgccgcgcgacatccatgactgcccctgctaccgcaacatgctcaccgccagccccaagaagaggcccaagtacccttgagactgagactgcgaggccggctcacacgacggcatccatgggactgcgactgctgcttgcaactgcgattcgatccatgctgggccatacaacctgttatgcatgttatggatccagatacttatttggtcgttagattttttgttgttatttcgttgttagatttttggttttctttgtttggttgtgaatatgtagaatgcaggatctactatgcatatttgtattttgtttttagcattgagctacttaagattttaaaaaataaatatcgaatttgtcctatatttttttaaatgatagaaataaaatccgaacattgattcatatttgaatgttttttcaccatttttgttgtacaaagcaaataatacataaaaattttaaacaactattcttattttaatatgtcgttagcaatataattgaaggttaatcctaaattatatgtatatctattttaaaatatttaaattgtatttggaaacatatcaaaaaagagtgctgaatcataggttaggaagactgaaggtggttgcaatgcgaactaacagagcaactatgaagaggatgcatgaattgcaaacttggatgggttgttgcatgtggttcacatggtgatggcttgatgggcctctatcttgctgtatgtatttgtcgaccttttcgtatgactatactaaaattactacaggccctaagagtatctctaacaataccttaaatcagtgttgtatctttaaaatagggctcaactcataataataggtgtatctttaaaaatagggctcaactcataaaaaatagctccaaacaatgttctattttatatttttcttataaagaatattggatagatcatgaagcgatccaaatatacacaccgaattagtatcatatccttgttttatacatcatttttaatatttttttctaacaatgtaatttattttctaaaatacatgattagcattaagcaattggagctcaaattatttttattgtactaaacactttaaatacaactttaaatgctcaaattaatagtgatactctaaatacaacttgaagtgttggaccagggctgcag

SEQ ID NO: 768 - DNA, 684 bp, Zea mays
gaacctcacttcctctccctccctcactcggccaaagctgactacagcctacaagcgaagcgctagaagagctcttcccgatagccatggccaagcccccgcttcaaacggctgcgatcatcctcctcgtactcctctcggccgcgtcgtgcctccacaccgtcgatgccgccactttagggttctgttggggcaagtgcagcgttcggtgcgcgggggcgaccgcgcggcaggcgcgagccgcgtgcatgagctcctgtggcctctgctgcgaggcatgcaactgcgtgccgcacgacatccatgactgcccctgctaccgcaacatgctcaccgccggccccaagaagaggcccaagtgcccctgagactgagactacgaggtcgactcacacggcggcatcaatgggactgcgactgctgcctgcaactgcgatccaatccatgctgggccagacaacctattatgttatggatccagatacttatatggttgttagatttttttgttattttgttgttagatttttggttttatttgtttggtagtgaataagtagaatgcaggatctactatgcatatttgtattttgtttttagcattgagctagttatgatttttttttcaaaaatatcaaatttgtgatcttaaaaaaaaaaaaaaaattgttgaagtctgattcc

SEQ ID NO: 769 - DNA, 1298 bp, Zea mays
tactcattcatttttgacatggagcctggttatcctgcaaatgacatggataggcctgttcctgttgcgatatttattgcgcggacgcgtggggttagaatggatcctcgaaacaaagaagttaatctcgatagtttaatgtatggtacaattggtggactaacagaacaagaactaaaaaaacaagaagcagaatacatttaccgttaccgttacaatggtggtggggcaactcaagtttggctaagttctggaagatttgttgtaatagatctttcagcgggcccttgtacatatgggaaaatagaaactgaagaaggcagtgtcagctataggtcaatgccacggctgtcacaaataatcttcccaagaggacttgctgccccaagtgctagttcaacgcaagatattttcattgggcagctcggaggtgcaattgcaactaccattgagcatgtgatagctcctgatataagatttgaaactgttgacatggcagtgaggttgcttgtacctattattgtgctacagaaccacaataggtacaacattcttcaagaaggccataactatagtatagatgttcaagctatagaaagggaggttaaaaagatggtccaccctggtcaggaggtaataataatttctggttcgcatgcgctgcaccagcatgaaaagttagctgttgcagtttccaaagcaacacgtagccattctcttcatgaaacaaagagtgatggccggtttcatgtccgtaccaaaacttacttggatggagcaatacttaaagaggaaatggagcggtctgctgatgtgctgtctgctggtctattagaagttgcaaatccttctctctcaagtagattcttcctaaagcagcattggactgatggagaagatgatgtaaaagactctattaagcacaggcccttgtgggaatcttacatgcccaaaaataataaaggaaggagaggaactggaaagaagaaacatggaagtctgtacagaacttatgggaccagagtgatcccagtttttgtattatcactggccggtgtcgatgctgaacttctcatggaagaggagagtcttgtttggacaagtaaagatgttgttattgtgcttgagcataacaatgaaaagattcctctaagctatgtgtcagaaacgactaggcagtttgctcttccatctatcgcacagcgccacatcttggctggtctggcatcagcagttggcggtctgagtgcaccatatgaaagagcatcacgtattcatgaaagacatgtagtgaactg

SEQ ID NO: 770 - DNA, 2186 bp, Zea mays
accggttttcacgcctccgaaggccgggcaggcaggctgcacccgcgaagacgcggagcctccactccccgtctcgcttcctcctctggatctagccgacgccgccctcaccctgtcacccaccgacgtcgccgtcgccgtcgccgtcgccacctatatcacccaccgcctctgaagaagaagacgcggatccgagggtagttaactgctgaggaagaagagccggtacggagaagacgcggagcagtacgtctccgatctggatgttggtaaggttcatcctgatttgaacggcaagctcactgataacgagttcctgggaggaggaagctagacgatttctgttagaggaggaagaagaggatgatgaactcttcttagtacttgtccctgctattctctcggccatgcaagaagagaaaaggtcagtccatactcctcttattggtgctgtgaagattaaggaagttttagaagggcatgaaatttggagcacagttgagtttagtatggtgtcggttattttcagagccatagtagcatctgctgttgaaccggtgcaacatgtaccaagagcgggcagcgagatcaatgttgctgggccaagtgtgggcagtgagactaatgttgatggactaatgttggatcaagaggcttgtgaagttcagtctccaccttctgttacgtcagtatatagaagtgggaaaaagcggaagaaaagtcaagttgcaagtgttctggatgactatttggagcacaagaagaagcaaacacagaagattatggaggtgttacttgagaagaagagtcgtgaagaggagtactctatcgagaggtgtctcgacacagttgatgttatggaggacttgacggatgaggagaaggcccttgcagcagaggtgttcaagaatgaattgaatcgggagatgtttgtgatgcaaaaaaatgtaaacgtgcgactgatttggcttcggaggaagataaggtacgtgtatatctatggccttccctgtctgaaaacagtggtaaactgtggaaaaaaaacttatgtatttacttgctttctaatttcagtaggattgcatctacctgagagatggacaatgtgccgactgatggttctgtgcaaacataggtatgcctcatttcagtaggtatggcttcgttacagctgttctgtattcttaataataactgacgggcatatgtgttggccttgtttaaccataccagatataccttgctctccatctatagtatttatctacttgatgttgtcgcctttgctctccaagtactatttgattctatgtaaaagacagttaatgacatctgttgtagctacataaggtctattatgtgcaacattaatatccattagcagaattatttgtctatgcatcactcctagcagtgtatttgagattagggaccgctataataaaattttgatagggccggagtttcgcgtgtcgttgcttctatttctatctgatcagatttggtcctgacgctggttttgaatagttatgccactatatgtatctacagataaggtgatcatagttatcagattttctgattagtctgcagatagataaatggtaggactggagttatcggcataaatggttactgttgatgattgtgtcaagaagttagctagaattgtccgtgagaaactaggacctaagaatgcaatcttcaccaaagcagcagataccatggatctcagaacgcatagcttggagtttgcttgtgtccaacagaacatcaataatcatttggaatatttgttttttcagttttatatttttccctgtggaactcatgaagctgaaatagaccgtgtgttgtcaggacagagtatttttggtgcacagatatttgttacagagtttttttttttgaaaatttcagatctttgctacagagctgttctgcgaccgcaatgtcaaacgattgcaggtagtacgtattgagccccaattggtcagcaggggtgccgtcaaccaaacggacacaggttacatgagtcccttggggcagcaccaccaccaccaccacacgggggacaatcatgcaggtattcccccaccggtggtggctggacctggatgacagccaaacgaggcctaaacgtaaatttcttgtgcattgtaatgcaactacaattattgaccata

SEQ ID NO: 771 - DNA, 1311 bp, Zea mays
tatctcatccgtggattggcacctcctgtatctcgagagactgaactgaacgtgctcttaccgtgtttgcagtgacgctgggctccggttcggaccggttttcacgcctccgaaggccgggcaggcaggcagcacccgcggagacgcggagcctccactcctcgtatcgcttcctcctctggatctagccgacgccgccctcatcctgtcacccaccgacgtcgccgtcgccgtcgccacctatatcacccaccgcctctgaagaagaagacgcggatccgagggtagttaactgctgaagaagaagatccggtacggagaagacgcggagcagtacttctccgatctggatgttggtaaggttcatcctgatttgaacggcaatctcactgataacgagttcctgggaggaggaagctagacaatttctgttagaggaggaagaagaggatgatgaactcttattagtacttgtccctgctattctctcggccatgcaagaagagaaaagagccatagtagcatctgctgttgaaccggtgcaacatgtaccaagagcgggcagcgagatcaatgttgctgggccaagtgtgggcagtgagactaatgttgatggactaatgttggatcaagaggcttgtgaagttcagtctccaccttctgttacgtcagtatatagaagtgggaaaaagcggaagaaaagtcaagttgcaagtgttctggatgactatttggagcacaagaagaagcaaacacagaagattatggaggtgttacttgagaagaagagtcgtgaagaggagtactctatcgagaggtgtctcgacacagttgatgttatggaggacttgacggatgaggagaaggcccttgcagcagaggtgttcaagaatgaattgaatcgggagatgtttgtgatgcaaaaaaatgtaaacgtgcgactgatttggcttcggaggaagataagtaggattgcatctacctgagagatggacaatgtgcggctgatggttctgtgcaaacataggtatgcctcatttcagtaggtatggctttgttacagctgttctgtattcttaataataactgacggcatatgtgttggccttgtttaaccataccagatataccttgctctccatctatagtatttatctacttgatgttgtcgcctttgctctccaagtactatttgattctatgtaaaagacagttaatgacatctgttgtagctacataaggtctattatgtgcaacattaatatccattagcagaattatttgtctatgcaaaaaaaaaaaaaaaaaaaa

SEQ ID NO: 772 - DNA, 1361 bp, Zea mays
cctcgaggccggccggggtcaaattcaaataactcggccgcaggcagcatccgcggagacgcggagcctccattccccgtctggcttcctcctctggatctagccgacgccgccctcaccctgtcacccaccgacgtcgccgtcgccacctatatcacccaccgcctctgaagaagaagacgcggatccgagggtagttaactgctgaagaagaagagccggtacggagaagacgcggagcagtacgtctccgatctggatgttggtaaggttcatcctgatttgaacggcaagctcactgataacgagttcctgggagggggaagctagacgatttctgttagaggaggaagaagaggatgatgaactcttcttagtacttgtccctgctattctctcggccatgcaagaagagaaaagagccatagtagcatctgctgttgaaccggtgcaacatgtaccaagagagggcagcgagatcaatgttgctggaccaagtgtgggcagcgagactaatgttgatggactaatgttggatcaagaggcttgtgaagttcagtcaccaccttctgttacgtcagtatatagaagagggaaaaagcagaagaaaagtcaagttgcaagtgttctggatgactatttggagcacaagaagaagcaaacacagaagattgtggaggtgttacttgagaagaagagtcgtgaagaggagtactctatcgagaggtgtctcgacacagttgatgctatggaggagttgacggatgaggagaaggcccttgcagcagaggtgttcaagaatgaattgaatcgggagatgtttgtgatgcaaaaaaatgtaaacgtgcgactgatttggcttcggaggaagataagtaggattgcatctacctgagagattgacaatgtgcgactgatggttctgtgcaaacataggtatgcctcatttcagtaggtatggctctgttacagctgttctgtattcttaggccctgtttggcacagctgctgcttgttgaaaaagcagcttatctaataagctggtgaaaagcagcttctgcttgttggctgcttttagtgtattctgagaagcagctgaactgataagctgctgcagaagctagctgtttggcagaacttctgcttaaatttgtaaagaagctgaaaataagctgtgccaaacagagccttaataataactgacggcatatgtgttggccttgttaaccataccagatataccttgctctccatctatagtatttatctacttaatgttgtcgcccttgctctccaagtactatttgattctatgtaaaagacagttaatgacatctattgtagcaaaaaaaaaaaaaaaa

SEQ ID NO: 773 - DNA, 5373 bp, Zea mays
  misc_feature (1504)..(1504): n is a, c, g, or t
  misc_feature (1544)..(1544): n is a, c, g, or t
  misc_feature (1702)..(1702): n is a, c, g, or t
  misc_feature (2029)..(2029): n is a, c, g, or t
  misc_feature (2478)..(2478): n is a, c, g, or t
  misc_feature (2504)..(2504): n is a, c, g, or t
  misc_feature (2769)..(2769): n is a, c, g, or t
  misc_feature (3581)..(3581): n is a, c, g, or t
  misc_feature (3800)..(3800): n is a, c, g, or t
  misc_feature (4593)..(4593): n is a, c, g, or t
  misc_feature (4676)..(4676): n is a, c, g, or t
cttgagttgctgctactggtatattagttgctgcatatacaaaagttccacttcattttcatttttgtgtttgaattagcgtttcttgtgtttgaattatatatctggatgtcgagctagtcatgataattatatatatctctatataatagataatgagttcctgggaggaggatgctagacaaatttcttttagaccagaaagaagatgaatcaactcttagtaattgtctctctgttctcgtggccatgcaagaagagaaaagggacgtccatacttcttctcttagtggtgctatgaagattaaggaagttatagaagggcatgaaatctagagcaaagtttagtttaggatggagccaaatattttcagagcgatagtagcttttcttagagctgaggatcttctacatgacacatgaggtgttactgttgaagaacagtttggcatgtttatgtacatgatctcgcataatgctactaatcaagatatgcaaaaatggtttcaacacagtggtgaaaccattcacaggaagataaatgaagtctttgatataattccagccttgacaagtaggtttgtaaagctttcaagttcagtacagactcacatcaaaattgtaaccgactcccgtttcatgccttttttccaggtagacataaaacccaagaatttctaattccttcttaggtttttatgcctctaattgtctctttcctaacatgcagaattgcattggtgccatagacggtactcatattcctatcactatctcagaagacaaggctgctccatacagaaataggaaaagggtctttatcccataaatgttatggtagcttgcgattttaatctaaactttacctttcatttcgtgtggatgggaaggatccgcatcagatgctggggttcttcgttcagcacttggcagaggattccatgtgccagaaggaaagttttatcttgtcgatggtggatatgcaaatacaccatcattcattgccccttatcgaggagttcggtaccacttaagcgagtttaggagtcgacgttcctatgccaactacaaagagctctttaaccatcgccacgcaatccttcggaaccatatagagagggctataggtgtcttgaagaagaggtttcctattctaaaagtcggaactttctatcctattcagtctcaggttaagattccagcggcagcagctgtctttcataatgtcattaaacaacataatggccaggaagggtggctagatcacctcccaggcaacattgaaccgtctcaatatgtcgatgtcccagagggagaagtcaactaccctaccggctcagagtctgttgatggaaacattttaagggatgacattgcgatgcagatgtgggttgcacacaatgtttagttgatgtgatagcacttgtatcgttatttatgtacttgatgcacctaatatttgtatcttatttaagtacttcttgcacacaatttaatttttatntgtaatttaaaatagtaatggcagatgaagcatctagggngaattggaacttcttatatgagaagggtttaattgaagtattaactgagcacaaggttgataccagatttaagggacagaatggttggaactcagatggttggagaagcatcacttgtaagttcaatgagaaattcccctcagcacatttcacaaagnaacaacttcaagacaaggagaaagatttgaaagcaagctacaaggccataagcaacgcaaagaaagagagtggtataggatggaatgagactatggggatgatattagctgaaccagatttgtgggagaagtgtgcacgtgtaagttattctctctcttttgataaagtagtatcattccaaaacatgccttcgtactaaatatatgttgtattcaacagaaattccccaaattaaagaagcatcgcaagaatgggtttcctctgtttaggagctgtgaggccttgtatgaaggtagtcatatatctttctgacttctactaaacanatatgagtttttatgaagaaacactttgactccctcgcggccggcattgctagaggtgacatgagtttcacttctactgaaccggtgctacatgtagcatctgttgatgaaccagtgctacatgtaccacgagcgggcagcgagatcaatgttgctggaccaagtgtgggcagtgagactaatgttgctggactaacgttggatcgagaggcttgtgaagttcagtcaccaccttctggtacgtcagtacatggaagcgggaaaaagaggaagaaaagtcaagttgcaagtgttttggatgactatttggagcacaagatgaaccaaacagataagactgtggaggcgttccttgagaagaagactcgtggagaggagtctatggataggtgtatccacatatttgaagctatggaggacttgacagatgaggagaaggccattgcagnagaggtgttcgaaaatgaattgtatngggagatgtttctgaagctaacaattcacaacgtgcggctgatttggcttcggagaaagataaggtatgtgtatatatatgcccttcctccctctctgaaaacaattgtaaattctaaagaaacttgtgtatttacttcctttctaatttcagtaggattacatctacctgatagatggagaaggtgtgacggatggcttctgcaatatggtctctgcaatgttttttccaacaagatctcttcagttattttttgattcatggnaatattgtactaaacttgaaaaatgatacatttaatctattttgatcagtgaagttcttgttctaacactgatagtatgagttaacttgtctccagaattgtggttgttaaaactagtagtggtaaataagccagactttatgttgttgttctaaacatatttgtatcacaaatagaacaattttattccttgcacaaatagaacatttttgtatcacaattagctcaattgtgcttcatgctaaggaaagttctaagtttgttgtttttattccttgcagaaaatcgaggtttgccacaggagcatcagtcagaggcgcttcatgctattctgaattttcaagttctctagaatttttactggaaccataatttgtatggagttaagaactgttctgcttgttccatcaatatgtatgcaggttctaatacatattgtggatctgatacatatgtacacactctcataattcactggttcataaaaatttagaatacatatgtgtttaaacgtccagctctactttctttttattactgagtctgttattctatttatatgttcatttatacatttgaagacatgtgttaaaagggtcactggacagcctgacaaccaaacgatcacagggcgctcaaaccccaccgggcagcaccagacagggaaggagtatagcaggttttgcccccatcggtggtatccaaccggggtggctattacctctgttgccaaacgaagccttattctcctgcgaggccaactcgaagatacatccctcctcaaaactgttcttgattaatttagtttgacnacatgcccgaacatcaatttctctagtgtgttggtccctatgcagaagagaaggattcccttagagctacctctgcccctatccaacagaaagctccggttacacatgttctctccctagatagcaaaaactgacaagatacgggtggcggtcaccaatcagattgctaagagaatgaaccacactctaactaagttggtcaatgccatgttcaagacngtgagagtatctaagaaacggtgggatgagacgattatgacaatatgttatatcttgaataaagtgttcataaagaacaaagaaactacactattcaaggaatgagagaagaagatattaaatctctcttacgtgcgaacatgaagttgtttggccaaagtgaatgttccaatcaacaaaaatcaaaagtttggatcaaaaactattgattgtatgtttcttgggtatgcttttaatgacgtgagttatatatatttcagtaataaattttggagcacctggtggtacaattatggagtctagaggtgctacatttttagtaaattttcctatgagaaatacacctatacttctagtcacgaaacatttatacctgagatgcatgaatcggtatattgaagcctatgtgaaaaaaattcataaaccgataatattatattgactcaaaagagtaagagacaaaaaaactagtctttttaatgaagacaaaaaaagctctttagtcagttagaagaggcagatgcactaaccctagaaggacctgcccctggttgaaccccgcagcatcgagcccggggctgtggatggcagagcctaacaaggaaggacgggcatgtcggaagggaaccacttgagttatatggatgatatattaatctttggtaataatgttaatgtggttaatttttgtctagtaaccttgaaatgaaagatttggaaaaaggctgatgctattcttaacataaagatatcgagagaaggagaaaatagtggggttactcttgtgcaatcntattatgtagaaaaagtgttgagtcgctttgaatatagtggataaacacatgctctaactccttatgactcaagtgtgttgtngaggaaaaatcacaaaatcgcataggatcagttgagatactttcaaaccattggctctctcgtatatttggctagtgcaataaggtctgacatctcatttgttgcgaacaaactaagcctatttgtttttaaccaggggatgatcatcggcttgctcttgagagggtattgcatatctaaaatggactatcagttgtggcatctactataccaaattaccaattacgtgacggtagtagtggaggtttattgtgatgtaaaatagatatataatgctgataaaatatacaccacaactggatatgtgttcacacttgaaggtggcactgtttaatagaagtcttgcaatcataccattttaataagggcagccatgaaagcagaactcacgatatttgatatcaccatagttgaagttgagtggtttcgtgaactccttacgaatttccgttagttaataaagcagtaccaaccatctccatgaaatatgataatcagacaataataatcaatgtgaacattctaataatgacatgaagtctatatggcattgaagacaactgaaatctgtttaagaaactctagagtacttgtgttggactatatatgcctatacatctttaatcttatgggattatgggcttagcctatataaatatttaataattttaaaagtttctattaaataatattttga

SEQ ID NO: 774 - DNA, 1813 bp, Zea mays
cactcctatagggcgattgggaatttccggccgggacagcagctccgaagccacaccacagttatttattactgttttttcgttgcctccaatccaatagagttgaccgaaccacgcgccgcccgctgacatggacgacgtagtaccagcgacagcgaagcagaccgtcgttctgtaccccggcggcggcgccgggcacgtcgcgccgatgacgcagctcgccaaggtcttcgtccgccacggctacgacgtcaccatggtgctcctggagccgcccatcaagtcgaacgcctccggcgccagcttcgtcgagagcttcgccgcctccaacccgtccatcaccttccacctcctcccgccgatccctccccccgacctcgccagctccaccaagcaccctttcctcgtcgtgctggagttgctgggccagtacaacgacaagctcgagagcttcctccgcaccatcccgcgcgagcgcctgcactcccttgtcatcgacatgttctgcaccgacgccatcgacgtggccgcgaaggtgggcgtccccgtctacacgttcttcgcggcgaacgccggagccctggccgtcttaacacagacggtggcgctgcttgacggccggcaaacgggcctcaaggagctcggggacacgcccatcgagttccttggcgtgccgccgatcccggcgtcgcacatcatcagggagatgctcgaggacgcggaggacgaggtgcgcacggcaatggcgaagatctggaagcgcgacacggacacccggggcgtcctcatcaacaccttctactcgctggaggcccaggccctgcaggcgttcagggacccgctgtgcgtccctggcaaagtgttgcctcctgtttaccccatcgggccgttggttggcaagggcgggagcgggacggacggaggagaggcggcggagaggccgcatgagtgcctcgcctggctcgacgcgcagccggagcgcagcgtcgtgttcctctgctgggggagcaggggcttgctgtcagaggagcagcttaaggagatagccgctggcctagagaagtccgggcaacggttcctgtgggtggtgcgcacgccggccagcagcgacgacccgaaacgattctggctgccacgcccggagccggaccttgacgcccttctgccggaggggttcttggagcggaccaaggaccgcggcctcgtcatcaagtcgtgggcgccgcaggtggacgtgctcagcaaccccgctgttggcgcgtttgtcacccactgcgggtggaactcgtcgcttgaggccatcacagcgggtgtgccgatgctgtgctggccacagggcgcagagcagaagatcaacaaggtacttatgaccgaggccatgggcatcgggctggagctggaggggtacaacacaggtttcatcaaggctgaggagatagagacgaaggtgaggcttgtgctggagtccgaggaggggagggagattaggacacgggcggcagaggtgaagaaagaagcacacgcggcgttggaggacgggggatcatcgaaggcagcatttctccaattcttgtcagatgtcaagaatattaattaggtcgggaagtgatcaatctttaaccgcccgatacaacgtaacacaaactattcaataaaatattagtatacatattgcttaggaaaaaaaaatcccataaacaagtaataaagaaaacatgtgtgtagcaacaaaaaaaaaaaaaaaaaagaacaatcctacattaaaaacctttaaaaaaaaaaaaaaaaaaaaaaaaaaaaaactcgaagaggg

SEQ ID NO: 775 - DNA, 1330 bp, Zea mays
tatattgttgatgatgtcataattgttttgtctctagaacttgcatataagcccattgatgtaagaagagtgcaacttgcatataacctttttgatgaggtaactcttttcttatgcaactctgttgaaccaatgtgtttgactgcatggctgtgtgtaatacaacaaataccagtagagtagtgtcatgtatgcatctatggatatattatacattttttgtagaaaaactataattttaatcgagtgagaacatagtaccatgcttttattgttctcctgctcttacctgacattatgttacacaatagtacaaataactttcttttggggcagtgtagccacagatgcctttatccccttccataccgatttttttgttgaattcaggttctttatgatgttctaatctacaaatgtgttagaagacggccggatcttgtgtgactggcaagatttaccatttaaaaaccatgcccccggagaatgaggagaattctatccgacttattacacgttctgatgccacatttgagaaggttctgttaatatccacccagtaacttttttgttttgtttcctgtcatctaaagatcaaagatcctaagaaacaatttctggtttatgggtctagcagagccagaactgagcacctacaactcttttaagttaagcaacacaagttgaattcatgggagcatgtggtttgttaccaagatccgctgtatatacatatgacttatcaatgattttcaggttgttgtaactatccagtatcgtacaactgacctgttacctagggggaaacactgcatgagtgttgttggtatccttgtctggtgagcgaaaatctctcttatcttttgtttctcttcgtttgattcagtccagtcatttccttaaattatttatagatatgaggcggagcgagcgattcttgcaggaggagagagtgattctcctagaggtggaggaggatgaagtggtgatagacttcaagccaactccaagtgtcgtgtcgacctctgcctccgctccctgcacacatccctcccagtcgtcttcaaggtccagacctcctccccgctcaagttcctcatcagcacgttgtgcggtgtcatgtcgccgctttccttagtgtccatacacgtcgtgcgaggcgtcccgcttcatctctaatcacctttatgtgcacatcgtccatatgtgacccccttctccatataatttcaacaaattttactcttttgggctccgtgtaatttcattagtaaaatctctactaattattaatgctgcaaagttaacctgtcaaaaaaaaaaaaaaaaa

SEQ ID NO: 776 - DNA, 1687 bp, Zea mays
  misc_feature (11)..(11): n is a, c, g, or t
  misc_feature (1606)..(1606): n is a, c, g, or t
  misc_feature (1653)..(1653): n is a, c, g, or t
  misc_feature (1671)..(1671): n is a, c, g, or t
gggtcgcccanctccgttagtcagattttcacagagtcatttacagaacaacgcattgcaccagcaaaccagagctgactccacagcagcagcagcagcttatgctgcaggctcagcaaaattgtcttcaccaacatctagtgacgtcgacaacagaagactgacgcggggcctaaatagaaatgctgttcttggccgggatggacagacaaatagtggtagtgatattattccgaatattggctctcctagtcaaagtggtgcagatatagatatgcttataaagtagaagaaacttgctcagcagcagcaactattacaacagcaaagcaatagccaacagctcccacagcaacatcagcttcagcaacctgctgtctctagccagcaatctcaaagttcaaatcaacatcttcaacaagaaaaactaggaattggaagtatgcctgttgatgggggcataccaaactcatttgggggagctgaacagacagcgaaaaagagaaagaagccaggctcatcctctggtagagccaatagttcaggcacagccaatactgctggtccctctccaagttctgcaccctcgacaccttccactcatacaccaggagatgcaatgtctgtgccacagctgcagcagaatggcggttcagctaaacccatggtaatgtttggctctgatggaactgggagcttgacatctccagcaaacccattggatgatgtggaccgtttgctggaagatggctcattggatgataatgttgaatcttttctatcacaggatgacatggatcctagggacaacttggggcgatgcatggatgctagtaaaggttttggtttttctgaggttgccaaagcacgtgcaagtgcagccaaagttgtctgttgccacttctcagctgatggtaagctgcttgctactggtggtcatgataaaaaggttactttgtggtgtacagattctctgaagcctaaatccttcctggaagagcactcgtttcttatcactgatgttagatttagcccaagcatgtcgcgccttgcaacatcctccttcgacaaaactgtgcgggtttgggatgcagataacactgactattcactccgaactttcacgggccattcagcatctgtcatgtcacttgattttcatccaaacaaagaggatatgatatgctcctgtgatggtgatggggaagtgcgcagctggagcataaataatggtagctgtttgacatgtgttaaggtgtttaaggcaggtgctactcagatgagatttcaacctcgtaagggaaagtatctagcagctgcctcagagaaagcaatctacatacttgatggggagacacaacatgcttgtagaagccccttgcaggggcacaataagaatattcaatcgctttgttgggactctgctggtgaatatctggcttctgtcagtgaagactcggtcagaatatggtcattcagttctggacgtgatggtgaatttgtgcacgaattgaatcgcagcggaaatcaattccactcgtgtgttttccacccaacttatcagtcattactagtgattggttgttacgagtctttggaactttgngacataagggagaagaacaccatgacccttcacaatgcgcatgacgntttgggttgcagccctgncatcatccagtgctac

SEQ ID NO: 777 - DNA, 1455 bp, Zea mays
tggaaaatgaagtgtgcgctattctaaaatcggaagagcagaggaaagattctgaatttgaagtcaaggatgtcaagtatgtacctgctgaggtcaagcttgtgaaggtaccatattctaaaatcgtagatctttatggtggcaggtcaagcttgtgaagtgcaaggtgcaaaacattgctgtagacatctcagttaatcagattggtggacccaataaagtttattttctagagaaggttgatcaaaacttggggaaaaataacttgttgaggagaagcataatgcttatcaaacattggtgttattatgaaagctgcattcttggtgctcaacgtggtttggtttccacttatgctttggagacattagtgctgtacattttccatgtcttccacaagtctctggatggtccattggctgtttcttgactactatagcaaatttgattgggataacaaggggatcagcttgtttggtcctatttcactatcttcactacccgagctagtcagtaaattcggctcgaggaactgttgattgtgctgtatgttggtgttctgtctgcggttgaaactattggtcattggcatggcttttcttgaacagccgagccaccatatactcgtgatgatggttttctctcacgggaggcgtttctcaaagactgtgctaaggcttttagtgtccccccaataaactctgaggaaaatccgcaagtattctccaaaaagtttgtgaatatagttgacccattgaagcagagtaacaatcttggacgcagtatcagcaaaggaaaccttggccggatacgcaaggaattctattttggtgcttgcaagctcggcaagattcttcaggcgcccgcgtgtttctctgccaacgaaatcaaccggtttttcaggaacacattaagcagggcagatgttccggtgagctctcctgatgatgttctacaggccgctagtgtttctgcgtcaccgggcaacaagggcgtggaaggagtcagcaagggcagttcacccaacaactcgtgtgacgttctgtgcaatcagttcggttacattaaaatctcagattccaacaatgcgctgcagaatctggtcgtggacaggcccgcttaggctgtacctgcacatggtcatagaacctccagcagcttactcatcttactttctaccatactttttttaaaacttccacattataaagaatacagtctatggtataaaataatgttttacggctgtgtgcacggaccgctgatcatagcctaagtcgttgtcgttggtggccacaacaactgtgaatcgtaacctgttacaacgtctttcttagaccgtcttcaacagctgttctatcgtatcctctatatcatttaacattttaaacttcactatataaacgatgtaatcttttgtacaaattctctattttagatgatctactactgcgg

SEQ ID NO: 778 - DNA, 3153 bp, Zea mays
gaggtcatccttatctcatcgcgatcgaagtcgtgcccctacaaggcaatgagccggcccttttccccgcccctaccccccgcaaggcgagcgcacacgcgtgtggcactttatcctctatctcctcaaccataacttgataggagaggaaaacctccacatataaaactagtctcactctacttatgagagaaagagggcactagaaggtaattgaatttcttaattaagtttggcccataaatccaacaacaagtagagttatgggaacatgatgcctcgtagcccttacggcaacagtacttttgaatttataatcggagctgtgccaggtctttacaagccctagaacatggcgtggctgtgcctgtgcctgtgcaggttcatctagtggagtggctgaaaatgatggttggcactagaaggtagtgagtggatcttgacatggccagccaacgaatccaaggcaaacgatccctatgagaaaaagaggggcacaacagatcaccatcaatccatcatgtccaagttcagttcagttcagtgcatttcgtctcgtctcgtcctgcgtttccccgtgggcctcattcttttattggtgggccggccacttggggttggagatccactcggccactctgatcccggaaatatctttcaccgtctcgtctcgtctcctctcctctcctctcctctcgccccgcctcgtcatgtcacgtctcccaaagtcccatctcgccttcgcttaaacataaaccacacccatcgcacccagccagccctcgccatccatggccaccaccgccgccatccacctgcgcccgctccgttccgtcgccgtctcctccgcgaggtcacgctcgctcctccacctcctcgcccggcccctctcctcttcccaatcgtcctacgcctaccgcccttcccctacagcgcccgccgccgccgcccccaaccatgtccaccaccctccccatcaccaccagtcggtgcctcccccaggaccccctccacagtggtccgcgcagggacatccgcctccgccgccccgtggctatgggcctccaccgccgcagcaccagcatgtgccgcctccgccaccacgcggctacggacctccaccaccgcctccacacggccacgtacctccgccgcctccgccgcgacacggccacgggcctccaccaccgggccagcacgtactgccgcccctgctaccacacggccacggacctccgccaccgggccagcacatgccaccgccacacggccacgggcctccaccaccgggccagcgcgtaccgccgcctccgccgccacacggccacggtcctccgccaccgggccagcacctaccgccgcctccaccaccacacggccacggtcctccacccccgcaccagcaggcaccgccgccgcctgatcctgtggcggggcctggggagctgatgggactgtgccgggaggggcgggtaaaggatgccgtggagcttctctccaagggtgcgcgcaccgacctggacaccttctacgagctcgcggccacctgctccaaccctaagctgctggaggagctcaggaaggtgcacgacttcttcctccgctcgcccttccgcggcgacctccgggtcaacaacatgctgctcgcgatgtatgccaagtgcgcagccatgccacatgcccgcaggacgtttgacaatatgcctgaccgcgacatggactcgtggcacatcatgatcgacggctactctgtcaatggacttggggacgaggcgctgcgtctgttcgagctgatgaaggagtgtatggcacccacaagtcagacctacctgcttgtgctcaatgcctgtgccaactcagaggccatcgaggaggcgctcctttactttgatgccatgtccagggaccatggcattgagcctggtgtggagcactatgttgggatcattgaggtcttggggaagtcagggcatctcaacgaggctctggagttcattgagaagctgcctttcgagcccaatgccatggtgtgggagtcactcttgaacctggcccggatgaatggagacattgaccttgaggaccgggcagaggagttgttggtgtcgcttgatccatccaaggcaaatcctaagaagctcccaaccccacctcccaagaggcgcctgggaattaacatgcttgatgggaggaacaagctagtagagtacaggctgccaccaaagattgaaaagaaggtggtcaatgagcagaggtatgtcccagacacaagatatgtgctccatgacattgaccaggaggccaaggaacaggcattgctgtaccacagtgagaggctggcaattgcttatggtctgattagcactccagcaagaactccacttcgtatcattaagaacctgaggatatgtggtgactgccacaacgccatcaagatcatgtcaaggatcgttgggagagagcttattgtgagggacaacaagaggttccaccacttcaaagatggaaagtgctcctgtggagattattggtgataatggattaaagccgctcttctatcctttatatggagctgctggcagccatggtttcagttgataataagcaatatgaaggtatccaatgggtgttgctagtattttgtcatccttaaatattcttaagatacttagctgcaagcacttgtatcatgcaaggctatcacttgttgatgcgctaattgatcctactctcctctgtatcaacatcttgtttcccatgggaaaacatgtgctggtctggagtatataacaactatacggttgtaagagctgggtcttccttgcattactttgactaaaacgaatcttatatatctgtgcgcatgtatttattttcttggtctattatgtgcaggctatgttggatatactaccggccaatttttaattagcattgaacaatttattgggataagaaccgaggcattagttttcagggtttcacctttagccctttcttttccttccctatctgggggcttgttcggttagctctcaattcatgtggattgagtgagattgggtgggtttaaatcctaagtaagttaaaaaaattcttaatttttttcaattccattcaatacatgggtaacgggattaatcgaacaaggcc

SEQ ID NO: 779 - DNA, 1601 bp, Zea mays
agctcggaacccggctcgttgagctgttcagatgactggagttcacattcatcttctgctggcaacccagacataccgtatgtggttgtctccaagtcatcaattgtgactgctgtatgcaaggagattcttggctgctacaggaagttacttggcattcctgatctgttgaatcaaccaaacatgtcaattctgaagcaacttttgcagactttacagccaactgaaaattttgatgatgttctttccgagttccaaccatctcttgctccttgcaatgttgattacctgtattgtggagcatgtaaaatgttggaggatattatggattcagtgtcctcattttcataccttctgtcttctgatgtgttaattactatacaatcaatcgtaaattctgttgttgtgttgttggacaaatctggggaaccaaatggaaaaaatatacacatgggatgctccaaagcaatcattccctttctgcgaaagcgtcttggatactcagctcataagctgctcacgtgctgatgtccctagcgaagatgctggaaaaggatggcagactaaaggtgatcttatacagaagatattgcaaatatatctcaggaatagttactctacttcagatctacttgctgagataggtcgtgaattgcctaaggaaccttcgctcaaaacaaaagataaccaagatgtatcgtatggttttccaacattgtgttcctccactattacctcttggtaccgtgtgcttcacgaggagaacacagggagtttaaacaagacgatcaaacaagcactgaaggctagaggatcagttgatactattcttcaagagattcagaaatcagtggatgcatttgtctctctaataggaatgtgcaagtcccacgaaaaggtttctatgcatgcaatggcagttaaacatggggggaaatttattgacacatttctgaaagccttcaactttctagagagacatttcgagcaacataatgacaccatagttaaaatgctaaaacaactccagaaaggaacaagaataatccaatccatatgctcagatgctaagggtaacaagctgacaatgatcgcaagcaaagtacctcctgcaaagagatccatggagcggttcttgttccaggtcaaggcgctgctacacagctgctccgccgagaaggaattccagatgggcaatttgaagcacaaggacttgcaaggccatgtggtgagctctcaggcgtatggaaacgtggatgaggaagatgaggagcagacggagatcgactccgaccttccagctgatgagcatgataatggcaatgccatggaggaggatgctgtggaaggtagcaacgagacgccgatggaggaggaagaggaatagtggcataggtaccaatctgtacatctctttctctctaagccggccaaaaatctgtccccaaaattaacagttttgtgtgtgcatttagtgtagaaaaaaagataggatccccatcagaatctaggttgcaacgtcacttgtaaatatggatgtctgaacaagtagtttatatattgctagcagtggtcgtttcacacccaaaaaaaaaaaaaaa

SEQ ID NO: 780 - DNA, 2685 bp, Zea mays
  misc_feature (2134)..(2134): n is a, c, g, or t
gaaagggaattggagtcttcggcgaagacaaggcttccactccactccatcgaattattcatccttcgtagtcgctccacaccgctctccaatttggtataatcttcactcgtatattatttaccaagggggagaaagtagtaaacagggcttatatttcactcacaagtatccgtttttggcgattcatgccaaagggggagaaagtattagcccaaagcaaaaggaccgcaccaccaccaatttcaaaaatttagtctttccatttgtatttaaagaagtgttttcaaattggtatcttatttttgattcaatttcaaattagtatgacccatttcaaaaataatatctaaaaccctcttgaacactaagacgatgattttattgagggggagttttgtttagtcaaaggaaaagcatttcaaacagggggagaaaatttcaaatcttgaaaatgcttctcaaaatgttattcatttacctttgactatttgcaaaaagactttgaaaagaatttacaaaagaatttgcaaaaaaacaaaacaagtggtgcaagcgtggtccaaaattttaaatatgaagaaagcatccatgcatatcttatgaaatgtatattggtttaattctaagtaacctttgcacttacattatgcaaactagttcgattatgcacttatatatttgctttggtttgtgttggcatcaatcaccaaaaagggggagattgaaagggaaataggcttacaccttttcctaattgattttggtggttgaattgcccaacacaaataattggactaactagtttgctctagattataagttttacaggtgccaaaggttcataataagtcaataaaaggaccaaagatgggttcaaataaagagagctaaagacatcccaatggcaccctggtctggcgcaccggactgtccggtgcaccagggaacttgacgctgaactcgctaccttcgggaaaatgggaggccactccgctataattcaccggactgtccggtgaagcaccggatagtgtccggtgtcacaccggactgtccggtgtcacaccggactgtccggtgtgccagcggagcaacggctacttcgtgccaacggttgactgcaaccgcattgaatgcactacagtgcgcgccagagtcagagcacgcgcagaaggggcaccggacagcccagaggccccaccagttagagctccaacggtcagaacccatcggccggctgacgtggctggcgcaccgaacagtgtccggtggcgcaccggactgtccggtgcgccatgcgacagacagcctcccaacgaccacttttggtggttggggctataaataccctcaccacccaccattcatggcatccaagttttccaacttcctacaccttacaagagctatagcattcaatacaagacacaccaaagagatcaaatcctctcccaagtccatagatcattcccaatcaaatagtgactagtgagagagtgacttgtgttcatttgagctcttgcgcttggattgcttctttttcttcattctttcttgtgatcaactcaattgtaaccgagccaagagacaccaattgtgtggtggtccttgcggggactttgtgtcccgtttgattgagaagagaagctcactcggtctaagtgaccgtttgagagagggaaagggttgaaagagacccggtctttgtgaccacctcaacggggagtaggtttgcaagaaccgaacctcggtaaaacaaatccttgtgtctcactctttatttgcttgcgatttgtttctcgccctctctctcggactcgttcatacttctaacgctaacccggcttgtagttgtgcttaagtttataaatttcagattcgccctattcacccccctctaggcgactttcaggctccactgaaatataacttaaagcaccggaagaaacaacttctatgttcagcttgcacaactcatcacatagggtggtgatttttgcatccatattcatacagttgcactgggctttcctgcttaaggtatctgccacaaaattggctttgccaggatggtaatgcacctccaaatcatagtccttgattaattctaaccatcttctctgcctcatantaagatcagcctgagtgaagatatatttgagactcttatgatcagtgtaaatattacaatgagctcccatcaagtaatgtctccaaattttgagagcatgaaccacggctgctaactccagatcatgtgtggggtagttttgctcatggggtctgagtgctcaggaggcataagcaatgactctgttgtcttgcatcatgacacatcccaatccagtaccagaagtgtgacaccccagtgtcacttagggttcttccttaagctagccccaacccatgatcacatgcaatctcaataaaagggtgaacattgaaaatgagaacaaagaattaagttgaagtctacttaaaattttcatgaattcaaaaaaggggaaaaactcttaaaccctagttaaccctaagtgaaccatttatgcataaagggtaaatgggagaaacccttgggagaaaaatacaattttggagaaaaccaaattataaagttttagttcactgattaactaacaaaacatagtaaggaagttttgccttttgaactttttaaaatcc

SEQ ID NO: 781 - DNA, 2654 bp, Zea mays
gctacaaaatcgcagtggatccatggctaaaactagatcagtctagagatggaaaatgtgacagctaaaaccttaagccaaaaacaaatggcaaccaagcaatactaaactaaacagcctacccctatatttatagagggttattttcatttcctaaactagccctatttacatagagcctatccattccactaagggtgaaatggatcaactcctaagtttttgatccgacaaccacacccttcacacggagttgcttcgccttgatgcaccctccacgatcacgccacgtgccgccatcggttcccttcggaaccgccaccattgagttttgaggccaaactcagcaaaatctggcatctgtagctgaaagggaaataggcctacaccttttcctaattgattttggtggttgaattgtccagcacaaataattggactaactagtttgctctagggtatgagttctacaggtgccaaaggttcacaacaaaccaataaaaagaccaagaaagggttcaaataaaaagagcaaaagactactgaagtgtgccctggtctagcgcaccggactgtccggtgcaccaccggacagtgtccggtgcactagggaacccgactctgaacttgccaccttcgggaattctgggagccactccgctataattcaccggactgtccggtgttccagcggagtaacggctacacaacgccaacggtcgtctgcaacgagcaggtaatgcgctacagtgcgcgcagaagtcagagcagagccagaaggcgcaccggacagtgaacagtgattgtccggtgcaccaccagactgtccggtggcccagctgtcagaagctccaacggtcagaacccaatggctgggtgatgtggctggtgcaccggacagtgcccggtggcgcaccggactgtccggtgcaccatgcgacagcagcctccaccaacggctcctttggtggtttgggctgtaaatacccccaaccacccaccattcattgcatccaagttttcagccttcaaacctcatacaagagctatagcattcattacaagacacaaccaaagagatcaaatcctctcccaagtccggaatcactccaaccaaattagtgactagagagagagacatttgtgttcatttgagctcttgcgcttggattgcttttcttcttccttcttttcttgtgttcaactcacttgtaatcaaaacaagagacaccaagttgtggtggtccttgtagtggacttagtgtcccatttgattgaagagaaaggctcactcggtctaagtgaccgtttgagagagggaaagggttgaaagagacccggtctttgtgaccacctcaacggggagtaggtttgcaagaaccgaacctcggtaaaacaaatcaccgtgtcatccgctcttattcgcttgtgatttgttttcgccctctctttcggactcgcttttatttctaacgctaaccccggcttgtagtgtgtgcttaagtttgtaaatttcagatttgcctattcacccccctctaggcgactttcagttgtatattctattcacaagctcattgagagtgtcgatgagtgcatggtgctccacaatgacacgctcaagcttgccacaccaacttttggtgatctcaaccaccttatctctgcaacaatgaatggtgtggtgtgttgccttcgtttatctggtcagcagaattcttattttcagcagcctacaattaacctgattcccttcccatatctccatttcttcatggtgggattcacttcactgacctcatggggctcccagcagtaccgtgccctcattatgcccgagctgacccagcagatgtgggactccaagaacattgtgtgtgctgctgactctcatcatgatccctatctcacaacgtttgctatgttccgtggaaggatgagcaccaaggaagtggatgggaaaatgttgaaagtgtagaacaagaactcttcatatatcgtggagtggatccccaacaatgtgaagtcacgtgtgtgaaagggaaatgtacccttgggccttttctattctgttttggtgattaaatgctcaacacattgtgttcggactaacatcatcttgtatgagcaatgagtacatgtagttaaagaaaattgagaaaaaaaggcacttttaggcttggaagtgggcataccacaaatctatatggtaccaagtgaaaaaagtaagctccaaacacttactcaattgttttgggtactaatcatatttgtctaagtgctagagactatatgaagtcaagtcaaaaagagcgaaagagaataggaatgaaaaagagcaagttggactggtctgtgtagcaccagacggtctggtgccacccattggacagtttggtgcacggtctgccgaacaggccactctcgggaaaatcaagactttgttggctataaatcaccggttagtccatgcagagtgcctgacagtccggtgtgtcagccgaccaacggatagttgacacgtcggccagagccaacggtcaactggttcaccaaacagtccgtgccacccaccggatggtccagtgccccctagaagcgaaaaacaaccaatcaaaatatatgtagtcgttgcactatgcagtgtccggtgc

SEQ ID NO: 782 - DNA, 2059 bp, Zea mays
cctcgcgcctgccgggatttgggaccccgaggcggccgggaaactgactgattgtctgattgtgattgcggcagcaccgccgaccacgagcccgccgaaaggctcctccgcctgccgttccagggtgcactgccgccattgctcatctccccgtggtgcggaggtccacccgggcgccaattggtctcctctttcgttggcagactgagtggcatccaatcctgaatcaatgaggggctggggtttgctcgtgttatcgctacatgttctttcatgcctggttagtggcgttgcttctggtcgaacaagctcttatgtgcgcacagagttcccatctacagatatacctctagaaagtgaatggtttgctattccaaagggatacaatgctccacagcaggttcatatcactcaaggtgattatgatggaaaggcagttatagtatcttgggttactccagaagaacctgggccaagtgaagtattttatggcaaggagaagctatatgaccagaaagcagaaggaacaacaacaaactatacgttttacgattacaaatctggatacatacaccattgccttgtcgatggccttgagtataacactaaatattattacaagattggaagcggaaattcagctcgagaattctggtttcaaacgcctccagcaattgatccagatgcatcatacacatttggcatcataggtgatctggggcaaacatttaattctctctcaactcttcaacattatgagaaaactggaggtcaaactgttctatttgttggggatttgtcgtatgctgatagatatgaacataatgatggcattcgttgggattcctggggtcgattcgttgagcgcagtactgcataccagccatggatttggaatactggaaaccatgaaatagagtacaggcctgatctgggagaaacttctgtattcaagccatatttgcataggtacatgactccatatttagcatcaaagagcagttctcctatgtggtatgctgtcaggcgtgcatctgctcacatcatcgtgttgtctagctactctccatttgtaaaatacactcctcaatggctgtggctgaagaacgaattcaagcgcgtggacagggaaaagacaccctggcttatcgttctcatgcattctcccatgtacaacagcaacgaggcacattacatggagggtgagagtatgagggctgctttcgagaaatggtttgtgaagtacaaggttgacttggtgtttgcagggcacgttcatgcttatgagagatcataccgcatttctaatgtcaactacaacataacgtcgggaaatcggtatccagtgccggacaaatctgctcccgtttacataacggtcggtgatggaggcaaccaggaaggacttgcttcaaggttttataacccccagccggattactcagcgttcagggaggccagctatggtcactcagttttacagctgaaaaacaggacccatgctatctaccagtggaatagaaacgatgatgggaatcctgttccagcagacaccgtaatgttccataaccaatattggacgagcagcacgcgccgcaggaggctgaagaagaaccatctccatctcgaggaccttgaggatttgatctccctattatagaaaaccgggttcgcaggacgcatgaactgtgtgtgggggaataatcgcaggttagcactgttgctagtgtgcccgcctctcttggaatggaagcagcagagccagctatcagactggcagtgaccaccacctcctcagctacctggttgcatgccacagatctgaaattctgaaatgctgtgactgtgactgtgaggtatgaaaaaacagtgtaaataacgcggttgcctccgtacatgtgtgacattttatacacgtgcaagaaagcatcggtgtccaccgttgtccgtgaaccaaaaaaaaaaaaaaccgcctgtgccctgtggaaatcctttccatctcgttgttgctggtgtaaaaaaaaaaaaaaaaaaaactcgaaaggggggcccgtgtacc

SEQ ID NO: 783 - DNA, 747 bp, Zea mays
cggacgcgtggcgcggtatgatctctcataagcatgaacgtgccctgcaacataacgtcgggaaatcggtatccagtgccggacaaatctgctcccgtttacagtacggtcggtgatggaggcaaccaggaaggacttgcttcaaggttttataacccccagccggattactcagcgttcagggaggccagctatggtcactcagttttacagctgaaaaacaggacccatgctatctaccagtggaatagaaacgatgatgggaatcctgttccagcagacaccgtaatgttccataaccaatattggacgagcagcacgcgccgcaggaggctgaagaagaaccatctccatctcgaggaccttgaggatttgatctccctattatagaaaaccgggttcgcaggacgcatgaactgtgtgtgggggaataatcgcaggttagcactgttgctagtgtgcccgcctctcttggaatggaagcagcagagccagctatcagactggcagtgaccaccacctcctcagctacctggttgcatgccacagatctgaaattctgaaatgctgtgactgtgactgtgaggtatgaaaaaacagtgtaaataacgcggttgcctccgtacatgtgtgacattttatacacgtgcaagaaagcatcggtgtccaccgttgtccgtgaaccattttcgcttgtatgcgcttgtgcccagtggaaatcctttccatctcgttggtttgctggtg

SEQ ID NO: 784 - DNA, 939 bp, Zea mays
tcgaggccggccgggcctccaggccccccaccagttgatacatgtcttgtgacttgtgaagtgtgttcctatctgcatcaccttccttcgccttgcaaccctttggctagttcattcatacgaatggattattctaatttgcgtcgccaagctgcatccatgaaaaagactctctttgatcaggggtacctagatgagcaattttgccaggtggaagacttgcaggatgaagctagtcctaatttcgcggaagaggttgtcactttgtttttcaaggactcggccaggctaatatcaaatgctgaacaggctctggaaaaataccccaaagatttcaatagatgggatgcatacatgcagcagctaaaaggcagctgttccagcattggtgcttcaaggatgaagagtgagtgcgtgtcattccgggattactgcggacagggaaatgttgaaggttgtatgagatcgttccagaaagtgaagagggagcacggtgccctgaggcagaaactagaggcctatttccagctgctacgacaagctggtcctgctggagctgccaccaggcctggatgtaagaactaggagttgcaggaaaacggagtatgacccaagaagatacctcactacaactgactggcccggtggccctgctgcgcagcaattaggggtcagcatacgaagcgaaacaagagatgatatgcatggatatgcacaaaactgtaataagagattgttttttcaagaacaaaaaaaaaatcagaggagaggaagggatgggaaccttgtgtagtgagtttacaagctttactgaaagatggtattattgtctcatgtgtaatatattccttccattttaaaatatatttattcttagagtcaaaaaaaaaaaaaaaaaaaaaaaaaaaaaaaaaaaaaaaaaaaaaaaaaaaaaaaaag

SEQ ID NO: 785 - DNA, 3354 bp, Zea mays
attcggcacgacactacgcagaacttcgccgccgtcgcctttctcagtttctcctgggagcttgcctgtgtcgaacatggcggtggctgcgacgacggttctggacatcgcggagctctccttctccgacttagtcgccctcctatctcccgagactcttgctgacgacggccgctgccgacgtgttgtggacaccgtcgcaaccgagctcggccgaggtgggtccgggttgctggccatcgacggagtgccgcgcatgggcgccctccggcgacgactcctccccttggcccgacgcgtcgccctcatggatcacctgacccgctcccaactcctcaagaagcacgggttgggcagcgacgttcctttgaagaagctcgatcggtccgtatcctcgttcgcgcagcttctaaggcattcaggtgaactcgtcttgctagagtcggtaaacaacaatgggttcaattcttctgatagggtacaggattgtaaccaatccgaggatgttaatgatgatgatgatgctgatgatatggataatctgggtgacctcattaaggagcttggtttgtacatgatggagcttggaatcttgattgcacgagcttgcgatattgtcatcggtagaggtcagctagagcagagcatcactgactttgggacggcaaaggctaggctcattcactaccactctgagctggataacattgtgatcagggataacagtgcaaagaggaaagtttcggcaagtaaagtggcagtacagccttaccagtcatgctctggaagtaggtccgggtcagtgtgcccgtgctgtattaagtcagaagatgggactactgtaatgccaatagaagaaaataattctaatgatgcctcgattcagggtcaggctgctgaaatttccctgttaaacctatggcaggaatggcactatgactatggaatcttcactgttttaacagcaccgttgttcatgagcgtctctgaggatgaaaaaagtttggtcaatctggaatatcatcctcctgatggccacacacacttacagttatgcaatggaaggaagatattctccattagatgctctcctgagagcttcattgttcaagttggagaggcagcagacatcttgtcccaagggaaattgaaatctacacttcatgctgtgagtagaccttcgagttccacagacatcagccgtgagacttttgttgtcttcctacagccctcgtgggacaaacttttagcttatcctggttactctttagatgctgaaggtgaacccattcttagcaagcagacttcaatcatcagtgatggatcagcagggccttgtaatgaagatgcatttatgcaagaaattctgaaaaaagttccacctctatcatcaaggctaaaagaagggatgacatttgcagaattttctcgtcagacaacaaaacagtattatggtggcaatggcatccaacagaacaattgagcacttgcaatacaatggcaatgcatgtagcacacaatgaactgatgtattgacttgcattttgatactgatttggatgcacaaaactaaagcatcctggcaaacaatgcatactgctgatcctccttgatgactaagttttgcaattgtttgttgggaatagtcccacattgtgagttgtgggtgggcaaacatgatttatatggttgaggttacaaccttctaataggctaactttttggtgagtattggatcgaaaaaaaaaaaaaaaatgttgtgtgttcgaacgtgtgtgtcgcggcccgacggccttgggtgcgtgttcgggtgcactgtgtgtgggtgatatggtgggcgtgctatgtgttggtggtccggtccaacaattggtctcggagatcaggtcgatattgtacattctcaaacaaatcttggctcaacatgtgagaaggaaattgttaggaatagtcccacattgtaagttgtgggtgggcaatcatgatttaataaatcatatggttgaggttacaaccctaagagcatctccaatagcttcttaaaaccttggttctaatgattattttagggaaaaagagaaaaagagacgtccaacaatgaccaatctgagctccttgtcttcctgcacgcgaataatgtccctcccatggcgccaacttgcgcagctagccgagctcccaatctatgtgcaagtcgcccaccaatcttccacatactgcgactaccaccaccatcggttgacactccctcgcctgacgtcgagcagggctaggagccattgcacgatcccttcgctctcctttgccaatcaaacacatcactccatgactacctccgcttggtgctccccttcgcctctgtgtgcgcgctcattctcgacatattctgcgttaacatgggcttctttccgggtgttccctcgttcaaggtcatggagctccccgtgaacaccctcgactaccggtctactgcgtcgagctgctggtctcgggaggcagagacgaagaataagaagcacatgcttcacgttaaagttgtagtggctgcaattttgtcaagcgcaatctacaattttctatgagagggtaaacagtagctaggctctagcttcttgctgcttgagccaccctcacacttcaatcacatcatgggtgcattttcaccatagtgttttggacccgagggtcctaaccaatagtaaatttgtgttgcatacacaaggttatcctggttcgggcaagagatggccctacatccaacaggagaagcagacttgtattatcttgcacctaagtgctcgtagtagttaatacaagcaagtcgagagagcgagtaagtcccaagtctctaagtatgattaaggcgagttccaatataaggagtggggtgagtagtgaacagtgaagtgttgtcttccacctcttatagtgtaaaccccaagctgagaattctagagcattaattatttatgaaataaaatgattttattgaaacatgatctttttaaatcgagatagagttcttaagtattgtataactcactcattaccaagttttgatgtgttgaagcatgccactatttagagggataaaatagtaaataaatacatgaatcacattcatgctgatattttggttgtgcattttaaaattaaacagtgactccaaactagaatttgaatttaagaatagaaatttgaaattggttcaaatggaggagagaaaagataaaaaaggaaaaagaactgttctgcaccctgccagtcctccacctcggcccaaagtcacacaccggcccacctcctcatgcacgctgaacccattgagattgcgccgacaggtgggccccgcta

SEQ ID NO: 786 - DNA, 572 bp, Zea mays
gtagctcttagttcttctcctctctctctctctctctctcctctcccctctcctgtcgcactctcctgttccggccaccagcgtgcccagcatggtgcaacgctcgggtagaggagggcggagctggtcttcaggggtagcttgaactggcgaccggattggtttggagaccggtttgtccctgatttggtgccccaagtgcaagatggcccgagtgattgaactgagggtgaagagggagaatgagaacctaggccaaatgccaggaaggtgcccatactacagatggcagagggagtattttgagaaattggtgaaggagaggttgattgccttgttattcgatgattgggaggaagatgatggagaggtggattccaagaaggtttctgaagtaggaaatagtgaagacattgcaacttctgtttgtaatggttgtagtacctgtggtagtagtggtgatgtacatgttttaatgatctgtctgtaatgatgtatatgaacaattgaagaagttggaagggaatgttgaactttgtcaaaaaaaaaaaaaaaaaaaaaaaccaaaaacc

SEQ ID NO: 787 - DNA, 2664 bp, Zea mays
gactctttaaatagtttgtgcgatattgataatgtttgtcacacggattctgtatattatagtgaatagatggtgagagactatgcacgaggcatgcaaattaacaagactcctacaagcgtggaacagtgtgctaatggggcacaagagtaacacatgctcataatcctaacatgtttggctttcgagcaaactttctccagaccccaaagaaatataagatctaattagatatgtgtcgatgctcatcccagcgtacttccgttgcaacgcacgggcacacacctagtaagatataagggtggaaatttaggacgaacggctgaaggtagtctcccgcggccgtggaggcgctccatctccatgcaatgcaatgggaggggtgtccgcgcgaaagatgttgtatttttgccattttgtacaacgtggctgtgaagtgacgctatgccgctcgataccagcgtggatcagccagggaaatccctgttttgccctcgctcgctttcctttgccttctttgccgccgtcgttgacccgatccactgtagctcttagttcttctcctctctctctctctctctctcctctcccctctcctgtcgcactctcctgttccggccaccagcgtgcccagcatggtgcaacgctcgggtagaggagggcggagctggtcttcaggggtagcttgaactggcgaccggattggtttggagaccggtttgtccctgatttggtgccccaagtgcaagatggcccgagtgattgaactgagggtgaagagggagaatgagaacctaggccaagtgtttatcaagtgccctaggagtgttgacgctttgattgccattactttgtgtttttcgaaatctgattttggattatttgatttgcttttgtatgtgtagatgccaggaaggtgcccatactacagatggcagagggagtattttgagaaattggtgaaggagaggttgattgccttgttattcgatgattgggaggaagatgatggagaggtggattccaagaaggtttctgaagtaggaaatagtgaagacattgcaacttctgtttgtaatggttgtagtacctgtggtagtagtggtgatgtacatgttttaatgatctgtctgtaatgatgtatatgaacaattgaagaagttggaagggaatgttgaactttgtcaatacagttcacagatcattgaaacaaaaaaaaaaaaaaaacatagcattgttgaatccttctgctttctttacatcccaacatgaccttgttcatagcattcaaaagagacatcattacaacattcaaaagagacatcattacattcatggctcagcttaaactgttcttagccctcagattacaaaagagatatgcaaccaccttttcagggctcagcttagactattcttagcccttagattacaaaagagacatgtcatagcactcgaagggacatgctcctcggcttcaagcattgaacttgatcttctttcttgttgcaagctatttccttcttagggggagcatcaaccattgaactgggaccgtcttcttgcactgacatgttcacttcaactcgtggtggttccaatgttagtacccttcttgtggatacctataattctgcttccttggctgcttgctcagcctctagtgccctcctagccttttctcttgcagcttgtgcccttgttcttggagatggttcagctagtggttcagcttgtgcacctgttgcagcttgtgggtgagctagtgcacctgttgcagcttgtgggtgagcttgtgcacctgttgcagcttttgggtcagctgctgcacttgagcagcttctggttcagcccccttagctttcttcctctctccagttgtcttggtctttctggttctcttcctacaaaggatgaatagttagtaggcatttctaacataagtacaaaggatgaaacattcataacttaacctctttttcgttccagttagaggcatttccaacttcccttcctatggtcattttcaccacagttggcgcacttaacttgtcttctagccttacttgtcctctctagaggagataagaatctgtttttcttctgccttcccacacctctcctcttgaatattggtggctgcaatttgaaatctttatccaccttaggccattgtgacatgtcagtaatgttaggccatcccttgtcatatgctgcccttagcattgaaacaaagaaagccatgtccacgtagggttctagctgaggttgtctgcaagtagtgattacaacgaaagcatgtgggcatggcttccttgtcacctgccactacctacatgtgcattcctttttctctaagtatacaacatgcctcctcacttcttgatccctatacatcactgtcacctcagtctggtcaggtataccctttgtcactttcaaatggttcagtcctttggaggcagcattcaactgttgcacaacagctggcaagatcaccccatctagtgcccttgttatgctcctcctcttctcaaataacacacccccttctctctaatggcatcaaccatgcaatgcaatggtagatccttcagctgtttaatccatgcattccaacactcagctagattattgttgatgtacctcggccgcgaccacgct

SEQ ID NO: 788 - DNA, 1710 bp, Zea mays
gattactcattgcttcctgcttctatgtatgtgcagatgggttgtacttgatagaggttgatcgtatcctgcgtcctagaggttattggattttgtctggacccctaatcaactggaagaaacactggaaggggtggcacaggactaaagaggacctagatgcagagcagaaagccattgaggcagttgccaggagcctctgctggaagaagatcaaggaggaggatgacattgctatcgtgttattatacggttccgttgcaacgcacgggcactgccccggggccggccggggttgctatctctacttttgacctaaaatccggcctccacggctccacccacgagccagtggaatcttaccgattcggcaaccgtgctaatcgatatccgtgcaattccacctcccgaaccgaatccctccaccgacccaaaccctagcgcgcacccttctccgtcgtcctttcctggcgcgcgggccggtgtcggagatgcgggcgctgctcgcggacggcgggatggcactggcggtgtcgccggaggccaacgagtcgtcgggtggcgctgcggtgtcgctagggccgttatcgtgggcgtcggagtgccacggggtactgtacaacctggccttgatgctgccatcgctggcctttgtggggttcctggcgtggcaggcgcggcggagcttccgtaggctcagctacggccgctctcacgtcgttgtcgtcgcgtactacgcgctcctctgggccgtcgccgtactcaacctcctctggtgcttcctgcaggcatggcaatgtatgcctgacagggcattctcttggaatatactgtcactgtttacaaaatcaggaatgttattcttggaagtgagtctcatagcctttctacttcaaggaaatgatgccagcggttttgaatctttggcacgaacctttgttatatctggagctgtagttgctgctgatgtattgctcaagactatatatgtttttggcttcggtgttcctttgttcattgatactgatcaaggaactagtgggaaatggggcctgtggattctccacaaacttgtgcttactggagtctatgggctgattgttttcatgcatcattcaagatggagagacaggctgcctgcaaaaccagcatactacaactatgtatgtgtgatgttgctactgaatggcatatcactgtttggatgtttccttattgcaagtggagctggatttggtttatggttatataatctcacaaccgtatgctatcattctctttaccttcccctcctatatgtgactttcttagcagacttcttccaggaggaagacatgctcctagagaacgtctactattctgaaatgaaggatgctgggttcttcgatgctgactgggattaatccgtggctactgtgctgtatgacccatcccatatgaagtacgctgtatttgtttttattttatctgtgtactctcaacgtagaacaggaaatgtatgtagctagtcgtggtagtgaatggaaatatgtaatcttactgctgcatacttcagaaaatcagaattcaagtgatttcacggctgagattgccatctcaaaaaaaaaaaaaaaatttacgtcgatggtacaaaactacgaagtcggtcgtcaaaactgcgtttttgcaggctcgttttataaatgtaagcgtatcacccaggattctacc

SEQ ID NO: 789 - DNA, 1366 bp, Zea mays
ggtattttgataagtgggttctctctcccgtataagtcagtggtaaactaagatgtggcatccatattagtggcaaaaagttagatctcccttgatccaaacagccccatacgttgccttgggcaatcgagctaatcaatctccgtgcaattccacctcccgaagacccgaactgagtccctccaccgacccaaaccctagcgcgcacccacctccctccccctttcccggcgtgcggtccggcgttggagatgcgggcgctgctcgcggacggcgggatggcgctggcgatggcgccggaggttaacgagtcgtcgggcggtgctgcgttgtcgcaggggctgttatggtgggcgtcggagtgccacggggtgttgtacagccttgcggtgatgctgccgtcgctggccttcgtgggattcctagcatggcaggcgcggcggagcttccgtaggatcagctacggccgctctcacgtcgtcgtcgtcgcgtactacgcgctcctctgggtcgtcgccgtactcaacctcctctggtgcttcctgcaggcatggcaatgtatgcctgacagggcattttcttggaatgtattgtcactgttcacaaaatcaggaatgttattcttggaagtcagtttgatagcctttctacttcaaggaaatgatgccagtggttttgaatctttggcacgaacctttgttatctctggagctgtagttgcagctgacgcattgctcaagactatatatgtttttggcttcggtgttcctttgttcattgatgctgatcaaggaactggtgggaaatggggcctatggattctccacaaacttgtgcttactggagtttatgggttgattgttttcatgcatcattcaagatggagagacaggctgcctgcaaaaccagcatactacaactatgtatgtgcgatgttgctattgaatggcgtatcactgtttggatgtttccttgttgcaagtggagctggatttggtttatggttatataatctcacaatcgtatgctatcattcgctttaccttcccctcctatatgtgactttcttagcggactttttccaggaggaagacatgctcctagagagcgtttactattctgaaatgaaggatgctgggttctttgatgctgactgggattaattggtggctactgcgctctatgaccactccaatgtgaattacgatgtgtttctatctgtgtactctcaacgtagaacagaaaatgtatgtagctaaccgtggtaatgaatggaaatatgtaaatattactggcgcatacttcagatttcaagtgatttcaacactgagattgccaccccaacggttggtgataagttcacgcc

SEQ ID NO: 790 - DNA, 1096 bp, Zea mays
  misc_feature (8)..(9): n is a, c, g, or t
ctaatcgnnaaatttttgcatcatttgttaagtgcacaggctatgtgttaaattgttgtgcttaatgatttggtgtaaattgatttcttcctaatcctagctgcactaaaatatgttgctttggagtgtggccatgtgtgcgatgatttggtgtaaattgatttcttcctaatcctagctgcactaaaatatgttgctttggagtgtggccatgtgtgcgatttaattgctgggttgcccttttaatttatgttttccaatttatgacatgctaagttaaatcatgtgacttgtctagacttataaaattactacatgtttttaataaatgtgtcaagtaactattatttgtttttgcacctcatgcactgacaaattatgttcttgaaaaataagattaatgggagtagaagttataattagaagttagaaccattggttgggtcgctttgggcttgtgtgttttacattctatctttgaaatcttgtagaagaggaaaaaatggtcagtgagcatccatatctactatattaaaatgtgacacagccattaccattccactatattcaaatttctaagcttctatttgatcagtgagtacccatatctactgtatcatcatgtttcttcaatttaagcacattttttaccgaaacctgacctgctcttgtttgtttcatgtagtgctctgcatacctggtgagtgtttaatcaatcccggtgctgatttgttagttgtctttgagagggagttgccgagctttctcaacaatagcgatcgtggaaggcgtcaaccagattgtggatgttgaaactattctatctgcttttggatttaagttataggatatttaaacatgtttaatgtttgatacctggatgctttatgctttagttatatgtggatgctagaaaaagttgtgtacacatgtttttgataaaaattgtacgcacgatttggatttaattcaattgaatgatcgttttactaacttgatggtgaaaaaaaaaaaaaaaaaaaaaaaaaaaaaaaagggcggccgccgactagtgagctcgtcgacccgggaattaattccggaccggtacctgcag

SEQ ID NO: 791 - DNA, 2500 bp, Zea mays
cattagattaccatgtttatgacgatttttagaagatgactcattgtagtgacgaaaatttaacctctgtcattaaaaccatcataatatactctagcaatgtgtttgtgacaattttttatgacaatataagaatcgtcataagaataaatcgtcacaacctttttaacataataattataacgatatcacatgacaatgagcatatgtcatcgacatatgatttattttttttaaaaagctattgcccatgttagctcgcgtgacccaccattaaaggcaggtcctattgccatataagctcttatgtttaacaagttatcacacatggcaatatggttactagatcatgatttttcattttaaatctactatacaaagcaccattttttcatcttatctgtactatatacaggcactttgctaaactcctataaaacaccagtttctatgtttttatggtttccactgtcatcgagtttcgtaaaaaaaactcctcaatgttccttcaaccaaaccatggtcttacacctccctctagacctcctcattatgcctcctgaacttggaaaaagccccttgcctacgtgctccatcgctttctctgccctcgcctcaaccattatgtcttgttgggcgtccgtctgtcccctagctctgtcgtcacgcccctagcgagagcactgtgccggcctacttcgcgcccatcgccgactgtctcgacgtgttgctataccttggccccttcgtcgattggcttaacatcgccccacacgacagtgtctagacgcttgtcaagttcctcggtaaggggtggacctaccatataagatatcggtattcaaataaatatctaagttttttttaaaaatgaacacataaataaaaatatgtgcatatataaaataaaaagaacatgttcactaccttactagtcgtgcagcccagcagcacaccaatctttctcatggacgcacggacatgcctgctttctcgggcgtgctaggcgctatcccctcctgagccgccacaaccaccgcctgctagcgcagccagcaagccgcttgccacgcgcgcgacgtcgtgtttggcccccaccgccgttcggccgccttccccgccgccggtccgcctactcttcttcgctagactgctccccttctccattgatcacttgctccactacacgcaagacgcaaccgtgcatgcggcctgctagtgcctagcttcctccccctctctatgcgcgccactccaggcgtcgagctcgcctctgcgggaccgtagcccccacccctcattggctctctgcgcgagcgtgatcgcgcttccgcatcccatgttcaatggagccctaaaggtaatgcaaatccattcacattccattatgggtttccacacaaccgatctatatattagacaaaacacaaaatcgatttagtattctctattccaagttctggctaccgatgctggaggatttggaatggcgctgtttgattagaagacaagcgtcctgacaagtgggtacctatatcctgtatggaccattttctggtagcagtttgtttcgcatctccatttatttctcaatttggagactggagagagaacaacagagagaaactgatgttgaggagaaccataaaagtaattggttaggcttgagaggaggaatttggcaaacagggactatattttggagagcgattttggttcttatttgaaattcttatgttgcgtcaatacactgataatttccaatgtcaggttgtgcttctacgaagatccaaaattccttggaccaaaagcttcagcttccaatagttggtatgctctactcatatatcatggtcaatgcagatgatttattaactcattaggtgctgaagaactgactgaattgtgtacaaaggttgcagacctgggcattgtgcatcttcgtaagtgctaggatacatagtatgtaaggtttaactctatcttattccctcccttttgtagttaagggccttgtactgcgaactctggacaaagtttcatgctgctacaaaggtgtggttcactgacttcaaagagaataagctaactgtttccaactttgtagtcacactttttacttttctaggctttacacctagcctcaaaggcagaggtgtggacacatatttaatattgtccatgttttgttcaggtttatagcgcacttgggcatggcttatgccatcacattttttgcctgttatctactattgaaggagtatgaaagtatttctaacatgaggctgcactttctagcttcagagaaacaccaactagaccagttcaccgttgttcttttgctactatgttcctgtttattatagcaggtttggatccatatgtttactttatttgaattgatgggatagagcagtatggaatgatttttgcatcatttgttaagtgagcaggctatgtgctgtgcttaatgatttggtgtaaatgatatcttcctaat

SEQ ID NO: 792 - DNA, 1227 bp, Zea mays
acaaaaagagatcgaattcggcacgacgacgcatggacgtgcctgctttctcgggcgtgctaggcgctatccctcgtcagcagccacaaccgccgcctgctagcacagccaacaagccgctcgccacgcgtgcgacgctgtgtttggcccccaccgccgttcggccgtcttccccgccgccggtccaccgtactcttcttcgctagactgctccccttctgcatcgctcacttgctccactacgcgcaagacgcaatcatgcccgtggcctactagtgcctagcttcctgcccctctctatgcgtgccactccaggcgtcgagcttgcctctgtgggaccatagcccctgcccctcatcgactctctgcgtgagcgtgatcatgcctccgcatcccatgttcaatgcagccctaaaggttatgcttatacgaagatccaaaattccttggaccaaaagcttcagcttccaatagtcgataagggccttgtactgcgaactctagacaaagtttcatgcttctacaaaggcgtggttcactaacttcaaagagaataagctaactgtttccaactttgttgtcacacattttactttctaggctttacacctagcctcaaaggcagagctatggccacatatttaatactgtccatgttttgttcaggtttatagcgcacatgggcatggcttatgccatcacattttttgcctgttatctactattgaaggagtatgaaagtatttctaacatgaggctgcactttctagcttcagagaaacaccaactagaccagttcgcctttgttcttttgctactctgttcctatttattatagcagaagaggaaaaaatggtcagtgagcatccatatctactatattaaaatgtgacacagccattaccattccactatattcaaatttctaagcttctatttgatcatgctctgcatacctgttgagtgtttaatcaatcccggtgctgatttgttagttgtctttgagagggagttgccgagctttctcaacaatagcgaccgtggaaggcgtcaaccagattgtggatgttgaaactattctatctgcttttggatttaagttataggatatttaaacatgtttaatgtttgatacctggatgctttatgctttagttatatgtggatgctagaaaaagttgtgtatttgtttttgataaaaattgtacgcacgatttggatttaatt

SEQ ID NO: 793 - DNA, 3146 bp, Zea mays
ggccgggccgggaccccatctccagcccctccgacgcggccccaccatctccacctcccggccgaacagacacggcccgccggcaaacgacaaatctcgcgacctctcgaaatgagcggtaccggaagcagcgtgtagcgcgagacgaacgccgccctaatccaaaccctagaggcgggaggaagacggcgagcgaacgcagcaacgattcctgatctctaatatcctagcacggcggcggccgcggccggatctaggggtaacgaaggatgtcggactcggcatcgatggcggccgccatcgaggcgcggttcagcagccgcgacctcatcggctgcggttccttcggcgacgtctataaagggtttgacaaggaactgaataaagaggttgctataaaagtcattgatttggaagaagctgaggatgacattgaagacatccaaaaggagatatctgttttgtcacaatgccggtgcccatatattaccgattattacggctcttatcttcaccagactaaattgtggatagtaatggaatacatggctggtggttctgttgctgatcttcttcaagctggtcctcctctggatgaaatgtctattgcatgcattctgagggacttgttacacgcaattgagtatctacattccgaaggaaaaattcaccgtgatattaaagcggcaaatatcctcctcactgaaagtggagacgtgaaggttgcggactttggtgtttctgcacagctgactaaaacaatgtctaggaggaagacatttgttggaactcccttttggatggcacctgaggttattcaaaattctgaagggtacaatgagaaggcagatatctggtctttaggtatcactgccattgaaatggctaaaggtgaaccccctctggcagatattcatcccatgagagttcttttcatcatacctcgtgaaaatcctccgcagcttgatgagcatttctcgaaaccaatgaaagagtttgtctcactatgtttaaagaagaatccagcagagaggcctagtgccaaggagcttcttaagcatcgtttcataaaaaatgcccgaaagactccaaagcttttggagcgaataagagagcggccaaaatttgcagcaaaaagcatggatgccacacaaaatgggcaaacacatgatgaagaggaggattttggtacaggcactatcaaggtcaataggacaaaagatacagctccatctttgagtcaaggaacagttaggaaatctgcagtcagagatttttctgatagatcagagggcacaggaactgtccgagttgtttcaaggcctcctcaaatcgcctccacgaaggatggtagatctgatatgcctcaaagtccaaaagcaccaatacgcacagctgatcgagaaaatcagtggaggtcatcagggactggatctgaagaatctctctctctcagagatactcagagcggacgagggagagtagaaagttctactgatgacaatgatcactctgtaagtgggtcaggaactgttgtgttacgctctccaagagcatctcagttgtactcaacagctagcaaccacagtgccaagcctcccagcagattctcctcttatgaagatatgtctaatagtgggacagttgttcggacccaaaatgaagacccagaaactccacgatcttcaaggtcaaggctggggatccaagaaaaaacatcaaatgctcctcttgaggatagtgccattaaccttgcagaggcaaaggctgctttgcaggctgggttaagaaagggaaatgctcgagaaagaccttttatcaacaggcatgaaaagggatcacatgagcatagatcttctggagtaaatagtcaagaggttcaaagtgaggatgtggacacgcagaaaggtcacaaattacggcaattacctgatgggcagtcagcctctcgtgctagttctgtagcttcacctgcagtctcatcattgctactcccttccctgaaagaggctactggtgacaagtttgatcggcctgctgttcatgccttccttgattccttgatggatttagaacgtgatatacctggatcatgcgaagtactggttggcagattgctacaccggctagggagctcaaaggattcctcattgcaaggtcttcaggagacggcgatgtcaattttcactaaggaacctgaacctccctctgaaaaagcaggcgacaataagttagctaatatgccaccattggctgctcctaccgtgagcccactggcaaggttccttctcacaaggtggcaaaatcaagtttctcaagatcttaactctgtttgatccctgcgatgcagaaaagtgatttcatgttcgattcggtgtataattaatatttttcaatgtacataatgcaaactttagaactttatttcatccagtcggtctcaaccacctgttatttcatttgttttgttcatggcgaatactccctctgtccccaattaaaatttgttttacaattaatgtatgtgttgtatatatatgtttagtttcataatcatccatatgaatatggatgtaaaaatctagagctagtacgagtactatttttgggctagtttgagaacgtcatcttccaacgattttcattttctcaagtaaaattagtttattttttcttaggtcatgtttttctctttattttgaggaattggaatctaactaatgctacttttttttagaatgtgacattctataactatctaaagtttatatataagtatatctcaaatttgtgaatcgagacatggaaattgattctatagatttacatgctacttttttaatatataatttatattatactattttacttgcttctctatagtataaatgtagtgtatatctctcgcttatgatttaggacaatatacagacatattatatataaaaatatattaacttaattagttttgtttaaattataattattagaataaagtttaatttcaatgaaataaaaagggtcttaggaaattagagtttccaaacggagggagtaacatatttcttgccccttttccggtgttactgtcaccacaatacataacatatttcctgcccctgttcggtgttacttgaaagcatcta

SEQ ID NO: 794 - DNA, 450 bp, Zea mays
aacctgctaaaccgtctgctattctgctcgactgctcagctctagcctccactccaggcaccggagtccgagagcccgcctacagtgatggcgcccaagcacctcaacctcttcgccgcggcggcgctgctcctcctcctcctcctcctcctcccctccggctcaagcgccaccgcgtcgagtactgcaaaaaggggtgggactacccagtgaaggtgagcagcgtggaggtcgtccccgatcccgtcgtcagggggcagccggccaccttcaagatttccgcctccacagataaaaacatcactaaagggaaattaacgatagatgttgcatacttcatcttccacgtccactcggaaactcataacctctgtgatgagacttcttgcccagtaacaggtgaatttgtgctagctagccaacagacattaccatcgttcaccccgccag

SEQ ID NO: 795 - DNA, 1241 bp, Zea mays
tccgcccacgcgtccgcccacgcgtccggtcaacggtctcgagctacgcttctgccagcagtgcagcaggttccacaacctggccgaatttgaccagcaaaagaaaagctgtcgcaagcgtctagcaggccacaacgaacgccggagacggccacctcctggaccccttgcgtcacgatatggccgtctcgctgcaccgctcggtgaagagcccggcggcaggttcagaagcttcatgctggatttctcatacccaagggttccaagcgccatgagggatgggtttccagcggttcgacctggtggtgaaagggtgcctggcagcagtatccagtggcaagcagcgagcctagatcctcctccccctcaccatcagagcgcggcagcaggatacggtgcccactcgtacgggagcccgggtagctcgtcgtcgtcgtcgaggccaccggtgttccctgctggcccggagctccccccaggcggtggatgtctcgcaggagtccccacggactctagctgtgctctctctcttctgtcaactcagccatgggacgctgctggccacagcgccggccacggccacggccacggccacgccgcgtcactgcccgcaacagcaggcttcgacggcaaccccgtggccatggcgagtagctacatcgcgccgccaagcccctggaccgactcccgggcccacgaaggcgggcggcggaacgtgcctcaactgccacccgacgtccccctcggctacgtgcactctggcccaggcacccatcacggccagttctcaggtgagctcgagcttgccctgcagggaaacaggccagccccggcgccgcgcaatggccagggctccgcgggcgcgttcgaccaggccggcagcacgacggagtggtcgctctaggaggccaaataaaagcgcggcacatcgtcgtagccgcacagcgagatggagctggaagcctggctccgctagctagctgcatgcgctgtttgcttgcctagaggctagagcatccagtatgataataagcgaggaactagtgcagtgccggccaggagactgatttcttttgcgcttgtccatgaactcgtctgttgcgtctatgtacacctccatggtttgaactcgtcggggactttgctcgatgtgttgttattaatctcatgctcatccttccgctaatgttgcctggcggcatcgccaggaatcggttccaaggctaaaaaaaaaaagaaaa

SEQ ID NO: 796 - DNA, 1329 bp, Zea mays
cccaacccaaccggggcattcaaccaccccgtgtgctccaaccgctcctcgatttgatctccggcccgcggggcccccccgggggtttaccggtgagcgcgcgcgcgagagcgcgcgagagagagtgagggcggaggaaaggggagatggcgcaggcggtggaggagtggtaccggcagatgcccatcatcacgcgctcctacctcaccgccgccgtcgtcaccaccgtcggctgcaccctcgagatcatttcgccgtatcacctgtacctgaacccgaagctcgtggtgcagcactacgagatctggcgcctcgtcaccaactttctctacttccgcaagatggatttggattttctgttccacatgttttttctcgcacgatactgcaagcttctggaggagaactcatttagaggaagaactgccgactttttttacatgctcttgtttggtgctactgtcctaactagcattgttctgatcggagggatgataccttacatttccgagacatttgccagaattctgttcctgagcaattcattgacgtttatgatggtttatgtctggagcaagcacaatcctttcatccatatgagctttctgggcctgttcacctttacggctgcatacttaccatgggtcctattgggcttctctatcctggtgggaagcagcacatgggttgatctcttgggtatgattgctggacatgtgtactactttctggaagatgtatacccacggatgactggccgccgtccgctgaagacaccgtccttcatcaaggcgctatttgctgatgacaatgttgtggtggcacagccacccaatgctgggattggtgctggtgcaaggtttggtgctatgggtctagatccccaggctcaatgatatgaattactttcagtgacctgaggctgtgactgatctgagatgcggcagtctgttcctctgcgcaagttgcggaactgtacaagtcattgttcttgtatttatacaggctagatgagaattcttgtgcataacaaaagattagtagtatccgaggcggctaaaagtttctcacctgttagcagggcccgaaggaaatggtttctgatgtgccaacaggccaaaacccctgtcgccgaaacttgttcttgcaacggtttaacatctgacctactactctttcatgcatcagtgagtttagtctaggaaactgttccaaccgaagttgaagtttgttgctttggcagcgagaatttgtatggagcgttatgatcgcagaattgtgcaaggaatggctcctaacattgtggatgcttggagggtggttcttttc

SEQ ID NO: 797 - DNA, 1534 bp, Zea mays
ggtaccccccgggcccggccggggatttgatcaccgattaggggaggcggtttaccagtgagcacgcgcgagagataggataggaggaaagggaagctagcggcttcgctctcgcggggagatggcgcaggcggtggaggagtggtaccggcagatgcccatcatcacgcgctcctacctcaccgccgctgtcgtcaccaccgtcggctgcaccctcgaagatctctaatttgcgctctttacgtgcgcccgttggctgggccggctgtgcagatcatttcgccgtatcacctgtaccttaacccgaagctcgtggtgcagcactacgagatttggcgcctcgtcaccaacttcctctacttccgcaagatggatttggattttctattccacatgttctttcttgcacgatactgcaagcttctggaggaaaactcatttagaggaagaactgctgactttttttacatgctcttgtttggtgctactgtcctaactggcattgttctgatcggagggatgataccttacatttctgagacatttgccagaattctgttcttgagcaattcattgacatttatgatggtttatgtctggagcaagcacaacccttttatccatatgagctttctgggcctgtttacctttacggctgcgtacttaccatgggttcttttgggcttctctatcctcgttggaagcagcacatgggtggacctcttgggtatgattgctggacatgtgtactacttcctggaagatgtatacccacgaatgactgggcgtcgccccctaaggacaccgtccttcattaaggcgctatttgctgatgacaatgttgtggtggcacagccacccaatgctgggattggtgctggtgcaaggttcggtgctattggtgtagatccccaggctcaatgatgaattactttcagtgacctgagggccgaggctgtgactgatctgggatgcggcagtttgtattctctgcgcaaactgcggaactgtacaagccattgttcttgtgtatttatacaggctagatgagagttattgtgcataacaaaagattagtagtatctgaggcggctaagtttctcacctgttggcagggcccggaggaaaatggatcgtgatgggcaaacatgccaacccctgttgcagaaacttgttcatgtgacggtttaacatctgacctgctaccctttcatgcatcggtgagtttagtctaggaaactgtttgaagcggggaaatttggtgctttggcagcgagaatttggatggagcgctgtaattgcagaatggtgcaaggaatgactcctaacattgtggacgcctggatggtgttcgttttccttcctgattctgctgtgttcaccgatccggatgatctggtctcctggaagcagtctttgtccatttttccttcatcagctgctctttaaccgtaaaatcggcgttcgtcatttcaagtgttgtgaccgtatcccttttctgttatataaataaaatgtttcagctagctgttcc

SEQ ID NO: 798 - DNA, 861 bp, Zea mays
acgcgaaagggacgtcgcttctacgccttgccggcctccccgaacactccacccaacccaaccggggcattcaaccaccccgtgtgctccaaccgctcctcgatttgatcaccgattgcgggaggccgactagggtttaccggtgagcgcgcgcgcgagagagagagagagagagtgagggcggaggaaaggggagatggcgcaggcggtggaggaatggtaccggcagatgcccatcatcacgcgctcctacctcaccgccgccgtcgtcaccaccgtcggctgcaccctcgagatcatttcgccgtatcacctgtacctgaacccgaagctcgtggtgcagcactacgagatctggcgcctcgtcaccaactttctctacttccgcaagatggatttggattttctgttccacatgttttttctcgcacgatactgcaagcttctggaggagaactcatttagaggaagaactgccgactttttttacatgctcttgtttggtgctactgtcctaactagcattgttctgattggagggatgataccttacatttccgagacatttgccagaattctgttcctgagcaattcattgacgtttatgatggtttatgtctggagcaagcacaatcctttcatccatatgagctttctgggcctgttcacctttacggctgcatacttaccatgggtcctattgggcttctctatcctggtgggaagcagcacatgggttgatctcttgggtatgattgctggacatgtgtactactttctggaagatgtatacccacggatgactggccgccgtccgctgaagacacgtccttcatcaaggcgctattggctgatgacaat

SEQ ID NO: 799 - DNA, 852 bp, Zea mays
gggccctccccgggccccgcccgccgtcctccccgaacactccacccaacggcccaacccaaccggggcattcaaccaccccgtgtgctccaaccgctcctcgatttgatcaccgattgggggaggccgactagggtttaccggtgagcgcgcgcgcgagagagagtgagggcggaggaaaggggagatggcgcaggcggtggaggagtggtaccggcagatgcccatcatcacgcgctcctacctcaccgccgccgtcgtcaccaccgtcggctgcaccctcgagatcatttcgccgtatcacctgtacctgaacccgaagctcgtggtgcagcactacgagatctggcgcctcgtcaccaacttcctctacttccgcaagatggatttggattttctgttccacatgttttttctcgcacgatactgcaagcttctggaggagaactcatttagaggaagaactgccgactttttttacatgctcttgtttggtgctactgtcctaactagcattgttctgatcggagggatgataccttacatttccgagacatttgccagaattctgttcctgagcaattcattgacgtttatgatggtttatgtctggagcaagcacaatcctttcatccatatgagctttctgggcctgttcacctttacggctgcatacttaccatgggtcctattgggcttctctatcctggtgggaagcagcacatgggttgatctcttgggtatgattgctggacatgtgtactactttctggaagatgtatacccacggatgactggccgccgtccgctgaagacaccgtccttcatcaaggcgctatttgctgatgacat

SEQ ID NO: 800 - DNA, 1501 bp, Zea mays
tgggtacctcgaggccggccgggggcctgtacaaagccttgggaccatggggccctcggccgttcgccgtcctcccggaacgcccgtcccgtccgtcctccccccatccacatccatcccgtgtgctcctactgctcctcgatttgatcaccgattaggggaggcggtttaccagtgagcacgcgcgagagataggataggaggaaagggaagctagcggcttcgctctcgcggggagatggcgcaggcggtggaggagtggtaccggcagatgcccatcatcacgcgctcctacctcaccgccgctgtcgtcaccaccgtcggctgcaccctcgaaatcatttcgccgtatcacctgtaccttaacccgaagctcgtggtgcagcactacgagatttggcgcctcgtcaccaacttcctctacttccgcaagatggatttggattttctattccacatgttctttcttgcacgatactgcaagcttctggaggaaaactcatttagaggaagaactgctgactttttttacatgctcttgtttggtgctactgtcctaactggcattgttctgatcggagggatgataccttacatttctgagacatttgccagaattctgttcttgagcaattcattgacatttatgatggtttatgtctggagcaagcacaacccttttatccatatgagctttctgggcctgtttacctttacggctgcgtacttaccatgggttcttttgggcttctctatcctcgttggaagcagcacatgggtggacctcttgggtatgattgctggacatgtgtactacttcctggaagatgtatacccacgtatgactgggcgtcgccccctaaagacaccgtccttcattaaggcgctatttgctgatgacaatgttgtggtggcacagccacccaatgctgggattggtgctggtgcaaggttcggtgctattggtgtagatccccaggctcaatgatgaattactttcagtgacctgagggccgaggctgtgactgatctgggatgcggcagtttgtattctctgcgcaaattgcggaactgtacaagccattgttcttgtgtatttatacaggctagatgagagttattgtgcataacaaaaagattagtagtatcggaggcggctaagtttgtcacctgttggcagggcccggaggaaaatggatcgtgatgggcaaacaggccaacccctgttgcagaaacttgttcatgtgacggtttaacatctgacctgctaccctttcatgcatcggtgaatttagtctaggaaactgtttgaagtggggaaatttggtgctttggcagcgagaatttggatggagcgctgtaattgcagaatggtgcaaggaatgactcctaacattgtggacgcctggatggtgttcgttttccttccaaaaaaaaaaaaaaaaaaagatccggatgatctggtctcctggaagcagtctttgtccatttttccttcatc

SEQ ID NO: 801 - DNA, 4957 bp, Zea mays
  misc_feature (4215)..(4215): n is a, c, g, or t
  misc_feature (4373)..(4373): n is a, c, g, or t
atttgacctgagatccatccttgatgatgtcatctcattattttcttcaaagtcaagagagaagggaattgagcttgctgtatatgtctctgaaagagttcctgaactcttgttgggtgatcctggaaggtttcggcagataattacaaatttagtgggcaactcaattaagttcacagaacggggacatatttttgtacaagttcatctggcagatcactcaaatcttgcaacagaacccaaagttgagccggtggctaacgggatgaatggacatacagatgagaaaactgctgtagcaaccagtgtttctctcaacacactaagtggttttgaagctgctgatagccgaaatagttgggaaaacttcaagcttttgctttcttatgagaaaaatgagatgccctatgaaagtgtatctgataaagttactcttgtagtaagtgtggaagatacagggataggtataccattggatgcccaagccaaggtgttcactcctttcatgcaggccgatagttcgacttccaggacatatggtggtactggaattggattgagcatcagcaaatgtcttgttgaactaatgggtggtcagataaactttgttagccgaccacatgttgggagtacattcacatttactgcagctctccaaagatgtgacagaagcgctattggtgacagtaagcctgttatgttgcaccctcttccatccagtttcaaaggtttatctgcactattggttgatagaagaccagtaagagctactgtaactaagtatcacttgcaaaggctgggaattgcctgcgatgttgttgctaccattgaactggctcttggtgtgctgtccgggagaaatggcagttccctaaccaggtacttgtcttgcctacgtactctctaaaagttgaagtgattgagctaccatcttgaggacttaggaataacgtggcatacttggctgcttgggtacttaaattgcatgtgacttctcttcaaaattgatatttggtttgcaacgaatttgttgcatatgcacactgaatattgatcgcttcagaattgatattgccatcataaaatatttttatacatcctttgaccatccaactcatcaaatcactgttgtggtcaatactaatttcttcattatttttacacacacacaccaaattcatcgtgttaccaaattcaccgagttggatctgctttcagtttgtatcaccttttttagccgtagttctcattacggttcttgcgtattatttatctagttcaaactttgcttatgttaaataattaagtgaaaatgcggtttttgctctattaaactgtagaatgcaaatgcctactgaactactttctacatgcagtttcactaattgttacctgtatttctctcgacatgcattttctctcgttttccttgggtctaactatttttttcctgaattcatcatgcagcacgaagcaaccatgcatgttattgattgagagtgattcatggggcttcaagattgatgtacctttacgatctcgactcctggagatgaagcagaatggtccacctggattgcccaaaactatccttctcgcagctgcagaatcgggcaaactcaaagcacactatgcagttgattctgtgatcacgaagcctctgaaagcaagcggacttgccgcttgtctattccaaacacttggcatcacacagtcaagcaacgagagacgcgacaactcaggttcccttcatgggttgctccttggcaagaacatattggtggttgatgacaacaaggtaaatcttagagtggctgctggcacattaaagaaattcggagcgaaggtggagtgcgtggagagtgggaaagatgctctcgccagcctacaagttccacataagttccatctttgtctcatggacattcagatgcccgaaatggatgggtgagttctatacatacaagctttcgctcgtgaacttgggcttgttttctccctcccttgtcattctctgatctaaatcaatattccactgcttgggacaccaggttcgaggccaccaagcaaataagggcaatggaggcgaaggcaaatgagcaggcagtcgcctgtgacgattcagaaacggatggcgcgacaagggcggcgagatggcacctgcctgtccttgcaatgaccgccgatgtcatccaggccacccatgaggagtgcacgaagtacgggatggatgggtacgtcacgaagcccttcgaggagaagcagctcttccaggcgctgcagaagttcttggaccctggcatgtccagctaacacccaagtgctgcgttcgttgcgagtgaggcaccattctcctccgttctgtagttcgctaaccatagacgcaatctgattatctgaccccgaagaaagatcgtaaatggcgggctgctcgtcgaccatgccagcggggaacagcaggcagcacgcagcaggggcctttgctgcctgcctgtgcagtgcaggcgccgtgtaaatgtattgtattagcagggatcctgtttatagcgctagtatggacctgcgcgacaatgttggaggagctgcctgcggctgatgcacgtcgagcataattttgttgtacagcttccaccatttttgtgctactgtggcaggcatgctcgctggtgcagtgcaggactggaaggaaaacctgactgcctgagagtagtttttttttgccgtcaacattgcattgggattcgtgatgtattacaatctgctaatgtgcgatataagctcatgtaattggctcagtgcgtttccattgttacaaatatgaattaagatggcattggtaaatggtaagactacactactgggtgtatgcccttcccttatccctgcaaaattccctgcaaaatgtgcaaagggaatatccctgcaagctgtattgggcaagatgccgccagcgacaccttggatccctatgcaatgcccgtcctgcccatggagagtgatcaagcacgaaccatggctagtaagtacctttcttcacggagataccgtcgtttgtttgttcgagtatttagacagcactgcacggtgatgataaaaccttcagcggcttactacgatctgttggttattgcaagttaatcttccgaaatgactctgccttggttatccatatagaacacaaaactcttgctgcccacaaatagagtcatggctagataaaagaaccacattagttcaaaaaaagaaagaaaaaggaaccatgagccatgtgtccagtgttcatggctagataaaagagaaagtatcatgggccagcttacaggcccattacagcgcctacaataggctaatcacggttgagagcctcttagataaccaggcccatctagcttcacttcagatagccttgcttgccctcccgggtttcggtcccccggactttttttttctggcggtgggtgcacgtccacggcaccgaatccacggacggcaagcagcagtgtgcctggctcgctcgctcgctctctctcgcgcgcgcgccgtgcccgtgtctgcacgtagacctcagcggatccaacttcggcgctccgctttccacgtctgctcatgtcgtgccgtgccgtggccgagagcactgaacgagcccacgtctccctccgcgacctccacacgcgcacagcggcggcgcaggacaaacgcagaggacgaagcaatgcaggtaacggaacggcaaggaagatcttttcttggcgctggtggatctcgtcggtttctggcgcagaggacgaagcaatgcgtgctgcaccccgcgctcggcttgtggcgacggtgagttgagttggggggtgaatcgtgaggccgtggagctgccgggtcacgcgactcacgagagggaagccgtccttgtccacggaagaggtcggagacccctcgctggaggctacgtggacctctaccgatgcgttaatttggagccagaacaagatgtgtatactatgccgatgtgcagtgcaggcagggccggtcatgaggtttcataaacccggggcgaaacaaaaaattagggccccaaaaaattttgaatgataaaagtctataatatatatactttcttctaagtacataagcaaatttttgaatgataaaaatctataatatatcaaaacaacttcaaatctttgtacatattatctcaaaatttttttttaatatttnttgatgcgaagtcattgataatagtgttgctatcaatctcgtctaataatttttctcaatgtataaagtagccaatccgttaaggcgatcttgagacattgttgaccttaatagttcttcaacaatttcaactttaaaaaacttctctaagccgatgncacagtcacaagcacagtaaataatatccaataagcgattgaaatatttggatacagatccatttgccgaacatactcaaaaaatcttcataaaagacattggtatttcaggcaaacttagcttcaaaaccttcaacttagatagtagatcatttaccttaacgtcagaactgtcctacgaagagggataagtggagcaaccgtactggacacaacacctaagattatatatacatgtacattacttggggcccttccaaaatcggacgcccggtgcgacggctccacttgcacccctccaggaccggccctgagtgcaggcgtctagattcggagtgacctggccatcaacgtcagtaataacactctaaacgtgtccttctcagtctcagtacatgacatccactacactcatcaacacgcacaaaataatgatggactctttggcagggccgtgcgtgaggcagggcgtgaggggcagccgccctggcccatatctcctagaggctcaccctatataaagtttaataggattataggaactagggcacaacacactgcaccgcaggtcctcattggatcac

SEQ ID NO: 802 - DNA, 2732 bp, Zea mays
gcttgcatgcctgcagtgtttacttagtactctgaagttcgttgccaactttactttaggattgatatttgcttgcactgacagttcacagaacggggacatatttttgtacaagttcatctggcagatcactcaaatcttgcaacagaacccaaagttgagtcagtggctaacgggatgaatggacataaagatgagaaaactgctgtagcaaccagtgtttctctcaacacactaagtggttttgaagctgctgatagccgaaatagttgggaaaacttcaagcttttgctttcttatgagaaaaatgagatgccctatgaaagtgtatctgataaagttactcttgtagtaagtgtggaagatacagggataggtataccattggatgcccaagccaaggtgttcactcctttcatgcaggccgatagttcgacttccaggacatatggtggtactggaattggattgagcatcagcaaatgtcttgttgaactaatgggtggtcagataaactttgtcagccgaccacatgttgggagtacgttcacatttactgcggttctcaaaagatgtgacagaagcgctattggtgacagtaagcctgttatgttgcatcctcttccatccagtttcaaaggtttatctgcactattggttgatagaagaccagtaagagctactgtaactaagtatcacttgcaaaggctgggaattgcctgtgatgttgttgctaccattgaactggctcttggtgtgctgtccgggagaaatggcagttccctaaccagtatgaagcaaccatgcatgttattgatcgagagtgattcatggggcttcaatattgatgtttctttacgatctagactcctggagatgaagcagaatggtcacacacatgtattacccaaaatcatccttcttgcagctgcagaatcgggcaaactcaaagaacactatgcagttgattctgtgatcacgaaacctctgaaagcaagcgcacttgccgcttgtctgttccaaacacttggcatcaaacagtcaagcaacgagagaagtgacaactcaggttctctttacgggttgcttcttggcaagaacatattggtggttgatgacaacaaggtaaatcttagagtggctgctggcacgttaaagaaatttggagcaaaggtggagtgcgtggagagtggaaaagatgccctcgccctcctacaggtcccatataagtttcatctttgtctcatggacattcagatgcccgaaatggatgggtttgaggctaccaagcaaataagggcaatggaagcgaaggcaaatgagcaggcagtcgcctgtgacgattcagaaatagatggcgcgacaagggcagcaagatggcgcctgcctgttcttgcaatgaccgccgatgtcatccaggccacccatgaagagtgcacgaagtgcgggatggatgggtacgtcacaccccttcgaggagaagcagctcttccaggcgttgcagaagttcttggaccccggcatgtcctgctaacgccgaagtgatgcgttggagaccgtgcagcgcgggctgctcgtcgatcatgccagcggggaacagcaggcagacaaggcagcacgcaccacgggccttcgctggtctgcctgcctgtgcaggcgtcgtgtaaatgtattgtatttgcagggatactgtttacagcgctagtatgccccgtgccacaatgtccgagctacctgtggctgatgcacgttgcgcataggtggttttttttgtacagcttccaccatttttgtgctccagatcagaccaccgaaggaggcaagcatgctcgctggtgcagtgcagcactggaaggaaaacctgacttcctgagagtagatttttgctgtttaattgcattgggatttatgatgtattataatcagataaatgtgtgatgtaagctggcgtaattggcccaatgcatttccattgttatggatgagttgaaatggcattggttagactacactattgggtgtatgcccttccacagttccattttccctgcaaaatatcaaaatgtgcaaagggatagtggaatcatggcttgaattatatgaattttctttggtgtttttttcccgtatcgaagctcgactataacattagaagaaagcatctggaggcatgtttaagttttggttattacacactataaaatacaagtggtatttaacatatttcattaaagttaaaacgtttacttttttcctgagttggaataacattagttttgggttattttgggagtatgtagtatattctgtgctcataacttcgtactccctctatcctaatatataatttattttaaactttttaattttgtgttcatattcagacatatatgatacacatatattaaatattatataaatcaattaacactctaaaacaaatactataaaacttaaaccttaaatcaatatattctgcaaccgttttcactatcgtctttctcgctcctgttcctattttcgataaaaagtatagtaacgaaaatagaagaggtggtttctcatctgttcccgtttattatcatccctagctccatcgaccctactatttgtcaaacaattaagcccagctccagttagttcagttactgcatattgcatattcagttaagttacatgtctgcatttgagttagttagttcagttagtctatattatcagtcaagggtcga

SEQ ID NO: 803 - DNA, 1354 bp, Zea mays
gaaggggggagcgctgcagatagtctcaagtccgcttcctgtgctggtccgccgtcgctctctgttcgccgtccgccgtgccgtccatccgccccgctccacgcagcttgggaataacggatcgccgctcgctatccctcgacctcggtagaaagttccaaacgaccacgacgtcctcttggtctcccgctgtcatcagtccgcaattccgcatttctattgtcctttttccgtcgcatccgtttcgtctctttgctcgcatctggcctcaagcccctcaggcctcagctcaccaccacgaaccaaccgacagaaagagggacgaatggcgagctctcagtgctgcgataacccgccggccctgaacccggcctgcggggagggcaaggtcgtcgacagcttcggcgggctcaaggcctacgtcgccggccccgaggactccaaggccgccgtcgtcctcgtcgccgacgtcttcggattcgaagcgccgattatgaggaagatagccgacaaggttgcttcgtcagggtactttgttgtggtaccagatttgtttcatggggatccttatgcacctgagaatgttgagaagccctttcctgtgtggataaagtcacatactccggaaaaagggtttgaagagacaaaacaagttattggggctctaaaggagaagggagtgtctgctgttggagctgcagggtattgctggggtgcaaaggttgttgtggagttggcaaaagctcatgagatccaggctgctgtgctgttgcacccttcttttgttaccgttgacgatatcaaagaggtcaagtgcgcaatttctatcctcggagctgagattgacaaaatgtccccaccggagctaatcaagcagttcgagcaggtcctttctttgaactcaggggttggccacttcgtcaagatcttccctggtgtggcgcatggatggagcgtgagatacaaccacgacgacgcagctgccgtgaagagtgctgaggaagcctttgcggacatgctcgactggttcaacaagaatctgaaataaactctgcaattgcatcctgccttgtaataatgcgtgttccagtgccctgggatcgaatctgctgtgtttgggcttttgcatggtcaggctattcagagttgtcatggacttagggttgtgttagtagattggttgcgctgaatctataataaaaacgaggtaaactaggacaatgatgatgtggccgtgtgtatttaatgtattctgttcacaattaaatttcgagctctttttttttactccaattctctcctaccattttttttgacctgggatatttgagtttatttacatcaatcaccctct

SEQ ID NO: 804 - DNA, 1218 bp, Zea mays
agtcggcgtcatgtgccggcccgccgtgcccctctgttcgccgtcgaccggccggccactcgctatcactctacctcgctagaaagttccaaacgactacggcatcctctgactcccccgctctcggtccgcatttccattgtgctttctccgttgcatgcagcctcgcatctattctagcctccgccctcagctcaccaccacgacccgagggaaagggagaggggacgaatggcgagctctcagtgctgcgataacccgccagccctgaacccggcctgcgggaagggcaaggtcgtcgacagcttcggcgggctcaaggcctacgtcgccggccccgaggactccaaggccgccgtcgtcctcgttgccgacgtcttcggattcgaagcgccgattctgaggaacatagccgacaaagttgcttcgtcagggtactttgttgtggtaccagatttctttcatggggatccttatgtacctgagaatgctgagaagctcatacctgtgtggctgaagtcacatactccggaaaaagggtttgaagaggcaaaaccagttatcgcggctctaaaggagaagggagtgtctgccgttggagctgcagggtattgctggggtgcaaaggtcgttgtggagttggcaaaagcaaatgagctcctccaggctgctgtactattttttttttccaatataacaccagaggtcaaatgctcaatctctatacttggagctgagatggatgtgaggtccccaccagagttagtcaagcaattcgagcaagccctttctgtgaactcaggggttggtcacttcgtcaaggtcttccctggcgtggcgcatgggtggagcgtgagatacagcctcgatgatgcagctgccgtgaagagcgctgaggaagcctttgcggacatgctcgactggttcaacaagaacctaaaatgaactctgcagttgccatcatgccttgtaataataatgcgtattccattgtcctggaatcgggtctgctgtggtagggctgccattcagagttgaacaaatcatttagaaatcattatgttgctcggcaacagattaagaccctatattgtacaactcaacttcactagtaaggccccgtttcaatctcatgagctaaactttagcttcctgctaaactttagctatatgaattgaagtgctaaagtttagtttcagttaaaaaaaaaaaaaaaa

SEQ ID NO: 805 - DNA, 1456 bp, Zea mays
gccggccggtccgacacggtcacacacaccacaacccagccacccaccacctcccccaattgcctcttctcttctcccagcagctgccgcgacgcagtcctactcctgcggtgcctccagtttcgcagcaccgttgccacacatcgccaactaacgccatcgatcacccggcggccgcccagagtcctgccctgccatatccgaacctgctcctgcagctagccagcaacacagacagaataggtcggtcggtcgatcgatcgatggccagcgttatcgacggcaatggaggcagccggctggtggtgacagagctgggccacctcaaggagctggcgatgcagctggaggggcacctcggcggctcctcgccggacctctgcaagcacctcgcctcgcagatctcctccatcaccgaccgctccatcagcctgctcatcaccgccacctcatcaagcccccacggcggcgcctctgacgcgccgcccttcatcagggctactaccaagaaaaggaagaggatggacaagaagaggcatgaggtgagggtgggctcggccggaggcggcggcggcgaccatccggccgacgacggctacagctggaggaagtacggccagaaggagatccttggagccaagcacccaaggggctactaccgctgcacgcacaagagctctcagggatgtgcggcgacgaagcaagtgcagcgcaccgacgaggacccggccttcttcgacgtcgtctacctcggcgaccacacctgcgttcagagccagagggcggcagcgacggcgggtcgtcaggctgccgcggacgcgcaggcgccggagtacgacgccaacctcatggtgaagaccgaggggccggccctggagccagagcagcagcggcggggctgggaggacgcgcccacgccctttctcttctcctccacgccggcgtgccttgtgccggagcgcagccccttctccgcaccgtccacgtccgagaactggggcgtgtccccggcgacctcggactccaaccacgtcgtctctttcccgcctttcgaggtcgccgccgccgctgccgcgcagttcgagttcgaggaagtcatgtcagcgatcgacagagccgacggcgagtttctcgaggacctcgacatctatgtctcaagcttcttagcgtgatctgctggatgtaatgtaaccgatgaacgctagggaatgggaatctgaggcagctgttaccatgagttgctctctgccgtttgtccaggggcagagcagggaagaacacatgttcttcctcggcccgtcccgttgtaaaccttagggtgtgagaatattgaatgtcccatctctctctcaaaaaaaaaaaaaaaaagggtttgcaaggaaaacaatttcgtaatagtgctgtcagttcagctaaacatgtgagtttctcgtgaatttaaacatttttccaacgg

SEQ ID NO: 806 - DNA, 952 bp, Zea mays
  misc_feature (9)..(9): n is a, c, g, or t
tcttataanaggcatgagtgagggtgggggggggggggggcggcggcggtgaccatccggccgacgacggctacagctggaggaagtacggccagaaggagatccttggagccaagcacccaagggctactaccgctgcacgcacaagagctctcagggatgtgcggcgacgaagcaaggggcgggggccgactatgacccggccttcttcgacgtcgtctacctcggcgaccacacctgcgttcagagccagagggcggcagcgacggcgggtcgtcaggctgccgcggacgcgcaggcgccggtgtacgacgccaacctcatggtgaagaccgaggggccggccttggagccagagcagcagcggcggggctgggacgacgcgcccacgccctttctcttctcctccacgccggcgtgccttgtgcaggagcgcagccccttctccgcgccgtccacgtccgagaactggggcgtgtccccggcgacctcggactccaaccacgtcgtctctttcccgcctttcgaggtcgccgccgccgccgccgcgcagttcgagttcgaggaagtcatgtcagcgatggacagagccgacggcgagtttctcgaggacctcgacatctatgtctcaagcttcttagcgtgatctgctggatgtaatgtaaccgatgaacgctagggaatgggaatctgaggcagctgttactgttaccatgagttgctctctgccgtttgtccaggggcagagcagggaagaacacatgttcttcctcggcccgtcccgttgtaaaccttagggtgtgagaatattgaatgtcccatctctctctctctttttcttcggtcgagggtttgcaaggaaaacaatttcgtaatagtgctgtcagttcagctaaacatgtgagtttctcgtgaatttaaacatttttccaacggaaaaaaaaaaaaaaaa

SEQ ID NO: 807 - DNA, 1440 bp, Zea mays
gtgccacactcgccatcgcggcgtccctcgagagtcgaccaccacctcgacggccggccaatatagcaacctatacagggcattctcatctcatggcgacgacgaagacgatggagatgggcgtcgtcgtcgacggcgtaagtagcaacggatcaggcggctgcggcgggctggtggtgacggagctgagccacatcaaggagctggtgaggcagctggaggtgcacctcggcggctccccggacctgtgcaagcacctggcctcgcagatcttctccctcaccgagcgctccatcggcctcatcaactcctcctccagcggcctcgacggcgcccgccggaagcgctccgcgggcgacgccggcctcgcctcgccgctctcggccacgcccaccagcggcgtcaccgacgggccgttcaagaacaccaagaagaggaaggcgatggaacagcggaggcagagggtgagctcggccggcggcgagaacccggtcgacgacggccgtagctggaggaagtacggccagaaggagattctcggagccaagcacccaaggggctactaccgctgctcgcaccgctactcgcacgggtgccaggcgacgaagcaggtgcagcgcaccgacgaggacccgacgctgtacgacgtcatctaccacggcgaacacacctgcgccccccacaggccgccggcggcggcggcggcggagcacaacccggacgcgcgcggccacctgcagaccctgagcgccggcctcacgggtgaagaccgagggcctgccggacccgccgcggggccggggccggggcgccgccacgcccttgtacctctccgcctcctccacaccgccgtccacgtcggagaactggggcgtgtcgcccgcgacctcgggctccacccacgtcgccttcttccggccgttcgaggccgccgagtggcgggggcaggccgagcaccaggaagtggtgtccgcgctcgtggccgccatcgcgccgcccccgccgtcgacagcctcgacgacctgctcatcgacatagatctagacgacatcgcgagcttcttcgcgtgacccgcgcgttgtagcagccgatgtggcgtagtatgtgaccgagccctctggctctgcttcctgaaactggaacagaacagaggagggaagagcaccaaagctctgcttcctggggtccatgcagatgcaggatgcaggcgtaaaaacctaggagatgaacaagagtagagactgcatttttttacccctctttttttgttaatctttttcctctttcagaggactgagggtagtgtgtttgtattgtattattgattttttatgccaatgggaaaaataagatccttcgtgccatctgagaattgtctttgatctcaaaaaaaaaaaaaaaaaaaaaaaaaaaaaaaaaaaaacaaaaaaaaaaaaaaaa

SEQ ID NO: 808 - DNA, 2411 bp, Zea mays
taaagaaatcaaacatggcctaactgcggctgtctcttgctctcgaccgttacgggttttccgcaggctgcaggccggtactttccactgagaaacatcgcggaaaaaggagtagtatgagatatatatcatgaaacaaacctagaaaaagacaggtgcccacaccaccagacatgcatgcaattttaaatacatttgttaatcgaataggtaccaagcatcttcgacttttttggttcagatttttgggtcccgtcccgtgcggccatgccacgacgcaccagcagcaccctgggtttcccactctgatcccgacctctcacaaaagatataccatcagtccatcaccacttcaccagcgatctggtgcagacgtgaaatccgatctagcgagggcgagctcacccagtcaccctcaccccacaacccaaacgaagcgtccacgaaatacagctgtgctgtccggactacgtgttcccgatccgacatggcacatcagcggccaatgactgaggccccagccgccggtattctcaccggtcagttcacttcctgttccctcggccgcctcgcccggacgcgcttcgttttttctttaaaagggcagctctggtcgagcgccccctccctcccgcccgcgccatcgcggcgtccctcgagagtcgaccacctcgacggccgaccaatatagcaacctatacagggcattctcatctcatggcgacgacggagacgatggagatgggcatgggcgtcgtcgtcgacggcgtcagtagcaacggatcaggcggctgcggcgggctggtggtgacggagctgagccacatcaaggagctggtgaggcagctggaggtgcacctcggtggctccccggacctgtgcaagcacctggcctcgcagatcttctccctcaccgagcgctccatcggcctcatcacctcctcctccagctccagcggcctcgacggcgcccgccggaagcgctccgcgggcgacgccggcctcgcctcgccgctctcggccacgcccaccagcggcgtcaccgacgggccgttcaagaacaccaagaagaggtgaacctcgccatccatcgctaatgctttgtcgttgattgctcaaggcaagccaaggcaatggacagacacaaccggtcgaacgaactgtgtctgactctttcgctgattactgctctttgaacccggccggctcgcaggaaggcgatggaacagcggaggcagagggtgagctcggccggcggcgagaacccggtcgacgacggccgtagctggaggaagtacggccagaaggagattctcggagccaagcacccaaggttagcacatctatctcactcaaacacgtattgttgatttggattggaaccgcgctctgtctgacgacctccgtcgtgccaaacctcgcaggggctactaccgctgctcgcaccgctactcgcaggggtgccaggcgacgaagcaggtgcagcgcaccgacgaggacccgacgctgtacgacgtcatctaccacggcgaacacacctgcgccccccacaggccggcggcggcggagcacaacccggacgcgcgcggccacctgcagaccctgagcgccggcctcacggtgaagaccgagggactgccggacccgccgcggggccggggcgccgccacgcccttgtacctctccgcctcctccacgccgccgtccacgtcggagaactggggcgtgtcgcccgcgacctcgggctccacccacgtcgcctccttccggccgttcgaggccgccgagtggcgggggcaggccgagcaccaggaagtggtgtccgcgctcgtggccgccatcgcgccgccgcccgccgtcgacagcctcgacgacctgctcatcgacatagatctagacgacatcgcgagcttcttcgcgtgacccgcgcgttgtagcagccgatgtggcgtagtatgtgaccgagccctctggctctgcttcctgaaactggaacagaacagaggagggaagagcaccaaagctctgcttcctggggtccatgcagatgcaggatgcaggcgtaaaaacctaggagatgaacaagagtagagactgcatttttttacccctctttttttgttaatctttttcctctttcagaggactgagggtagtgtttgtattgtattattgatttttaatgccaatgggaaaaataagatccttcgtgccatgtgagaattgtctttgatctcaattatcggtagctttgctcatgttctacactcttacatgtgtattttgaaatcacaaatacatttaagtgagctcttttacgtcttgtatacatcacctctttgaaactcatgaacaaaagtacgagctttcttcttcttctttcttcacaagagagaatgaaatatgagccc

SEQ ID NO: 809 - DNA, 4540 bp, Zea mays
cgataccatcttgttgccacataatcctgtaattacacagcaagaacaaaaacttaaactgtgtggctgcttatcgtgtctcacagtcacaatatatgtgctctggttaccgtccagaatatggctgaaggtgtatcgttgaaagacacccgagcaaggccgaagtcacaaatcttgagcttgcagtcgccgttggcgagaatgttcttgggcttgaggtcccggtggaagacattggcggcgtggatgtacttcatgccgcggagcagctggtacaggaagaactggtggtgctcgggcgtgaggtcgtcgttggccttgatgacctggtggaggtcggactccatgagctcgaagacgacgtaaatgtcgcggaactcgcggcgcgatggcgggagcatgatatgcttgatctggacgatgtccgggtggcgcagcaggcgcagcagcttgatctcgcgcaggatgcgggtggcgtcggagacgtgctcgaagacgtcgttgatcttcttgatggcgacgtgctcgccggtgagggtgtcgagggccgcggcgaccacgccgtagctgcccttgcccaccacctcggtaacctcgtaccggctcgcctcgccgtagtccgtgaagaacggcgcctcctcggagccctggtcacgcgggccaccacgacggtgccgaacccatgaaatccacaatgcgaatccggatacgtacgcgttaacagaagaacagaggggatttcggtgccagcccgcaccttcttctcgtccatggcgtcgcgtgtgtcgctcctgcgccgatccggcgggacgcacccctcgccctcggcagcgtcgccctcgcgcccggggtgaaccgtgctgctgtcggtagtgacggttgggggcgcggcgacggcgagggaggaggaagacggagaggcgccgggtgatgtggaattgtggataggtccattttacgtacggcgggggagcagcggggaagcgcgcaaagtgggcagcggacgcccgaccaaagcgggcgcgcggtgcgcgggcagcgcgggagcgagcaccaaggggcaaggtcactgcggatgagccatggcacgtcgcacgacgtgacgacggtgcacggtgacgggcctgacggcaccataggtcgtatgattgaaccagatacccacaaatatatatttgtaagcagaaattgacaatgataacatagtaacaaaactgtatcaattaataattcagtaggtgtagatatatattttgtagctagtttgaaccacgactgtaatttaggcattgttcagttgcatggagctcgaagtagattaagagggattaaatctccttatattcaattttaactagaaagggatttaatcctctttaatccaccgctaatcgaacaagcccttaggctacatttaagatgaattaaagagggcacatgtgtagagatttatgcctattaacatacccatagagaaataaataaataatctacctctttagatcttgttctgctatttctatgcatatgtattggatgagattgaaaaaaatgaattcagataaatactagattatccaaataaagaagtaccgtttgaattagcagacctaatatagcatgctagtgactgcctgtcaacaaattcaatgtaccacaccgaaacagtgtcactcatgcagcaatgctgaggtgagggccctaggggtaccgctagcgtgcatgcttccaaaacgtgagtggcaaatagttgaacaacctctcatctaccatatcttttgttttggaaaggattcatcgctgttcatctaccaagatcttacacacgacacaagttaacaatcacctacttttccactgaaacaattgtaatataatacaatatactcattaattattctgttccacaagataacagatcggtcgaacatgatgtactcattcatcacacgtcacgagacacgagacgaagcagtgaagtcaccaaaggaaaaccgtgtcatcttcttcatccatccgtaagctagcatagtacgtgcagtctgctgtgcggatcctcttatgcgcggtccatatagccgagcttggaaggatggacggggctcagcagcggcgacgacggcagcggcggcgtgcggggctgccgaagccgctgcccctcgcagtcgtagtgtatggcccccgtgaactccagtggctggcacctacgccccaggaggatcgtccgccgccacacgcacggctcgtcgccgtcgtcaacgaggtcatcgcctcctcgcccgcgcttccgctcccccacccttctgctgggcatcaccttcctcagcgtcttgcgcttgatgacgacgacgaaggagctgtcgcggacgacgtcgcggtggcccgcgccgcacgggaagaacgaacgtctggcggcgaaagcggaggacgtgatgctcttcctgcggcggaggggcaccaccagccgccgggccagggaggagaggagggcggacatggcactgaacatggcgtgaagtgaaggccggctcgatcgggtgcaagagctagactgcactgcaagtgcaatggagtgatgccctttttttggcagagggacgattcccgtcccgcccggctaggctagctattaaaatgggagctgacgcccagttggcagttgtttggtggaccgtttggcaccggacagtcgggcatgatgacatatactggccaaacagcatttgaaaatggataaacaaccggtcaatttggcattaatgttacatgtttaaaattgctatttacgctttctgacaatttatttataggtaccgtgttggaaaattatgctatttaaaaacaaactttgaagaatattactcccccaccagtctcaaaatattagtcattttaactcttgatttttatgtctatgtttaaatgaatgataataaatctagacacatatataaaacaaatacattaattattgtatgaatcaactagaaaggtaaaacatttttttggatggagggagtataagaaaaaaaaaagagactagaccataaaatgtaaatgattatgacctgcaggagttacaattgtacgaaagggatgaggcctacaaacccgtcccaaaatgccagtatcatttgaaattctgttagagacaaggcactatttgaaaatagtattccttttattttattttaaaatacacttcatctgtgctctcaaaacatttggtgcaaaaatacatattgtcgcatgtcagattgaaataatgatattgtctcgagtttctcatatccctgtttttcccaaattaacatggaacttattttttagttattattggctcacctattatgacattgccataagcatccctgaatatgaatgtttttgttatttactaagctatatttgtttatgtctttttagcttacaccatactgccataaacatcctcaaatctaattgttttgttgttatctttacaattattgtttacatatattgttgattgcaatttatataattctggtttcattatactatattatccatctcaccatttagcatatattcgaatcgataaaaaataatttttcctacgccgcaacgattcttgaaggcacgtctttgttgtagaacaaatatgtcattttagtttggttatgcaaaatagtcttatgatatatctcttttcactatgctttgtttttcttttttatgacagatgccacataagtgcttgtttatgttgtttttcttcactcatcaattattcattttaacttctagagccatataacagaattgaggtattctaatgtggacgagtgtctagagtgtacaattatttcatatagtcacttgtttatatgttaatgtatgtaagtcagtaaagtatatgtaaaatcaacatgtatacttgtttcactgttaatcatttttatttgtcgcatatgtttcacatttgttgccctgcaggctgctacttcaatcatgcggaaggttgatcgactccgaaccaatccgaagcgcttaatcattgagtctagccaagaatgcttcagtgttgacatcccgtgcttgacagccacgggagaccctccaaatcctcgttgcgacggtgatcctccgtaatatagaaagagaggtgctgccgagccaaaaaaggtccccatgcccagtgtggacgatgatgatgactttgagccccccaaaaaagtacaatatcaaaatagatgtcgcaaacaagcgtaggtgagtttataacattattgcagccacttatctattccaaaatcaatctttgaaatatacaacaaaaagtatcaatacggttgatattgttagattatgttttctactttaatcaaattattttaagtattcatataatcataatgcaaactttctaggctgcaacatacatgttattatattaaacaaaagcattattagcttatatcaagccaaaatagtaatagaccatggaattatgtaaaaatcagaatgtagatattatgatatttaattattaatatat

SEQ ID NO: 810 - DNA, 2648 bp, Zea mays
taaacccccctgtttggtcatcccggctccccccaacatcttcccaacaactccctccatcgtcttgaggcgtgcgcagccatggctgtcctcggcaccgcggcggttgaggtgctcatcccggtagcggcattggttggcatcgctttcgcgttgttgcagtggtatgtggtggccagagtccccgtgccttcgcacgccggcgaggacggcggtggaggaggcaataagaacgtgagggaggaggaggagcatgtggaggaggacggcatggactaccttctcgtggaggcccggtgcgccgagatccagcgcgccatctccgtcggcgccacgtcgttcctgctaaccgagtacaagtacctggccgtgttcacggcggcgttcgcggtggtgatcttcgtgttcctgggttcggcgcagcggttcagcgcgcgccctgggccgtgcgcgtacgacccgtcgcgggagtgccggccggcgctggcgaacgcggccttcagcgcggtggcgttcctgctgggcgcggcgacgtccgtgctgtccgggtacctcggcatgcgcgtggcgacgttcgcgaacgcgcggacggcgctggaggcccgccacggcgtggggcgcgccttcgccgccgcgttccggtcgggcgccgccatggggttcctcctcgcctccagcgcgctgctcgtgctctacgccgccgtcaacctcttcggcctctactacggcgacgactggggcgggctctacgagtccatcaccggatacggcctcggcgggtcctccgtcgcgctgttcggtcgcgtgggcggcggcatctacaccaaggccgctgacgtcggcgccgacctcgtcgggaaggtcgagcgcaacatccccgaggacgaccctcgcaaccccgcggtgatcgccgacaacgtgggggacaacgtcggcgacatcgccgggatggggtcggacctgttcgggtcgtacgcggagtcgtcctgcgcggcgctcttcgtggcttccatctcctccttcggggcggagcacaacctcacggcgatgatgtacccgctgctcatcagcgccgtgggcctgctcgtgtgcgcgatcaccactgtcgtcgccaccgacgtcaccgaggtgaagggttccgacgaggttgggccggcgctcaagcggcagatcctcatctccaccgtgcttatgaccgccggcatcgccgccgtcaccttcctcggcctgccgcccagcttcaccctcttcgacttcggcaacgacaagcacgtcaagaactggcacctattcatctgcgtgtcggccggtctgtgggcggggctcgtgatcggctacgtcaccgagtacttcacgagcaacgcgtacggcccggtgcaggcggtggcgcggtcgtgcaggacgggcgcggcgacgaacgtcatcttcggcctggcggtgggttacaagtcggtgatcgtgcccatcatggccatcgcggcggccatctacgccagcttccgcctggcggccatgtacggcatcgcgctggcggcgctggggatgctgagcaccatcgccacggggctcgccatcgacgcctacgggcccatcagcgacaacgccggcggcatcgcggagatggccggcatgccgcaccgggtccgggagcggacggacgcgctcgacgccgcgggcaacaccacggccgccatcggcaaaggcttcgccatcggctccgcggcgctggtgtcgctggcgctgttcggcgcgtacgtcagccgcgccgggatcacggcggtggacgtgctgagcccgcgtgtgttcgtgggactcctcctcggcgccatgctcccctactggttctcggcgatgaccatgcggagcgtcggaagcgcggcgctgaggatggtggaggaggtgcgccgccagttcgacaccatcccgggcctcgccgagggcctcgccgtgccggactacgccacctgcgtcaggatctccaccgacgcctcgctcaagaagatgatggcgccgggcgcgctcgtcatgttcagcccgctcgtcgccggtacgctcttcggggtcgagacgctcgcggggctcctcgccggcgcactcgtctccggcgtccaggtcgccatctctgcctccaacagcgggggtgcatgggacaacgccaagaagtacatcgaggccggcttgtcggaggaggcgaggtcgctggggcccaagggatcggaggcgcacaaagcggcggtgatcggggacaccatcggcgacccgctcaaggacacctccggaccgtccctcaacatcctcatcaagcttatggccgtggagtcgctcgtcttcgcgcccttcttcgccgcgcacggtggcatcatcttcgaccacctctgatcaatgcatgctgctgacgttccatggcaaaggcgccggctgtcgccgcaagccgcctctttgaatttgccgtgatcagttagtaagaataatcgtcgtgtatgtagcctgtaacaagtaatgccagaccaccagagttggaggcttattcatgtctggccctcttatcttacccttgaatatgttgctcggtatgctgcaactgcaatacaaagcgcgaacactagtcggctaaaaaaaaaagcaaaaaaaaataaaaagtacccaaa

SEQ ID NO: 811 - DNA, 1455 bp, Zea mays
ctcatctctcctgccccgccaccccaccagcgatggccctgtgcgccgccgctgcctccaggccaccgcctccgcgtcggcccatctatcggcctccaccgctcgcccgcggggcccctcctcgacgtcgctgccgtcgtccttcgtcggcgcgttcccgtgcgcggtcgctgcgaggacgaggaggaggcgcgcggcggcggcggcggcccgcgccaccgtcacggtgcgcgcggaggccaggaagagcgtgctgatcgtgaacaccaacggcggcgggcacgccgtcatcgggttctacttcgccaaggagctgctcgccgccgggcacgccgtcaccgtgctcaccgtcggcgacgaggcctccgacaagatgaagaaacccccgttctcccgcttctcggagctgacgagcgccggcgggaggacggtgtggggtgacccggcggacgtcggcgcggccgtgggaggcgcgtcgttcgacgtcgtcctcgacaacaacggcaaggacctcgacgccgtcaagccggtggcggactgggccaagacggccggcgtggggcagttcctgttcatcagcagcgcgggcatctataagccgacggaggagccgccgcacgtggagggggacgccgtgaaggagagcgccggccacgtgggcgtggagaagtacatcgcggagcagttcggcagctgctgggcgtcgttccggccgcagtacatgatcggctccggcaacaacaaggactgcgaggagtggttcttcgacaggatcgtgcggaaccggccggtgccgatcccggggaacgggatgcagctgaccaacgtggcgcacgtccgggacctgtccagcatgctgtcgctggccgtggagaagcccggcgcggcggccggcagggtcttcaactgcgtgtcggaccgcgccgtgacgctggccggcatggccaagctgtgcgcggcggccgccgactagagagctctacgacccccgccgccgtcggcgtcgacgccaagaaggccttcccgttccgcaacatgcatttctactcggagccccgggcggcgaaggcggcgctggggtggacgagcacgaccagcgtgccggtcgacctcaaggagaggtacgccgagtacgcagccagcggccgcggccacaagtccatggccttcgacctcgacgacgtgatcctcgctgccatcggcaaggcgccggcgagcgtcgccgtatagtatagtataataacacccggcgtgcaccgacagcgccgcaccatcgtctatactctagactcccgtggcgtccggtttagagatttctctccgaaaaactacgtacgcccgacatgcacgacgtcgcaaacgaacgttacaaaatacgacaaacatttttgttagttttttcgctttggtttttgtaccttgatgaagagaggaaaacatgtttgtccacaactg

SEQ ID NO: 812 - DNA, 628 bp, Zea mays
actgccgcgcgcgccagctaaccacttccccaacccccaatccatatctagcattctactgtagtggcaacgatgatggccgtgtctctgcagctgcgcccaatccctcgtctccctccgtcgagaaatcgctgcgcaggcacaagtccgcggatggccgccttgagctgcagatacaaccagcctaccaatgtgcaagggcgaacaaggctcacaagccacataacacgcagagatgccctgtcgttcatgtcatccggcgtgctggccgcattcgtgctcgtggtggccagtccggcagaagctagaccttcgagattggagaacaaaaggaaagccctggagaagcttgagaagctccgggagaaggcgttaggcccgaaggagaagagcggagccaccggtaacggtaaggagatgccccctccggcgaacttgctaatccctcctgccgccgtggaggctttcttgtgaaaggcagtctgccgatggacccttcccttgtgttaaatggcgaggctagtctgagtttgtacgttgttggagtcttgtatgactatgccaactggaaaatgaaatgaaagtgagcttgcatgcttaaaaaaaaaaaaaaaaaaaaaaaaaaaaa

SEQ ID NO: 813 - DNA, 1038 bp, Zea mays
ccccctgggtccccgagggcctgtaaaaagcccaacgctgggctccgctcccccggtctctctggagtctggactcgcctccggcgcgcctccaccatgtatcccaaggcggcagacgaaggtgcgcagccgctggccacgggcatccccttcagcggcggcggcggctactaccaggcgggcggcgcgatggcggcggcgttcgcggtgcaggcgcaggcgcccgtcgccgcctggtccaccgggctctgcaactgcttcgacgactgccacaactgctgcgtgacgtgcgtgtgcccgtgcatcacgttcgggcagaccgcggagatcatcgaccggggctccacgtcctgcggcaccagcggggcgctgtacgcgctcgtcatgctgctcaccggctgccagtgcgtctactcctgcttctaccgcgccaagatgcgcgcgcagtacggcctccaggtgagcccctgctccgactgctgcgtgcactgctgctgccagtgctgcgcgctctgccaggagtaccgcgagctcaagaagcgaggcttcgacatgagcataggatggcatgcgaacatggagaggcaggggcgcgccgccgccgccgtgccgccgcacatgcaccctgggatgacccgctgacgctctgccgctcgcctcacttctgctgaggaaatcaagtgatttggtattggtccgctcccagcaggcagtatcaactactgtaaccaatccatgatctgtatgcggtatcgggctgaactgatactttatggacttgttgcttcaacttagtccgtaaaacgctcaagaccacatgaaaatatggtccataaaacttgttcaaaaatagacattttgcactatattttaattctatgagataaaccatgattatgtttaatctctactactattaaaaacttaaggggtagtttgccttcccatggtttggcctctccctagttgtgacaggtgggctcccatgtctctatatgtgaatttcgtcgacctctcttacggcggttaccttctctc

SEQ ID NO: 814 - DNA, 850 bp, Zea mays
ccggccgggcccggattcctgtcggcaaggtgaacgcgagagccgaccgtctcagtgtgcgcgcgaagaagagaaggaggaggaggaggaggaagaagtagaagaatgtatccggccaagcccaccgtcgccaccgccagcgagccggtaaccgggatggcggcgccgccggtgaccggcatcccgatcagcagccccggccccgcagtcgcggccagccagtggtcctcgggcctctgcgcctgcttcgacgactgcggcctctgctgcatgacgtgctggtgcccgtgcgtgacgttcgggcggatcgcggagatcgtggaccgcggcgcgacgtcgtgcgcggctgcgggggccatctacacgctgctggcctgcttcacggggttccagtgccactggatctactcctgcacgtaccgctccaagatgcgcgcgcagctggggctccccgacgtcggctgctgcgactgctgcgtccacttctgctgcgagccgtgcgcgctctgccagcagtacagggagctcagggcacgcggcttggaccccgcgctcggctgggacgtcaacgcccagaaggcggccaataataacgccggcgccggcatgacgatgtacccgccgacggcgcaggggatgggccgctaattacgctaccagctccatcggtaaactcatatgttgttgtgttgtgtcagccagatcatcgcgtacgtacgggtatacttgtgatatgtaatgtcagggaccggcatgcccatgtgtttcaagatatttcacgttcaagtcctttctgtccgctcactatccgaatgaaaaccattttccttgaaaaaaaaaaaaaaaatct

SEQ ID NO: 815 - DNA, 1960 bp, Zea mays
  misc_feature (812)..(812): n is a, c, g, or t
cgtgtaggacatccatctttccactcacagctatcattccagtattggaagctaaaatctctttctctttccactccacatgttcgaagattgcattgcagtaataagtttgtctatgaagagctaatctaattgtattagtttctataatggatttcttatgtggaatactaatggatagggcctcgttgctaagtgctacaagatctagtgcactggaactcgtggttatggacccgaatcctttagtatggaacattgtcttttccaagtaaaaacccctagtatatgaaagaatgaaaaggtgctttcgttcttgtggaataagaagccctcgtaccttaatgaaaggaaaataggaatttttcgttaggtatttgaccaaataggattgtccagttcctatagaacctatcactaaaatacccgatagggctaagcggaacgaaaagggttttccatgagatggtaaatgaaaacgattagccccacacgaggtttgggaataagtgattgtctgataatgagcaaggaatatacgtctttctgctaaagagaatctattaaactcataattcattagatccttgttagcaatgtcaactaggtatcataagtaaatggatctcggttgttcaatcctttgataaccaaggtcattctttgctaaagagaaatgatcactatgggtcagactcaatagaattggatccattccaaatagcgagaattaggattcttgatccctctcagtctctctttcaattcgaggatccggagaggtgttttcatagtcatctccgaatatttgncatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaacgggaacggtctattggaattggctctctatccatggaatctcatccatcatccatacataacgaattcctcggggccggccgggccgggacccaagagcaataagaactcgaattcttatcgatactggaactcagagcataggggggaaagtcgatttatggatggaatcaaatacgcagtatttacagaaaagagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaaccgggttattctattccacttctagatagagaaacgaactaaaggagaatacttaataatatggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcataaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagt

SEQ ID NO: 816 - DNA, 980 bp, Zea mays
gatgatccctgttaagcatccatggctgaatggttaaagcgcccaactcataattggtaaatttgcgggttcaattcctgctggatgcacgcgaacgggaacggtctattggaattggctctctatccatggaatctcatccatcatccatacataacgaattggtatggtatattcataccataacataagaacaataagaactcgaattcttatcgatactggaactcagacggggggaaagtcgatacgataatggaatcaaatacgcagtatttgcagaaaagagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaactgggtattctattccacttctactttttaaattaaagggtattctgaaagaggtatttcttgtattttcacaatagctttcttttgaatccaatttcgagttcgattagaaggatagaaaggcgatgagaatgggaaaagaaaaataaaatattttattttaatgagttccccttttgagttccccttttttgcaattttcttattatcaattccattcatttattttatagaatacttttttattctatatctataaaaaatctttattttgtaaactaaaaaatacaatagtcaatattccttataatagatatacttaattatatcataagaatcttaagatatatttcgaatagatagaaatagtaaatttgaattgagacacatattctatgacagattttaacttaccctctattttccgtccctttagtagggcttagtatttccggcaattgcaatgacttccttatttcttttatgtgc

SEQ ID NO: 817 - DNA, 715 bp, Zea mays
atgagacaaatgtatgcatttgtcccatagtgtatgagacaaatgtatgcatttcgattagggtcgtattctatggttatgatgagaagagatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagttaagcagtggtaattaagacccccgggtgaaaatagggatgtctcctacgttacccataatatgtggaagtatcgacgtaatttcatagagtcattcgatctgaatgctacatgaagaacataagccagatgacggaacgcggagacctaggatgtagaagatcataacatgagcgattcggcggatttggattccttttctatatatccactcatgtggtac

SEQ ID NO: 818 - DNA, 1890 bp, Zea mays
cattgggtacctcgaggccggccgaaattccacccctcgccgccatctccgtctctctctctcccgcaaccaagcagttcaactcacacccgaagcggcgccgctagggtttgctccgacagccgcgaaacctagtccttactgcgccctcccacagaggccgtcattcactaatctagctgctacgcttcgcttcccgctccgattgggagctagggtttagcttatctccgagctcagcttcgggtcgcggcacgcggcatggcggggtacggggaagagaaccagaacgccatgaacgggtacgaggaggaagaggaggaagaagaggttgaagaagtcgaggaggtgtacgaagaggaggaggagggggacggggagggggaaggagacgagggggcagccgccgaggcagcagcgatggcggccgagacgagaagtgtcgatggaggccggggcctagcggaggccgttgggaatgttgatgccggaggcgaggatgagagggatgcagattctagcggcggtgacgcttcggggaaggttttcgtagggggtgtagcctgggagacaactgaagaaacattcacaaagcattttcagaagtatggagctataactgattctgtgatcatgaaggacaagcatactaggatgcctcgtggatttggatttgttacattttccgatccgtctgtgcttgacagggttctagaggatgaacatgtcatagatggaaggacggttgaagtcaaaaggactgttccaaaagagctgtcgtcgaaagatggccctaagacaaaaaagatctttgtgggtggtatcccaccatctcttactgaagataaattaaaggagcacttctcatcgtacgggaaggtggttgagcatcagattatgcttgatcatagcactggacgttcacggggctttggatttgtcacatttgaaagcgaggatgctgttgaaagggttatgtcagaggggagaatgcatgatcttggagggaagcaggttgaaattaagaaagctgaaccaaagaaacctggcgctggtgattcaagctcaaacggaagacacagccgtggtggtggtcatcgtgattcataccgtggtagtggtgtttctgtgaacagcggtggcggctatggatatggtggtggttaccgatcagctgctgcagcatattatggcagcacagcatatggtgcctatggcagagggtatggatatggtgctacttctggctatggctcaggttatggctctgcatatggtggctccatgtatggaggtccatatggtgcctacgggtcatatggtggtgcctatggaggtggtgcgtatggtgctccaggagggtatggtgggggaggatatggcagctacggtggtgctggaggcatgggtgggggtggcagcgctggtggtcggggctccagcagataccacccttatgggaaatgatcatccattctgtgtttctctaggatctgataataaagccatacctttcctcgtttctgctactgagaaaatggaacattccattcgtcttgttgaatcagcggcatctggacatttttttccttggaacttgcattgcacatcaacgattctatagtctatagtcgctgaaccctgaaccgcccccaccccgagctttctgtagaagctgcagctgaaattctcgtagtctggcatgagccttagaatgcccttgaaactattatctttgtggtagtaacattatggtgtaatggaacagatgtacgttgttgtaacattcactcactgatcagagacttgctatctctacatatgtggagagaagctttgcaaatgattgactgatactattgggccaaaaaaaaaaaaaaactcgagagt

SEQ ID NO: 819 - DNA, 1952 bp, Zea mays
acgaaagctactagcaacatctggttccactctcgccggcatctcccccacccatccccaagtccagcacacacccgaagcgccgccgctagggtttggtccgacagccgcgaaacctagactttactgctccgacaggctgccattcactaatctagctagctccggttgggagctagggtttagctgagcttcgggtcgcggcggtgcggcatggcggggtacggggaagagaaccagaacaccatgagcgggtacgaggaagaggaggaagaagaggttgaagaagtcgaggaggtgtacgaggaggaggaggaggaggaggaggaggaggaggaggaggacggggagggggaagcggacgagggggctgtagcctccgagccagcggcgatggcggccgagacgagaagcgttgttggaggccggggcttagcgaaggccgttgggaatgttgataccggtggcgaggatgggagggatgcagattccagtggcggtgacgcctcggggaagattttcgtagggggtgtagcttgggagacaactgaagaaacattcacaaagcattttcagaagtatggagctataactgattctgtgatcatgaaggacaagcatactaggatgcctcgcggatttggatttgttacattttccgatccatctgtgcttgacagggttctagaggatgaacatgtcatagatggaagaacagttgaagtcaaaaggactgttccaaaagaggaaatgtcatcgaaagacggtcctaagacaaaaaagatctttgtgggtggtattccaccatctcttaccgaagataaattaaaggagcacttctcatcgtatgggaaggtggttgagcatcagattatgcttgaccatagcactggacgctcacgtggctttggatttgtcacatttgaaagcgaggatgctgttgaaagggttatgtcagaggggagaatgcatgatcttggagggaaacaggttgaaattaagaaagctgaaccaaaaaaacctggtgtgggtgattcaagctcaaatggaagacacagtcgtggtggtggtcatcgtgattcataccgtggtagtggtggcaatggcttttctgggaacagcagtggtggtggctatggatacagtggtggctaccgatcaactgctgcagcacattatggcagcacagcatatggtgcctatggcagagggtatggatacggtggtactgctggctatggcttaggttatggctctgcatatggtggctccatgtatggaggtccatatggtgcctacgcggcatatggtggtgcctatggaggtggtgcatatggtgctccaggagggtatggcgcgggaggatatggcagctacggtggggctggaggcatgggtggtggtggcagcgctggtggtcggggctccagcagataccacccttatggaaaatgataatccattcactgcctttgccttcctctaggatctgataataaagctatacattcccaccgagaaaatggaacattccattcaccttgttgaatcagcggcatctgaacatttttttcctggaacaaagattctagtctgtagtcgctgaaccctgaactgcctcatcccacccccaccccctgagctttctgtagaaggtgcagctcaaattctcgtaggcatgagccttagaagacccttgaaactacaagctttgtggtaacaatatggtgtcatggaacatatgtattttgatgtaaaacattcgctcactgaccagtgacttcgccatctctgcttatgtatgtagagaagcttagcaaaggattggactgatactattgaattgtgtgggtttctatttgtctcctaaaaaaaaaaaacacgtgttatctcgttgcaaaaaaaaaaaaaaaaaaaaaaaaaaaaaagtactctgcgttgttaccactgct

SEQ ID NO: 820 - DNA, 1191 bp, Zea mays
attgggacctcgaggccggccctcccgtgcccggtagtgtaaatagaagataggcgacgaacacgaagcaagcaaggcagccgaatcccaactcctgtgtgtgcctgccaacgcctcgtcggccgccgccgccgctgcttcgcccctctccgccagccgctcccgctcggagcacgccgccgccgacgtgggcgcgcaccgacggccgtcgtgtcgcatggatatggcccccgcggccgtctcctccaacccgcgctcggtcgaggaaatcttcaaagacttctccggtcggcgcgcggggctcgtccgcgccctcacctccgatgtggacgatttctgcagcttctgcgacccagataaggagaacttgtgtctctacggccttcccaacggtagctgggaggtctcgccgccggcggacgaggttcctccggagttgcccgagccggcgctcggcatcaactttgcgcgcgacggcatgcagcgccgcgactggctctcactcgtcgcggtccactctgactcgtggctcatctcagtcgccttcttctacggcgcccgcctcaacgccaacgaccggaagcgcttattcagcatgatcagtgatcttccttctgtctttgaagcatttgcggacaggaaacacgtcagggataggtctggcgttgatagcagcggcaagtccaggcactcatcaaagagaggaaacgatggccatgcgaagaactccagggcagcagctcctgctgccaaagagtacgacgacgacgatgacgaggaggacgaggaacacacggaaaccttttgtggaagctgcggcggcctctacaacgcgaacgagttctggatcggctgcgacatctgcgagcggtggttccacggcaagtgcgtgcggatcacccctgccaaagcggaccacataaagcactacaagtgcccggactgcagctcgaagaaaataaggcagtaggtcccagtgtgcaccgccggccatcgctgacctgtctgatcccaaaccatactccattgcttgcctgccttgccccaaggtcgcagctagcagatgcgcattccttcatttgtggggggttgttgtgtgatggatagcctggtaggaagaggcaaaggactgatatataatgactcgtttattgttcaaaaaaaaacaaaaaaaaaaaaaaaaaagcggcc

SEQ ID NO: 821 - DNA, 774 bp, Zea mays
gtacatctacattcaagaatgatccttgagggtaagtccccattcttgatttcagtcacgatagcatttatcagaggcatgcagacctctgcaggcaccttgaggtcattaacactgctccgacccacaaccctttaaacacctaaggacaaccaatggagccctctggctcctgcagcactcaggtcattaaccctgctccgacccgcaacccaatcatatgacatagctattgcaggaatcccatataagaatgcctccctagcaccagcaactgttccagaataaatgacatggtacccacaattatttccaatgttgattccactaagtaccagatcaggaaccaaaccatcaaatagttttccagagatgcctaaagaagcacagtcagcaggagttcctgaaactccaaatgctgtagcacctattatatcaacacgtttacagcggagtgcagggcgccatgtgatgcagtggctcacacccgatttgtctgtgtcgggcgcgcagacgagtacgcggtatcgccctgcggcgacgagacggtcgacaaggaagcggagccccggcgcgtcgattccgtcgtcgttcgtcaccagcagcaccggcgccggcgccgcagccgcggccgcggtagcagcagcagtggtggagtccatgcgagactgcgagcgcagcatggggcgtttccgttcgtgcgtagggatgtgaatgaggaattcccgttggggaagagtcggaagactccccgtctccgcagcgacaaaaagt

SEQ ID NO: 822 - DNA, 1167 bp, Zea mays
ggggtaccccccgggccggccgggcgtcggcgcgtcgcatggatatggcccccgcgtctgtctacttcaatccgcgctcggtcgaggaaatcttcaaggacttctccggccgccgcgcggggctcgtccgcgccctcacctccgatgtggacgatttctgcagcttgtgcgacccaggtgagtgagatcgatccgcggcgagctcttcgctgcggtgcgtgcgtgcgtagagtggtggatccgggcggggaatgagcggatcgccgtttccttttcctgcgtgcagataaggataatttgtgtctctacggccttcccaacgggagctgggaggtgtcgccgccggcggaggaggttcctccggagttgcccgagccggcgctcggcatcaactttgcgcgcgacggcatgcagcgccgcgactggctcacactcgtcgccgtccactctgactcgtggctcatctccgtcgcattcttctacggtgcccgcctcaacggcaacgaccggaagcgcttgttcagcatgatgagtgatcttccttccgtcttagaagcattcgcggacaggaaacacggcagggataggtctggggttgatagcagcggcaagtccagacactcatcaaagagaggaaaagatggccatgccaagagtttcagggcagcagctcctgccgccaaggagtatgacgaagacgatgacgaggaagacgaggaggagcacacggagaccttttgcggaagctgcggcggcctttacaacgcgagcgagttctggatcggctgcgacatctgcgagcggtggttccacggcaagtgcgtgcggatcacccctgcgaaagcggatcacataaagcactacaagtgcccggactgcagctcgaagaagatgaggcagtaggtgtaggtccccgcgtgatctgactgacccgtgtgatctgatccaaaccataactccctccgtttgtttgtctcaaggtcgcagctagcagatgtgaattccttcatttgtggggcttgtttatgtggtggtaggaagaggcaaaggactgatagatagagatacatgaccgttttcttttatatatattcgttgttcaccgttttgcctgcttcgtcgcagtccaaaaaaaaaaaaaaaaaaactcgagggggggcccggtac

SEQ ID NO: 823 - DNA, 4598 bp, Zea mays
  misc_feature (3074)..(3074): n is a, c, g, or t
gtgtttttgccatagttttgttgagacatctgaattcgagctttatatctgaaattgctagtcggtgtgtgatttgtgatgaaccaagcagcgccggtgctacgactgatgggaacctgcttacctgccactgtcgaacttaacacctgtttttttgactgttcgtccacctgaagatctgaaccgctgatgtgcggattgacgtctgtgcgttgctggtgcgattatgctcccggtctcgggtagtatccatgcgggccagggaaaacggatggggattcccccaaccagtttcaaatgctattttaatccaaaattaaaaacggcaacggaataaaaaaacccaatagtaacggcatgaaggtaaacgatataatcggttgggtaattaaaattaggaatatctttgcatttaaccactctaaatacatcattacgacattacctacaaacttaatatattaattattatatataagtttcaacatgcatgataattcatcatttcaagatgccatgaccatacgacaacggctcaacaacaatagcacagtttaacaaacaagtttataaattacaatcataaataagttcctaactatcaagccatagcatgaggagatagtagttcataaatttaaaaacaacatcaataaatgtgtctcgactgcagtaacaaacgcaaaaacaataatctatggttcgtgggcttgaatgcttggatacgtttaattttctatacaaataacacgagaaataccaagtctagatcatttgtatggggttttggatcgagtgtggttggtgggcatgaacggatgtgtttaattacttatacaaataaaacagaaaatatcgacatgattttcgtgtatagatacagaattcgtaaatacggccggaaaactggctcaaccgtcttctttctcgttactaccactttctctcgagaattttctcatttatattttttcgaatataacatgtcgatttttacagcgtacgacatttttctatcctgttgctaatccgggcgaactagcaaagcagtgcaaatctggaaaccgcgacctgatcgcagaacgccagaacaggaggctcgggcccgtaccgtaccgcatccctatcattgccaggtcagcagcctatccgggtccgtcttccctaggccatacctacctgtcccctactcgcactccacgaatctcacctccacgtgggccacaccgaatctcacgctcttggcccgcggtgtcagtgccagggccccacaaggcggcatcgcctcgcgggccgccaggcccaggcgtggcgtgaccgaaactaaggaacccttttgtctcggccgggcgccccggtgtgcaaaaagattggcgacgaagcaaggaacgcaccccgaatcccaactcctgtgtccgccatcgcctcgtggcggtcgctcctgctcctgctgctgctgctgctcccccagccgcccccgcccggagcacgccgccggcgccgacgccggcgcgtcgcatggatatggcccccgcgtctgtctacttcaacccgcgctcggtcgaggaaatcttcaaggacttctccggccgccgcgcggggctcgtccgcgccctcacctccggtaacgaccgctctcccctcgccgccgcgctcttgagacccgcgcagatctaacgaacgcttgtctctcgcgtcgttgccggtgcagatgtggacgatttctgcagattgtgcgacccaggtgagtgagatcgatccgcggcgagctcttcgctgcggtgcgtgcgtgcgtgcgtagagtggtggatccgggcggggaatgagcggatcgccgtttccttttcctgcgtgcagataaggagaatttgtgtctctacggccttcccaacgggagctgggaggtgtcgccgccggcggaggaggttcctccggagttgcccgagccggcgctcggcatcaactttgcgcgcgacggcatgcagcgccgcgactggctcacactcgtcgccgtccactctgactcgtggctcatctccgtcgcattcttctacggtgcccgcctcaacggcaacgaccggtaccaattctgttctgcgacacacgctgggttcgattcgacttttcagtcagttgtctggtgttggctgaggtcgtggaatgcttgttctcagattcactcctcgaacgtgtggtttcgttaacttcattgtttgccccccttttttttctctgggtgaattagctgtttgattgttaggtgactgggacactttggggatgctcgtgtttatgatctatatttattttgtttcacttggtgcatgtgtttgcatgtgaacatgtttattgtgctcctctttttggttcgcttgagtgaattgagggtcatgctttagggatgagttcgctttatctgtacttttgcggggctgttctcttttctttttgtttctgtttatgctgcttgagtgcatgactgcatggtgcaatcagaatcgtcagcctctatatttcataattacgcatttcatagagctccgttctcttagtagtactgcggagatcatgggtccgtttgtttgttaaggggtttccagactattggacccttttccactttattattacagaaaatcatgtgccagtggttgggatcttgtgcctctttttttctcaaatttatattttttcctgctagtcgtgtttaaattcctttgcttttcttgagtactacctcctccgttttagaatatttgttgtccactagtttatttttaaactaaaacacgataaataaaaaagaatggaagctatatttaataatttttagtcttttagcaaaatgtttgttttttctctcacattaatatcctaagaatttacttctaagtgcctactttgtggaggttgaggtttatgtatttcaacatccttctatgtttgattggattgcggatttgcgcttgttcttctttctagcacagttttcctttatgagaactacagcgagaatactatgaatcattagtcctttgcattccttttctatatggtgctctatgcaattgatnccagacaattcagtttctggggggttttccaaaactttcaatttgccttctgttcttgggaccttacttgttcatctgtccacctgaaaacaaaatgaaattcccttaacttacactttcggaaggcttagatcatacgtagttgataagtcatcatttgttccaccgtaggtgtagaaaagctaattagacatttggactcttttgtctctgtagtctgtacatccccacccctgcttattcacgtgcatttgaactggcaattcttctgtttgcattgaagccatgtttgtagtagtaagatactattaaagatcacggctggaatactggttgcgagagaaggaaatgtttttgttttcactgaattgatgcagcctctgattcgattatttgttcttttttttgttatctctcaggaagcgcttgttcagcatgatgagtgatcttccttccgtcttagaagcattcgcggacaggaaacacggcagagataggtctggggttgatagcagcggcaagtccagacactcatcaaaggtgcccacatgaatctttctttcgctccagtctgtgtttggttctgcctccagttcgtgtagaaaaccttactcagaacgagttgcgtctttctttctattctcgctcagagaggaaaagatggccatgccaagagtttcagggcagcagctcctgccgccaaggagtatgacgaagacgatgacgaggaagacgaggaggagcacacggagaccttttgcggaagctgcggcggcctttacaacgcgagcgagttctggatcggctgcgacatctgcgagcggtggttccacggcaagtgcgtgcggatcacccctgcgaaagcggatcacataaagcactacaagtgcccggactgcagcccggcgaggatgaggcagtaggtgtaggtccccgcgtgatctgactgacccgtgtgatctgatccaaaccataactccctccgtttgtttgtctcaaggtcgcagctagcagatgtgaattccttcatttgtggggcttgtttatgtggtggtaggaagaggcaaaggactgatagatagagatacatgaccgttttcttttatatatattcgttgttcaccgttttgcctgcttcgtcgcagtcctatcgctgtgtgaaggcatgaactgatgagtgggttgttcactcaatagttgataaagaatttcatcggtttcatgtcatcaaaaaagcatgtacgacaacttataaaatacaaacgaaactataatgaatctctcacaaagactggtcacatgagcacatttggtgtgagactaacattgcattgtgtatgatcttattaagcatatcatatatatatctctactacttattaagttagcaatagtagcctgcctttttgtgttctgccttccgacgatctcaaccgtctgttctctctcgcctccattttgatcgtccgtcggatgctgcccacgcgcgcgtgcgtctcccactctccctgctcgtcacccacc

SEQ ID NO: 824 - DNA, 3401 bp, Zea mays
  misc_feature (3248)..(3248): n is a, c, g, or t
tgcagcttctgcgacccaggtgagtgagatcaatccgcggccagctctcgcgcggtgcgtgcgtcgggtggtggatccgggcggggaatgagcggatcggcgtttcctttgtcctgcgtgcagataaggagaacttgtgtctctacggccttcccaacggtagctgggaggtctcgccgccggcggacgaggttcctccggagttgcccgagccggcgctcggcatcaactttgcgcgcgacggcatgcagcgccgcgactggctctcactcgtcgcggtccactctgactcgtggctcatctcagtcgccttcttctacggcgcccgcctcaacgccaacgaccggtaccaattctgtcctgtagcacacgctggatgctattcgctttttcaatcagttgcctggtgttgactgagagcgtagagtgcttgttcttagattcattcctcgaacatttggttttgttaacttcattgtttgccttttattttggtgaattagttgtttgattgttaggtgactgggatactctgaggttgttcgtgtttatggtctacagtattttttcccttggcgcatgtgtttgcatgtgcacatgtttattgtgctcctctttttgtttcatttgagtgaattggggaggtcatgctttgggaatgagttcgctttatctccctttgcacgctgttctcttttctttttgtttctgttcatgctgcatgactgcatggtgcagtgagaatcatcagtctttatatttcataatggtccttgtcttactgctccgttctccgagtagtactgcggagatcatggatccatctgtttattatgggagtgccaaacaattggttccttttccactttattattaccgaaaatcatgtggagcagttgaggatctatcttgctctagaactgcatgttccattgcttataagaattctgaagtcaatcgtatttttgctttgtggggaacaatgccacggtttagaagagaggttaaagagacatccctcagcacctgtatttattgctgggccatttacaactgcatccgatcatcttagtgaatccttcaatctttgattgcaactctaaactcttgctgggtgtactaaaatgttacagcttgtttgctagtgcaaatgttttatgcttgcctagaaatgattttagctaattggcaaggtggggaaccatatgcataatttagttacgatgtgttcatttttatagtcagggttgcccaaacaattgtgtgccaatatactaatctgcagatattttgagcattttaaatacatagcggtattataagtgagatgtctagagtcatggcaaacaagggcagtatattagtggcatctatttatgcttttttctgaattttttattttttttcttgctacactagtatttaaattcctttgcttttcttgattatgtaatggttttttagtgtttaagtaaaacctttgttttttcatctaattatatcatttctgcatctcatattaatattttgctgaccgttatgtagtatttaatcctaagtgcctactttgtggaggttgaggtttatgtatttcaacagccttcgctgaatctctattgattagattgctgatttgcacttgttgttctttctatcacaagttttagttgatgagaatgacagcgagaatattatgcataattactcctctgcattccttttctatatactgctttatgcagttcaacctagataattttcagttccaagagatttttcaaaacttcgaatttggcttttgttcttgagaccttatttgttcatctctgcacctgaaggtataatgaacttcaacactttaggaagggttagacgataggtcttagtttttaagtcatcatttgtttcaccgtaggcctgtcctgtcttttgataatgggttatagattctgagttccatcacttcctcttttgagggacacgttgttggacctcagtgttctggtacccagcttatggtctcactgttgtttggatatgatgtccagagggtgttattctgacaaggctgggatactggttgccagagaaggaaatgttttttccctaattattgacaactgaagcaggctctgatttcattatttgctcttttttttttatctcaggaagcgcttattcagcatgatcagtgatcttccttctgtctttgaagcatttgcggacaggaaacacgtcagggataggtctggcgttgatagcagcggcaagtccaggcactcatcaaaggtgccacattaatccttccaatagtttggttttgctccactttatatacaaaaatcttactcagaacgagttgcttctttgcagcggcaagtccaggcactcatcaaagagaggaaacgatggccatgcgaagaactccagggcagcagctcctgctgccaaagagtacgacgacgacgatgacgaggaggacgaggaacacacggaaaccttttgtggaagctgcggcggcctctacaacgcgaacgagttctggatcggctgcgacatctgcgagcggtggttccacgggaagtgcgtgcggatcacccctgccaaagcggaccacataaagcactacaagtgcccggactgcagctcgaagaaaataaggcagtaggtcccagtgtgcaccgccggccatcgctgacctgtctgatcccaaaccatactccattgcttgcctgccttgccccaaggtcgcagctagcagatgcgaattccttcatttgtggggggttgttgtgtgatggatagcctggtaggaagaggcaaaggactgatatataatgactcgtttattgttcatctttttgcctgcttcgtcggtcgtcgcagtcgttgtggctgcatgaactgatgagtggtttgttcgtgctagttgtaggctgtttcactgatttgcgtgcgtatgtggactgtcctgtcaaatttgtaggcctgaaaccgtacttccatttacgtggctacgcgagctgatttgccggtctgcctctcccatctgtatcctggacatggcagtatggtcacgaagtccagatggcgatatgcctgactgccggtaacggagggcagctgtggtgtagtatatctcagtcacatgggaggcgttagataatttttgaccaaatgttataaaataagacactattaaatagtttttttatatagaaccttatattttaatttaagatactagnttaagatattgttggagattctaattcaattccttttgtaccaccgaggaaaaggagcagccctcgtgcgtagagacggcaatggttacccgatacctgatgggtatttactccattagcatgtgtatgttagctaaatattctacccgtggg

SEQ ID NO: 825 - DNA, 1354 bp, Zea mays
ttttttttttttttttaattttttttttttttttttgtgaatgcataattctgacataggctatgaagcagaatacacatgctgattgcagtaataacattcaggtagcaagaatggcaatattgcccatgtatggtaacaatgttatggggtaggaaaaagcaatgtggaacttgatcatggcgataaataaacagctttagaaatttcatggctcatcctctgcttctagaaaaagaagagccaggagaagagaaattatcaaccagacgtgagacacaagctttgaaatagggtatggcgtctggttctgtgcgggaaagagcacccaaaggagtaacagtgatatatccatcaactagggaattgtggtccgtttcctctccttccactccattggaacttctccctacaatcactctcttaaacagtaggtcattttctgaagtaactagttcgctatccttttcaccatcaacatccatgtttgctgtctggtaactttctactgcaggcttcttgtaaaccgtctgctcccaactaattctggccatatatgttccttgttttgtaattttgtagcccttgtggtgcgcagcatctgtaggtacatctacattcaagaatgatccttgagggtaagtcccattcttgatctcagtcacgatagcatttatcagaggcatgcagacctctgcagacaccttgaggtcattaacactgctccgacccgcaacccaatcatatgacatagctattgcaggaatcccgtataagaatgcctccctagcaccagcaactgttccagaataaatgacatggtacccacaattatttccaatgttgattccactaagtaccagatcaggaaccaaaccatcaaatagttttccagagatgcctaaagaagcacagtcagcaggagttcctgaaactccaaatgctgtagcacctattatatcaacacgtttacagcggagtgcagggcgccatgtgatgcagtggctcacacccgatttgtctgtgtcgggcgcgcagacgagtacgcggtatcgccctgcggcgacgagacggtcgacaaggaagcggagccccggcgcgtcgattccgtcgtcgttcgtcaccagcagcaccggtgccggcgccgccgccgcggtagcagcagcagtggtggactccatgcgagactgcgagcgcagcacggggcgtttccgttcgtgcgtagggatgtgagtgaggaattcccgttggggaagagtcggaagactccccgtctccgcagcgacaaaaaagtaccagtcgccgtccccgcgaacaaccaccacgttcccacatggggaatttttttttcggt

SEQ ID NO: 826 - DNA, 1144 bp, Zea mays
aaaaagattggcgacgaagcaaggaacgcaccccgaatcccaactcctgtgtccgccatcgcctcgtggcggtcgctcctgctcctgctgctgctgctgctcccccagccgctcccgcccggagcacgccgccggcgccgacgccggcgcgtcgcatggatatggcccccgcgtctgtctacttcaatccgcgctcggtcgaggaaatcttcaaggacttctccggccgccgcgcggggctcgtccgcgccctcacctccgatgtggacgatttctgcagcttgtgcgacccagataaggagaatttgtgtctctacggccttcccaacgggagctgggaggtgtcgccgccggcggaggaggttcctccggagttgcccgagccggcgctcggcatcaactttgcgcgcgacggcatgcagcgccgcgactggctcacactcgtcgccgtccactctgactcgtggctcatctccgtcgcattcttctacggtgcccgcctcaacggcaacgaccggaagcgcttgttcagcatgatgagtgatcttccttccgtcttagaagcattcgcggacaggaaacacggcagggataggtctggggttgatagcagcggcaagtccagacactcatcaaagagaggaaaagatggccatgccaagagttccagggcagcagctcctgccgccaaggagtatgacgaagacgacgacgaggaagacgaggaggagcacacggagaccttctgcggaagctgcggcgggctttacaacgcgagcgagttctggatcggctgcgacatctgcgagcggtggttccacggcaagtgcgtgcggatcacccctgcgaaagcggatcacataaagcactacaagtgcccggactgcagctcgaagaagatgaggcagtaggtgtaggtccccgcgtgatctgactgacccgtcgctgacccgtgtgatctgatccaaaccataactcctccgtttgtttgtctcaaggtcgcagctagcagatgtgaattccttcatttgtgggcttgtttatgtggtggtaggaagaggcaaaggactgatagatagagatacatgaccgttttcttttatatatattcgttgttaaaaaaaaaaaaaaaaaacggcacgag

SEQ ID NO: 827 - DNA, 1966 bp, Zea mays
actgcccttcacttttcaagagtaagctcatattttttggactggcaagcataaatcctgaatacatgaagtcttaccatggcaattcttatccaagtttgtgtgagtctgtatagttctcttgcgtttttccgaaaatactgacaatattagttctcctgcgttttttcgagaaaaaaaaagtctgtatagattacttgctctgcatatacaaatgcatggttttatttttctgatatgaagttatgaacaacataactttctgaaatccccttgtgcatacttttgggaggtacaagagataaccaatcaatgataggagtagcaaaaatactgaggttctgtgctagtatctattcagtgatttgatgcgtttgaggtatagtgataccatgtggctcataatattatgttgttaagcagagttaaaatttatttgcctgttgattttgacccactgtttatttcaaacttttattgcgttgaaaattgtgaggctttggatccactattttttcatgctcttgttgcgttgagaattttgggacttccgtagcaatgcacaggcatctgccttctattaaaacaaaaacttgtcataccgaaaacacctgtaaacattgcatggaaacattaattgataaattttgcttctcaaggccaaacttgtatttcctatttcttaaattctttaccgcaaatttagcacccacaattttcataccaatgcaatgatcaagagggaaaacatcaactaagcggtcatctgctgcagacacatccagaaatttacgaaagcaaaaggaaatattgtaactcatttagagaataagtgaaaccgatagaaacatgttattccaaattcctctgattcgtcttctgggcgagaatgccagaaagagaaaaggataaaaaaatcccagcacaattctagttctttttcctagcctactacgtcctctcggggtaaatcccgtgatccttccgcagaatctacgcaaggcaccgaccaatcaaccaaacaagcaggaaaccgcaagggagcgagtagcagataagggagggatcgcggggcctcgcaccccgatttgtctgtgtcgggcgcgcagacgagtacgcggttatcgcctgcggcgacgagacggtcgacaaggaagcggagccccggcgcgtcgattccgtcgtcgttcgtcaccagcagcaccggcgccggccccgcagccgcggccgcggtagcagcagcagtggtggagtccatgcgagactgcgagcgcagcatggggcgtttccgttcgtgcgtagggatgtgaatgaggaattccgttggggaagagtcggtagactccccgtctccgcagcgacaaaaagtaccagtcgccgtccccgcgaacaaaaagtaccagtcgccgtccataatgggattttttttccgtagcgaatatgtccctggaataaaatatgtaaagttattagggtgtttggttgcactttctatatcttaccaattagtgctagtttgagagaaaaagaaaaacggactaaattgagaggctagaatcacattcttatttaattttaaataaaaaaagttttagtctctctaatctgtttcggtttgtagacttccaaactaatccttaggttatccgaaatattcggtttgggtaattcaggtgaatgaaaattcaggtattaaaaaatgttatctgatttttgttttaaaaaagtattacccacgattttggttacatgatatttcgggttcagattcatgttttacttgatatacccaaaattgacaaattcaaccatttttaaaaattctagtagcatttaaagcaacaaacaaatgtttttaaatcatatcatgtcttcatattaattaacaacaaaacaattattaagttagcataaatctatattgatttgttccagtaaatatatttatattgcatcaaaccacttc

SEQ ID NO: 828 - DNA, 1377 bp, Zea mays
ccacattatatatcctttagttgagtttccagatctagcattcagtgcttaagttctttacaaagcacaaagttagtaacccaggacaagtttggaacatacttttcatattataagacttgctgttgtcaggttctgaggcggctgaagaaggtacgtcctggagtacagcaggtcagtaagcgtccagaagaatctggtcagctacgtaggccccccccccatatgagcccgagctcaaatcatgcctcttcggatgatgaaatagacatggctcccctattcttgaggataaagcggcggcagttggaaaaccaagatgttacaagtcgtggcgcgagatcacagtcatacccatcttccagtggttctcgagaagagtttgtggaaagaagtagagatgctgcagcagagcttcgtccaaaacgagtgaaaatccggctaccttctagtgccagtaggcagattgagcagcagcgcagttcggggcagcgatttgcaagggaggacaagttgccgcttgcattttagggaatcacaggtactaacctctactgggcagacgaattctttgtttaagtgcattgttaactacaaaacgaggtggcagaagagagtgggagggatcaggttgtgattgtggcagagctgatttggttagcacaggtgcagactgactttagaattggcagcaaagggaagtggctggctaatcgattcttttgtgcagcagggcctccaatttgaggcctctgggggcacgcttaggagacacacacgtgacaatattctcgttgctcgaggttctgtgtcactgccggtggctctttgatgcctggttatcagtgacagaaattgaggagaacctcgctacttcgatttctctgcaagtgtttagagcatgtagctagcttagctgtatatctctcactgtacctacggtctttcctattttttttgtaatttcctgtaaacaggcatagctgctacagtatggctaactctctattcttttgttggtttagcctggcgctgcttagcattttcaattaaatcgagattcgtttccttttaaaaaaaaaaaaaaaaaatctcgtgttgctgctctcaattgtgtggaatgttctgttatgttggcatggttagagatgacaatggggaccttatccccaaatccctgcggggaattcttccattagggttagtttgggagataaaattctagaggagattggaggggctaaattctttttaatcaaaattgaataagaaggagatttttagcccattcaatcccctcctattgaggtcttctggctatcggaggcgatggagcgaagggccacactgtttgagggggctcgctgcggcgtcgcg

SEQ ID NO: 829 - DNA, 886 bp, Zea mays
cacctgctctctctcgggcgctctcggtgtcggccatggaggccgcaagcaatcaggagccagggagatgcgacggcgacggcgacggcgacgacgaggcaaagaggagggaggcagcgcttgcgtcaagcaggctcctcgacccggggttcaagccctccaaactatcccaggaccgtctcgacaagtttaaggaattacacaagaaacggttacagataactgaaaagccgaagtataaaagaaaatcgaaaggaaccactgagagaagtatcaaagtaaccagcaattataaattcactgataaggatacatctgctgatagttctccaagagatgtgcatcatatgtcatcagttacaggaattcaaggggatcctgcatcaggcctgtcctcgaggaacaaaaggaaactacattgggggcttgacattaaagaacgatgggaaagaaaggcaaacatgtaaaaatatctgaagatccaacaacaaaagcatatccacaccgcactcatttgaaatttgaaagctgagggacaaaacaaagcggccgaccttttccacggatcatcatgttgctggtaaaggtttgtcagctagcagaactgatcagtaagctagtatctaatttttcagtgttttgtctaacgttttctccagacgtttggttgggactttgctctgttgtattgtccgatccaaacttgcaaagttcaagtgcgatgataatttgtttattgctgtgtgatatagtttgggtttgtttgtcctctttttgtgtgagaaaaggtactgatggtgcaacacaggcccatgtgcacaatggaacatagttgttgctgatgatactagtgtatatagaagattatttctcatatgcttctcgc

SEQ ID NO: 830 - DNA, 2429 bp, Zea mays
aacaattcgcccttactactatagggctcgagcggccgcccgggcaggtgccaccactaccagcctgcccgggccccccccgcgccccccggcccagcgcaccatccgcgcctcttctcttctcttctcctccccaaggccaagccccagccccagctaccgcgccccctcctgtctgttccaattccaccagcgtcggcctagctacctggccgtcccctctccgagtacggtcggaagcctcagctgaaggatctggacgacgggacaggttctgtttggtcttcataaagtagagcactagctagaagacatattcacacgcatcagctatcaaattgcaagcttagaattgacctcaaagttgggacatgcttgtcttaccagaagcaactgatagcttggagttgtagtccgtccggactgtctgctggaccagtatggctgacactccaacttcccgcatggtgcacccctttggcgacgtcccaaggcagactcccaagcaattcctgtattctggtaacccgcagcacctctgccatccgtaccagtcagctccggacacccatgtcgtgccgcagcgccgttacaccgtgaggtctcagtctcactcgccaaataatgctggttctcaagaccatgagactcacaagcagtacacgctggagtcctcggcggcttccggttgttcaaggcatggttctccctccagccaaagcgtccatgccgggagtggcagccctgtgtctcacgacgacagccactccggctccacgaacggccatggatcacctgtgagcgcgtcgtgtgtcaccggcgaggaccctactgatctcaagcagaaactgaaggatcttgaggctgtaatgctggggacgtctgagactgaccccgagatagtcaacagtctcgagatctccgcggcaaaccaactctcgttggagcccgaggagtgggagcacatggtgagcatgcccagagggaacctgaaggagctgctgattgcctgcgctagggcagtggaacgtaacaacagctacgccattgatctgatgatcccagagctgaggaagatggtttcggtgtccggcgagccgcttgagaggctgggagcctacatggtggaaggtcttgttgccaggctcgcggcctccggcagctcaatctacaaggctttgaagtgtaaggagcccaggagctctgatctcctctcctacatgcacttcctgtatgaggcctgcccctacttcaagttcggctacatgtcagccaacggcgcgatcgcggaggccatcaagggagaggacaggatccatatcatcgacttccacatcgcgcaaggggctcagtgggtctctctcctccaagcccttgcagccaggcctggcgggccaccgttcgtgagggtcaccggcattgatgattcagtctcagcttacgctcgaggcggcggtctggagttggttggcaggaggttgacacatattgctggcctctacaaggtgccctttcagttcgacgcagtcgctatctcaggcagtgaggtggaggaggagcatctaggcgtcgtcccaggcgaagccgtcgccgtcaacttcacccttgagctgcaccacatccccgacgagaccgtgagcacggcgaaccaccgggaccggatcctgaggctggtgaagggcctgtcgcccaaggtgctcacgctggtggagcaggagtccaacaccaacacggcccccttcgcgcagcggttcgcagagacgctggactactacacggccatcttcgagtccatcgacctggcgctgccgagggacgacagggagcggatcaacatcgagcagcactgcctggcccgggagatcgtgaacctggtggcctgcgagggcgaggagcgggtggagcggcacgaggtgttcggcaagtggaaggcgcggctgatgatggccgggttcagcccgtccccgctcagcgcgctggtgaacgccaccatcaagacgctgctgcagagctactcgccggactacaagctcgccgagagggacggcgtgctctacctcggctggaagaacaggcccctgatcgtctcatcggcatggcactagtgttgacttcagagaatgttgacctgatggagaatgtttcttgtaaccttcgaagtacctcttagtggtttagatatgtttggctggtcactggaactatctataggaagcctatggtgatagatactgagttgtagtagaacacatatagcctaaatgcctaatgctgtgatggcagtcactaccagcctagcctagaacaggttgatgatgtgtagtagtaagtttgggtatatgtttcagttaatcagttttgcttgggtgcattctgaagggtggcctcttcaaaaaggacatcattccttctaacttgacccttcaaaa

SEQ ID NO: 831 - DNA, 986 bp, Zea mays
cattgggtacctcgaggccggccgggaatgccctcctccctcggcggaaacatccaatccccgggccaccactacctgcctgcccgtgcccacgcttcttctcttctcctccccaagccccagccccagctaccgcgccccctcctgtctgttccaccagcgtcggcctagctacctgcccgtcccctctccgagtacggtcggaagcctcagctgaaggatctggcctgggcgccctccggacgacgggacaggttctgtttggtcttcataaagtagagcactagctagaagacatattcacacgcatcagctatcaaattgcaagcttagaattgacctcaaagttgggacatgcttgtcttaccagaagcaactgatagcttggagttgtagtccgtccggactgtctgctggaccagtatggctgacactccaacttcccgcatggtgcacccctttggcgacgtcccaaggcagactcccaagcaattcctgtattctggtaacccgcagcacctctgccatccgtaccagtcagctccggacacccacgtcgtgccgcagcgccgttacaccgtgaggtctcagtctcactcaccaaataatgctggttctcaagaccatgagactcacaagcagtacacgctggagtcctcagcggcttccggttgttcaaggcatggttctccctccagccaaagcgtccatgccgggagtggcagccctgtgtctcatgacgacagccactccggctccacgaatggccatggatcacctgtgagcgcgtcgtgtgtcaccggcgaggaccctactgatctcagcagaaactgaaggatcttgaggctgtaatgctggggacatctgagactgacccagagatagtcaacagtctggaaatctccgcagcaaaccaactctcgttggacccgaggagtggagcacatggtgagcatgcccagaggaacctcaggagctgctgatgc

SEQ ID NO: 832 - DNA, 1753 bp, Zea mays
cattgggtacctcgaggccgaaaatcattaataaaaagtttgctagtgagtcgagaagagagagagaggcgtccggaattcatcgccagcgatgtctccgtccgccgacgcccccggcccggcctcctccgcctcggcgcccccgctcgcgcccctcatcgccgcgcagctcaactacctcctctcgcactccaagctgcccattagggtggtacagatctggtccggctgccgcaacggtcgccctgccgatcggttcaggctcgccatccccttctgcctcgactacgtccactgggatttcgtgtacaatgcgctgtctcccaaggtggcaccagacgtggtgttcggtccggaggatgagaggttccagccgctggtcgattacgctgctgctggaaatggcgataagagctgcttggcgcgttgggattgccgcgcccccgagggactccatgcgctcgtacaggagcttcgagaattgtacattgaataccaaaaggagcgggttcacatggtggatgacgcgagactagcgtttgaactaagcacagttctctctaaggaggggattgaagtctgcatggtaccttctgctgataggccagatgaggccaaatttgctgtaccacttctggagtctgactttgactttgccaaactggtgccaggatgtccttggagattacctcaaaagatccatctccaggtcatttttcctatcagcaggagttcaagctactcttctatgccttctgctccacgactcaaactaatctcaacaccagatttgaggtcacttctctcagttgaggatgtgaaactccctccatggtcaaatgggatgtgtttggcggagtatcttcctgctttagaagacagtcttaacggtctgcttgtagatgcgtcggcttcaattggttccagaagacgctttattgaggcactagctcccatctttgggagaccattagaggctgatccgattttttgcaggagggctacagttctttccatttctggaatgttcacatttctggttcactttgccatcccccttcaattcccaaagcaacaacctgtcgtcacactgcagagttctcagcactgtaatgccgatgggatgcctatcacgtcgcctccgataaatgactatccctggagtcctagatgggaccaggcagagatggttgaacggatctacgacttcctgaccgacgagtgccaaaatttcaagaagttctgcagcgatgctatcactcagcagaagtagctgacatcgttctgcagcagaaagccgtggtgctgattttctcagcaacaggctttcttattcccagcaagcggcacacgtgtctacttgtgcgcccgccccaagcctgcaaccgttgatgctgttctctttcttgtcatgtgagaggacgcaacctcaggcgttggttaggatcggcataaaccaagcaggacaacacaagacctgttggttgtttacgatgtcgtacccctgtataagctgccgacatggtgactgtttgggatatggtatagatggatacaatccagttcttttgtaaatatgatatgaaggatggtggcactcctacccccgttgcattctcctctccaaagcaccacatgctgtcgatgccgttgggaagtttgcaaaaatcttactcttattgttatgcaatcaaattgtgtgtttccacgcgaaaaaaaaaaaaaaaaaagccgccagggggggcccggtacc

SEQ ID NO: 833 - DNA, 678 bp, Zea mays
cccagcgtccgagaccaccaccgccgcgtcacgcgctcgagaacgtcgtcaagcccaggatcgagaacaccatcagctacatcaagggggagctcgacgagctcgagcgcgaggacttcttcaggctcaagaagatccagggctacaagaagagggagatcgagcgccagatggccgccgccaggctatttgcggaggaacagcttgccgaggatctcgcgcttaagaggggtatctccgtgggggctgcggcaaacctgctggttgctggtggggagaaggacgacgacatcatcttctgaccactccttccatggccatccagtcattcaatcgattatcattttatcttaaaatgctgaagactggccattggaatttaattggcagaaacaataagttgatgctggagctccagaattgtatctgtttatagaatgatggagattttgattcagtaatctggagtctagccatccgagatcctcaataatctgtacctggaaaccaaacagtgccaagtaacttttacggagcgttatgtgcagctcgtgtagaaaattcaattgaaccgtatttcctgtcgtgtaccttccagtaccgtattatattatatatttattattcaattggacctgcactcagaagttgcagtctgggaaaaaaaaaaaaaaaaaa

SEQ ID NO: 834 - DNA, 1387 bp, Zea mays
  misc_feature (517)..(517): n is a, c, g, or t
  misc_feature (585)..(585): n is a, c, g, or t
attgggacctcgaggcggcgggcgggtcccagtcgaactcgacacaggcccgcgatccgctcccctttcttccttccccggattcgcggcgatctagccggcggcgggcggcgcagcgatggcggggcaaaaccagcggctcaacgtcgtgccgacggtgacgatgctcggcgtcatgaaggcgcggctcgtcggcgccacccgcggccacgcgctgttgaagaagaagtccgacgcgctcacggtccagttccgcgccatcctcaagaagatcgtagccgccaaggagtccatgggcgagacgatgcgcgcctcctccttctccctcgccgaggccaagtatgtcgccggcgacggcgtccgtcacgtcgtcctccagtccatccgcgccgcctccgtccgcgtccgatcccaccccgcgcatgtcctgccggggtcaagctccccaagttcactcacttcgtcgaccccgccgcggcatccggggggccctccaacgcgtctccgagccttacgnggcctcgcccgcggcgggcagcaggtcgccgcctgccgcgccgcgcacgtcagggccatcgaggtgcntcgtcgagctcgcctcgctccagacctccttcctcacgctcgacgaggccatcaagaccaccaaccgccgcgtcaacgcggctccgagaatgtcgtgaagcccaggatcgagaacaccatcagctacatcaagggggagctcgacgaactcgagcgcgaggactttttcaggctcaagaagatccagggctacaagaagagggagatcgagcgccagatggccaacgccaggcttttcgcagaggaacagctcgccgaggatctcgcgctcaagaggggcatctccgtgggggctgcggcaaatctgctggctgctggaggggagaaggacgacgacatcatcttttgatcgcctctttccatgctcatccaatcattcaatcgccctggaaacaataagttgatgctggagctccagaactgtacctgtttatagagtgatggcgggttttttttttcagtgagtagtctggtgcctggtcatccaagaccgatgaataatctgtacttgttggggactaaagattgccaatgaactttagcacgcagtggttatgtgcagctggtgtagtaaattcaattgtgctctgttttccctgtttgtgttcattatagttgtatttatatttatttgcggggtgtgcgcggattgctgtactacacctactctgaagtcgcgaccgatgtattatttgctgttggatatggcatgctattgaggttatagctcgctatatatatatttggtttcgttgctcaaaaaaaaaaaaaaaaaaaaaaactcgagactagttcctcgtgc

SEQ ID NO: 835 - DNA, 2541 bp, Zea mays
  misc_feature (538)..(538): n is a, c, g, or t
agaaaataaaaatgattaaaaagatggtggagtactattttaaaggatatgttcacttacgaatactattacggagaagttaaaattataagtactaaaagagaaaagcctaataaaatgaatatcataatagcaaaaagttctcggatgtcctcctcggtactgctgggaattgggctcgtgtcaaacgggttcggatcaggaaaatccaaaaaacttttgggtcgtgtcgtgccagtccgaagtataaaaacagtggcccaactcgatcataaaccacgtcgtgccttcgttgggccgtgccggcccaagcccacccgtatatttgaccacataaaatcaaaatattacaacaatataaagtccataacttactaaattaaagatattaaacaattctagcatcatttaaccatataaactcccaatataacaacaatataaagtaaatatcttactaaattaaataaattaaacatattgggcttaattggccgtgccgggggctcgacgggccgaaatttgaggcccgatctangctcgccttggatcgtgctagctcgtcccatattattttatattatgtcatattttggacttttattttcgagtcgtgctcgtactggtctaaaaagatcgacccatatttccagcactactcctgagcctagtacttttgttttgtgaaagactgcgtgcaggcctgtattgtattcagattttagtctggatagtggtagaagtttggctatggtcgggctcaaaaacttgttttgtcgaattatattttctgttttttaatgaaatagggttcccgtaaaaaaaccttcctttagtagattttttgaaagggtatgtagaggagtgaggagctttcggaggaacatactaaaggagtcattagccaactcaactcaatctagacggtcagacccaataaacacccgagtcccaaatagatctgtacaaacgttaggtcgatttcgggttatgggtcgtgctcgtatctaacatgtgtctaatgttgggtcaggtcagcttgtgctctctggttgacgtgttggctcggattttttcggttcggtcggattttttttatttgagtagatttttttagattaggttaggttttaggtcaaaaatcgtaactcatatctgtaaattattgcggatcaagaatttgagttgtattggttggatgagatcggggttagtcccgaaattagcagccggcatacacgagagatacgaccagcggtcagccccccctttcggcctttccctcccatatactcgccgtcggccagcggatctaatcggggcgggcgcgatggctgggcagaaccagcggctcaacgtcgtgccgacggtgacgatgctcggcgtcatgaaggcccggctcgtcggcgcgacccgcggccacgcgctgctgaagaagaagtccgacgcgctgacggtccagttccgcgccatcctcaagaagatcgtcgccgccaaggagtcgatgggcgagacgatgcgcgcctcctccttctccctcgccgaggccaagtacgtcgctggcgacggcgtccgccacgtcatcctccagtccgtccgcgcggcatccgtccgcgtccgctcccaccaggagaacgtggccggggtcaagctccccaagttcacccacttcgtcgaccccgccgcggcctccgggggcccctccaacgcgtccccgagcctcacgggcctggcccgcggcgggcagcaggtcgccgcctgccgctccgcgcacgtcaaggccatcgaggtgctcgtcgagctcgcctctctgcagacctccttcctcacgctcgacgaggccatcaagaccaccaaccgccgcgtcaacgcgctcgagaacgtcgtcaagcccaggatcgagaacaccatcagctacatcaagggggagctcgacgagctcgagcgcgaggacttcttcaggctcaagaagatccagggctacaagaagagggagatcgagcgccagatggccgccgccaggctatttgcggaggaacagcttgccgaggatctcgcgcttaagaggggtatctccgtgggggctgcggcaaacctgctggttgctggtggggagaaggacgacgacatcatcttctgaccactccttccatggccatccagtcattcaatcggtgcgtagcatcattcatcaacacattgtcctcttattctggatctgggatcagaaaacttgcacgatatgtgtctggcgcgacggtttctttcgttccatacaatgcccccgtagttccttttgattcgctccgtgaataatgacgctgtagggtttcattgtacttgtaccagtatcattctgggcgttacgattaatactttttaccttcttattagatggatccaatgtacatgttaacatgtaccttccctaaatgtgtacataaggtccaaaagtattcttgcttgtgataagagatctaactagaaagtacctgttgactgattttaacaagatatgctaatcacaatcacattgctgat

SEQ ID NO: 836 - DNA, 2101 bp, Zea mays
ccaacttaaatttacattttagggtttacagatggattttgacttgatatagatttaaaccgactcaataacatccaattcacatagattgaagaacaatcgaacaacacactaaggggtaagtaaatggggtatgagagatgatgcgaaattctgctgcgaaattcaccaccttctcaacgcaaaattggcccactccagttttgtggtcgcgcgtgtgacaagcaacagtatcatcgaattgagcccacggctcgacccgctgtgacctacccatctagccacgagtcgatatttctgaacccaactagttagaatatttccaacaatgttttaaatcgccttaaattaaaatatagggctctacataggaaaaaaactccagcaatgccttatttattaaaatttggtcaaaaaggtactttcaagtgccttaaacatactacatcgtaataggctaccctataatctatatttgatgctttaccgttgaagcggaatgttttattggtgccataaattttataaaatatatttatttttaaattataagctcatttttattagtcatgttgtcgttggatatgctcttacggcccaattattttttcatctaaaatttcgccaattctgctgcaattcaccaccgtccccatctcgtcgccgatccaacacaacccaccttcacatcaagcagtacaccgccgtgtccccgatccagccacacgagtcgacactcgacacaggcccgcgatccgctcccctttcttccttccccggattcgcggcgatctagccggcggcgggcggcgcagcgatggcggggcaaaaccagcggctcaacgtcgtgccgacggtgacgatgctcggcgtcatgaaggcgcggctcgtcggcgccacccgcggccacgcgctgttgaagaagaagtccgacgcgctcacggtccagttccgcgccatcctcaagaagatcgtagccgccaaggagtccatgggcgagacgatgcgcgcctcctccttctccctcgccgaggccaagtatgtcgccggcgacggcgtccgtcacgtcgtcctccagtccatccgcgccgcctccgtccgcgtccgatcccaccaggagaatgtcgccggggtcaagctccccaagttcactcacttcgtcgaccccgccgcggcatccggggggccctccaacgcgtctccgagccttacgggcctcgcccgcggcgggcagcaggtcgccgcctgccgcgccgcgcacgtcaaggccatcgaggtgctcgtcgagctcgcctcgctccagacctccttcctcacgctcgacgaggccatcaagaccaccaaccgccgcgtcaacgcgctcgagaatgtcgtgaagcccaggatcgagaacaccatcagctacatcaagggggagctcgacgaactcgagcgcgaggactttttcaggctcaagaagatccagggctacaagaagagggagatcgagcgccagatggccaacgccaggctattcgcagaggaacagctcgccgaggatctcgcgctgaagaggggcatctccgtgggggctgcggcaaatctgctggctgctggaggggagaaggacgacgacatcatcttttgatcgcctctttccatgctcatccaatcattcaatcgctgcgtagaatcatcaaagccttattctggatctggttttagaacatccacaatgtgtttcctctcatgttttttttttcttctgtgaagactgctgatgtagttgctttgattgtacaatatcaatcgtgtatttcaattaattagtagatgcatccaaattaccttccctagatgtgtgacccaaaagtgttcatgcctgtgataattcatctgaattttgcttgacattaatgtgaacaagatatgctaacacaaccacatggttgatatttccatacatacatggcatcagtgtctcactttacataatgtacagcataatagcttgcagattggtcgcattgattttattcctgcatgcgatagtttatttgaactctaaagtgagacactcgcagatttgttcatggaaaacaaatattttgtaatgacgaac

SEQ ID NO: 837 - DNA, 1451 bp, Zea mays
acggcccaattattttttcatctaaaatttcgccaattctgctgcaattcaccaccgtccccatctcgtcgccgatccaacacaacccaccttcacatcaagcagtacaccgccgtgtccccgatccagccacacgagtcgacactcgacacaggcccgcgatccgctcccctttcttccttccccggattcgcggcgatctagccggcggcgggcggcgcagcgatgcgcggggcaaaaccagcggctcaacgtcgtgccgacggtgacgatgctcggcgtcatgaaggcgcggctcgtcggcgccacccgcggccacgcgctgttgaagaagaagtccgacgcgctcacggtccagttccgcgccatcctcaagaagatcgtagccgccaaggagtccatgggcgagacgatgcgcgcctcctccttctccctcgccgaggccaagtatgtcgccggcgacggcgtccgtcacgtcgtcctccagtccatccgcgccgcctccgtccgcgtccgatcccaccaggagaatgtcgccggggtcaagctccccaagttcactcacttcgtcgaccccgccgcggcatccggggggccctccaacgcgtctccgagccttacgggtctcgcccgcggtgggcagcaggtcgccgcctgccgcgccgcgcacgtcaaggccatcgaggtgctcgtcgagctcgcctcgctccagacctccttcctcacgctcgacgaggccatcaagaccaccaaccgtcgcgtcaacgcgctcgagaatgtcgtgaagcccaggatcgagaacaccatcagctacatcaagggggagctcgacgaactcgagcgcgaggactttttcaggctcaagaagatccagggctataagaagagggagatcgagcgccagatggccaacgccaggctattcgcagaggaacagctcgccgaggatctcgcgctgaagaggggcatctccgtgggggctgcggcaaatctgctggctgctggaggggagaaggacgacgacatcatcttttgatcgcctctttccatgctcatccaatcattcaatcgccctggaaacaataagttgatgctggagctccagaactgtacctgtttatagagtgatggcgggtttttttttcagtgagtagtctggtgcctggtcatccaagaccgatgaataatctgtacttgttgggaactaaagattgccaatgaactttaagcacgcagtggttatgtgcagttggtgtagtaaattcaattgtgctctgttttccctgtttgtgttaattatagttgtatttatatttattgagaggtgtgcgactctgaagtcgcgaccaatgtatttgctgttggatatgcatgctattgaggttgtagctcgctatatatatttggtttcgttgctcaaaaaaaaaaaaaaaaaagcggcccctagggcc

SEQ ID NO: 838 - DNA, 1367 bp, Zea mays
cctcgaggccggcctggccgggataaattataactctacacgcctgttgtactgcggccgggatgagatcggggtcggtgcccatggtctagtcccgaaatttgcagccggcatccacgagagctacgaccagcggccagccccccctttcggcctttccctcccatatactcgccgtcggccagcggatctaatcggggcgggcgcgatggctgggcagaaccagcggctcaacgtcgtgccgacggtgacgatgctcggcgtcatgaaggcccggctcgtcggcgcgacccgcggccacgcgctgctgaagaagaagtccgacgcgctgacggtccagttccgcgccatcctcaagaagatcgtcgccgccaaggagtcgatgggcgagacgatgcgcgcctcctccttctccctcgccgaggccaagtacgtcgctggcgacggcgtccgccacgtcatcctccagtccgtccgcgcggcatccgtccgcgtccgctcccaccaggagaacgtggccggggtcaagctccccaagttcacccacttcgtcgaccccgccgcggcctccgggggcccctccaacgcgtccccgagcctcacgggcctggcccgcggcgggcagcaggtcgccgcctgccgctccgcgcacgtcaaggccatcgaggtgctcgtcgagctcgcctctctgcagacctccttcctcacgctcgacgaggccatcaagaccaccaaccgccgcgtcaacgcgctcgagaacgtcgtcaagcccaggatcgagaacaccatcagctacatcaagggggagctcgacgagctcgagcgcgaggacttcttcaggctcaagaagatccagggctacaagaagagggagatcgagcgccagatggccgccgccaggctatttgcggaggaacagcttgccgaggatctcgcgcttaagaggggtatctccgtgggggctgcggcaaacctgctggttgctggtggggagaaggacgacgacatcatcttctgaccactccttccatggccatccagtcattcaatcgtggcagaaacaataagttgatgctggagctccagaattgtatctgtttatagaatgatggagattttgattcagtaatctggagtctagccatccgagatcctcaataatctgtacctggaaaccaaacagtgccaagtaacttttacggagcgttatgtgcagctcgtgtagaaaattcaattgaaccgtatttcctgtcgtgtaccttccagtaccgtattatattatatatttattattcaattggacctgcactcagaagttgcagtctgggacgtatttgcttttgcattttataaccaaaaaaaaaaaa

SEQ ID NO: 839 - DNA, 1152 bp, Zea mays
tattgaccatttcccaaagaaacaaatgaatttgagtacaagaccaattacttttgtcatagctgtatacatcagtttttgtcataggtgctgtcgagtttttgttttcattgctttatccagaagtttctaatggatacaaagtgggggtgctggataagcgaaatggttcatagttacactctagagtagcacctccagtgcctagttgactccctgtgggagtgagtttcagggatggttaagaaaactccctcgctagcaacccataaaatagtggcagggcgctggtagtcagggggtgtgagagctggtcctacctaggggttgtgccagggtgcccaaaccaggtcgtggtgggtttgtggtcactggcctaggttatggtgtggcgctatagggtccactgtcagggttcagtgctgtttctcggtctgttgaagactggtttattctttcaaacaatataccttccctgctagcggagtttttgttatggttagtaagaccttgtatactccttccatcccaaaatataattcgttatagattaaacatgcatccattaattaatttatgaatgtagtttgtatgtatgtcaacattcattatgatttcttcgaatgtagacgaaaaaaagggccaaaaagaactatattacttggtggcgccatatctttgtcatttgggcagataggcactccccatttgtcttcccaaaggcattgctgtttactgtgcctcgtttgcatttcaaatgctccacatcagacatggaattagacaattagtctttcattaccaggttttaattgattccttctccttgcagtggcagaaacaataagttgatgctggagctccagaattgtatctgtttatagaatgatggagattttgattcagtaagtagtctggagtctagccatccgagaccctcaataatctgtacctggaaaccaaacagtgccaaataacttttacggagcgttatgtgcagctcatgtagaaaattcaattggaccgtatttcctgtcgtgtaccttctagtatcgtattatattatatatttattattcaattggacctgcactctgaagttgcagtctgggacgtatttgcttttgcattttataaccgattgttgttttg

SEQ ID NO: 840 - DNA, 3178 bp, Zea mays
ttgcatgcctgcagtggtactcatgtctgtctgttttggatatggaacatatatttattcgtaccagcggataactgctgctacttcagcttgtgcagcaatttcaagggtatgtaccagatttttccaatgcaaattagttgtttccagtgccatgaaaagctcatatcatgtgctcccttttgttgcaggagtatacatcttggtggatgccaagttcagtgtcagcaatcaactccggtttgctgcttttcaaatgccatgtgatagccgcaacaaggatattctttggaattttgatgctcctactaatcggttggttgatattccagcgttctgcaatgactggaccaaacatgccagtaacattcaatgttatgatattgggagttctttgtggttattttggaagctgctgtgttgacacactgggcggggatggaaatgtatggcttatatactgggaggccctttgctccatccatttacttggaaatatttggccatctcttttacatcacatgctgtatggtcctatttctgtgactcacaggaccaaggctggtcatttgccatattgggcccgccgatacacattttacattttggtgtcacttattctgccatgcttggctggtttgctgccatttgcatctctgtcagactggaaagagcttgctgttcaatatttgaagtccagattcagtggaattaatattgaggattgattattgagagattggttgtggttaccggtgtaatctcaatcccattttgcgaaggtgtaaaggttttttctgtttgtcacatatgaattgtatatcattgtagcgaaggagggaagatttttttgtttggcttcctttcatcctcggactgaagatatgtcaacacagttgttggaatgacaacaaaatatctcctttccttggtagtggaatatcagatgggctaggttctgatagttgtgctcctatgcgcactgctacagatatcaagagcaaggcacttcatatcgggaagcttagaaatataatacagtgtgcaatttcattgcagattttttgtgaccctttttgtgcaaggacattgtccacagtgattgttatctgatgatttctcttcccctctcttctcaatcatctaggttgcagttcttctcttcagtgggaatccactctacattgaaagttttgcttgcatatagtccttcagatgcatgtatgttgtaaaaggatgctcagaagcgcaatgtatcatttctatttagttgtacacattatttagttcctgcagcatcgattatgtgtatcagttcttcaacagaacttgcttatgtttgtccaatgctttcgttcagaataagtggagttaaaaacgagtggtcaaattatttctactgtggcctaaatagttttatagatgcttaaaccacccatgtgaaatggcacgtgcaagtttctgttgaattttgaagatattttgtcgaaatgcaagtttgtcgaggcacgagaggatgaggatgtcatggaagctaggagcctggaggcggcggggacccggacagacagaactgaaggagacaggcggcgaagcgagcgcatcagtaagcactttcgtggagagataaaactaccccggtgttatggcggccgccgctcctccgtctctcgcccaccccgcacctccgcgctccacgaaagaattccaacgcgcaccgcgccatgcgccgcgggacgtcgtctcctggacgtctaccatctcgcgcgcggcgcgacagggtgacctgcatgcggcggcagcatctctctgcgctatggtctcctcccccgccgcgcccgcccccaacgacgtcacgctacttaccgttctctccgcctgcgccgactccccatcctcgccgctagccagccccctcgccctcaccctccacgcccgcgcgctcaagctattcccctcccacctcctcctctccacctgcctcgcgcggttctacctcgcgtcccgcctcccgcatctggcgctccagctgttcgactcaatgccggtccgctccgtcgtcacctacaacaccatgatctccgggcttatgcgcaacggcctcgtcgacgccgcgttcgaggtgttcgacgggatgcccggcccggacaaggtctcatggacggcgctcatcgacgggttcgtcaagaacgggcgccacgacgaggccatcgactgcttccgcgccatgctgctggacggcgtcgagacggactacatcacgttggtcgccgtcgtgtctgcgtgcgcggaggtaggcgcgctcgggctcgggatgtgggtgcaccggctcgtgctcaggcagcggctggagcgcaatgtccgcgtcgccaactcgctgatcgacatgtatgcgcggtgcggacaggtgaacctcgcggcgcaggtgttccgctccattaggaagcggacggtggtctcttggaactcgatgatcgtcgggttcgcagccaatggccggtgcacagacgcgatcgagctcttcgaggagatgcggaggcaggggttcaagccggacgcggtgacgctcaccggcgtcctcacggcttgcagccacgccggtctcacggagcacggcctgaggtactacgacctcatgacgacagagtacggtgtcgccgcgcggatggagcactacgggtgcgtggtcgacctgctcggccgggccgggcgcctggacgaggcgatgcacgtggtggagacgatgccgatgcggcccaacgaagtggtgctcggggcactcctcgcaggctgccggacgcacgggaacctggacatggccgagcagatgatgcagcacctcttcgagctggatccccagggcgacgccaactacgtgctgctttccaacatctacgcagccgtcgggaagtgggacggcgcggggaaggtccgaagcctgatgaaagcgcgcggggtgaagaaacggccggggcacagcaccgtggagatcgacggcgacgtgcacgagttcgtgtcgggagatcagtcccatccgctggccggggagatcggacagatgcttgggctgctctggcacgagatgacgaggtatggttgtgatgtgcatggaggcagcagctttgatggggattgagttgctgatactgcgttaacgtagaagatgccatgcctgcag

SEQ ID NO: 841 - DNA, 1825 bp, Zea mays
gcacgagaccattacctagaacatccgaagcgaaaaaacccccgggcagcggacaaacaagcacacagcacgagcgaagagacgcagccatggcgatggctccaccgcctgcctgctcgctcttcccccgggtcgccgctgctgcgcccagttccgtcacctccaactccgttttgacctcgcgtggccccggtatccttccttccccgcgtctcgctttcgcccgccgccacctctccgcggcatggtcatcgaaggcagcagcctccgcttctgtcgaaatccaggatgactacacggatgagatggacgcggtgaacattgcgcaggatgtcacccagctcattggaaaaacaccaatggtgtatctcaatagagttgctgacggatgtgtggctaatatcgctgcaaagctcgagtacatgggaccttgccgaagtgtcaaagataggattggattaagcatgattaatgatgctgaagagaagggattaatttctccagacaagaccattttggtagaaccaacaactggaaatactggtgtagccattgcttctgtggctgcagcaagaggatacaagttgatagcaacaatgccttcatcattagatgtcgagagacgcattcttctgcgtgcattcggagcagagattgtgttaactgatcctaccaaaggactaaaaggagcttttgataaagctgaggaaatagtcctgagaacaccaaatgcgtatatgtttcagcagttcaacaatgaggcaaatagtgaggttattggggtagaacctgctgaaactagtgtgatttctggtgatagccctggttacattccaagtatattagatgtgcagttgattgatgaggttgtgaaggttagcacagcagaagccgttgattctgcaagggaacttgctctaaaagagggcctgctggttggtatttcctctggtgctgcagcgattgctgctatcaatgttggcaaaagacctgaaaatgctggaaagttgattgcggtcattttccccagctttggagagagatacatctccaccattctgttccgtccgatatatgactctgttcgaagaatgaggaagagatagcgagccttgtactacttcaagcgcgttgccagtccccttctctagacctgacaggcttccatgacatgattgataaacgtgaagcagtgaagaccctgtttgattgcaacttcagggtccgaagttttgaagctgcacagagtttctatcaggtgagctgcaggcctgcagcttggttctagcaagactggaggagtgcctcatgtttagaccagctcatacaatcctggtgcaacatgcagaattgcgtgccgcagttagcttgggcctttcgtttagtagtctaggaccgggtacaaaccgcttgttacctggtacgcacttgagctgattttagcgaccaactatctgcaaattctttttgccttccgaattttgattgtttcatcttttatctggcgtctactttactaactagttttttgcggaactacaattttcttttctctttttcttgtctgcaaaagatcgaaggtcgagcttgcaattgcaagatcaaaggtcaagctgaaaggagcctgtcgaacaaaatgcagcgtcttcactcaggtcgaagcgggaagctctaaaccgtcagagcgtctccaaaactggctgacactgacagacaaaaaaaaaactgatttaggtattggagcgaacacatccttccaatagcagcctaaatcaccaccttattttagctattacctaaaccatcaaatctcctcaaatttatg

SEQ ID NO: 842 - DNA, 6187 bp, Zea mays
  misc_feature (448)..(448): n is a, c, g, or t
  misc_feature (671)..(671): n is a, c, g, or t
  misc_feature (5233)..(5233): n is a, c, g, or t
gccccagtctgcatccagccgccactgcctctgtgccccggtccccctacccatctagctgctaggaccgggagcgtaggagcccgacacggtgagttgggcgcatgtcgtcgacgccagccgagtcactttggccggacacgagctctgcgaccgcagaaggccggaggaggagcggaggagctccggctaccgcatactgtggaggaccgcagacggatggacgcaagctcgcgtgagtcgtgactgtggaggatcggcgaccgaaggtgtcggtcaggggctcgacagtgcagggcgggcgtgctcaagaacggcggtcaggcgacgtgctcgacgtgcagtgtcggcgtgtcagcaagctcgcaacgcaggtccgagcagagcccatttctacagttcgtcactcaaccgagccgagccaggctaggctcgcaactggttcgantcgttttcggccctacacgtatgaacgcgcgctatacactaatttatactaatatatttgaaaatcggattctataacatggttaaacatgtgttgtcgtaacttttgtacacgaatcgtgagtcaagtcttagatggaatagtgaatcatttagtgctaatttggaatagtgaatcatttagtgctaatttggtggcaaggtatttggagggaatctgtagngccgaaatcccttgatgtacaaatccaaactagcttttaaggtccgttcaattacggtaagatttgacctataaattatttcaactcattaaaattatacattttagtagacattttttactaggaatcaatccagcatgtcaatccgaaagaaccgaacgagacctaggactattttctctctccaattcatcacttgcaattgctcttagtagtaataaaacgtatcagaattcatcctaacactcatgtaataaaatgtgtggcatcgggtgagagagtgagcgaattagagaaaaaaaaagttgacacgtggtgagtaggagacacctagtgctattgtagctcatataagaacaacttgtgatcgagaccaggtcaaaaggacagctacttgtggttagtttgagagcctcaatactgaagaggattgaaggggctaaaatccctttcttattcaatttaaataagaaagaaattttagtccctctaatcctctccggtattttagctcctaaactagtccttagagtctaagaccacctaatcaatttattctaaagcaaaccagaataagggaagaggggattttccttttctttgttcacttattttaaaacaaaattcaaaagattttggattttatttaaatttagaaccaagtacaagtaaataaaatacaccatcatgaatgcatagacatgcttctaaccttaagttaattttgatttaataaaacgtcattccgctcatctcatgctcatataaattcataattaaactagtctcaatgatacttcaaatagaactagtcttatacaaatagggtgtataaaagtacattcatatagataaatgttatgtgttaatgctggtgtgtggcaacaacacacaaattattcaataaagtgtcagtgcataatgattacattaatataaataatatatattactatccactttaatatatcacaaaatctttagtaaaagccaatacattgttgaggtgccacttaaaggcggatgtcgtggcttgggtcatctcgacaccacccatctcatgcagcgtgtcacggaggtggcccatggtgtccgctaggttctccagagagtcacgtaccgattcatcgtcgctgaccacaatcccttcatgttgccgccacaccgggatgttgccaccggaccatgtgacccatctatgaaaaagcggcacacaccagttcccgttggctccgcggcggcgcaagccctcgtacaacgccaaactctgctcgtacaacgacgatgtgcaagggttatccagcagagttggatttttgggttgcacatatacataatcaaaaaacgtatgtggttagctgtcatatattatttttgttgtcttattcaattacatgcatgagagtttatccgtggtacacactctggttgttagacacaggaaagaccgaaagaggaacaaatttatgggggtttgttttctaatgactaatttttagtctctttattttatttcattttagtttatagattacaaatatagaaattagaataaagttttagtttccatattttataatttataaattaaaatagaataaaatagtggaactaaaagtttaacaccctcttacacggtttatgtatgcgcgcacgatggtgacggtaaaaaactgattcacgacgacggtaaaaacttcagtggagaagaggagagaagagattacggttcaaacctcaaaaatatttacatgttgcgtcagataaataacccgccccgtcgccgccgccaccgcaacggtcggatactgaagtactgaacggttcgagtttggaacacttcattccgccccgtccccaatctctccatctccggctctccaccttccacaaatccccaaatcgccacatcaaatcgaatccacccaccacggaccacgcattcgccatggagtttcccaagcgagggcgagcttttctccaaggttccatcgcgagccctcgcttcagttacgccatctgtgccccattccgatccccttacatttcttcatttgcaggttccctgcgaaggagccccaaggcgacgatacctggagctgccacgggggccgacgagaacgcaagctctaagcatctcgtgccggtgggggccgcgtcgccgaagaggaagaaggtgctcggggagaggaacgacagcggcgtcgggggcatggagggcgccgcgtcggcaccagtgcagcagccaaagctcgcgttgagccccccgacacccgcgagccgcggcgcggggccgtacgacccgaagacgaactacaccacgccgcggccggcgttcctgcgctacgaccccgaacggcgccgcgagatcctcctccgggtgtcgcgtgcggcagaggtgatggacgacgactgctccagcaccacatccggcactgcggcctcggaggaggacggtggctcgtccttggcctcggacgcggcggcaggctcccttatctcgtcgccgccaaggagcgactccgaggccgagcttgatgacagcgaggaggaagaggaggtaatcccagctcgtcgaggccggtgggccaggcggctgcttctgtttctcgtctgtgtgtcctgctcgttctgctacatgtattgcgccaaaccctctggctttcctacttattcagaagacgcacttgatttggatagaggtattgggggcatgtacgatgcctatgatcatgaattagactcactgagattgttagggccagttcatatgatgggtccagaggatgtgctggaagaaaatacaaatcaacttgtgcacgaggactctaaaggtgtggaccatctgtatggcaacagagctcctagaaatctggtggcagttgctatggtagggctagctgatgtctgcctcaatgtttcttcaggagaatttacatgccaaattgggggtgaaaaaggtgagaatgtgcctgatttgaaggaagattctgaaatggacaaactcgatacagaaatgacaatctcctttcagaatgacaagcaaagcagtgaagttgattgcctgggtggaaacgccccactggattccattggttccacttctactcacactgataacttggagggcagttcggaatcattccatctagaggaatgggatgattactcaaatcaatctgaactgcagttagtctccatggagagggcaataaaatcagcaagttacaagctgaaagacagaacgggtttggaaagtgaggagttggatctatggcagtatgagaatacagcagaagctgctaaaacaatatgctctactgtaaaatttctgtggtctgcaatggaacctcacttgctgcaggtattggcaggcttgtcttttgcaggtttggtggctgcattatataggtactatcaaagatcaagagagtgctgcaactgcatcataacctatgactcacttgctgaacaaccattgttagttcaacatcaagttgcgcagctgtcagtgacttcttcagttcgagatgcacagctacctgttcactcttcggagcaacctatacaattggcaattcctaaccaaggcacggctggtagtttggaggttcctatggagttgacattgcccaagctggacccattggtcagtcttgaggatcctgcacaagagtcattgcccatgacagacccactggtcaccgtcaagattcctgtgattggtcgtgggatccatgatcagaaacttaaacgtggggattctgagaacattaaggcttcaaatggtatgtttctgaaccatagtgacgttgacagctccaagccaccagtggttgaactacttggagagttcgtgcttgcaagtagctcaagagaaagatctaccaagaaattgtatcagaatgctggagatgctacagataagaaattgttgaaacctttgaaaaaggatgaggatgttgaaaagatgcagatgcattcaagcatcatcccaagccctagtgttggaagagccaaaaaagaggtaaacccaatccttactactttcatctctgtagttcatttagtactactaggttgtggaagcatgcgcggttgcatagtatgagaaccgagaaatgagaaatgtttatccagaagaaattaaccagatttcaatgcttgtgcactctaattaacttgaggttcatagaaaatttggtggctgtattgattttagatgaattaggtggtgtgctatttttatgagataaatttattcaagccacttcctttttcctccatatacaaaattatggtgtgggtctgtgggggctaacgctactaaggttcagcctactggttgagacagatacagaggggggccagtaggaccaaaatcaacgaaattttggtgggagttttcaaatctttatgaaatttctgataaaaatttaaaaaagaatgagataggaccgaaattgctggtatgtatatttaccagaggtcaccagcagacctgaaaatcggccaaaattctgaactctggaatctgtactaatggcttattctcaaactcntatggactgatagtgactaatcagtttgcactagtaagtggttcgtacataacggtttcagtttgtagaagaagttccaggccctgttctttatagaccgtcgctgtgatgaatttttaagtaataaatagcgttattgttgctcttactttaatgatcttggttcaacacttcacgtttagaaaattatgtattatcaaatcagacaggacagaggaattgagattttgattcgcaatttggttggcggtgagctgtccacttactgcatgattttccacagcaggagaaatctataaaccgggagaagaccgatgcgacgccaactccactgagacgctcaagccgcctccgcaacaaggtgacttctccctgaccaaaatccaaggtgctcagctcgtcgttcgctaacctttggatgctgggttcctctgtggtgtggtggaaagctgtggacgggacagcacctagttgttacccaagctttgatattgtactttaggagcagaacaatgttttaccagaatatatgctgcgtatttgtcccctcttaatatcctcctcatgtgcatgaatttctcgtaatggtggctacacttaagctttccggctagagatgtctgcaacgaacacatatgtggcctcttagtttattttagtcctacattggtggcgtacattattctgtctcgttttagtaactgatttgttttacatgtcataccagtgataccaccgttgtagttcatgttggactcatgtcatccggctcactcggtcagaggaccgagtcggatgccatgctcgtatcttgatcgtaggtgcaacaatgcaaccttctttcacatcgggtttaaaaacaggaaaggattgacacgtggactaatgtttatgtaccctctttcgtcgtatactctcatgagatccaatataatttctacatggttagtgaag

SEQ ID NO: 843 - DNA, 2543 bp, Zea mays
aacggtcggatactgaagtactgaacggttcgagtttggaacacttcattccgccccgtccccaatctctccatctccggctctccaccttccacaaatccccaaatcgccacatcaaatcgaatccacccaccacggaccacgcattcgccatggagtttcccaagcgagggcgagcttttctccaaggttccctgcgaaggagccccaaggcgacgatacctggagctgccacgggggccgacgagaacgcaagctctaagcatctcgtgccggtgggggccgcgtcgccgaagaggaagaaggtgctcggggagaggaacgacagcggcgtcgggggcatggagggcgccgcgtcggcaccagtgcagcagccaaagctcgcgttgagccccccgacgcccgcgagccgcggcgcggggccgtacgacccgaagacgaactacaccacgccgcggccggcgttcctgcgctacgaccccgaacggcgtcgcgagatcctcctccgggtgtcgcgtgcggcagaggtgatggacgacgactgctccagcaccacatcccgcactgcggcctcggaggaggacggtggctcgtccttggcctcggacgcggcggcaggctcccttatctcgtcgccgccaaggagcgactccgaggccgagcttgatgacagcgaggaggaagaggaagtagtcccagctcgtcgaggccggtgggccaggcggttgcttctgttgctcgtctgtgtgtcctgctcgttctgctacatgtattgcgccaaaccctctggctttcctacttattcagaagacgcacttgatttggatagaggtattgggggcatgtacgatgcctatgatcatgaattagactcactgagattgttagggccagttcatatgatgggtccagaggatgtgctggaagaaattacaaatcaacttgtgcacgaggactctaaaagtgtggaccatctgtatggcaacagagctcctagaaatctggtggcagttgctatggtagggctagctgatatctgcctcaatgtttcttcaggagaatttacatgccaaattgggggtgaaaaaggtgagaatgtgcctgatttgaaggaagattctgaaatggacaaactcgatacagaactgacaatctcctttcagaatgacaagcaaagcagtgaagttgattgcctgggtggaaacgccccactggattccattggttccacttctactcacactgataacttggagggcagtttggaatcattccatctagaggaatgggatgattactcaaatcaatctgaactgcagttagtctccatggagagggctataaaatcagcaagttacaagctgaaagacagaacgggtttggaaagtgaggagttggatctatggcagtatgagaatacagcagaagctgctaaaacaatatgctctactgtaaaatttctgtggtctgcaatggaacctcacttgctgcaggtattggcatgcttgtcttttgcaggtttggtggctgcattatataggtactatcaaagatcaagagagtgctgcaactgcatcataacctatgactcacttgctgaacaaccattgttagttcaacatcaagttgcgcagctgtcagtgacttcagttcgagatgcacagctacctgttcactcttcggagcaacctatacaattggcaattcctaaccaaggcacggctggtagtttggaggttcctatggagttgacattgcccaagctggacccattggtcagtcttgaggatcctgcacaagagtcattgcccatgacagacccactggtcaccgtcaagattcctgtgattggtcgtgggatccatgatcagaaacttaaacgtggggattctgagaacattaaggcttcaaatggtatgtttctgaaccatagtgacgttgacagctccaagccaccagtggttgaactacttggagagttcgtgcttgcaagtagctcaagagaaagatctaccaagaaattgtatcagaatgctggagatgctacagataagaaattgttgaaacctttgaaaaaggatgaggatgttgaaaagatgcagatgcattcaagcatcatccaaagccctagtgttggaagagccaaaaaagagcaggagaaatctataaaccgggagaagaccgatgcgacgccaactccactgagacgctcaagccgcctccgcaacaaggtgacttctccctgaccaaaatccaaggtgctcagctcgtcgttcgctaacctttggatgctgggttcctctgtggtgtggtggaaagctgtggacgggacagcacctagttgttacccaagctttgatattgtactttaggagcagaacaatgttttaccagaatatatgctgcgtattcgtcccctcttaagatcctcatgtgcatgaatttctcgtaacgatggctacacttaagctttccggctagagatgtctgtaacgaacacatatgtggcttcttagtttattttagttctacattggtggcgt

SEQ ID NO: 844 - DNA, 768 bp, Zea mays
  misc_feature (714)..(714): n is a, c, g, or t
  misc_feature (745)..(745): n is a, c, g, or t
ataaaaaaaactgagcctgcccgcccgcccgcccgcgcgctccgctccgtgaactatatctatctatcacctgctgctccaaggaggcggacagaggcaggcaggaaggcactcacttctccaggagcccggagtcggcagcaagagagaatggccgccgacgccgccgccgccgccacccttcgtactgctctctcccaaggtctggtgctgtggcatgtttagtgcaatcttcattgcttgctgtcttgctgcatttaacacagcacgagcttcagagaatagtccaagcctatctgtgttgccaagagatctcatccaaggtttacggcaatgaaccatttctaaagcacaaagacgtgatgtctttatcaattcatcaggagagcaaatggcgtcaacaggaggtcaccgacgagcggttcgtcgacatacccgaggaggtcatcgacgtgtacaagctctggcgcccgacgcccctgatcagggccagggaggctggagaagctgctcggcacgccggcgaagatctactacaagtacgaggggaccagcccggcggggtcgcacaagcccaacaccgccgtgccgcaggcgtggtacaaccccgcggcgggggtgaagaacgtggtcaccgagaccggcgccggccagtggggcagcgcgctgtccttcgccagcagcctcttcggcctcaactgcgaggtatggcangtgcgcgcgtcgttcgaccagaaccgtacgngagctgatgatggagactggggc

SEQ ID NO: 845 - DNA, 1919 bp, Zea mays
ccggccgggaaacggggcctgcctgcccgccccgcccgcgcgctccgctccgtgaactatatctatctatcacctgctgctccaaggaggcggacagaggcaggcaggaaggcactcacttctccaggagcccggagtcggcagcaagagagaatggccgccgacgccgccgccgccgccacccttcgtactgctctctcccaagcaacagggcaagagcagagagcttcactgctgtgcacaccgaagcaccgagttgctgccagcaggagaagcttgagattcaccactagggccagctcgaatgcgggcgccagtgtgagcatcccgaagcaatggtacaacctcatcgccgacctgccggtgaagccaccgccaccgctgcacccgcagacacaccagcctctgaatcccagcgacctctcccctctgttccccgacgagctgatcaggcaggaggtcaccgacgagcggttcgtcgacatacccgaggaggtcatcgacgtgtacaagctctggcgcccgacgcccctgatcagggccaggaggctggagaagctgctcggcacgccggcgaagatctactacaagtacgagggaaccagcccggcggggtcgcacaagcccaacaccgccgtgccgcaggcgtggtacaacgccgcggcgggggtgaagaacgtggtcaccgagaccggcgccggccagtggggcagcgcgctgtccttcgccagcagcctcttcggcctcaactgcgaggtatggcaggtgcgcgcgtcgttcgaccagaagccgtaccggaggctgatgatggagacgtggggcgccaaggtgcacccgtcgccgtcgacggcgacggaggccggcaagaggatcctggaggcggacccgtccagcccgggcagcctcgggatcgccatctccgaggcggtggaggtggcggccaccagcgccgacaccaagtactgcctgggcagcgtgctcaaccacgtcctgctccaccagaccgtcatcggggaggagtgcctggagcagctggcggcgctcggcgagacgcccgacgtcgtcatcggctgcaccggcggcgggtccaacttcggcgggctcgcgttcccgttcttgcgcgagaagctgcgcggcaggatgagccccgcgttcagggccgtggagcccgccgcgtgccccacgctcaccaagggcgtctacgcgtacgacttcggcgacacggccgggctcacgccgctgatgaagatgcacaccctcggccacggcttcgtccccgacccgatccatgcaggtgggcttcggtaccatggaatggcacctctgatctcgcacgtgtacgagctgggcttcatggatgccgttgctatacagcagactgaatgcttccaatgtatcctactctaccttttgcaatggcaacgagacttgtcaacaaggaaatggatgaaagaagaacaacaccgtaatgctaacgtcttgttttgttgatgaactgtggagcagctgccttgcaattcgccaggacggagggcatcatcccggcgccggagccgacgcacgcaatcgcggcggcgatcagggaggcgctggagtgcaagcggaccggggaggagaaggtcatcctgatggccatgtgcgggcacggacatttcgacctcgccgcgtacgagaagtacctgaggggagacatggtcgatctctcgcacccggcggagaagctggaggcctccctcgctgccgtgcccaaagtctgacggcgttggagccaacagcacatgcgactggaatgggacgaataatccattgatatcaggttcatgaatcttgtggtgatccatcgcccatcggcagtgggatacttgtgttccttatgaaatgaatgaataaaatttcaataaaagcatttattttatcat

SEQ ID NO: 846 - DNA, 1745 bp, Zea mays
gcacgagggaaggcagtcacttctccaggagcccggagtcggcagcgagagagaatggccgccgccgccgccgccaccacccttcgtactgctctctcccactcccaagcaacagggcaagagcagagagcttcactgctttgcacaccggagcaccgagttgctgccagcaggagaagcttgagattcaccactagggccagctcgaatgcgggcgccagtgtgagcatcccgaagcaatggtacaacctcatcgccgacctgccggtgaagccaccgccaccgctgcacccgcagacacaccagcctctgaatcccagcgacctctcccctctgttccccgacgagctgatcaggcaggaggtcaccgacgagcggttcgtcgacatacccgaggagatcatcgacgtgtacaagctctggcgcccgacgcccctgatcagggccaggaggctggagaagctgctcggcacgccggccaagatctactacaagtacgaggggaccagcccggcggggtcgcacaagcccaacaccgccgtgccgcaggcgtggtacaacgccgcggcgggggtgaagaacgtggtcaccgagaccggcgccggccagtggggcagcgcgctgtccttcgccagcagcctcttcggccttaactgcgaggtatggcaggtgcccgccgcccgcggccagaagccgtaccggaggctgatgatggagacgtggggcgccaaggtgcacccgtcgccgtcgacggcgacggaggccggcaagaggatcctggaggcggacccgtccagcccgggcagcctcgggatcgccatctccgaggcggtggaggtggcggccaccagcgccgacaccaagtactgcctgggcagcgtgctcaaccacgtcctgctccaccagaccgtcatcggggaggagtgcctggagcagctggcggcgctcggcgagacgcccgacgtcgtcatcggctgcaccggcggcgggtccaacttcggcgggctcgcgttcccgttcttgcgcgagaagctgcgcggcaggatgagccccgcgttcagggccgtggagcccgccgcgtgccccacgctcaccaagggcgtctacgcgtacgacttcggcgacacggccgggctcacgccgctgatgaagatgcacaccctcggccacggcttcgtccccgacccgatccatgcaggtgggcttcggtaccatggaatggcacctctgatctcgcacgtgtacgagctgggcttcatggatgccgttgctatacagcagactgaatgcttccaagctgccttgcaattcgccaggacggagggcatcatcccggcgccggagccgacgcacgcaatcgccgcggcgatcagggaggcgctggagtgcaagcggaccggggaggagaaggtcatcctgatggccatgtgcgggcacggacatttcgacctcgccgcgtacgagaagtacctgaggggagacatggtcgatctctcgcacccggcggagaagctggaggcctccctcgctgccgtgcccaaagtctgacggcgttggagccaacagcacatgcgactggaatgggacgaataatccattgatatcaggttcatgaatcttgtggtgatccatcgcccatcggcagtgggatacttgtgttccttatgaaatgaatgaataaaatttcaataaaagcatttattttaccaaaaaaaaaaaaaaaaaaaacccgagaaggggcgcgg

SEQ ID NO: 847 - DNA, 1848 bp, Zea mays
cattgggtacctcgaggccggccggggcccaacacctctgaataactaccagtacgccattcgcataaaaaaaaaaactgagcctgcccgcccgcccgcccgcgcgctccgctccgtgaactatatctatctatcacctgctgctccaagtaggcgggcagaggcaggaaggcagtcacttctccaggagcccggagtcagcagcgagagagaatggcagccgccgccgccaccaccaccacccttcgtactgctctctcccaagcaacagggcaagagcagagagcttcactgctgtgcacaccgaagcaccgagttgctgccagcaggagaagcttgagattcaccactagggccagctcgaatgcgggcgccagtgtgagcatcccgaagcaatggtacaacctcatcgccgacctgccggtgaagccaccgccaccgctgcacccgcagacacaccagcctctgaatcccagcgacctctcccctctgttccccgacgagctgatcaggcaggaggtcaccgacgagcggttcgtcgacatacccgaggaggtcatcgacgtgtacaagctctggcgcccgacgcccctgatcagggccaggaggctggagaagctgctcggcacgccggcgaagatctactacaagtacgaggggaccagcccggcggggtcgcacaagcccaacaccgccgtgccgcaggcgtggtacaacgccgcggcgggggtgaagaacgtggtcaccgagaccggcgccggccagtggggcagcgcgctgtccttcgccagcagcctcttcggcctcaactgcgaaggtatggcaggtgcgcgcgtcgttcgaccagaagccgtaccggaggctgaatgatggagacgtggggcgccaaggtgcacccgtcgccgtcgacggcgacggaggccggcaagaggatcctggaggcggacccgtccagcccgggcagcctcgggatcgccatctccgaggcggtggaggtggcggccaccagcgccgacaccaagtactgcctgggcagcgtgctcaaccacgtcctgctccaccagaccgtcatcggggaggagtgcctggagcagctggcggcgctcggcgagacgcccgacgtcgtcatcggctgcaccggcggcgggtccaacttcggcgggctcgcgttcccgttcttgcgcgagaagctgcgcggcaggatgagccccgcgttcagggccgtggagcccgccgcgtgccccacgctcaccaagggcgtctacgcgtacgacttcggcgacacggccgggctcacgccgctgatgaagatgcacaccctcggccacggcttcgtccccgacccgatccatgcaggtgggcttcggtaccatggaatggcacctctgatctcgcacgtgtacgagctgggcttcatggatgccgttgctatacagcagactgaatgcttccaatctgccttgcaattcgccaggacggagggcatcatcccggcgccggagccgacgcacgcaatcgcggcggcgatcagggaggcgctggagtgcaagcggaccggggaggagaaggtcatcctgatggccatgtgcgggcacggacatttcgacctcgccgcgtacgagaagtacctgaggggagacatggtcgatctctcgcacccggcggagaagctggaggcctccctcgctgccgtgcccaaagtctgacggcgttggagccaacagcacatgcgactggaatgggacgaataatccattgatatcaggttcatgaatcttgtggtgatccatcgcccatcggcagtgggatacttgtgttccttatgaaatgaatgaataaaatttcaat

SEQ ID NO: 848 - DNA, 1182 bp, Zea mays
gcacgagaccattacctagaacatcctaatcgaaaaacctcacgcttcagagcagcatcggctgctgcttttcaccgccgctgcagtgtcacggtgcgccgtgcacgcactcccaatggcacccggcggcggcggcggcatcagagccccttcgccagacctcccagtcccagcccggcaaaagttcgcaaactcgacgagaagaccacgggcttattccgctgccagtgcgctaccgagactcccacggcctcagtcgatcagacgcggagccgtggtggtagtggtagcatgcgcccgcggaagcgagcagcaatcctctccggccgtcgcggcaaaggtgcggcccgagcccggcacgctcagcgtcgagttccggacgcgggacggctgccggctcggcatcgccaggtacccggacttcgcgtacaacgcgcagggcggccgcggcgtgggcgccgggcgcgggtcgaagagcggggaggatgatggcattggcacggtactcgtcgacttcgacgtggcgaccctgtacatcccgcccatgtccggcgcgacgaccaggttcctcggcctgccgctaccgccgtacctcaagatcgatatcttgcccgaggcactgggcggaaccatcgatcgagccactggtcatgttgatctcaagtttagatcgaggttctgcttctcggttgggagcgtctacaaagcgccgccactgttcgtcgagacaacactgacctccgaggagtcgaggggagccataagatccggcaccggagaaagaatggacgaagaaggcagatgcaggctggttggggtggccgtcgtcgacccaattgatgacctcttcatgaacacatttctcagcctgcccaccgagtgcattgcttacttgagcgccaccatttccatagccgctgcgagatgaacgtctttattgctggcttacattgaaaatataatgcgcgcgccgattttcttttttcttgtaaagattagccaaggctcggccatatcgcttcagttcatattggaaacctgaagtacactactatcgatcatcgcttggccattgatgttgttggggtgtaccatgtctcataagctaaggagccctcgtgtgtaaaagaggccaaaataatatgttcagggacatatgtataaacatctagtggtttaatt

SEQ ID NO: 849 - DNA, 6545 bp, Zea mays
  misc_feature (922)..(922): n is a, c, g, or t
ttggctgtcgtaattgcagaaaacgcaagagataatattatgaggcagatcgctgcaaagtagtttctttgtatgccggatgcaacgatttttttttccggaaacagagggaggcggaggagagcagttgcttgcaagcttcccctaatggagtaccaagtttttcacagaaaacaaaaggagaagagagaaaaaatggtaaagagatctacccaacctagattatatggtcatgactaatgatggtggcgcggtcgtccgcttttttgttcaccgtacccggatttatgtgtgatcttacaaaaggataaaaagccatgcacggggtgtggtcctgccgcgggtttattggatgcccaaaagaagcatggtccctgctctatatagagtagcctcctaggttctggtgcgcaaggacatgcaaagcctcgtcgtatatatgctgggtcgtacaaaaacattgggaaagacacttgacgattattatggaatttagacactgtttggttcacataattgtaacgtaacgagcaatcgataacgttaaatcattattttttttaagtcaaccgtaattagatcacacactaaaaattaataccggcatattcaaacctattagtgcggtcactcaagtgtcaatcattaccattactgtttacgttacattttgcatgccaaccaaacgtcaacttgacgtgtgatacgtattggtggtgtcatgagatatcatgaatgatgtgatatgtattggtgtgttccgtaatatgggttgagagaactccgtgacaacgatatgtatgtcttcatactcaaatagtgtatcaatatattgtcatctgagacgattagtatttcttctagtttgctcagttattattattggagctcgcgacctcagggccggtctgagttttgtgtntgtgaaatcatatggggttcaaacgacgcactggtaggtattactattagatcggtcctagtgatagttttatgtgaaattcatttatattaaataagttgccacacaagtacttttttatgacatgaacacgtacgtatttaagaagggatgaaaataaatacggcctctgtatcaatatagtagtcgttttagtatctaaattcaaatgatgttaaatctagacacgtatataaaacacgtacattaaatattaaatgaatccactattttactaaaacgattttatttttggaacagagagagtaaggtttttctatgtaaaaatctctactagtcatgaaattaaatgattagtaaactacggaataaaaataaatattgagagtaagagtttcatcccagttcattttattatatgtgattcgactgagactgactttattgggaaatgttcaattttttcgcaagagttagctgaaattaagctcacggtttttgggtactggagcgtttgtatgtttgattaattactcgccagtaatatatcaagctagctatagctacttgctgcaaagtaaacgctctcgcagcggttatttttgcttcagggaaaaaaaaaagaaaacccaaacgtgaaaggtgtggcgcggcagtatacgcgcgtgtagttcacgaccgtcaatcagtgcagtcgtcccgcagcactactcactgtacgtagtacgtggcgagaaatgagagtcgtcaccgcgcggcgtcaccatctgtccatctctgctctcgacggtaacacggcgcagcgctgctagcttatcgcacacgaggagcacgacctgccgggccggggtgaaaggacagggacccgaaaacgacgccaccagcagcagctgatcatttatagttggtgcaaacaagcaccacacaagtccgttcctcacaacgcacaagtagtagtagtgcatgcctgctcccatcatcatcactacacactacaaacactaccaccatccagcagctagcagaaggcagaagcagctagtgtagatagccggcggctggctgagaccaccacctctccctttcctttcttctctttgctttgctccctctcatctcatcttcccttcccttctccagctaacactacagctttctagggctcacaccgcagcaccgatccagcgccgtccggtcgtcgatccacatcaccattattccatccccctgataacgatcgagccccagccctccctcgctctccgggctgagctagccggacgaattcgggcgtgcggcttcgagctctcgcttatatcagcgccgcgcgcgccggccggcggccggaggagccactatcatccccggcgtttgattcggccagagcagcggccatggtcgaatatatttgatctctctcgatctgatctgagctgagccggctggtggcccgggaaggacgaagtgtgtcgccaccgagaatttgatgatgtttgtaagtggttcttaatggatctacaattctatactacatatatatactacacgctagctatgccggattttaagttcttctctctctctctctcctgttcttaattgctcatatatttgctttgtttacactccgagaaaaataagttttcattttacactagtgcatacgtcacacactcccttgtttttatatgtgggagtacttgttttctgtcttttggggaacaaaacatatataattctttttttctcttttagtatatatgtatacgctaagcagcttgcttccccaccttcagagcaagggattggaagaggcacaaggcagcccagggacccatttcaatctgatttttcaaggcgactcttaattttatttgttcctcatccccattattctccctccgccggtttctaacttatttctccagcatttgttgttaatgagctttggataggattatatataggtgctagctgtaggacttttaatatttttcttgatgaacatcgtatatttaattagcatgtttctataacacacaccttcgaattacactggctgctgtttttttttcttttttggaagaggattctagtttactgctgcttgtggagtaaggaaaatttaagcataagaggaagtataataataacaggctacaagagagcataataatggtgagctggagcaaagataaaaagagggaaggaaactggccgggttgtaagtctactgtcagtttctacacaggaattaagaaactttatgaaataaaaaaaatcgatcagtattagtattgaagagctaaccactctatagatataggctgcgaggacaagctgtatcattagttttgctataaataaagagagctacagtccactatccacccaagttcatgtttcagtgccatatatatgcccatatctttccgtgattcgatcgatctgaccagtgccttagtagcaaataaggctgctcgtttaccagtggacagcagtgggcagatcgatccatatccacatgttgctcaccagcaccagcagcagcacgcactgtcatctggatgcgccagcgatctcatttcatgcatgcccaattaacttcccctgcagtagtctcgactgtctggttcaattctgtactatcctgatgatgatccgttattaggtgtcatcatgatcggtggctagcagaataagagatgataagcggcaacctcaacaatgaagagctggggggcggcgggtgcaccaaggccgaggggccggccgcggccgccggcgccggcgccgtcgtcgcaaagagtcccgtgctgtcgagctcccggcactggccgccgtcgacggagtcgaggatcgtgcgcgtgtcgcgggtcttcggcggcaaggaccggcacagcaaggtgaggacggtcaaggggctgcgcgaccggcgcgtgcggctgtccgtgccgacggcgatccagctctacgacctccaggaccggctgggcctcagccagccgagcaaggtggtggactggctgctcgacgccgcgcaggacgagatcgacaagctgcctccgctccagttcccgccgcaagggcaggacctcgtcgcccatctcccgccgtccatggtggcgcccttcgccaacgttgcagccgaccgggccgccgccgccgctgccgccgcgaacgcgtcggccgcgatggccgaaggcggcaaacgccactgccacggaggcatcaaagggctcatgggcatgggcctcaacaattctatcggcctcgccaacgccaccatgccgctggctcacggcttgtactacacgcccggtgagtcttggaccaatggaggcaatgccgccgtccatgatcatcaggtgagccacggcggcacctcgcctcagacggtggctcaccactcgccgttctcgtctctgctgtctcttgctgctccggggccccagctcgtcttctactcgccggaaggcggcggcttcgccatgaaagaagccaccgatcatcagttcgctgtagatagcctcgatcactcgcaaggccagctctcactgagctcagctagaagcttccttcaccccggcaaccagggatgatattaggtcactgatctctactgctccaagaaggtacgtagaacaataaagcttggtgtagtagtaatcaagtactcgtttgaaggctccgtaaagcttgcaactgcagttttgagatgttattgtttggtatgatcgagtagaggggctctagcgtagagagctgctagcatgcatagtaattaaggttaattttgcaggacatgcaatgcaattcgttgcttcttttttatacaaggaagtaaccggtcatggggtgtgtggtgtgtgtgtgtgttggcaatgtaataacaattttataattcgttcttgaatttgtgcttagctaaaaaaaaaacctttttagactttgttttcatatatactcgatcaatccataccaatatttcgaggtgtttttttgttgtttcacttgtattttagagaaaaactttcatgctctcatttctctccttttgtcagggttactatcggtttaaaacaaagatcattggcacgccattaccattgtagattacattgcaatatagcctaaagttattatctcctattatatacattcacattggattagtcactgccatagcatggataatttcctaagaactgatgtttggactgaggattagtttggagaatattatctatatttttgcagtgttacttcaattcttgaaattggccactgaagtttggctcaagcatatttcacatagttcatccatatatcattctcaccctttggcccttccagaaaccggagaaatttaaaaaccattaaggatagtttgaaaattcaaatacttaattttggggattgatggaggggattaagggaaaattaactagcccttaacagaaaattgatggcatgattcacgtccatgcatttattactagactagacaccgcactaattaacatacttataaactctatataatttagtgtttctctttttatttatgtgagagcaaatcattgactatactatattttgctaccatatctgggaaactttattgaaccagggcacttcagtgttattgaaaaacagtgtggtcggaaataatgtcatcatgccacacccactagatcacgtacaattaacggtactaagggatgtttgaatgtacttttgctaatagttagtttgctaaacaaatgctagtagaattagctagctaacgaatatctagctaactattagctaatttgctatagctagactgtttagatatcttcgtctaattctaataactaactattagctcgagtgcattcaaacatgcgtccgtggatatcttgaagaggacgagtgtgacgctttctcctcaatttattcacgctcctcctaagcctttcgacttctccgatgaacatcttttcatcacaatatgacatttgttgctcaatcggagattcacttactttggagttgggttagcacatgataaagtattctcagaatgaatgcatgtgcttatatgaggttcacagaaattaaaactagcaataatatcctcatgagcagtttctaatatgatatggtcatcaagcaatttttcatgggaataagacaacatatcatatttttcacatagagctaacttttcaagttctagattttctatttggtccctgagcatgacattatcaagtttaacttgagcaatacaaaatagcgcattctcattattaatttgcttaattaaaattgcttcataccatttgttgtaaggtcaaacctatcaagtatcaacagagtgtaaatcagttgttgctctcacgagacctatgtgcaggtgcgctcgtgtcatttaagggaaatgtgactagtgacagtgctagatatggggcggatagagctcgagcacccccaatcgctcccgaacccatagacccctctaatgttctttctaaaatttaaaatgtactagtacattctcattatgtattttaggatttccttcgttcatcgatgttctaatatgagattactccaaaccctgctaaattta

SEQ ID NO: 850 - DNA, 4103 bp, Zea mays
  misc_feature (783)..(783): n is a, c, g, or t
  misc_feature (3712)..(3712): n is a, c, g, or t
atccgttacgatcgagggacagatatcgtcagacataaatttgctagcttcataccacacgtgtgtgtgaaggtgtggcggcatacacgcacgtgtgtagctcacacggccgtcaaccactcctgcattactcaccggccgtacgtgccgagagagatcgatggagtcatcactcatcatcgcgcggcgcggtcaccattatatgtggtcgacggtaacaacacgccgcaggtagcttgcttatcacacacgaggagcacgacaggggcccgaaagcgacgccgccagctgatgatcattttgttggatggtgcaagcaagctagcaccacacacaagtccatcacaactcacaagcttagtgcttgctcccatcacgacgatatcagtacaaacaccagcagcagctagctagtcgatagccggccggccaaaaccacctctccctttccttcttctctgtcccccttaattctccagccaatacagctttctggggcttacaccgcaggtccagagccggccggtcgtcgatccacatcaccattactccatctcctgataccgatcgagagctcctccctcgctccgggctgagtcgccggccggacggactcctccgacccgtgcggcgtcaggccggcccgccagctgggccatcccgttttttgattcatcagccgtagtaggactaggagccatggtcgaagctatttgatctatctctgagctgagctgggccggcaatttgatgatgcttgtaagtggttcttaatggatctancatcatctacatgcagcagctgcccggattttagtttcttctccagctcttgctcctttttttttaacatttactccacaattttatttcaacacgtactagcgcatacgcgctccacacactcccttgtttttatgtgtgcagtggagtagtgtagttagtgccttctgtcttttggggaaacgtaatcacgttttcttttagtgtcgtatatgtgcttcattctacctgcagaacaaggaaagatacactggaacccagagatgcagctcaatctgatttttcatggcggcttttgattttgttcctcatctatctatatcgtccccgttaattctagctccctctggtttctaattttctccagtatctcttgctaatcttggatatataggacttatatactgtatggtaatttgatactgagtactgacacattgctgtgttgaatccaaatatccaatgcaaagagctcataaattaaacgccactaaagctaatcttttgttaaccaacatcatattaatataattcgtctgtttctttaataaacaccttcagatttacattgactgccgcttgtagagtagtaagcaaaattaaagcatataaagagggctacagtccactgtatccacaccaagttcatgtttcagtgccatatctttccgtgattcttcatgtcttttaccgaataaggctgctctgtgctcgtttaccagtggacaacagtggccatgccagatccatccattcacaattccacatgccgctgctcaccagcacgcactgtggccgatgcgccatcgatctcatttcatgcatgccgaattatttccccccggcccctgcacaagtctagagtctagagtctagacactagactgtcttgttcagttctgacttattatctgatcatgatccgttgttattaggtgtgtgtgtgatcatgagtggatagtaagagatgataagcggcaacctcaccaatgaagacctgggggccgggcgcaccaaggccgaggggccgacgaccgcggccggggccgtcgtcgcaaagagtcccgtgctgccgagctcccggcactggccgccgtcgacggagtccaggatcgtgcgcgtgtcgcgggtcttcggcggcaaggaccggcacagcaaggtgaggacggtcaaggggctgcgcgaccggcgcgtgcggctgtccgtgccgacggcgatacagctctacgacctccaggaccggctgggcctcagccagccgagcaaggtggtggactggctgctcgacgccgcgcagcacgagatcgacaagctgcctccgcttcagttcccaccgcaggcagcgcaggacctcgtcgcccatctgccgccgccatccatggtggcgcccttcgcagccgaccgggccgaggccgacggcgacaaacgccactgccacgccggcgtcaaagggctcatgggcctcaacaattccatccgcctcgtcaacgccaccatgccgctggctcacggcttgtactacacgcccggcgagtcttggaccggtaccaatgccgatgatgccgccgcccatgatcatcagacggtggctcacggccactcgcccttctcatctctgctgtctcttgctgctccggggcctcagctcgtcttctactcgtcggaaggcggcggattcaccatgaaagaagaagccaccggttatcagttcccagtacaaaatagcctcgaccactcgcaaggccagctctcactgagctcagctagaagcttccttcgccccggcaaccagggatgattaggtcactgatctctactgctccaagaaggtacgtagaagaataaagcttggtgtagtagtaatcaagtactcatttgaaggttccgtaacggttgtaactgcagttttgagatgctattgtttggtatgatcgagtagagggtctctagcatgcataattgaggttatttttgcaggacatgcaatgcaattcgttgcttcttttttatacaaggaagcaacgacaggtcatatgggtgtgtgtgtttgtttgtattgtaataacaattttaataatccattcttgattttgtgtcaaaaaaaaaaaaaaaaggaatatgataatgatgaaaattataccaatcatcacggaaaagattgcaccatgcatgatcaatttgcatgtaaacagtcttccaatgtattatatgaaatctacagtttcatagaagctttgaatcaaacaactttcagcttcttcatggctccctgctcatagcagataatagaaaacaactttttttcatagcacatatcaaaaccaaaacgcgctctaaagcaatccattcaaatattttgatggatttttattgttgtttttcacttgcattttaatttctctcctttttacagcgttactatctacttaaaaaggattattggcattatcttgcagattacactacaatatagccaaaagttattattaactatctcctgtatatgatcatcgacaatatcctaagttaactaggtttttttccttcaaaatttccttttataagttgtgtgttttttcttaaatccaacactacttttcaacacaataatagaaatatatattgcatataattcatgtttaatacacaattctagggactacagtttgagctgaggattagtttggagaatattctcactatattgtacagtacttcaactcatgaaactgttcagtgagcaaatcttaattttggctctagcatatttgagatagatcatccataccactctttggcccttccaaaatctggagaaattgaaaaccattaacaggaaattgtggacatgattcacatccatgcatttgttactagactatagagacaccacaatgataacatacttttgaaactctatgtaatttanttcttattttatttatgtgagagcatatcactaattataatgtattttgctaccttgttgtaaaacttatgtgagagcagatcactaattataatttcaaatatttgaagttggataagtttgagggattttcaaggcatcagatcgtgtgtttcatgggatgaggcctctacgtagacagaccaaaagcacttaatcgtcggatcctataaatagtacctcattgaaccaatatgttgggttcgacggtttgtgatatcagactcgagagttagttctagggacgtgaaactagctagtttgatgtcatgcatcaggccatatggcacggtggcaccattgtttgagttagttttcttctatattgttgttagagcctagaacagtacca

SEQ ID NO: 851 - DNA, 1601 bp, Zea mays
ggggtcatcccttatttcctcaggagaaatgtcaacaagattatagtcttcagaaaaatgcttctggtggggcattctgggagatatcattactatataatgataaatcaaaagaaaaaccagctttggactttcgcccacagtttgatatgccccttgatatagttatcgataagtgcattattcaagaaattttgcttcagtataaatatgttagcagcttcacgatgaagttgcttgaggagggttttgatctttgtgcacatctactggctctgcggcggtaccatttcatggaaatagctgactgggcagactcctttattgcttcaatttatcagaagaaatggtcatttgttaaatctgagcagaaaagatcggagatccaaggacttatggacttggcattgcagagatcttcatgcgattctgatccttataaggaaagattatttatatacatgagggagtcacctgtggattctgttgatgcctctccatgtggtcttgatttgctggatgatatcttgttgggttataaagctgaatggccaatgaatattgtcattacagtagatgcactgaaaatatatgctgaaatattctgttatcttcttcaagtcaggtttgcagtgttttccctgactgaagtttggagatttttaaaggagttgacacagttcatcggtcgttccagccatagcagatctgatgtgttgaagaaattgaattttgtaatgaaattgaggcataaactttatcactttctatcaacactacagcagtatctccactgccatttatctgatatatcgtggcgccgttttcaacattcccttaaaaatcaggtgagggatatactggatctggagtatgtgcatatatgttatattactgatgcacttgacatatgtttcttatctgatgagtcaaaacaagttgctacgataatcaagagcatgctgcagctggctttggagttacgatcatgctttcagagtggtgacacttgtgatttatcagtaaatcaactcagtaatttgcaataccttataaacttctctcaggtggatgtaattagaacaaagttcgaggataacatcaaagatctctatattttgcattcgaaatcttcaaaatatacggagcttggcctttcccgtttctgggggtatctgaactacaatgagtatcattctacgaaagtcagcaaagatatggacaacttctatttttgataggacattgcaagactgaagtaaggtttgcctttatatttgggcaatagctcactggccaccgggactagcttaccttttgaggtacacactgctgagtggtgagagttcttgtagatatacgctggtttgatcaaattggcccttgtattggtttttggcgaacttaagagaactattgttcagacatgccatatacttggagatgcatgtatgtcctaatggtgtatcccagttttacgatcaaaatgggaaatcatgtgtagttctggaaaggtgggaactttgtatagccaatgttgatattgattgttgacacgttacaattggtaaatggaaggtgaatgattgctctctggcctt

SEQ ID NO: 852 - DNA, 1155 bp, Zea mays
gtgctcgatgatagcgtggaggtgtatgagttgctcgtactatgtatgagtggagaggttcgtgaggttgcgtgagcttgaagcattgggcgactcgagcggaactgtaatggcaataaaaccttcctccttcgttccccatttctcctcttgctaggtttctacccctctaaatcgatcctcgctccacggccatggtgaggatgaagcaggtaaagatttcggtaaagaaggacgtggattcgtacacaatccgcggcaccaacaaggtcgtccatgtgggcgactgcgtgctgatgcgggcgtcggactcggacaagcagccgtatgtggcgcgggtggagaagatggaggccgacggacgcggcagcgtgcgggtgcaggtgcgctggtactaccgccccgaggaatccaagggcggtcgccggcagttccacggcgccaaggagcttttcctttccgatcatttcgacctacagagcgcccacaccatcgaggggaaatgtgttgtccactctttcaagaactacaccaagcttgataatgtcgggcctgaggactacttctcccgatttgagtacaaggcggccaccggttcgttcacccctgaccgcgtggcagtgtattgcaaatgtgagatgccatacaacccggatgacctcatggtgcagtgcgaagcttgcaaggactggttccatccatcttgcatggctatgaccattgaacaggccaaaaaactagatcactttgtttgctcagactgtttgaaagaaaatggttcaaagagactttcaaatgtatatgccacttcatcaaattcttagcccaaggctgaatcaataaggcagacgaggtgaaaactgagtgccaacatccaggggagatgtgctgcttctgtggcgaatcagccattgcactggcgagagcagaggtgtacagtgtttgctgtggtttgttcgatgtaactagccagtgtggcatgtcatgcagttgttggtagatcagtcattgtgttgacttggtcaacttaacacaacatcccccttcgttgattacattgttgctgtggcggtgcggcatgatcgattactgttctattaacatatgacttttatatgttgatataattaaattattttgatactaaagaagcat

SEQ ID NO: 853 - DNA, 1141 bp, Zea mays
aacttcaacgagtcccattttggcaaggcttcggagtaccaaactggcgaattgcgacgttggcggaattgtaatggcaataattccttcctccttcgttccccatttctcctctttctaggtttctacccctcatcggtcctcgctccacggccatggtgaggatgaagcaggtaaagatctcggtaaagaaggacgtggattcgtacacaatccgcggcactaacaaggtcgtccatgtgggcgactgcgtgctgatgcgggcgtcggactcggacaagcagccgtatgtggcgcgggtggagaagatggaggccgacggacgcggcagcgtgcgggtgcaggtgcgctggtactaccgccctgaggaatccaagggcggtcgccggcagttccacggcgccaaggagcttttcctttccgatcatttcgacctacagagcgcccacaccatcgaggggaaatgtgttgtccactctttcaagaactacaccaagcttgataatgtcgggcctgaggacttcttctcccgatttgagtacaaggcggccaccggttcgttcacccctgaccgcgtggcagtgtattgcaaatgtgagatgccatacaacccggatgacctcatggtgcagtgcgaagcttgcaaggactggttccatccatcttgcatggctatgaccattgaacaggccaaaaaactagatcactttgtttgctcagactgtttgaaagaaaatggttcaaagagactttcaaatgtatatgccacttcatcaaattcttagcccaaggatgaatcaataaggcagacgaggtgaaaactgagtgccaacatccaggggagatgtgctgcttctgtggcgaatcagcccttgcactggcgagagcagaggtgtacagtgcactagaaaccagtgtttgctgtggtttgttcgatgtaactagccagtgtggcatgtcatgcagttgttggtagatcagtcattgtgttgacttggtcagcttaactcaatacccccttcgttgattactttgttgctatggcggtgcggcatgatcgattactgttctattaacatatgacttttatatgttgatataattaaattattttgatactaaaaaaaaaaaaaaaagtctt

SEQ ID NO: 854 - DNA, 4155 bp, Zea mays
  misc_feature (1731)..(1731): n is a, c, g, or t
tttcatcttactatttattgttgtcttaaatccttgaaacatgacagttttaaatttatagaatattttttatagaaaacctcttagagatactcgatatatataaattttagggaaccgattggagatgctcgatatatctgaattttagggaaccgaagagttggagaatctttttatatttatttttacgaatcttgggagctgtccggattccggaacaaccgcttccggccccgacccgaccttcccgatctgagccgctacgaaaccaaccaatccaataccgccacgcgtcccctccccgccttcggcctcggagccccgcgtcccccgcgccgctggcagtataataactcccgcgccgcgtaactgcacgagctcgcccgagcaaaccgtcgccggtgcctaccgttcccgtcgccggtgcctaccgttcccgtcgccgcccgtcctctctacggaggtacgtgattccggctcctcaatcccgttgtcttctccctcctctgccgcggttttctttcccgcttggtcaggttcgcgcttcccgattagtagatgtttccttttcgcgtcatcttttcccgttttttttcacctgaaaactctgtttcgctaaccatccgtgggggtggtgcgcgctacatctcctgcgatctggttttgtgtcaggattcgtctgggtaattggagctgtagggatttattcttccaccataccatggatctgctagagaccataccaggggctgtggatttgaggatttaccgtgtgggtgggaagggagggtattttttatcgtagtatgtatatgcctaaatttgtgtaatttaggttatggagtgtaattctgtgtgtagcctaccggaatatttatcgatgtgctcctaggtgatacagattcgttgcagatgaataagaatgccagtgctgattgggcccaactttaattgacaggtcctttttcagatatcgctagggattggtgagttgtacggttcagagcgcttctacctgagttttctggtctttgatcagctgtgtgtaagggactaaaatttggaaagtgtcatccttcgaagttgacaaccaaccaatgtagcatgtttgacaggttgacaaaaaaatatttcacagtttcaatctttgatcaattgttctacagtctcaattgtacctttcttgcacttacgatgttaccataatttgtcatttgggcatttccctctatagaatctgaatacatattaaatactccctatgttcgttttgatttgtcatattttagttaaaaatgaactagtggacgataaatattcgataacagaggtcatacatgtctagcatcattctcgcgcgtgtgtgtgtgaattcctccttatcatgtgaatacgcttaaccatatactctactttatgctcatgcataattgttatcagtttgttcgactaatcacgattagttgggctgattgatggcatggcgatcatcaattagtcatgattaatcacgactaatcttgattagttgggctgatcagtgccatgacaactaggatctatcggacgaattgataacattagtctacttgccatagctcccacagaatcaaaatacatcaaagtttatgagaacgtaagttgcttccatttttttggggtgaaatggtaagttgtttccagttaaacgtgaggttgtaggctcactatatgaacatttactgtatnttataataatcgtatggtttgtgtgttttgaactgaaaactgagaccaattttatgcctaagcattatccaataatcatcctagcctgaagctattatttactgatgtaccctcttcaatgttcatcaagcaagctgcccattctgtaaaataaaaatattattattctgcctgctgcccatagaaaagttaatctcatgaattcaggaattgttttgtactgaagactgtcaccaattttatgcccaagaattatgcaacaatcatcctagcctgacgtggcccgagcaaaccgtcgccggtgcctaccgttcccgtcgccggtgcctaccgttcccgtcgccgcccgtcctctctacggagcccatataaaagttgatctcatgaattcgggaagaacagcggcatccaacgtttcctgttcagcgggaaacagcggcagcttccctccctgcctccttccaggatttcttgggttcccaattgttttcgtcaatttccacttgttcaaggccattgttcgcagccctgcatcttccgttgtcttgggaatgtgtggaaggagccttccttaaattgtggcccaagacttcctagtcatcttgcggaatctcataggttctcgaagatggtttcctctgagatgacctctgtcacagtgacgcgtgcacagggctccaagctttttagagggaagatccttctgccagggggatcctcagatgttgtgccttctgaaaatgttgagttcgatttttctgatgtttttgggcctagtgctgtccatacacacacagaagtgagtgttctcactctgggcagtccagcacctgtggctgagtccaacgatgaggtttacaatgaccctgatgtcattgtcaaacgatcccattcccttgttggtccatcatctcttgttagtcaatctttgccatttagcaagcttacattacacaagaaagacagctcattggaaatttcagagtgcctttccaaagaaaaacaaatcaaccaagggtcctttagtgatgatgagtttgatgatgtaaaaaaggagaatgagggtgttggacttgacgacttcgaagttctgaagctcgttggccgaggggcatttggcaaagtatatcaggtgagaaagaaaggtacttctgaaatatatgcaatgaaagttatgaggaaggacaaggttgtggagaagaatcacactgagtacatgaaagctgagagagatatactgacaaaggttgaccatcctttcgtcgtgcagctgaggtactcctttcagacaaagtaccgactttaccttgtcctggacttcataaacgggggtcatctcttcttccagctttaccaccagggtttatttagggagttagtttcatctactttgtgcctatcaagattttactggttttagttttattaagttaccacttatcttgtagggaggagcttgcacgcatctacgctgctgaaattgtatctgccgtagcccacctccatgccaacggtattatgcatagagatttgaagcctgagaacatcttactggatgctgatggtcatgctatgctgactgactttggtgtggcaaaagaatttgatgaaaacactagatcaaactcaatgtgtggtactgttgaatacatggccccagaaattgttcagggccgaggtcatgataaggctgcagactggtggagtgtgggagtccttctttttgaaatgcttacaggaaagccaccgtttgttggtggaaacagatgcaagattcagcagaagatagtaaaggagaagataaagctgccaacttatttatctagtgaagttcactctctgttgaaaggattactgcacaaagaagctggcaggcggctgggaagcggaccaggcggcagtgatgaaatccagaagcacaagtggttcaagtctgtaaactggaagagactcgaggcccggcagatcgagccaagcttccggccgaatgttgctggcaagacctgcatcgcaaactttgacaagtgctggacgaacatgtccgtgcttgactctccagtggccagccctgttgcagccaacagcaactttgtggggtacagttatgtgaggcccgcaccgttcctccaaaagccgagcccacttggctgaggaactgcttccgtggtctgagatctgccccggagttcaaatatttatctttttgactccgaatcctatgtatttcatcaagacactagtgttggagatctaaccttattgaggacaacaacttggttggtgattcccaaaaagttcctattgaagtgccatggttattatcctctgtttttgcttattgccattccttgtttgtgtatcttcactggtgaatattgtgataactagacaccgtcaagctctcccaaaaaaaaaaaaaaaaaa

SEQ ID NO: 855 - DNA, 3303 bp, Zea mays
acagccacgcgtccctccccgccctcggcctcggagccccgcgtccccagcgtcgctgctagtataacagccccccccgcccgccgggccggcccgggcccgagcaaaccgccgccgctgcccgccgttcccctcgccgctcgtcctctctacaagccaatagaaaagttgatctcatgaattcaggaagaacagtggcatccagcgtttcctgtccagcgggaaacagcggcagcttccctccctgcctccttccaggatttcttgggttcccagtcgttttcgtaaatttccacttgttcaaggccattgttcgcagtcctgcatcttccgttgtcttgggaatctgtggagggagccttccttagaccgctgccctataaggcattatttctggtctgggaattggccattgggagctgcatagctaaattgtggcccaagacttcctagtcatcttgtggaatcttataggttctcgaagatggtttcctctgagataacctctgttacagcagcgcgtgcacagggccccaagctttttagagggaagatacttctgccagggggccccccagatgttgtgccttctgaaaatgttgagttcgacttttctgatgtttttgggcctagtgcagtccagactcacacagaagtgagtattctcactcctgacagtccagcacctgtggctgagtccaacgatgaggtttacaatgaccctgatgtcattgtcaaacgatctcattctcttgttggtccatcatctcttgttagccagtctttgccatttagcaagcttacattacacaagacagagagttcattggaactttcagagtgcccttccaaaggaaaacaaatcaaccaagggtcccttagcgatgatgagtttgatgatgtaaaaaaggagaatgagggcgttggactagatgacttcgaagttctgaagctcgttggccaaggggcatttggcaaagtatatcaggtgagaaagaaaggtacatctgaaatatatgcaatgaaagttatgaggaaggacaagattgtggagaagaatcatgctgagtacatgaaagctgagagagatatacttacaaaggttgaccatccttttgtcgtgcagctgaggtactcctttcaggtaggcaattgtgatttacgtgcttattctttgttgccatgttcaaatctccagtatcctttttgccagtattaatcactcgcctgttttggcagacgaagtaccgactttaccttgtcctggactttataaatgggggccatctcttcttccagctttaccaccagggtttatttaggtaacttagattcatctactttttgtgtctaatgtctatcaagtttttactagttttagttttattaagttaccacttatcttgtagggaggagcttgcacgcatctacactgctgaaattgtatctgcggtcgcccacctccatgccaacggtattatgcatagagatttgaagcctgaggacatcttactggatgctcatggtcatgtaaggatctgttggtatgttctctgcccatcctacatcatcttctgctcatatattggaagtttgaaaaaaaatgccccttcttgacttgtcgacgtgtttaggctatgctgcctgactttggtgtggcaaaagaatttgatgttaacactagatcaccctcaatgtgtggtactgttgaatacatggccccagaaattgttcagggccgaggtcatgataaggctgcagactggtggagtgtgggagtccttctttttgaaatgcttacaggaaaggtgagtttttttttttttttgagctggaagtttctgactggacgtgttataggtacagaggagattttgtttatgtctcattacttgttcttttgccatgtatggcagccaccgtttgttggtggaaacagagacaagattcagcagaagatagtaaaggagaagataaagctgccaacatatttatctagtgaagttcactcaatgttgaaaggagtaagttgctgctatgtctaccttgctcctatgcattttgttcaaccagctttgtgttattgttaaaacctactgtttacggccatcactctaccattcgatctcataatgtttccattttttgtggataatcatcctgccatgatcatgtcatatttctcaacactgttatttatttcagttattgcacaaagaagctggcagacggctgggaagcggaccaggcggcagtgacgaaatcaagaaccacaagtggttcaagtctgtaaactggaagaggctggaggcccggcagatcgagccaagcttccggccgaatgttgctggcaagacctgcattgcgaactttgacgagtgctggacgaacatgcccgtgcttgattctccggtggccagccctgttgcggccaacagcaactttgtggggttcagttatgtgaggcccgcaccgttcctccagaagccgagtccacttggctaaagaactacttccgtgatctgatatctaacccggagttcaaataactatctttgagtctgaatcctatgtatttcttcaagacattagtgatgggaatctaaccttattgttgtgttgtgggtaggccagccaagcgcctattgcttgagaacaacagcttggcaagtgacaatgtgcaatattgccagaagttcttattgaagcgccataataattctcctacgtcaatttgaacttgctcggtctattcaattgtggccttataatgcaatttcattctcgggtctagttgccgtttttgtttccgtattccttatttatccattcgtggttctttggcctagttttggcgtagcagctataattcggtttatccttttcttccaaagatttcataattgggcgttgaacctattttattaggggcagctatgctatgcgctgtccacggggctacgtagaaaacactttcgaagatggagaagtttgtttggtttcaaaaggacttgtcacatggccaaattgttgtttgcttgccctatgaacacaatgtgcaggatcgggcagttttcccactgccagcaagaaaaggcggaacatgcggtgcgccccgtccccgtccccctacctcacgcatccacaggtgtccccctcatgccgatcagtacctccgattaactggcattgtctacgcggctacgccaaatgtatgaacaagataacgcgcattggcaacgccaagaaccaagaatggcagccagcaggataaccgatggacaactcccagtcccatccatg

SEQ ID NO: 856 - DNA, 2381 bp, Zea mays
ccccgcgtccgcccacgcgtccgcccacgcgtccgcggacgcgtggggcggcagcttccctccctgcctccttccaggatttcttgggttcccagtcgttttcgtaaatttccacttgttcaaggccattgttcgcagtcctgcatcttccgttgtcttgggaatctgtggagggagccttccttagaccgctgccctataaggcattatttctggtctgggaattggccattgggagctgcatagctaaattgtggcccaagacttcctagtcatattgtggaatcttataggttctcgaagatggtttcctccgagataacctctgttacagcagcgcgtgcacagggccccaagctttttagagggaagatacttctgccagggggccccccagatgttgtgccttctgaaaatgttgagttcgacttttctgatgtttttgggcctagtgcagtccagactcacacagaagtgagtattctcactcctgacagtccagcacctgtggctgagtccaacgatgaggtttacaatgaccctgatgtcattgtcaaacgatctcattctcttgttggtccatcatctcttgttagccagtctttgccatttagcaagcttacattacacaagacagagagttcattggaactttcagagtgcccttccaaaggaaaacaaatcaaccaagggtcccttagcgatgatgagtttgatgatgtaaaaaaggagaatgagggcgttggactagatgacttcgaagtccggccgctcgttggccaaggggcatttggcaaagtatatcaggtgagaaagaaaggtacatctgaaatatatgcaatgaaagttatgaggaaggacaagattgtggagaagaatcatgctgagtacatgaaagctgagagagatatacttacaaaggttgaccatccttttgtcgtgcagctgaggtactcctttcagacgaagtaccgactttaccttgtcctggacttcataaatgggggccatctcttcttccagctttaccaccagggtttatttagggaggagcttgcacgcatctacactgctgaaattgtatctgcggtcgcccacctccatgccaacggtattatgcatagagatttgaagcctgagaacatcttactggatgctgatggtcatgctatgctgactgactttggtgtggcaaaagaatttgatgaaaacactagatcaaactcaatgtgtggtactgttgaatacatggccccagaaattgttcagggccgaggtcatgataaggctgcagactggtggagtgtgggagtccttctttttgaaatgcttacaggaaagccaccgtttgttggtggaaacagagacaagattcagcagaagatagtaaaggagaagataaagctgccaacatatttatctagtgaagttcactcaatgttgaaaggattattgcacaaagaagctggcagacggctgggaagcggaccaggcggcagtgacgaaatcaagaaccacaagtggttcaagtctgtaaactggaagaggctggaggcccggcagatcgagccaagcttccggccgaatgttgctggcaagacctgcattgcgaactttgacgagtgctggacgaacatgcccgtgcttgattctccggtggccagccctgttgcggccaacagcaactttgtggggttcagttatgtgaggcccgcaccgttcctccagaagccgagtccccttggctaaagaactacttccgtgatctgatatctaccccagagttcaaataactatctttgagtccgaatcctatgtatttcttcaagacattagtgatgggaatctaaccttattgttgtgttgtgggtaggccagccaagcgcctattgcttgagaacaacagcttggcaagtgacattgtgcaatattgccagaagttcttatcgaagcgccataattattctcctacgtcaatttgaacttgctaggtctatctaattgcggccttataatgtaaggtgtcgtttggttcacatattgataacataacgggtaactgataatgttaaatcatgtttgtttaagtacaactgtaatacgatactacactaaaaatagatgtcagcctattcaaatttattaccatcggtattcaagcgtaaatcgttaccattacatttacgttacatttcgtgaaccaaatgacacctaatttcattctctcactggtggttttttggcctagttttggcgtagcagctatatttcggttcatccttttcttccaaagatttcataatttgacgttgaacgacctattttattaggggcagctatgctatgcgctgtccacagggctacgtagaaaacactattct

SEQ ID NO: 857 - DNA, 1032 bp, Zea mays
atacgcaactcgcactcgcagcggccgtccgctcccctccgcctttcgtttgccccgccattctatcctttcatcgcctctccagcgcccaccagctagctgttcgacccaacaccggactcctcccaccccgatcctctacccgccgcacaccccaatggcgaccgccaccgcgtccgtggcgccgccctccacctccacctcctcggtcctcctgcaccgccgtctcccttccccggcgcccggcgccttcccccggctctccggcccggccccgccgccgcgccgcgcgcgcctgctcctccgggtcgcgctcaccaacgaggtggcctcggacgacgtggcggccgaggaggccgcggccgcgcctaagatcggcaggcgggtgcgcgtcacggcgccgctccgcgtctaccacgtcctcaaggcgcccgacctggacatccagggcatggagggcgtcgtcaagcagtacgtctgcgtgtggaagggcaagcgcgtcacggccaacttccccttcaaggtcgagttcgagctcgccgtcgagggccagcccaagcccgtccggttcttcgcccacctccgtgaggacgagttcgagttcgtcgacggagagtgacagcgtcgagtgcgttcgggtaagcggcgacggcgagcgccgttcttatagaataatcaaggccgcggcggtcgctggtttatactgttccggtgcaggagctcgcgaggcaaggcatgtcaagtgtttgcttactcactgtctgtgctgctcaggcttcttcctcgttcggttcagcatcggtttttcagctgtggggaattaattgttcggatgctgtgcaccatcgatagtttataatagtggtaatttggccgctgttcgttggctatgctctgcgcttagttattttgctggctcttccaagagattcgtttgtctgattggtacacattgcattgaaacccggaactgtttccttggattataaaatctggttattgtacaaaaaaaaaaaaaaaaaacccgcggcc

SEQ ID NO: 858 - DNA, 852 bp, Zea mays
tttgggaccctcgagccgccccccgtcagaaaggaatcacacggcacgccgtctcgtgtgcttcctaggtcattcggtcattccacttccaccaatctgtctcccaatctttcttgctgctccaattcgctctctttactcggccagcggaaggggagaggagggcgagatgacggtggagaaggtggacgcggggctttccgacttcgacgcccacttcgatcgcctcttcgcttccccggacgccgcctccgacggcaaggtgaagctgctgctcttcctggccgaccgcaagcctggctcctccctctcctggtgccccgactgcaacgtggcggagccggtgatctacgagcggctggaggcactggagggcaaggacgcggtgctcctgcgcgcctacgtcggggacaagcccacttggcgcgacccggcgcacccgtggagggtggaccccaggttcgggctcaagggcgtgccaacgctgatccgctgggaggatggcgccgccgccgcccgcctcggggacgacgaggcgcacctcaaggacaaggttgacgccctcctctgcgctggcggcaactgagtactgacagatctggtttcccgttcgggttccatctgcgtagagtggccataataacatgtactgtaattcagttcatctacatgccggaccagaagctggggaatcgtgtgaagcttaataattcagtttatctacatgccgaaccagaagctgggaaattgtgtggaactaataattcagttcatatatgaccaaaaaaaaagaaactgcgagattgttaagctagtaaaacgatggtaccacagtacaatatagtacattcc

SEQ ID NO: 859 - DNA, 856 bp, Zea mays
agaaaggaatcacacggcaccccggctcgtgtgcttcctaggtcattccacttccaccaatctccctcccaatcttccttgctgctccaatccgctcttttattactcggccagcggaaggggagagaggagggcgagatgacggtggagaaggtggacgcggggctttccgacttcgacgcccacttcgatcgcctcttcgcttccccggacgccgcctccgacggcaaggtgaagctgctgctcttcctggccgaccgcaagcctgactcctccctctcctggtgccccgactgcaacgtggcggagccggtgatctacgagcggctggaggcactggagggcaaggacgcggtgctcctgcgcgcctacgtcggggacaagcccacttggcgtgacccggcgcacccgtggagggtggaccccaggttcgggctcaagggcgtgccaacgctgatccgctgggaggatggcgccgccgccgcccgcctcggggacgacgaggcgcacctcaaggacaaggttgacgccctcctctgcgctggcggcaactgagtactgacagatccggtttcccgttcgggttccatctgcgtagagtggccataataaataacatgtactgtaattcagttcatctacatggcggaccagaagctggggaatcgtgtgaagcttaataattcagtttatctacatgccgaaccagaagctgggaaattgtgtggaactaataattcagttcatatatgaccagaaaaaagaaactgcgagattgttaagctagtatttcgaaaagaaaaaacgacacagtacagcggcctacattcccagaggccgaatcctaggttcaatt

SEQ ID NO: 860 - DNA, 2898 bp, Zea mays
gtccgcgagcagagcgcgcggcatacactagtgcaatactagtttgcaaaggtatttcgtacttgcaaaccgccctgtgcaagcgccttcgatccggatccacgcgtccttgaccacatctgcatctcgcatgtccttcaagctcccgccggcgtcctagtcttactcgacacctggactggacgccgctatgctctgtgagtggacacccggtccattcgggctcagatcagttgatcgcttcctctattagctacaagccgttgcctggacagactgctcgttcgttctttccgccgcaatccatctcttcttccgtgctgtgtgcggctgcactggtgcgcactgatcgctgcacgtacacctagcaaatggccgggtggagaaaggcgtggatgtcggtgctggaccgggccggcggcggtggcagcaccgtctccctgcagggccgcctccacctcccgtccatcctcgccagctacaagcggggcggtaacaagtacgggaacggccacgtcagcggcaaggcggtggcggcctgcttctcggtcgcgctcgcgctcgccttcttctacgcctcggtcaccggcgggcccgccgccgccggcttctcctcctcctcctacgcgcttctcttgccgtggctgtcgtcgaactcgtcgtcgacgtcaccgaagaaatcgcctcctacacaccctcctcccgtttctcctgccgtggctgcgggcggcgctgctgaccacccgacagacgcgcgcaacgcgaccgcggtgtcgcgtcgcgtgccgagcggcggcgcggtggggggctcgtcgggttcggaggtcggcttggggcgagcgtcatcggcgccccggcgaacgggcagcgcgcagggtcgtctccccctgcaggacgccgggaacgccaccgtgggttccgacgccaaacccaccagtaacagtaaccgaacaagagaagatggaccccaagtagaaaccgcgatgcggatgcagcagtggcaaaaggcagacggagccagtcgcgcttcccacgacgccgccgtcgtcgtcggtgatggcggtcagcgagcggcgaacactacggacatcgccaccggcaactccacatacacagggacttcgagcagagaagaaacagacaaagacagcgccgttggctacgtccagaacctgccacggcgagtggctttgccatcacgaccggagcggaaggcggaaagacacaggcgcaggagagccgtgaggcacaggcacccgaggcgacggaaggagaccctggtctcggcgcaagatctcgctgccgagcgcagcgacgacgagatggctggcgtcaaaaccagcttggccgtcgggccagggaacgacatggccgcaggtgcgaacgccagcatgggcgctgtcggggccggcaacaaccgtgtcgtgtggacgtccggcgtgcaagacctggtttccttcgccaagtgcgacgtgttcagcggccggtgggtgagggacgagagctacgggttctacccgcccaagtcgtgcaaactcatcgacgacgacttcaactgccacaagaacggccggtcggacagtgacttcctcaggtggcggtggcagcctcacggctgtgacattcccaggtactcctgtcctgaggcatttctgaaactgaacttcatgcatgcgatatccgatcctcacaatcttacgacgagactcactcgcctcgctccaggctgaacgcgactgaattcctggagaggctgagagggcagaggatcatattcgtcggcgactcgctgaaccggaacatgtgggagtcgctggtctgcatcctccgccatggcgtcagggacaggaggagcgtgtacgaggcatcggggaagaaccagttcaagaccagaggatactactccttcgtattcagggtacagacgtttgcccactgaatgagatgacaagtcttcaatttcatcacttgtttttttttcctcaatggtacttcacttgcacgtcgccgtcggctcggttgatttcataagatcaatattcctcgtcagggagacgatccgtgagggcagaaacggcactgaagacgcgaagctgaaactggatgagctagacgcgacgaccccagcataccagaccgcggacatcgtcgtcttcaacaccggccactggtggactcactacaaaacatcaagagggtacactgtactttctggagcgagtatcatatcgtcacttggtttccataatccaaacattgctgaagtgcttgcttgctagtccacaggctgaactactaccaagagggcaaccatgtgtatcccagcctcgatgttctggacgcgtacaggagagccctcgtcacctgggctagatgggtggacatgaacatcgatccgaggaggactcaggtcgtgttcagaggatactcactctcgcatttcaggtaagacatcgccgccgccgccgccccggcgcttcgctggctggattccttcctggttgattgttggtgccatatatcttcacttgacaatgaaaatttttggcaacagaggagggcagtggaactcaggagggagatgccacggggagaccgagccaatattcaaccagacgtaccttactgagtaccctgagaagatggttgtcttggagcaggtcttgaggcagatgaaaactcccgtcatatacctcaacatcagcacgctcaccgactaccggaaagatggccatccgtcagtctaccggatacgttgtgatacggaggaggaacggatggcgatggtgaagaagcaggactgcagccactggtgcttgcctggcgtgccagatacgtggaatgaactgctgtatgcttcgctgctgcaggcaggcaagggctcctggaaattatgag

SEQ ID NO: 861 - DNA, 1469 bp, Zea mays
tattaatcaccagtttgacgatcgtcctgcagtgtcgagtaggcaccagacaggaagaaaagtatctagtgtttgaaccaaaaaaaaatgatcgatacatgccagctgttcattaattaattatgtggtggatggagaaatactcatcatatatacagtaccacgaaaaacatgtaattaataactaacgtgctgtcgttggaaaaaatctaaaaccgcagagcattccggagtccataatcgcgaggctcctgaacgtggtggtgctggacgtgcgctccaaccagctcaagtcgctgcccaactccatcggctgcctctcaaagctcaaggtcctcaacgtctccggcaacctgctccaagaactcccggccaccatcgaggaatgccggtaactatataacacatgcatgcatgcatgccgcatatgagctgcactgcttcactcactggcttgctgtgagtgctgactacgtgagacatgtgtgtgtgccagtgcgctggaggagctgaacgccaacttcaaccagctgacgaggctgccggacacgctgggcttcgagctccacggcctccggcggctgtccgtcaactccaacaagctcgcgtacctgccgtcgtccacctcccacatgacggcgctgcggtcgctggacgcgcgcctcaaactgcctccgcgcgctgcccgacgggctggagaacctcggcggcctcgaggcgctcaacgtgagccagaacttccagtacctgcgggagctgccctacggcatcggcctcctcgtctcgctccgggagctggacgtcagctacaactccatcgccgcgctcccggactccatgggctgcctcaccaagctcgccaggttcagcgccgcgggcaacccgctggtgtgcccgcccatggacgtcgtcgagcagagcctcgacgccatgcgcgcctacctcagcgcgcggatgaacggcaccgccaaggccaagaagaagagctgggtgcccaagctggtcaagtacagcaccttctcggcggggatgatgacgcccggccgcaccaaggtgcacgggaacaacaccgacggcctccacatgtcggattaccggtcgctcgacggcggcggcgttgcgtcgtcggcgtttctcagcatgctgtcgccccggcgtctcttctcgccgcggagaaattcggccaagcactagtagcttagcagtggccactggttcggcgggctatacatgtgtgctccctccttattgctggctatttgcttgctgcttcgatgttcatatgacatgctcgtactgtagcgcaagctgaagctaatgatcttgctactacagttgtatatgctttgaagagaggtatatatgaagtgtgtatagtagcacgtagtgcaatagggcattgatgtacataggaattaagggtgtctttctttccattgtccaaaaaaaaaaaaaaaaaaggggcggcc

SEQ ID NO: 862 - DNA, 3906 bp, Zea mays
  misc_feature (2859)..(2859): n is a, c, g, or t
  misc_feature (3531)..(3531): n is a, c, g, or t
  misc_feature (3554)..(3554): n is a, c, g, or t
aggccggcccggccgggctcgacgccgcgcgccacgacgcagcacgcccaagaaaccccgtgtcctcacaaaaaccctgcctgccggagatggccagcggcgaccttctcctccgcgcccacgccggcgccccggtcctagcgagggccttctcctgccgcctcctagtcccggcgaggcgccgcagcggactaatctcacctctggccgcttccaaggtcggcatcgccgacgtcgttgggcgggtcaggtcgggcggcgccgaccagaagaggcgacgcagggatgcgaaggagggatttgggttctccggggtggccacgaggagagaacttatcgacgacgagaaggtggagcaggacgaggaagatgaagctctcaagttgggagtggagaagaatggtggcgagacgggaggtgtggatggctcgtacctcagtgagacacggtttgatcaatgtgctatttcccctttatcgatgaaagccgtcaaagatgctggatatgaaaggatgactgaggtgcaggaggcaactctgcccataattcttcaaggcaaggatgttcttgcaaaggcaaagacaggaactgggaaaacagttgcctttttgcttccagcgattgaggttctctccactctacctcatcagcggggtcagttacggccacctataaatttgctggtgatgtgccctactagggagcttgcaaaccaagtggctgttgaggccaggaagcttctcaggtatcatcgcacgttgggtgtgcaggttgtaattggtggcacaagattaactcaagagcaacgaagcatgcaagctaacccatgtcagattcttgttgctacaccaggaaggcttaaggatcatcttgagaacacacctgggttttctaccaggctcaagggtgtgaaggttcttgttcttgatgaagctgaccgcctgttggatacccacgcgtccggagatattgagaaaataattgcttcaattcctagagaacggcaaacactgttattttctgctactgttccagaagaggtccgccaaatttctcatgtggcaatgaagaaagattataggttcattaacactgttaaagagggtgatgaggagacacatgcacaggtgagccagatgtacatggttgcaccactagacttgcatttttctatcctatatgatgtattgaagaaacatgtcgcagaagatgcagactacaaagttattatattctgtactactgcaatggtcaccaaacttgtggctgaagttctctcccagctgaaactgaatataagagagattcattccagaaagtcgcagtctgcaagaactaaggtctcagacgaattcaggaaatcaaaaggtttgatactggtcagttcagacgtatctgcccggggcgttgactatcctgatgtcactcttgtaatacaggtgtgttgtaactaacgctgaattatgtgctttagttcctgactatctgtaaactagagctttgatcgtgcatatgttagtccttttctgagaaaagatcgtcaaaatttactctcttgcaggttggagttcctgcagatagagagcagtacatacatagactaggccggaccggacggaaaggcaaggaagggcaaggactcctactattggcaccttgggaaaaatattttcttggtgctgttaaggatttgtcaatagcagagtctgctgtaccaccagttgattcaagtgttgagacagaagtaagcagcatgcactatttattttctacatggctctctgattcagtcagtcttctcctagctatgcatgtattctttttaacctgttcagaaaatctatactcaaccttttctgcctgtaaatataacataatcattgtgttgtattcttttttctgcttgatttggtaggtcagaaatgcggtcagaaaagtagagatgaagagcaaagaatgtgcctatcaagcatggttagggtactacaactcgaacaagaccattggtcgagataagtccagacttgttcaccttgcagaagagttcagccaaagcatgggtcttgcagttcctccagccataccgagaaacattcttcgcaagatgggccttaacaatgtccctgggcttcgttcatcataatctcgatgtcacgatatcaagcagaagacgtgtgctacagcacagtacatgcatttgaccagccataatgctgttaacttcgtaaacaacacttgttgctggacttaagtaccgcagttaacataagcagattggtttgctgatgacctgaagtttctacaagcatcctcatttccaacccgtacacaagtcctcgggtgtagccagaatatgcattcattttgaagccaaattttgttcggtcgagacatcaacacttcacagagaatgctcaaacagacaaggtgattctacgtatacaaggatttgtcaaaagcatagtgatgtgtatgaagtattaaaagttcgggaagaaaaatgcgctttcctgatttatcgtcatataggggaatgcatgtgttcagtttcaaattctgacgttgtttgtacgcgaatgaaaagaaaggtatagggttgtgtaggggcaacaactactatacaaacaaccgttagatataaacatgcaagcaggtcactcggtctgttagatctagatccaatcatatgttatactaggtgagtgcccgtgcgttgcaacgggatcatataataccaataaaaatatatatataacacggaatgataggagcgttaataagtagtagagattttaccaatgaaattacacggagcccaaaagagtaaaatttgttgaaattatatggagaagggggtcncatatggatgatgtgcacataaaggtgattagagatgaagcgggatgtctcgcaccacgtgtatggacaccgaggaaagcggcaacacggcaccgcgcaacgtgctgacgaggaacttgaacagagaggaggtctagaccttgaagacgactgggagggatgtgtgcagggagcggaggcagaggtcgacatggcacttggagttggcaagtcgatcaccacttcatcctcctccacctccaagagaatcactccctccttctgcaatagaatcatcccctccgcctcatatctataaataatttaaggaaatgtttaattatttatttataataactgtatatatacttatttctttacttattcatttatttatagacacattttgaaatgtttaaaaaataatatcgatgggtcaaacaacaaacactaattagctagctcctttttatggtatacgcgtacgtacgtgccgaaggttaatcgttggcgtgtcccggtatatttgcagtattgtccagtccatattaggtgcatatctaagtaaacagtaaaaaattagcctgatatatggtgtacatctaagtatacggtacaaaatcataagttcccaaaacgagcgacccggccacaacatctaagcagaagagcttccatcttacattgaagggnatcactgacaggaaggctaatcnagaattcgctaaagtcaggcaggagggctaactttagcgaattctaccaaacgccaataagcaggaagcagccggtaaaaacatttcctttcatttctttttatattataagaaaaagtgtagactccagtgtggtagactcgctagtgtaaagttcgatggagcaatctttcagttccaaatgccttaagtcccacgttcatggttttggatatgttagttagaccaacatataatatattaacttcaaccaatatatgttgaatcaagtcccttaaaaaaccattgcgttccatcagccaggcgcgacagtgaatggtatgccaggggatgcagtaactatcaccgagca

SEQ ID NO: 863 - DNA, 1305 bp, Zea mays
agcacacacgggcgcatcagggcctagctcgagtccactactcccgggtcggcccacgcgtcccgtttgaggagatgacgaagctcgtggagatagccagccactgcgcgtcggcgtatgaaaagcggtcggaatacggtgagcgcgaagctgcgaggagcgacctgaacatggcgacgcttcttgatcctaccaggacttatccttacagatacagagcagctgtactgatggacgagggcaaggaggaggaggcgatcgcggagctgtcaggagccatagctttcaagccggacctccagctgctgcacctccgcgcggcgttcttcgactccatgggcgagcgcgagagcgccctgcgggactgcgaggccgcgctctgcctggacccgacccacggcgacacattggagctgtacagcaaagcctccaccaccaaggccgaaccccagagctaggcagccagccggccggccggccggcaggccgccgctctcctcgtcgtcgattcagctgcggtttttgcgaggcaggatgatgagacgatctcttctctactctcatggggtggaagctgcagatcagtgaggcaggagcaccggaacatgcacatatctcttctaagagtatatacaagagccttagttctgttactgttagagttggacatggggaggcagcaccgcaggagattgagtgcgtgttgccttaagggtagactgcgcaggtgaggtgacaaagagcatgcactgcactgcactgcactgcaccacatatgtgcatcgaaggttgaagacgaccagcacctccggtcagaagagaggaaggagaggcggctggagaaagagagccaggtcagcagggtgttcaaaccgccggcggtaccaacgaatcttcctctttttcttcttttgcttgaatttatgccttgtgacgtgcatctggaggcacgactgattacaaaagaatacgagtttttttaaagtaacgcagcgcgaaagggaagattcttcctgctgcggattgcagtgggtgtacgctgtattatgtatgagtcgtggctccgtcgtgcctccagctaacgaggccctgacatgcatctgctgcattgctacacgttcgttcgtgttcacaactacgctttgttctttcgttcaaaatcaccgaccgcagcttgttcagctagtactttgttatttggcccaatgggatcaacagctagtttataatcaggctcacgatttataatcccgcccatagaaaacgagatgcgctggcagtcgtctcctccacggagcctctttg

SEQ ID NO: 864 - DNA, 2945 bp, Zea mays
actatagaattgcatttaataacatgtttttccactagaaattcagaaagttaccggggtctgaccctaataaaagagcatggttccaccgctgcaggcacagtaactccctctctcctctgtcgctcctctctcccgtcgtcgccgccggccactctctctttgggacgataacatatcgttagcacagacgtgtagtagactagtactcgttaaataacatgtcatgcagtttaaggaaaagagatacgaagagttttataagagatgagagaattttacgagaatgaaattctggatacaagataaatgttggcacgacagtctttagacgcagtagtatgaaactacgtggtgagaatgacctgagggtccgggcctccggggtgggggagaggggactcgctccgccgacggaagcttcgtcgtggttgccgcgctcacctggtcagttcacatgtgtcaaaaaatatgacaagatggcgggcggcggcccagcgtgccgcatgcattttctttttgtcatctgcagggcaggcaggcaggcagccagcgaagtgggaacgccattacgacgacgcgcgcgactcctgtcgctgcatgctcgctcgtgcgcgcggcccggtccagtccatccccagcccagatggagtaaagctgaagcaacagccaaacagatatatatatacgtggcggggggaaaaaatcgatcgcatcgcatgcaatgcagctggatcgatcgaccggcccgccggccggcgaatggtcgcaagcacgcacggtggcgcgcgccgaaaacgtacaaacgcacgtgtcgtagaggtctccgtcgcccgatccgccgccgcgacgaccccgatccactcgccgccgtggctgtgcccctccaaaccacacagctctaagctaggcatgaaggcatctactagtatttcttttttccgcgaccgcgaggggattaggagaaagtaaaaaaaaaaaaaccgcgacaacatccaaattcacggcgcgcgccgcgccatccccgcagctcgtctcctgtgtgccccggcccagcgaccggtcccacttccacgagcgggccccggcccccggcgtccggtccgggaggagggacgcttcgtggaaacctgcacgagccatcgaccttccagaagacgacttggcgccgtgcgtcgcgcatccgacggcccggcgaccctcccaagcgcccccggtttgactcgtcgccgggggtggcaactataagtacctgccctccccgtccgtccaaagaactctaactcctctaccagccggcgcacgccgacgccgacgccgacgggcacagtactagcgaccgagctgcgagcgacgccagggcatgggtgacactggcgcgaacatggcccactggggcgggctctacggccggggcggcggcggcggggttgtcgcgccggcgacgacggagacggtgacgacggcaggaggcggcgggtcggtgtcgagcccgacgtcgggcgggtcgggcggcagcccgagccgcgcgcagctgcagcccggggtcggggtggagggcgggcgcgtgggcaagcccgcgcggcggcggtcgcgcgcgtcccgccgcgcgcccgtcacgctgctcaacaccgacacctccaacttccgcgccatggtgcagcagttcaccggcgtcccgcccgggccctacggccccggccccggcggcggcggggggcccgtcatcagcttcggcgccgagtacggcggcgcgcagctggtgcgcccgtcgccgacgtccgccgtcatgtcgttcgacccccagcaccaccaccaccggccgacggcggcgtcgtcgctgcagagccagctgttcaggccgcagcagcagcagcagtacggtgccgacgtcggcggctacggcgtgcacggcatggccatggcggcgccgtcctccttcctgcacggcgggttcgaggcctcgtcggaggaccggctgctgctgcagagcatgatgcaggcctcgacgatgcccaccggccacccgccccccactaacaacggcaatggataccacttcggctagctgatcgatccaccggtttgatccccaccgcacaaccgaggtaattaatataataagcggggagctagatcagggatccatggaacgaagaagccgtcgtcgatgaccacgagctgatgatgacgcgtgttctagcttgttgctgctgcttaagcagctaagcattttttttgttatgttttttttgctggcctcgcagaaggctagctaattacgagtaagtaactaagtatagttagtagtggtagtgttatcttgctgctttaactagaaaaggagttaagctaggtcgatgtaaatagttccctttccttttttttctttttctttttgaaaaaatatcaatcaagaagtttaattttggggccgtcgtcaggttgttggcgcgcgtgcgctttcggtgtgtgtacatacagctagtgcagctgatagcgaggaatcttttctagaagattgccttggttcggaagcaaagttcaagagggcttctctctctacccctcccctctctacttgtatgctagtacgtactgattaattataggaaaaaaattatggtcccgccgctaattaatcgcacgttggtcaaatgagtgtggaacatatgctttttcttttacaataataaatcatcagacttgactttggaaacttgtctttagcgtcggattaaaacctcgaaaagagagattagaaggaaagtgccagtcaatctctacataaattggtagtgatatagacctccattgttgtttcttgtcactaaccaacggtggtatcctcttaattattaccggtccagaacattggtatggcaatactgttagtccaatacataagttgtgagtgttatatatatatgatcattgtcggcatg

SEQ ID NO: 865 - DNA, 5554 bp, Zea mays
gggtttaacaaaactaaaatatatacaatacatttaagagtatgacaaatatgtatgtaaaaaaataaaaaataaaaaagtctttaatataggtatttgcgtataaaggatgttgttggagagaaagaagatatagaggataaaatcttttagagaagattataaaaaacagatataaagaattgatatacagtacgttgctggagacagctttaagtcgcaagcgcaacgcatatacgatttggggcacatcatcaacacaagacgcattgatgggggctcggtaccgacactgcgcgtgctctggccttcgatgcccggggctaggaaaaaaaaagaagccattgatgccgctgaacgtgaagccaggcccaaaatgttgtagaataacttggcgagccccgaaatgttttagaatatcttgcttctacaaacttttgatggtacttgtgtacattgtttgtttgttctaaaccgaccgcccagcagggtttaataaaccgttcccccttaaaaaaccatcagtcatcgggaaccgaaaaccgctaatctcgaatggtttgtgattttaaatctgaaaacagttttcggtgcgactcgagcggttttctgttgaaaagaaccgatttttggtgcgactcgagcgggtttcggttaaaaactaaatataaacatataacaacactaaagagtttagtatttcattatgcttttacgatttttttataaagattttcaatttttttaaaataaaaggttgggaaaccgaccccggaccgaccggatcggtaaaacccactggttttcgccaaatcccgaccgagagttttaaccgcgccgcccgggcacttcaccacagaggcacacacatggcggcacggcaggctgtccatgccaaccgggcctcatcctcaactgtgccagtgccagactgccagcgcgagtgcgcgactctgcgagcgagcggtcgcctcgtgccccacgccgtgtgccggaaacaatctgcatggctggagcccaccgctccgacctccttcatgcaccgccccgaggcccccgacgccagccgtgcttggcagttggcatggcacggccaaaaatcacggcacttcctcccataaaaaacttggctggccgctgcccctgacgcatcggcatctgtctcggcacggccgtccgatcaaatcgggctagcacagcacagccagcacgcgccgcgctcagcgctgtacttgcacaaaatatcgccttgctcacgcgctgtccccccggccgggactctggctcgggacatccttgagcgcagacaaatcacccccttcctcctgttcatttcctcctgctcccccctcctccctcccccccccctcctcgccgctcgccgttgaagaggtaggcccacgggccggcgagaatggaggcggcgacgatggcgtggacggcggcggtggtcggggcggggctggtgtactggttcgtctgggtgatgggcgcggcggaggtgaagggcaagcgggcggtggatctcaagatgggatccatcacgcgggacaaggtgcaggacaagtacacgcagtactggtccttcttccgccgccccaaggagacggccaccacggcggcgtcggcggagaaggtgccggccttcgtcgacaccttctacaacctcgtgaccgacatctacgagtgggggtggggccagtccttccacttctccccgtccctccccggccgctcccaccgcgacgccacgcgcgtccacgaggagcgcgtcgccgacctcctcggcgccaggccgggccaccgcctcctggacgtcggctgcggcgtcggcgggcccatgcgcgccatcgccgcgcactcgggatccaacgtcgtcggcatcaccatcaacgagtaccaggtgaaccgcgcccgcgcgcacaaccgcaaggccggcctcgactccccgcgctgcgaggtcgtctgcggcaacttcctctccatgccgttcccggacgcctccttcgacggcgcctactccatcgaggccacctgccacgcgcccaggctgcaggacgtgtacggcgaggtctaccgcgtgctcaagccggggggactctacgtctcctacgagtgggtcaccaccccgctgtaccgcgccgaggacccggaccacgtcgagtgcatccacggcatcgagcgcggcgacgcgctaccggggctccgccgccaggacgagatcgcgtccatcgccaaggaggtcgggttcgaggtgctcaaggagcaggacctggcgctgccccccgcgctgccctggtggacgcgcctcaagatgggccgcatcgcctactggcgcaactccctcgtcgtccgcgtgctcaccatgctccgggtcgcgcccaagggcgtctccgaggtgcacgagatgctgtacgagaccgcgcagcacctcacccgcggcggcgagaccggcatcttcacgcccatgcacatggtgctcctccgcaagcccgccgccgccgcctccaccgaggaggccaactagtgtaagactacacaccgccaccaatcagttactactcgcccaccgcaagggggagaaaatggggagggaggaaaaagatgcaagcagcagcagcaccagaggtaagaagagcaggctaatcggcgacttgaagaagttacaaattgatctattagagaagaagatactactaggaacgattcttctctccgtttactcttttccctgttcgtagctttgagttttaatttttgttttttggtggacggattgttccggggaggtcgaggttgggatctaaatttattttcaatcggtggagatccatctatctatcagcagcagcagcaggagcaaccatgttttctctccaacaatacattggaattgaattcctaacgggcagattggatccttgaaattgaatttaattctaataatatgaatttagataaagatcttttaaactaacatagttttatctaaaatatatttatgtactattgttatcggagatatttatgtgatacatttttatttttattatagagatatagagaaataggctgaataacatcttttaaggtttatagcatcttttaagttgcaagtttatagtataaacatatttcgttgatacataatattatttcttatacttcgtttataaatttgagatagatttatatttaatctttggaaatagatgaagtctcaaattctaaatcaaatatactattttattaaggaaattctaattcacgatccatttattttttaggaaggaattggaatttacttaataagttaacctatttagcttggaatttgataatccactagtttctaaagtttatatataagcccatctcaaattgatacgagtagaggatgagaaatgattttatgtatcaatatactctacaatttacactcttctataataaaaatatagcacataaatatatttaacatcttaataaaatagtttacaaatatatattacataagactttattagtttaattgatatatgttttaattgatattatttgaatagaattcaattctaagggaaaacgaatagatccaaacggcactccagctgctgtcctgtttgcttatgttcggtgagatctgttatctgattcgatttcgacagcgcgtccctttcctcttttcgtccttcgtccccgcctcattatcactcgggtctcggggtcgtttgtactatagctccgtcgtcgggtgggtgaaaaaaaagggtgggcggtgaaaaaggttagaaacgacaaacattctcgctgtttcaagttcacctggtttttaccctgccacacagacagacctacgactacgagagcggcgtgggggaccctgacggtcgtggtgcgtgtgtgtgtctggcaagtgggacctgagatccggatctgcctaggagtagaggactccgtattcgatagattattattattttaatccagtcagttggcaatttgggggcgggggatggggacaagccgggcacgtgagcgcgtcgtggcgaccgatgcgatgcgcgccaccgttcctttcttttcttgcaccgctgccctacgcagggccggaaaaaaagttgacaagtgacaactgctgcattgccttgtcctccgtccgcgcggtcgtgcactcgtacgtacccccagccctgcactgccctgcccacaaccaccaggccaccagcccaccacacacactgtgtactccacatgagaaacaggaggccggaggagcggagccgataaaatatccgttggggggcaggacgtgcgctgtgcgtgccaatagatgggggatggtggggcctgtatcgtgtcagcggcgtgcaggatcggtcgctgtcagaggagagacagcccttcgactttggcggtggcatgtgctgttccgcatgatagagaaaaaaaaaatggcttttgcaggtttctgcgtggcgccaccggcactacgctaggcttcatgctgctgagctgaaaattcatgctgctaattagagccgaaagtttgggcgggtttgtgccggtacgtttcattggacttttttttcggtcagcacaacataattttggactgagctatgacgtgtcaagatactaaaaaccaggtccgatctagttcgaagtacagcgggtcagtgatagtgctctaccagtctagacacggtaaggataaaaaaaaacttctaaaaatatatcctcgtaatcgttaactttgttatagacaaaaaaaaaacttatgagaaagagaaatcaatgttttttttctagtctgctagttgccatgccagattgccttgttgggtaatcggattcgaataactaatttctaaacccatacccgtttactcaatacgtggagattgtcccatatctatacatatggaaatactttttgtcacattaccacgtgttagcggatatcggatctccattgacatctctactcttactgccttgcctttattttttctttttctttgggtacctcgctctccgtctcttgctcttctcttgccctgccgccgctgccaagcctcgtttgatccttcaatagtttactgcgcgcttccaattaaagtactggcaatggcaatgacaatggcaatgtagcgacttcaactagcttgcgcccaatcatatgatatgatatcggtgtgtatgcatggcaaccaaccaactgaactgatcagatgctagcaactggagctatgcatgttccggggtcgctgtctgtctgtctgtctgtctcggctccagacatggcatgcaagtatgcaactatgcaagtatgcattgcttgcgctactttgtttccactccacagtccacgctccgcaccgccgccatcgttgaactttccccgcgcactcaagttcaaacattgcaaccttgcttaagatcaggatcactgtgaagcacttgggtactccctccaatcgtttgattttttttgacatcaagtttaaacggctcgttttattctaattatttataaaacattagaaaaatt

SEQ ID NO: 866 - DNA, 3979 bp, Zea mays
  misc_feature (3574)..(3574): n is a, c, g, or t
tgttgcgttcctctcgatctttgtccagtcgccgcctgcaacgaattcgatcgtctagtcaaggatgagacgaccactcactcaccaccgcaggacgcatgcggtttgtcagcaacctttttctctcaaagaaacattatctgaagcgacgcgagcgggaggtgaagaaagagataggcgaaggcaactgtgcgtggagtggaggcggcggccggcggggtcgacgaaaggaccaaggcccacgtacggcacacatggcaggctgtccatgcccaccgggtctcatcagactgccagcgagctagccgagctgagccgagcgcccgcgtcgtggccccggcgccccgtgccgaaaacaatctggctggctggagcccaccgcccccaaactttcctccctcctcgtttcttccacctccctccccatcgcacgcgcatcttggcacggcacggccacgaccccttcatctcataaaaaaataactcggcagccgcaaaccctgcggggtgcgggccgcgcgtcccctgacgcatccgcactggtctcggcgcagccgtccgatcagatcgcaggctctcagcacccctcatctgcgccgcactcagcgctattactttactagtatacagtagtaccaaaaaaaaaaatcaccttgctcacgcgcgctctgccccgcttgctatatcctcctagagcccagccaaatcccccgacgtcctcctgttcatctcctcttctccctctcctcctcctcctcctcctcgtcccccttcctcgggttggaaattggaatggaggcggcgacgatggcgtggacggcggcggtggtcggggcggggctggtgtactggttcgtgtgggtgatgggcgcggcggaggtgaagggcaagcgggcggtggatctcaagatgggatccatcacgcgggacaaggtgcaggacaagtacacccagtactggtccttcttccgccgccccaaggagacggccaccacggcggcgtcggcggagaaggtgccggccttcgtggacaccttctacaacctggtgaccgacatctacgagtggggctggggccagtcgttccacttctcgccgtccctgcccggccgctcccaccgcgacgccacgcgcgtccacgaggagcgcgtggccgacctcctcggcgcccggccgggccaccgcctcctcgacgtgggctgcggcgtcggcgggcccatgcgcgccatcgccgcgcactcggggtccgacgtcgtcggcatcaccatcaacgagtaccaggtgaagcgcgcccgcgcgcacaaccgcaaggccggcctcgactccccccgctgcgaggtcgtctgcggcaacttcctctccatgcccttcccggacgcgtccttcgacggcgcctactccatcgaggccacctgccacgcgcccaggctgcaggacgtctacggcgaggtctaccgcgtgctcaagccggggcgcctctacgtctcctacgagtgggtcaccaccccgctgtaccacgccgaggacccgggccacgtcgagtgcgtccacggcatcgagcgcggcgacgcgctcccggggctccgccgccaggacgagatcgcggccatcgccaaggaggccggcttcgaggtgctcaaggagcaggacctggcgctgccccccgcgctgccctggtggacgcgcctcaagatgggccgcatcgcctactggcgcaactccatcgtcgtccgcgtgctcaccctgctccggatcgcgcccaagggcgtctccgaggtgcacgagatgctgtacgagaccgcgcagcacctcacccgcggcggcgagaccggcatcttcacgcccatgcacatggtgctcctccgcaagccgcccgccgccgcatccaccgaggaggaggccaaatagtgttttaagagaaataacctggcagaagcagcagcagaggtaagaagagcgagctactcggcgacttgaacaagtgaaaacttcatctgttagagaagaagaagatactactaggaaccatgcttgtctcgtttactctttttttttccttgtccccattcttcttcgtagctttcacttttatttttttttgtttttctggtggacggattattccgttggggacgaggtcgggatttaaatttgcttgatcgtggagatccatctataatctatcatcatcataagccatgttttgtctgctaagagtacattggaattgaactctctaacctaattgttattacctgcttgcttttatgcttggtgagatctgctacccttgttccgttttccacgggccggccccggtgaaaaaggggcgaaaaactttagattatctgcaagttgcgagtggtggtccagcttgcaagttgcgagagaaagagcggcgtgtctgggtgtcacgagctatctcgtcctctatggcaactggggcccgagatcggatctgaaatgttgtttacatttggagcagtaggttgagagatagggatggttccgtgggaccatctgttaagtgggatgggatgacactcttttgcatccaacgatcttaatattttatctattgacgatctcgagcttgaagccatctgacctgcgcgtgcgagttaaaccttgatcaagaccctatatttcctaatagaataaatttgtgtacgagcctttacctactaaaatgccacactaatatttcacctagaattattttattcctgaaaaccaaacacaaaagaaggggatgcggacaagccgggcacgtgagcgcgtcacggaggccgatgcgatgcgcgccaccgttttcttttctgcaccacgcagggtcggaaaaagctggctttgctttgctttgctttcctttctccgcgcggtcgtggatcgtggcccctcccgcgcgcgccactagtccgatcaggcagtagggacgggtggatacgaggagaggagcggagaaaatatccgttgggggcacggggcagtggggacggacgggcgtgtaggactctaggtgcggcgtggcaatgggtgcgggtggtggggcctgtatcgcatcgtgtcagcggcgtgcaggatcggtcgctgtcagaggaagggcggtggcatgtgcagggagagcaaaaagaacgacgtttgcaggtttatgtcgggctactggacctatgctactactttcacgagttcggatactatttccaattgaatttgatgctcctcctaatcttgtctctctcttttttttagcacgggtctgtctataccgttagtgaaatgactctaaaccattttatatatcgatttttgtgtttgatgaacatcaaagttattcggaccgagtagtttatctaagttttaattcacatcttcataaattgaacaattcagttttcaagtcataatcaacttaaattaaaccaaaaaaggataaaacttataatagataaaccaccaatagttctatagtttggataaacttctaaatacccctaaaaactagcaatatttcagtttcaacatttcactcttttgggacgattttgagctacagcaggaatatgagttgaanaaaattaaacaacaatgttttatcaattagactagttaaaaagtcactaaatatatttgtttaagtaatagaaacactctaagtacatctaaactcgtttgaagaagatatgccaaagtttgcccaagttgttctatacagaggtgcaccggaccgagtgcgcagagggttctgcaatcgcaaggcgtctggagcactgaaccggaccggtgggtcgtcaaaccgaagttccagagagttttttttggggctaattataggttggtgggtcagacctgtccgatgagttaccagactgtttaacaggttcaacagtcaactgcttctctaatggctctgctgatgtggtgatggtctgatgcacatgtcagcaacaaactgatagggatccggtgcgcgtccgga

SEQ ID NO: 867 - DNA, 973 bp, Zea mays
tcggcatcaccatcaacgagtaccaggtgaagcgcgcccgcgcgcacaaccgcaaggccggcctcgactccccccgctgcgaggtcgtctgcggcaacttcctctccatgcccttcccggacgcgtccttcgacggcgcctactccatcgaggccacctgccacgcgcccaggctgcaggacgtctacggcgaggtctaccgcgtgctcaagccggggcgcctctacgtctcctacgagtgggtcaccaccccgctgtaccgcgccgaggacccgggccacgtcgagtgcgtccacggcatcgagcgcggcgacgcgctcccggggctccgccgccaggacgagatcgcggccatcgccgaggaggccggcttcgaggtgctcaaggagcaggacctggcgctgccccccgcgctgccctggtggacgcgcctcaagatgggccgcatcgcctactggcgcaactccatcgtcgtccgcgtgctcaccctgctccggatcgcgcccaagggcgtctccgaggtgcacgagatgctgtacgagaccgcgcagcacctcacccgcggcggcgagaccggcatcttcacgcccatgcacatggtgctcctccgcaagccgcccgccgccgcatccaccgaggaggaggccaaatagtgttaagagaaataatctgccagaagcagcagaggtaagaagagcgagctactcggcgacttgaagaagtaaaaacttgatctgttagagaagaagaagaagatactactaggaaccatgcttgtctcgtttactctttttttttttcttgtccccattcttcttcgtagctttcacttttttttttgtttttctggtggacggattattccgttggggacgaggtcgggatttaaatttgtttcctcgcttgcttgatcgtggagatccatctataatctatcatcgtcaatcacgacccaggttttgtctgcaagaat

SEQ ID NO: 868 - DNA, 4968 bp, Zea mays
aaaaactatgttttttatgcggtaactttaacggctctgtttctcgaccgtcttttatgaccatttgccgtttggtagactgtgagcccgagctagagcgctgaaagagccgtgccaaaggccctaacattgaaagacaatggttaccagttgatttgagcctggaccgtcactgatgggccgttcgtatcattctgagcccgtcgagttcgcttctcgggtcgtcgctgccccgagctcatgacatgagcggcaggaagcagtggctgcgccgtccctccttcgctgctagcctgctactatgaaagtccgcccaagtgggtcactcgtcacgcccatctcattcattccgtcgcaggctcgcagtcgcagcgccgttgcggacgcagccacgcaggcgcaggaggcaggacgggacctcgccctcccccgccttgcctttgagtgcttccactccacctcatcagtcgccgcccccgccccgccgcgccgcgggcccctccacctaccctcggcgcccgcccttcttggcccagcgcccctgcacatctgcctgccccccctcggccgccggcggcggcgatcgcgggtagccgccccaaccggccgaggttgcatagaggtgctggtatcttactctgcttctggttatgctatctgcctatgacttcagcttcccaaacttctccctgcttcttgcccctggttggtaaaaatctgtaacaactgctgccctgactgcaaaagacgcaactatgcgtctttcttcttctcttcaagatttgccgaccttcaccagaattgatgctttggaaaggggttctagcgtaggcagtgatctgagctcagggcgcccaaaacctgtccgcatgcttcaaagagatggtgccgtcgcaagcttttcaaaagaaagaacacccccctcatcgccgacaaatagaaagaaatgcatgagagcagccgggtgtgctattgcattgatcttactggtgttctttgcgtatggttcatggagatattttcatgtgttcctctctgaaggaagatctgaatactatgttgttcttgattgtggcagcactggtacgagagtttatgtctatgaatggcatattaatcataatgacgcaaatgcatttcctattgttttgaaacctttagggaatgctcccaagaagaaatctggtaaattaacccgactatatcagcgaatggagacagaacctggattgagcaagctcgttcacaatgaatctggattgaagaaggcaatagagccccttcttcagatggctgagaaattgatccctagacatgcacacaagcacactccactttttctatatgctactgctggtgttcgcaagctacctagtgcagattcagagtggctcctggataagtcctgggatatcctgaacaattcatcatttttatgtagtagagatagagttaagatcattagtggcatggatgaagcttattatggatggatagctcttaaccacaacatggatatgcttggcacctcatcatctaaaatgacatatggttcacttgatttagggggatcatcattacaggttacatttgagaatgataaatcagtgcaggatgagacaagcattcgtctgagtattggttcagttgaacatcacctcagtgcttattctcttactggttatgggttaaatgatgcatttgataaatctgtagcacatctagtgaaaagactgggaggagttgctagcaatggcaaggttcaagtcaaacatccctgtctacagactggattcaaggaagattatatttgttcttactgccatccattgaaacaagatggaagtcccagtgtcggcgagaagaacagtggcaaagagaagcagggaatagctgttgaactggtcggagcacctcagtggaatgaatgtagtgctcttgcaaaagtaacagtcaatctttctgagtggtccagtgcaagtccagggcttgattgtaacatccatccttgtgctcttgcctctaactttccccgaccatatgggcagtttttcgctatctctggcttctatgtggtttttaaattttttaatttgactgctgatgcgactctaggtgatgttcaaaaaagaggtcaggaattttgtgaaaaaccatggaaagttgcaaagagtagtgttcctccacagccttttgtagaacaatattgcttcagagctccttatatttcatcactactgagagagggattgcagattaaagatagtcaggtgataattggctctggcagtattacttggactcatggagttgctttgctggaggctggtcaagcattgtcttcacgactagatattcaaggataccgaatactgcacagggagataaatccaaatattctcatagtactgtttctgatttcaattgtgttggtcatatgtgccatactatgcgtcagcaattcgataccaagatcattccgcaagtcttatctgccaattcataggcataattctggaggcagttctgttcttggtatgggattgcctttcaaacatttattatggaatcccattagttcaggtgatggtagaacaaagacaccactgagccctactgttgctgggtcagatcctcatccatttgcaggactaggaggcagcagtgtcgagcttatggagtcctcgaggcaatccttgggtgcctatcacagctattctgttgggagcttaggtcagatgcagttttctagcggggtgaggaaccctagccgaggtcagactacacttcaaagtcggaggtcgcaatcaagagaggatctcagttcttcacttgctgatattcattttccaaaagtgtagcactgcatcaaggaatgactagaatgagatccttacatgccataacaaactctgtaaataatagctccagagttcgaactgcttgatttcttctctaatcagaagtcaattttgtctgtccgcttacacttcaatgaggtttaggattcatataaatgaacttatgacttgtgcctatcctggacatgatacatccattcatcccattgtatgtgctcaagaacataccatagcagtgaagttctggtagtgtactggaagatatatttatgccgttcaccagactggttgaccatggctacagcctacaactttatagatcgattgtgctgcaatcagggatgttatttttttgtatctgagacataataaaggtgcatgtggtctcatgtactgttgtaccctctaggctctagtggctctgtgaggttactcttctttcctggaataccttttgataggctactctgtggtatcaactgaaatcatgaaacactgacatcagttctactggattatctagttgcgtactgtgtatacacatctattgagttttttttgttggcatagtatctactttgatgacactgaaaatcagtataggaacatttgggccaatgtttttcctcgttgagctgagtttgatctgtattgcacatttgcttgtggatcgtttcaggttccttcggccgttgtatcctgatggcctaaattttttctgagatgcttcagcttgtgtaggaaaattcgttctcatatcttgctcacttgtcgactctaaaatttagagtccacatacgaccgaagcacccgccagcacgaatcgtgacgcagatcaagcaaaccctaactgccaaccctactatattttttttttcttgcccctctcgatcccgccgccgacgccgacgccgcagccgcagccttagccttgccttcgaactcgaagcccgttgcatccggctaccgcagcgtcgccaaccgtcacagccggtctcctccctccgctaccatggggtgagtctcccccgtctcgctccagtgtcctgcgcccgtgctcgttgtttcgaggcgttccttcgccgcagcaatgcatctgctttctctcgttgatgcgtagatttcgctgcgtgccttgtgatctagcaagtcttctgatctggttagagaatggaatcgggttagaggcgaaaagcaaaaaccgagcttattgacggtccagtgctgatcagattatacaccgtcagtgctaaacatattcataagctacaccaatccgttgccgctgtgtagtcatgtgctccaggattccaacgcttgggtccttgaggttatgcgtggcggcatacaagtcctctattaaatgggtatccgacgttttaagattctcctcttctgggttgatatgcctgtggttttttttttgttatgttgtaacttgtgaatgccagtacccagtcgtcatccatcaacgttctatagatggacggatatgcttgtttggtctagccgtctagctaaaagaatggattcgtgtgtggctaatgtttacagtctgctaggtgaaatgttggttgtttgcaacactcatacaattcagggtataagttaaaaattatctcagtactgaattgttcacattgttgcattttgatgcacgattgtagttcgtgcatttcctacatgatttttgttttgcatggtagggttgtgttgtgtcatggcgaacatgtttatgcactggacatggaaaattgtggtcatgagttgcagatcctgtgatgtatgtatgatttaacatatcaccttttaattcacatcgtatcacaggaagacacgcggtatgggagctgggcgcaagctcaagacccaccgcaggaaccagaggtgggctgacaaggcatacaagaaaagccacttgggcaatgagtggaagaaaccttttgctggatcatctcacgccaagggcatcgttctggagaagatgtacgttggatatgggaatgatcggtgcttttattatcttgtacttgctgtgcttgggctaaggtttattgcttccactgtgtagtggtattgaggccaagcagccgaactctgccatccg

SEQ ID NO: 869 - DNA, 1982 bp, Zea mays
ggaagtgggaaaataaaatgtaaacgtgaacagttaaatcagagacgtggcgtgtccgttcgaaataaattgcccaaattttactccatgttcacttttggaacagccagtcaactaccaagaatgctgagtgcatctcactcacccgaaagcgaacgttacccaatcgaaccaccgacaggttgccccgccgccccagcagacccacatgtcagttggagcctccgctcagcccaccaggatcacatgtttccaagctcccccagccccaccataatcccatctcggagctttcccccccaccccacctcacctcgctccccgcgtcggcgcctactaatggcagccggatctcgccgcccgccgcgcccacggagatgaagcgccggcgcctgccgcccgtcctcttcctcctcgcgctcgcgctcttgtccctcgccttccgccgccacctctccctccccctcggcgttccccagttcgccgccggtggcgtcagcggcgacgcgctcctccgcctcctcgcggccaccgacgtcggcggggaccagatcctggcggaggcggccgcgctgctggccaacgcgtcggtgtccaccttccccagcatcggcaaccaccaccgcctcctctacctccgcgtcccctaccgcatcaacgccacctccgcgccgcggcagcggacagtgtcccgtctccgcattcccttccacgacgtccccaacgacgacgccctcctcgccgccttccgcgcatccctccgcggcttcctcctcgcgcgccaccgccaccgccaccgccgaggcggcgacgacgtcgcgggcgccatggccgacctccccgccctcctcctcggccagcgccggcgccggcgcgccccgacctgcgccgtcgtcgggaacagcggcacccttctcggctccggccggggcgcgcagatcgacgcgcacgacctcgtgatccggctcaacaacgcccgcgtcgcggggttcgcggccgacgtcggcgccacgaccggcgtctcgttcgtgaactccaacatcctccaccactgcgccgtccgctccgccatcaccgccccgggctgcgcctgccacccctacgggcgcgcggtcccgctggccatgtacgtctgccagccggcgcacctcctggacgcgctcatctgcaacgccacggcgacgccggagtccccgttcccgctcctcgtcaccgacgcgcgcatcgacgcgctgtgcgcgcgcatcgccaagtactactcgatgcggcggttcgtggcggccacggggcagccggccagcaactggacccggaggcacgacgagaggtacttccactactcgtcgggcctgcaggcggtggtcatggcgctaggggcgtgcgatgaggtgagcgtgttcggtttcgggaaggcgccgggggccaagcaccattaccacaccaaccagaagaaggagctcgacctgcacgactacgaggccgagtaccagttctaccgcgacctccaggaacggccagaggcggtgccattcctcgacgaggcgccgggcttcaaggtgccaccggtgaagctctactggtgaccactgacgtcagtaacgtctggttggtagtaacttgtactgtaatatgtttgttgtacaatttttttttatttttacattttcacctaaagaggtgtttaggcagagagagataagcgtgtagagaatgtagcgattgacagggagggaatgtgtttaaggatagggaaaatggagatcaaatttgtgattgatcaaatggatcaaattggttgtagttgttcatgtattctgtctgtgtagggcaactgtacacttcatcgattcttgttcatatatagacactttcagacaccagtggaaaaaataagttatgggcaacggaagcatacaatacaatacagagtctgctgttgcagtatgaatttggaaatgtataatgaggcttgtgatattgtc

SEQ ID NO: 870 - DNA, 2504 bp, Zea mays
gttcctggcttgggccgaacaaccccgtattgggctaccgctgcagcggttcattttcaccacgcgtgcgctctctctgtctgcgacgactgggctacgccgccgccgccgtcctccgtctggtgccgaggtcttcgttggacccttcgcccgcgactagcgtccgccaggtgccaggctgaaggcgatggcgacggagaggaggcgcgcgtcagtcgtggtactgggcgacatcggccgcagcccgcggatgcaataccactccctctcgctcgctaaccaggccagtatggaagtggacattgttgcaaatggaggaagtgatcctcacttgtcactgagagagaatccatcaattcacatccacgagatgaaaacagtgcagttaactggaatttcaaagatatctggtgctctgtcacttctacttaaagctgctgtccagttcattttgctggtttggtttctttgttttaagattcctcgccctgatgtcttttttgttcagaatccaccctctgttccaacactggctgctgtaaaactggcaagctggctgagaggtgctaaatttattgttgattggcataactttggatatacattgctggggttgtcgcatggcagaagtcacattattgtcaaaatctatttctggtttgagaagtactttgggcagatggctgatggtgccttttgtgttacaaaagcaatgcagcatgagcttgctcaaaattggggaatcagggcgacagttctttatgatcaatctcctgatttttttcaccctgcttcattgatggagaaacatgggttgtttagcaggctagggaattccatgtgtagtgctatgggcaatgctgattgcatatcagtggaggaagtaggggaagacatgaacactactgcctttaccagtaagattgatggccaagttttcttgaagcctaacaggccagcacttgttgtgagcagcacaagctggacgccagatgaagatttcagcatacttttggaagcagcactaatgtacgacagacgcgtcgctgcagctttaggtgaagatgattcaatggatgaggggcaactttggattgatatcaagaacgggaagcagtttgtctacccaagattactgttcattattacaggtaaaggacctgataggaagaaatatgaggatcaaataaaaaggttgaagttgagacgtgttgccttgcggacaatgtggcttgcatcagaggactaccctttattgctcgggtcagctgatctaggagtgtcgttgcatacatcttcgtcagggctggacctaccaatgaaggtggttgatatgtttggatgcggattgcctgtttgtgctgcttcattctcctgcattgaggagcttgtaaaagtaaacaaaaatggtcttcttttctcaacatcttcggagcttgctgatgaacttatgatgctctttaaggggtttccagaagaatgcaatgccttgaaatccctcaaagaaggtgccatgaagtcagcatcatcttcgaaatggtcaacagaatgggaaaccaatgcactacctttggtggaccaggtcattggatgagatgtgtgcttacatacatcagatagaattgttgtattgcagagaaccagagatcggtgtactagagagaccagatgtacattaaagggtacggtttgctttcaccaaaaatcaattgctagttgctgccagtgccatgtgcaccacttcagcaaaacttgggcaagtttgtagctacgaagctctttcctttttaggctgggaaacatactctgctgaacacatgtctaagttgtttcaggatgtatactactgtaggccagcactttgtttgataatatggtctgtattggaatacctctaatctgttacgtcagaaggaaaacatagaaaaccatattgttttccctggcttcgaaggccatctgataagatcctatgcagagaggcgtgtaccaaacagaagtgtacaaggaatcaggatctctagcacgatgtctggagaatgaaaaggatatgtcagatgcatggtcctatcttatgtttacacactgctacaaatacactctgaatcagttctgatccatttgacctcttcgtcctcggcctctacctttcctttcggggccatctggactgcttggtcatcccctgttgcagtatcagggaacgctgggcttcagggtgtgccttcttgagcagcaaacctcagacaacctgtcaaacaggaaagccatgcgtgagtaactctgaaattctgaacaggttcggttctgaaatctgaatgcgacctgaactctatagcacctcgtcgaatcccatttcgggtacgggtacagtttccctcaagcttggcctgggccgaggacctccgaaggctcttgttgcgagtaccctgaacgaccttggcctaccaatgcctccattcctggaggtggaagaacagctcagaagccgctacgagctgcag

SEQ ID NO: 871 - DNA, 1804 bp, Zea mays
tgagagatgattgtcgatgcggcttgtcagcttgctgcccacgatcatgatgttcatgtcttcacatcacatcatgataaaaaacgttgctttgaggagactctttctggtaaaccaagaactttgactatgcatattctgtttacaactagtactaattacagatagtgcttatgtgagcacaatcctgacgtagttttttctctggccgtttgcaggtttgtttccggttactgtacatggggatttcctgcctcgccatgtgttctaccgctttcatgctgtttgtgcttatcttcgctgcatttttgttgcgctctgtgtgctactcagatggcccttctttgatgtcatattggtagaccaggtttctgttgtgattccactacttaaactaatggcatcatcgaaggtatcagtgtttgtttgcatgaagtgcttattgttctccaattgcagctccttgataacaatttatattttgtatctccagataatattttactgtcatttccctgatctgttacttgcacaacatactactagtagcttcggaggttatatcgcaagccaattgacatgattgaggaaagcactactggtacagtattctgagtacctgctattttttcttcccttttctttgtttagctatatgtcttggcatccagcagcattataattgtagcggttaccttttacgaatatcaggtatggctgatttgattcttgtcaatagcaagttcactgcagcaacttttgcaaggaccttttctggtttacatgctagaggaatcgagcctggtgttctttatccagctgtctctgttgagcagtttcacgaaccccatgcttataagtaacttcatgcttgcatatctccttacatttaggtctaacttattcagtttatagactaaacagatctttttaccattatcatattaagatttagctaaagtagacaacaatcttttgtacaggttgaatttcctatcaatcaaccggtttgagaggaaaaagaatcttgatcttgccatttcagcatttgctttgctccgttctgctgcttggactctacctggtgatgctctacaagaagcaacattaacagtggcaggtgtttatattttatttttccttctagttgcatgttcaatgttacaacaccaccggttttaaaccatatgaaatattgactgctgatttcctaccatgcccattatttaggtggctatgataagcgtctcaaggaaaatgttgaataccttgaggaactcaaaagactcgcattgacggaaggggtttctggacaggttaattttgttacatcttgctcaacatctgaaagaaacgagcttctctccaactgcctctgcgttttatacactccaaaggtaagtgcctagggcttacatccagctaagcagtttgtttacctttaatttaacaagcctgcgtctcttatccaggatgaacatttcggtattgtacctcttgaagccatggccgcccataagccggtaattgcctgcaatagtggtggcccagtggaaacagttgtgaatgaagtaacagggtttctgtgtgatccctctcccgcagaattctccaaagccatgctgaaacttgtgaatgatcatgatcttgctgtcagattgggtgaacaagcacgtgaccatgtggtgcaaaaattctcgaccaagacatttggtgatctcctcaacagctacgtcttgaacatctaccatgagaggatggaatgatctataatattgggtcagccatgccatatgaaaacaat

SEQ ID NO: 872 - DNA, 1188 bp, Zea mays
gcaagttcactgcagcaacttttgcaaggaccttttctggtttacatgctagaggaatcgagcctggtgttctttatccagctgtctctgttgagcagtttcacgaaccccatgcttataagtaacttcatgcttgcatatctccttacatttaggttgaatttcctatcaatcaaccggtttgagaggaaaaagaatcttgatcttgccatttcagcatttgctttgctccgttctgctgcttggactatacctggtgatgctctacaagaagcaacattaacagtggcaggtggctatgataagcgtctcaaggaaaatgttgaataccttgaggaactcaaaagactcgcattgacggaaggggtttctggacaggttaaatttgttacatcttgctcaacatctgaaagaaacgagcttctctccaactgcctctgcgttttatacactccaaaggatgaacatttcggtattgtacctcttgaagccatggccgcccataagccggtaattgcctgcaatagtggtggcccagtggaaacagttgtgaatgaagtaacagggtttctgtgtgatccctctcccgcagaattctccaaagccatgctgaaacttgtgaatgatcatgatcttgctgttagattgggtgaacaagcacgtgaccatgtggtgcaaaaattctcgaccaagacatttggtgatctcctcaacagctacgtcttgaacatctaccatgagaggatggaatgatctataatactgggtcagccatgccatatgaaaacaatttgttcaatacaaggttttttttgcacctttacgtctaatctgattttgatagacacacataatgacaatgacactccattgaagccctttggcatactatagtcactctatgatctgtatattgttttcaattataacatcaaatttggcttggtccatcctggagtctggaatggagctggagtagagatgacaatggggacctgattctctgtgtggaattcctttattaggagatgaggaagtttcttctccgatggaaatgtaaatggaaaaaaattatccccggggatagggatgggaatggggaagcattctccatcccagttctccacgtgatgatgttttcatgtaatagtttatgataaaaataaataattagtttgttaagagatc

SEQ ID NO: 873 - DNA, 1424 bp, Zea mays
ggaccctcgaggccggccgggacaaggcagcaaggccactaacactagttatcacatccaccataacgaccatggctaccacctcagctttgctagctcttgtcttgttagccagcctccttgcaggcacggtgttcagtgatgatatcgtacccatccatatacccttgttggatcggttccaagcctggcaggccgaatacaaccgcacatatgcgaccccagaggaattccagcaacgcttcatggtctatagcgagaatgtcaagttcatcgagaccatgaaccagcctgggagctcatatgagctcggtgagaaccgattcgctgacctcaccgaggaggagttcaaggacacgtatcttatgaagcttgacaacgtggcctcgtcccctgaggccatggcactgaccgtcgataccatgaatagagcaggcacatctggcggcagcaacaccaacgaggctcccaatagtgtggactggaggaccaagggagcagtgacgccggtcaagagccagcaacattgtggctcttgctgggcgtttgccgcagtggcgtctatcgaaggtgtgcacaagataaagacaggtcgtctcgtgtcactgtcggagcaagagattgtggattgcgaccgtggggggaataaccatggctgccatggtggtcactctagttctgccatggagtgggtcacccgcaacggcggcctgaccaccgagtcggactacccatatgtgggtaggcagggacaatgcatgagcgacaagcttggtcatcatgcggccaagatccgtggccggcaggcagtgcagggcaagaacgagggcgcgctacagcatgcagtggcggggcggccggtggccgtaagcatcaatgcaagcagggccttccagttctacaagcgcgggattttctcaggcccctgcaacaccacccggaaccacgccgtcacggtggtcgggtatggagccaacgctagtggccacaagtactggattgtcaagaactcatggggtgagaggtggggagagaagggctacgtgcgaatgcagaggggtgttagggctagggagggcgtgtgcggcatcgccatagcgcccttctatgcggtgatgtgagagtaccgtctctccccatactagttaccagttgcattctgattctaaacaagtatgggtgtcatcttggagaagaatgcatggaattaaataaactacagctcaccgagggatggtacatgatgtttgctacgcgttgccaatttatcgtttgtttgctaatgtaacaaaatctcaaaatcaatgacttttgggatgtaatatgtgttcttgttaaataaagagaatcacaattgatctcttgccttaaaacatcatcactgcgatgtgcaagaggttagtttgtcaaaaaaaaaaaaaaaa

SEQ ID NO: 874 - DNA, 1772 bp, Zea mays
caacctacaatagtttctggtggctagaagctgaaaaagctataaaaaacagggcccttgctatgtgtttgagttgatacttggtgaggcacttggcaaactctcctgtatcaccatgcatgtgaatattcacactcaagcacgtgatgattgagataacacccagacgaaggacgaaggacgttaggtcacttgcctaacaagcagccagtagagagctcctgatttcctttatttgctcccgtattttttatgaagaaaagaacctttgtctaatataagtactaagtacatggaaggtacgctattgtttttcccttcctcatacaccggtacacacctagctagctagtcatatcatgcagcatcagtactagtactacatccgtgcatcaccatgcactatataaacccactcacacccagctccctcacaagacagcagaggcactagttatcacatccaccataacatgaccatggctaccgcctcagcttcgctagctctcatgttcgcctgcagccttctccttgcaggcacggcgttcagtgatgataccatagccatacccttgttggagcggttcaaagcctggcaggctgaatacaaccgcacctatgcgaccccagaggaattccagcaacgcttcatgatctacagcgagaacgtccggttcatcaagaccatgaaccagctgtcgaccgggagctcatatgagctcggtgagaaccagttcaccgacctcaccgaggaggagttcaaggacacatatcttatgaagctcgacgagcagccccctgcagctgaggccatgggaccgaccgtcggcaccatgagcacagcaggcatgtccaacggcaacaacaccggcgaggctcccaacagtgtggactggaggaccaagggagcagtgacgcgggtcaaggaccagcaacaatgtggctcttgctgggcgtttgcaacggtggcgtccatcgaaggtgtgcaccagataaagacaggtcgtctggtgtcgctgtcggagcaagagatcgtggactgcgaccgtgggggcaacgacaacggctgccgtggcggttcccctagatccgccatggagtgggtcacccgcaacggcggcctgaccaccgagtcggactacccgtacgtgggcagccagagacaatgcatgagcggcaagcttggtcaccacgcggccaggatccgtggctaccaggcggtgcagcgcaataacgaggccgagctggagcgcgccgtggcgggacggccggtcgccgtgttcatcgacgcgagcagggccttccagttctacaagagcggggtcttctcgggcccctgcgacaccaccaccgtcaatcacgtcgtcacggtggtcgggtacggatcaaccggcagcgacagcggcggacgcaagtactggatcgtcaagaactcgtggggtcagggatggggagagaatggctacgtgcggatggcgaggcgtgtcagggctcgggagggcatgtgcgccatcgccatagagccctactacccggtgatgtgatctctccgtactagttaccggctgcctcctgatcctaaacaagctagtatgcttggagaatgatgcatgcatatgatgcatggaattaaataaactacaactcaacgagacggtgtgtgtgctgcgctgcgctatgccgatcgatgttatcgtttgtttgctaatgtaacatctaatctaaagtcttaaaaaaaaaaaaaaaaaaaaaataaaaaaaaaaaaaaaaaa

SEQ ID NO: 875 - DNA, 4526 bp, Zea mays
  misc_feature (3608)..(3608): n is a, c, g, or t
  misc_feature (3622)..(3622): n is a, c, g, or t
cattgggtacctcgagccggcggggaagttttcattcctaccctggtcccccgcgccgtcggccgggagcacgctcaaaagacaagagcaagcacggaacacccatccccgactgtagtttgcccggcaagcaaacatctccggcagccatggcgtccactgtaacagccgccaatagcagccatggaagcgccctgcgtacccgtaccgcctccccaaggccggtcgcgggctggagctgcagacgcacgctttccacgcctgcacaccaccaccacgcgcggtcgtcacccagagctcgggttgtcgccgtccgagccgccggcactcagcgggcgacctggttgcccggactggacccgcccccatacctcgacggcacactaccaggtgacttcggcttcgaccccctgggcctcggcgaggagcccgaagccttgaagtggtacgttcaggccgagctcgtgcactgccggttcgccatggcaggggtcgccggcatccttttcactgacttgctccgcgtatcagggaacagcgacctccccgtgtggttcgaagcaggcgcggcgaaattcgacttcgcgaacaccacggcgctcttcttcgtccagctcttcttgatggggttcgctgaaaccaagaggtacatggacttcaaaaatccaggatcgcaagcagaggaagggacattcatagggttagaggctgcactcgcaggtcaacagccaggctaccccgggggcccactgttcaatccactaggactcgcaaaggatatagagaatgctcatgacgagaagctcaaagaaatcaagaacgggaggttggcaatggtagccatgcttggcttcatggtgcaagcatccgtaactcatgccggccccatcgacaatctcttgacacacctttcggacccgttcaacaaaaatatcattcacacattctcctcttcctaagtactcgtcccaatgcccggatgctatggcacaaaaaggtcacaatgtttttgaacacaacagaacaacatgattattgatttacgtccttctccccaccgaataggggaaggaaggttagggaagcgttcaatcaattcaatgagatagtgtaatctatagcaaactcagatacgctatgatgtgagatgaagcgtacttcgtgcaatcaataagttccatttattcatatggacaacaaagttcctctctgatcattttgaaacaacaattcatattaatgaaatatatcaaagatttgtgtcgttatacttatggaagctccgtccggagaagatgctacaagtgctaggttaccaatggtcgatccctgtagcgccggcactattcacctatttataggactatgtcaatgtaaatttttatatggagttataagaatatccatcctattatacaagtagctctatgtaagcgaagatgtttaattatgtcttttatggtagagacattccatatatgtcttttcttctctagcacccacttctgattcctcctttcgtgaaggtagctttgaaagcaatcagacttcgtcttgtcatgtctgacactgatcttctttccttcgtgttttcaacagatagtttcatagattagtccgatgctctagagttatcccttaacccgaatgtgctccttgcgaatttttgtcatgaacagtgagtaaaaacttcaataactgacgaactgtattaatagctcctaatgacagggggggagaaggaaattagtacagcttatcgttctttggcgattgatcgtagtcctcagtatatttgctcactttttattttcttggtcgacttttgcccagttcaagcatgctataattgcgtgaacacatgttataagagacacatataattcgtacggacagaaccgttatagttgcgctaaacttacctgaccacagtcagcatacgtgtttgtttggaattataatctagccagattatataatcccaaacaaacacccctatgccattttgtattaactgtgtcgctcaaaccttgccttcaatataaatacaaacccgaacctatgttcctgaaaaatccacagcacaaagcattcggttctactgtacatatatgaattatacaaagaaaaaaaaacaccgcatctggttatctacagctcacctgtatcaactagcttgagcccccagctcatatcttcacagtgtcttacatgtggaacaagcttccctgtgtcagttcccttcctagttttgcaatcatagaaaggcggagcatgaaagcacggttctatagacatgacctgacggcaaggtggattaggcgcagtgcgattttcaggcttgaacagaagccacgtcttcgaaccactcagaccctgagctacatacccaaaagttgaccatgcacttgttaccatagcatcagataagctcagcagataaatctctgcccatgctttcatgttatgcattgtcttgtctgaatcctggtgctcctcgtggcttggctgatggaagctaatcatctcaccattctcagtcggatgttcccagtacatgttcctgatcctttcgtagtatcctgagttcaaagaagtaatcagaacaactttggacttgatgttccctgtcgagataattggctgttgcgcgttgatctctggtagtaatttttccttcagtgtgcaatcaaggacctgatccaagacatgctgaaatggaccggtttcagtatcgaagactctgatctggatacctaacttctcgtcagctctggcaagataagaatcatagtaccttgtaatcaagccccacacagcattggtagggtggaacaagtaacgtcccaagtgatggaagacaacatctttctgcggaaacagcctcgtgagctcctcttggtatgatgagatcagaaaaagcgaaggtacaaagtaattatcggatcttaagatcagccatgggatcttctggagatgttgctgactatgttcacagaaaaaaagcttatcatgatcatcatagtcatgagccaggtgaagatatagaaaggcaggtttaggacccttaaaagaaccatcagaatgaatagcttcagttttcgccatgtttccgtaactctcaggggagccaatactgaagttcttaaatttagtaatagggaaatccggcggtaatacccatgaagtttcagggaatggttcacagaaaagatctgcagtgcctttatctccatctacaagtagaactctgtttgtaaggatggcatagagaaatgctgaggcaatagtcaagatcctgttaccaagaccactataagatacccacaccaaatagttgcaatctccaaccattatatcctgaccagaattcagttgctcaatagctttcttgtatgagtctgtatatgggccacatttcttctggagaacctcatgttctctcagtctttccaaaagcccggttgatactaaatggtgcgactctttacgatacaatgctgattggtatctacttagacatgactgttcatcaaaaccaggagctaacaagccaccaattagtttgtccctttgaactttggaagacaccgtagttgcatgctctnctggaacacagaangtgaatagttttatatcagagttcagatggaaatggaataatttgacttcattctgtgcaagacaaatggtacttttcgttcttccattatgttacattcatgacgtatacatatgtgaggtcgtggatattctcagaaaagaaatagaaagaaaagtgaggcaacagtgaattgttaacttcaattatcagttcaaaaaaacaaaaacaaactatgcttccatgaacagcataatggcaaaatttaaatgaaacccttttcacagcataaatagcaaagcgtaacataatattttatcacagagatgctaaacagtgtaccacctacaaaaaaaagtaccaggtgatactacctccattcttaaatatatgacgccgttgacttttttgaaaactttgattaatcgtcttattcagaaaaaatgtgaattatcatttattttgttatgatttgttttatcacttaaggttgtttaagcatgacttgaaattgtacattttttaataaacatttttggatgtttattcaaaatattttgaataaatattttccaagagtttgctagttgataaggtaaatatccaagttattcaatgtttggcgtaatcaggataatgacctccaaaaaatcattctataaaatttgaaatgtataaagtttcatagtaaactcttgcagaacgaaaagaactacatttcacttatgttgatttaatttagaccgaagataggtctaagtcaagatacactcttattaatatgatgtgtcagtcctaaacccattcatgtgtaaaaattagaggcagtagtctagtttttataatacaattattatttttatgacgattctattgtaaaaggttttttcgatagaagaagaatactaggtataatatacataaa

SEQ ID NO: 876 - DNA, 2821 bp, Zea mays
  misc_feature (2527)..(2527): n is a, c, g, or t
cccattcacaaaaagttagaacccttaaataattttaattaaaaaataaataaaatattgtctgattttaattcgatttgataattaaaatttatagcgtaaaatgtagagtacattagcaccccttattccaacccaacgttcgctggtcccacgaactgacggacagagaggcgccgctgcgtcgtcactggtcaggggtccccctgccgctctcctagcccactccactccacagggggctcaggaacccatggcttcactgcctctatgccgctcgccgtcgtccctactaccctcatggcctcaccggccaatctccgcctccttcaacccaaagaatccctcctcccctgtcgctgctcacgtctccgtccaggagacgcctccccaacctcaagacccgtcgcctccctctgattccaacccaaatggcacaaggcccagcagcagcagcaacacgaggttcctgtgggtcaaccccaacagcccgcgcgccgccgacgtcgcacgcgcgcgtgccgggtctggccgccgcgcacgtctcgcttctgctgccgcggcgctcggcgcgtgcgagaccaccgagtccgctgtagaggccgcgcttcaggcggccttccccgagcctccttccgagcaggacgccgtcatcgtgctcaacacggctgccgccaccagggcggagaccgccgtgctcgctctccgctggttcctggggaacgccaaggtccggaagaaggtcatcctctacaacgtcgtgctcaagttgctgcgcaagaagcggctctggagtgagaccgaggcgctatgggccgagatgctgcgggacggcgtgcagcccgacaacgccaccttctcgaccgtcatcagctgcgcgcgcgcctgcggcctacacagcaaggccgtcgagtggttcgacaagatgccggagttcggctgctcgccggacatgctcacatactctgcggtgatcgacgcgtacggccacgctgggaactccgaggcggccctccgcttgtacgatcgcgctcgcgcggagaaatggcagctggaccctgtgatctgctctacagtgatcaaggtacactcgaccagtggcaacttcgacggtgcactcaacgtgttcgaggaaatgaaggcaatcggtgtgaggccaaacctggtcgtgtacaataccatgttggatgccatgggccgcgcattgcgaccttgggtggtgaagaccatccacagagagatggttgaccagcaggtgcagcccagcagggcgacctattgttgtctcctgcacgcatacaccagggcacgctatggcgaggatgccatggccgtgtaccgactgatgaaggatgaggcaatgggcatcgatgtgatgctgtacaacatgcttctgtccatgtgtgcagacattggctatgttgacgaggctgaggagatcttcagagacatgaaggcgtccatgggtgcccattccaagcctgatagctggagctactcatcaatggtgacgctgtactcatccactgccaacgtcctgagtgcagagggcatactgaatgaaatggtggaggccggcttcaagccaaacatctttgtcctgacctcactcatccgatgctatggcaaggtggggcgcactgacgatgtggtcagatcattcggcatgctccaggaccttggtatcatccccgatgacagattctgtggctgccttctcagcgtggcagcaaacacaccagcggaagaactgggcaaggtgatcagctgcattgagagaagcaacgtccagcttggtgccgtagtgaagctccttgtggacaggagctcctctgaatcttttagagaagcagcccgtgaactgctgaggagctcccgcggcgtggtgaagatgccttactgcaactgcctgatggacctatgcgtgaacctgaaccagatggagaaggcctgcgcgctcctggacgccgcacagcagctcggcatctacgccaacatccagacgaggacccagacacagtggtcgctgcacctcaggggcctctccgtcggcgcggcactgaccacattgcacgtctggatgaacgatctgtatacgtctctacagaccggcaacgaagggctgccaccattgcttggaatccacacggggcaggggaagaacacgtactcggacagagggctggctgctatgttcgaggcgcatctgaaggagctcgacgcgccgttccacgaggcacccgacaaggcaggctggttcttgacgacgaacgttgctgccaagcaatggctggagtcgaaggcggcatcagaactagtaactgtgtaaactggttactctggcgcgtacataggattatttttccgtgtaagctacatgtgttctccgatatatgcaggtgaagatgttgagttagcctatctccgaccttactcatccgtatacctatattcaaatttcactctatgatttataatgaaatttaaaatagatcttaaatacctacttgtgcatggtcttgaatcntgtcgttccttaaaaagggagaaagttaaaccatatgtacatatttcacgtgacttgtgacttgacgactgatcttttgtcgttttctacaataatctgattttgttttgagtgacaagctcggaactgaattaatcggattgtgaagattgtaactgggtcaatttcttttcttttgcacgtgattatcctgaggctaatctcctgtataatagagatgacgatctctccaaaaggttcgagagacaaacttagggttttagctgagagacaaacttatcttttgcgcgtgat

SEQ ID NO: 877 - DNA, 2177 bp, Zea mays
ggtacccctgaacacaggccacatgctactgcacggcgtacgctgcctgcatgggattagggaatatctctctatctcggttctaggcgacaaaaaaatttcattcttccccatttccgttccccatggaataaattctaacatcatcgtttaaattataattaagatatacattctttgtttttaatgttaaacattgtcacttatacacattatcagatgtaagaaataattatgcatacatcaaaataaacatatttgtacaattagtagtctcttgataagctaattatttattttttgtcgttaactagtacacaaaatatagtcacgtgcaagtttaataaatcctcgcggagaacgggtataaggaatatgtccccatctccttttacccgtcggaagataattttttctcgtttatattcccgtagtgaaaatttcttttccatcaccgtctcctaacagagaaattttcagtgataaatcgaagatcgggtccacgttgccatggatctctaccgtacgtggaccatggcgtgacgcgacctgtcctctcgtcccggcaccctactataaattgcggtccggcccccacgcggccgggacacagagctacctactataaacattcaacactcaagagccaagagggagagacgatgaaggttgatgtggtggggacgacgcttgtggcgccgagcgaggacacgccgcacccggagctgtggctgtcgaacctggacctggcagtccccaagacgcacacgccgctcgtgtactactacccggcgccggcggccggaggcgacaccgacggagaagcggccttcttcgcgccggagcggctcgaggcggcgctggccaaggcgctggtgccgttctacccgctggcggggaggctgggcgtgggcgagggcgggcgcctgcagatcgactgcaccggcgagggcgcgctcttcgtcgtcgccagggccgacttcgccggcgaggacgtgttcagtgactacgagccgtcgccggaggtcaggcggctgttcgtgccgttcgcggcgtccggagacccgccctgcgtcatgtccatgttccaggtgacgttcctcaagtgcggcggcgtggtgctgggcacgggcatccaccacgtgaccatggacggcatgggcgcgttccacttcatccagacctggaccggcgtggcgcggggcctcgacacggccgaggcgtgcggcccgctgccgttccacgaccggacgctcctccgcgcgcgctctccgccggccccggccttcgaccacccggtctactcgccggctctgctcaacggcgtgccccggcccttcgtcacccgcgtctacgccgtctccccgaagcttctcgctggcatcaagtcccgctgcgcgccgggcgtgtccacctactgcgccgtcaccgcgcacctctggcgttgcatgtgcgtcgcgcgcgggctcgccccgggctcggacacgcggctccgcgtgccggccaacgtccgccaccgcctgcgcccgccgctcccgcggagctacttcggcaacgccatcgtgcgcgacctcgtgaccacccgggtggaggacgtcctggaacgcccgctcgggttcgtggcgcaggcgatcaaggacgcggtggaccgcgtcaatgacgcctacgtgcgctccgtggtcgactacctggaggtggagtcggagaagggcagccaggcggcgcgcgggcagctcatgccggagtccgacctgtgggtggtcagctggctcgggatgcccatgtacgacgccgacttcgggtggggcacgccgcggttcgtcgcgccggcgcagatgttcggcagcggcacggcctacgtcacgcagcgcgccaacagggacgacggcctcgccgtgctcttcgggctggagcccgagtatctgcagtgcttcgaaaaggtgttctatggagagtgagtcgtgagattactagtgtcatccgcgtttcgtcgtgagcaccgagtgcgattactgtagcttggaacctgatgctgtggatgtgggctttgcaaattactccggtttctgtgttcggtttctgtgttttttttcctagtattctcatgtggtttttaggtgctcagtcgagacttgagagagaacatagctgcgttgactttagcatggtttaatttc

SEQ ID NO: 878 - DNA, 812 bp, Zea mays
gattctaaggttgagagcagagtaccatcgtctatcgactggtttaattcgtgctaagcagcacacgtctccctcttctgaaagaagctgcaggttttcgccggaccatggctggaagaggaggaaatggcgttccggccgaacaggagttcccaggctggagcgtcgccaaagcccaggaagatccacacccacctgtgcggcatgtgcacgctgctagaggtctccctgcgcaggctcggcataaaaacgaggaagggccggcgcatttcatccctggcatctccaactccatgcctagccatcatcatcaatttccgggggcgcagtggagcaagaatcctacgccgcatgtcccctctccagtgggattcatcatagaggcgtttcagcaccaaaaggatgagctgaaggaaaaggcgcgccaaaagttcattcgcttatccagcggggggaactagacaaagaagagaaaggatgcatggggatgaacaatctacagcagcgctatagttgtctggacatcagcatagagaggtggttgatgcagatgacacatacatacaacatcgactatatatattaatttatgctgcacgcgcgactcgtgagtctttagtttgatttgttgaataaatgtaatgagagctagtacgtcgtctctactatacatgcatatctgcatatgcccaaatccacaagatgatactagtccgcagtaaacaacagaacccaactggttcaaattgtattcggttctgaataaaatctgattctattcacagctagcaattacatggagcatgttcatc

SEQ ID NO: 879 - DNA, 1969 bp, Zea mays
ccgggaaaaagtccccgctgaggaagcaggaacgctacccttgttctatcctatccggctatccccattcggccactctccagtccgcgcaagggtgccggacggcgaggaaagggtgcgaggtgcgcgggaagacggcagcccggtcgattcgaggcgcggacaccggcaagtgccactcggcgaggcacgaccgctggcagggctgacgcggtttccacagccgcccgcccgccttcatcagagtccataatccaagctctaaacaggttcgtccatgagcagataaggcgcgcgccacgccgcggccaccacacgtacgtaaggcgccaacccaatctacgggaaagtatgggggcgctacccgtcgcccacagtctcgctctcaccgccgcgttcctcccgtgccgccgccccgcggcccacggccggtgccggcgccggcggtacagagcggtggtggcgtacatggagccgaaccccaactcgccggcggccatcgcggggcgcctcgtcggcgcccttcccatcgtgggcctcgtggcgcgcatcctcaacgacgagggcggcgtcggcggcgacatcatcgacttcgccgagttccgccgccgcgtcagcaagaagtgcacggtcatggactccaaggccttctacgacttcaaccaacgacgcgggaagccaggcgatcccttctacgttctactgtgctgctggctggccgccatcggcgccgggctgctcaaaacggaggagatcttggaaggcgtggcgcgcctccgcatctccaacgacattgagttcgaggaggagacgttcatcgacatgatgagggcggcaaaggagaaaagggcgaagctgaaggctcctgctccgcagataccgatggagacgcgggcggagaaggccctcgaagccatctacgtgtgctgcttcggtcaggacatggtggaggacgaggacgagaagcttctccgggcgatactgaacgccgtgttcccctccgtcgggcgggccgcggtcgagaggatggtggcgtccatggccaagcaggtggcctccggcgagaggaagcgggactggaggaccgtgtccaaggaagtgcagcagcggcagctcaaggacctggagtttctgaagcagaacaagctggagtcgtcgtgaagcagcggcggcggcgagcagaaacttggcagcaaatcacgcggcgtggttcgccggcggctgcagccgccttgcttttggttcgttttggaacaacggattcatgatggaattttgtaggtttattagaacagaactctatatgaatttgtaaccctttggaagttggaacaaggaagtggccatactgaaatcctacatgccctttttggaaccgtggtatgctgaacactgggcttcataaaaatattatctccaacattgtaattagatttgtagtattataatcataattcataaccaaaaaaaaaaaaaaattttgttattctcgcaaggtttagccgtaattttaaaaaacctagttatggggttactctcgttccaaaaaaaaaatagccgtaattttaaaaaacctagggttactttcgttccaaaaaaaaactccttatggaatgcctcatgccgtagaattctggcggagcaatccctatatttgctttcaaacactatattagaaagtttgccagtttcttaatctctgtatgtaggacaattgactttaatacctcctagactatagtcctatataccaacagttcctctttgaaagataataatacgcggaaccttttttttgcctacatggaaaaaaaaccctccaaaaacggtacagcttcgtttgccagaattctcccggtcagccaccatcagcgaggcaatacctgcaacatttgtgccccgtgtggtgctgcgctgcggggcttggtagaaaagaaatgggatggattattctaaattaacctggatt

SEQ ID NO: 880 - DNA, 1737 bp, Zea mays
actttgatagtgataattttacgttccgcgcctcgcaaaaaaaaaatatatatttccaaatctaacagcctcgtcgccgctgccggagaaatgccgccgaggaggcgagatcgccggagactccgcgacccgtcgccgccgtcctccgatgcaagagcaccaccctccgccttaggcttgcgtctcaccctcctcgttcccctccttatcctggttctcgtcctcgccgcccttggcttctccggcctcctctcccattcccctccccactcccaaacgctacagacaaccgcccactccgtctacgagcgcggtctggtcaagcgcgacgtctccgcacgagagatcctctctgagcacacaagggtttccgagaaccggtcgcagcggaacttcgcgaaccccgtcctcgcctatgtgaccccctggaactccaaaggttatgacatggcaaagttgttcatcacaaagcttactcatgtatcaccagtgtggtacgatttgaagagtgataggaacaggctagttctggaaggagaacacaattttgatgccaaatgggtctctgaacttcaaaccaatgggtctctggtagtgccgagaattgtcttggaagcacttcctgctgttttactattcgaaaagaagcaaaaggcaaaagctattgatataatagtgagtgaatgcagggataagggctatgacggtattgtgctcgagtcctggtcaagatgggctatttatggcgtgctggatgatcaagagctacgttacatggcacttgaatttgttaagcagctgggagaggctttgcattcagtcaattccaaatcaagtagccaccatttggaactaatttatgttattccggctccaagaatgcaaaagctcaataatcaggactttggacccaaagatctcatgcatctggctgacactgtagatggtttttctcttatgacatacgacttctcaggacctcagaatcctggtcccagtgcacctctgaagtggatacatcattctctagcagcacttctttcagcaaaaggttcctctcatagcaattcacattcacggatgatattccttggcatcaacttttatgggaatgattttctactgtctggaggtagtggtggcggtgctatcaccggaagagattttgttcatttacttgagaagtacaagccatctttgcagtgggatgaaaaaagtttggagcacttctttatctattcagatgaaggcgcgaagcatgctgtattttatccaacactgatgtcactctctgtacgtctggatgaagcccgaaattggggaacaggcctttcaatttgggagattggacaaggtttagactacttctttgatattttataggaatgtctcaatatgtcttttggtactgtgtggagttgtgtccactaatctagtatgtgaattacgcattttggtactgtatgcaccgtgggcattgttcttttcagcattgtaatatcagctggcaacagctcacattaaccgtgagaaactgcttcactgaatatttctgccggctgggtacacactagtgtagtaagaggcatctgtattcatctttgcttatggcatatgtgctgttatacatcttccaaaaaaaaaaaaaaaaacgccctgtctgccatgtcaatggaaaaaaaaaaaaaaaaaaaaaagaaaaaaaaaaaaaaagaaaaaaaaaaaaaaaaagcggcc

SEQ ID NO: 881 - DNA, 1840 bp, Zea mays
gtcagagtcatcctcagattctgaatttgttgtatcaggtaaggaattggaagaattgagggagcctgagcctccaaaggctgcaccaaatctgcatgtgtccttgagaaggatttgtattacaaggcatggagaaggcaagggaaaggagaaacaggaacatgaggaggctgggaacccacgcgtccgcccacgcgtcccggaggagctgaaagctactgtacaaggtgtcctcaattgttgctcacactatttttgcttcgcatgcatcatggaatggtctagggttgagtcgagatgcccattgtgcaagcagcggttcactacaatcaccaagtcatcgaaggtagatcttggtcttggagtgagaaaagctgtaatcaaggtcgaagagcgtgatcaggtttatcagcccactgaagaagaaataaggcgttggctagacccatatgaaaatgttgtttgtatagagtgcaatcaaggtggcgatgataatctcatgctactatgtgacatttgtgattcctcagcacatacttattgtgttggcttgggtagagaagtgcccgaaggaaactggtactgtggaggatgtagactcggtgacgagggaccatcatatactggaattcagcgtacagtagcttatgaaagacaaaattacagaagtcatgtcgatagtagttctgtaagttttggcatggctgcaccaggcggtacatttgaaaggccgtcatcaatcaatccgccccgtccttttcaagggattgatctaaatctatctccaagagagtttcccggagaatcatatcctgctgaatcacaagtttcaactgatagcgtatcaactcccactggaagagctggaactatttcaggaaggcgtcaaatacaacggtacattcggagtttgttcagaccaagtctacctagtagaccagacacgtaccacaatattgcgcagaacagtggtggtgtatcaagaaatgaaccgaaccgctggaacttcccttcttcatcagaagcaaacacatcacagaatctgcctgatggcattcagaaccatcacagtgaccttccatttgttcaagctcacagcaattttgctccatttatgtccctagatggggatgatttccagcaaattgagggtgtcaagagcaacctcaggaacatgcagtagagcccttacggcgttactagaagctcgattctaccctgtgaagcttaccaagggggcaacatgtgccgttttaatggcttgtggaactgaacataacaaaagcttgtgcctgttgcattctcccagaaattgatgtggttcggctcatttgcggagatgtgatgtggtcaacgatataagatacatgctctctttgtttaagtttaggcattttttgttgtcgtcattcttattcattcagtcattaagcacaacctcagattacacagcgaagaaggcatttctgaatgtcttgatagcttcaaatttatacattgtaatattgtggtaacaccaatttcattaggctgaccattcttttccctcgccagatgctcttttgcctactaggaatgctgataactgagcttcccagcctcttctataatcatataccgcgcggtggcaaactagcctcgttcgggtactggctttctgctctattagcatactggtctagtggatcaaccgagaaaagctatcaacaatcttagtactaacaatctatggtctgaagactcgtcttctttaagtgttttgttgtatagcgcagctgctttttgtacagatgaatgtttgttccatattgcttaagtttgtatccagtatccccttcac

SEQ ID NO: 882 - DNA, 1621 bp, Zea mays
ggaccctcgggctgccggcggatcggttgcgcccgccccacacccggccagccgggggctagacccatatgaaaatgttgtttgtatagagtgcaatcaaggtggcgatgataatctcatgctactatgtgacatttgtgattcctcagcacatacttattgtgttggcttgggtagagaagtgcccgaaggaaactggtactgtggaggatgtagactcggtgacgagggaccatcatatactggaattcagcgtacagtagcttatgaaagacaaaattacagaagtcatgtcggtagttctgtaagttttggcatggctgtaccaggcggtacatttgaaaggccgtcatcaatcaatcctcgccattcttttcaagggattgatctaaatctatctccaagagagtttcccggagaatcacatcctgctgaatcacaagtttcaactgatagcgtatcaactcccactggaagagctggaagaactatttcaggaaggcgtgaattacaacggtacattcagagtttgttcagaccaagtctacctagtagaccagacacgtaccacaatattgcgcagaacagtggtggtgtatcaagaaatgaaccgaaccgctggaacttcccttcttcatcagaagcaaacacatcacagaatctgcctgatggcattcagaaccatcacagtgaccttccatttgttcaagctcacagcaattttgctccatttatgtccccagatggggatgatttccagcaaattgagggtgtcaagagcaacctcaggaacatgcagtagagcccttacggcgttactaggtaaagtacccccttcccccccaataaaaacgtgatatttattcaaatggtatctttatgcttcattgacctttctgtaaactatggtgcacggtttatgactatgtttggtttagtccttaaataaagtcttactggagttgacatatactctctttgtttcagaagctcgattctaccctgtgaagcttaccaagggggcaacatgtgccgttttaatggcttgtggaactgaacataacaaaagcttgtgcctgttgcattctcccagaaattgatgtggttcggctcatttgcggagatgtgatgtggtcaacgatataagatacatgctctctttgtttaagtttaggcattttttgttgtcgtcattcttattcattcagtcattaagcacaacctcagattacacagcgaagaaggcatttctgaatgtcttgatagcttcaaatttatacattgtaatattgtggtaacaccaatttcattaggctgaccattcttttcctcgcgagatgctcttttgcctactaggaatgctgataactgagcttcccagcctcttctataatcatataccgcgcggtggcaaactagcctcgttcgggtactggctttctgttctattagcatactggtctagtggatcaaccgagaaaagctatcaacaatcttagtactaacaatctatggtctgaagactcgtcttctttaagtgttttgttgtatagcgcagctgctttttgtacagatgaatgtttgttccatattgcttaagtttgtatccggtatccccttc

SEQ ID NO: 883 - DNA, 4802 bp, Zea mays
atgtcgtttcctagttcaaagatgaactattgggcgtcaagtatttagaaacggaggtagtattatataaaatgtttatgccaaaaaatgtaaaatgtccgtccgccgacatcgccctcaaccatctgccgatatgcgaacctggagagtcgttcggacggacgaggaagaaagacggaagtgaggatcctctcctcggcaacgataggtggggcagctgtctcaccggcccccccgtctcacccgcccgtatggggagctcctcctctttcaacgcgtccccggctccacatggcaccgccctcgtccctagcagccgcgctcaagccggtgctaatccacctcctgcgcggctcctccgacctcgcgtccgtcgccgccacgcacgctaagcttgtcaaggccggcatcgcgacccccctctcctcctccaatcatctcctcgccgcctactgtcgctgcggcgcgattggtcgcgcccgcgacctgttcgacggaatgcgggaccgggacgtcgtctcctggacgacgctcatgtccgggtacgccgctgccgcccggccccgggacgccgtgtccctcctccgcgccatggggtgcagcggcgtgcggcctaacgcggtcaccttctcgacggccgcctgcacgtgcgcgcgcctcgcggacgcagaactcggccggcaggtgcacgcccaagcggagatcgctgggtgcgcacgcgacacagtcgtcgccactgcgctcgtcgacatgtacggcaagtccggcagcgtcgaggacgcgcgcgcggtgttcgacgccatggctgcgccagcgaggaacgctgtgtcgtggggcgctatgctggccgtgtacgtgcagaacgcgctcgggaacgaggcggtcgagctcttcgcggagctcaggacgtgtggcggtggcatggcgcccaaccacttcatgctggcgagcgtggtgagcgcgtgcgcaggcatggcacgtctgggcatcggtaggtgcgtccatggcgctgtccttcggcttgggtatggaaacaatgacgtgatttcggtggctttggtcgacatgtactccaagtgcgggcgctacgagtactcaagaaaggtgtttgacaggatcgagcaaccatccgtcgtcacttacacctccatcattgtcgccgcagcaaagtacggccgctggacgtgcgcgcttactttgttcaacgagatggtagatcaaggtgtgcagccaaatgatgtcactttgctcggtgtcatgcatgcttgcagccattctggccttgttgacactggccttcagctcctccgctccatgcagagcagatacggcgttgctccgtgccccagccactacacatctgccgttgacatgctgggccgggcagggcggctcgaggaggcattcgagctggccaaggaggcgcagcttgaaggcaacgatgccctcttgctgtggaactccttgctgtcagcttgccggacacataagcgcctagacctagcaaccatggctggccagagggtttatgagttcaataaccagcaggatgtagcagctgggctggtagtgatgtcaaatgcatatatttcagccggtcagatcgataatgctgccgctgtgcgatcaagcatgaggctgcgtggcatacggaaggatcccgggtgcagctggattgaagtaaaggataccccccatgtgttctatgctggtgcagtatcatgcgctggtgcgtgggcagataaagttctgatgttgctagatgaattggagagtaagatgagggagagaggttacagggggagattagggagtgctagagtatccgatgcacatgaagatgaggaggaagggaaaggtgtgatggttggtgtgcacagtgagattcttgctttagcgtttggtttgctagttgtcccgaatgggatgaccatcagggtgatgaagaacctgaggatgtgcagtgattgccatgaggtgttcaagctcatcagcgccattgttgagagcgagttcgtggtcagggatctgaacaggttccaccatttcaagctggggtcatgttcttgcaatgactactggtgatccgaaattgtaatctcagtggttctgctgttcatagtagaaaagaacaactttagcagattatcagttattaaaaaaatgttaagaaattatcttgctggagatgttcgagtgacttatttttgggtacaactacggaactaccagacattggtgagtggttgtagcataatctaactctgccctgagtttgctctatcctgttgtgaacttcactattgttcaactttgttccatgttttttcgccaaacaggtgtagtttcacaatcacaaactccgctctaggaagaaaaagtagagttgtgagaacacaggtacttacaaactttccacttttttttttgagcatctctaaataggctctagatctgagcatttgtgggttaagagtttggaatttttttggtagcgagggctaaattccagtgcctgaatgagcgaagttgggcctttgtttttgggccaggcacatgcctagtcaagccacccgttcttttttagttgaaaaaattaaaagaaatagtagtttaatatgggttcagatcttggcgtgcttatcattatccaggacttttacagaaagaacatctcaacagtactgcccaaatcaggcctctacttttctttttataggtagccagtaaccacttactttcaggtgctgtttggtttggtcattttttttccgttatccattgacccattcacgaaatagattgcgttgtttcgtgtttggttagaacagcttatattgtgttgtttatatttttttattctggaatttttaaaaaacacaaatagatcgaaccaatttctagtgatattgaagggatcggtatagattttgatgacattggataaatttgctttaaatagaactaatggtgttagcttcaaactaacggtaatgtcattcaagacattaaaatttaaatttgatggtattgaaggaaagttataaattctgatggcattgaagagattggtacaagtttagatgatattgaaggattttaaattctgatggtattcgagagataaaaaaagtatggaattttaaaaaatctggtccatatttttgttgttgggtgtgaaaaggccacaaggatcgatggtatatctccggtgggagtggaaagcagacagcactaatgcgctatatatgatcatctatggctacctgctagcagaggtttggcaggcacccacctcacgatacgaccttacgtttgttcttggaccgagtgggagtgggaagcggacaacgctaatgcgctatataatgcgctatatatgatcatctatcatgcgctaccgcgcgcccggccggcaattggttcaccatgcttctccttcaggtcatccttcttggactcctctccctgcacgcgccgtccaactcagccaccgccacggacacggtgtcccctggcaatggcctcgccggcagcagcaggctcgtctccaacaacagcaagttcgcgctgggcttcttcaggatggacagcaagtccttcaactacgccaccaacccatacacttacctcggcatctggttcaacaaggtccccaagctaactccgctctggagcgccaacggcgagagcccggtcatggaccccgcctcaccggagctcgccaccgccggcgacgggaacttggtcatcctggaccaggccaccaggtccgtcatctggtctacccatgccaacaccaccaccaacgacaccgtcgccgtgctccagaacaacggcaacctcgtcctccggagctcctccaactcgtccaccgtcttctggcagagcttcgactacccgaccgacaccttcttcgccggagcaaagattggctgggacaaggtaaccggtctgaaccgccgccttgtttcgaggaagaacctgatagatcaggcccctggcctgtacactggggagatacaaaagaatggggttggtcatctcgtgtggaactcgacagtagaaatcgagtccaccgggctgtggaacggccagtacttcagctcggcgccggagatgataggcaacaccgtcagtatcacaactttcgagtatgtcaacaacgataaagaggtgtacttcacatggaatctgcaggatgagacggcgatcgtgctctcgcagctaggtgtcgatggccaaggcatggtgagtctgtggattgacaaggactgggtggtaatgtacaagcagcctgtactccagtgcgatgcctacgcaacgtgcggaccattcacagtctgtgatgagggtgagaacgagggcccaatctgcaactgcatgaagggtttctccgtaagctcacccagggactgggagctgggagaccggagagacgggtgcacgaggaatactccattgcactgtggaaggagccgcaacacagataagttctacgctgtgcaaaatgtcatgttgccccaggacgcaatgaaaatgcaggctgcaacaagtgatgaggatgactgctcacgggtttgcttgggtaactgctcgtgcactggatattcctatggggaaggaggctgctctgtctggcatggcagattgaccaatgtgaagaagcaacaacctgatggaaatggggaaacactttacctacgccttgctgctaaagaggtgccaggggtgccgaggaagaatagtagaatttttcgctttggtgctgccattattggcgcaagcgctgcaggcatgca

SEQ ID NO: 884 - DNA, 1067 bp, Zea mays
ggtaccctcgggctggccggccgacgattccatacaggacctcacctccctactcgcgtagtagtcgtcgtcgtcgtcctcctcccgacgtctggtggtatcggacttgcgtggcgtggaggtgcttccgaacttgggatcgatttgcttgtcagcgccgaaccctagctttgcttcgacggcacccacctacggtacgcccgcggccccaagcagtcaggcgacaccgaataatttggttacagagacgagcgggtgcgccggcgagagggcccgattctcaccgcgccggcgatggcgagcagctcgtctccgtcacaggtcatctgcgcctccttcaatcaggacaacagcatgttttctgtcgggaccaaggatgggttcaagatctttgacgctcgtaatgggaggctctgctacgaaaagagtcttgggggattcaacattgtggaaatgctatttggcacaaacctacttgccattgtcggaaccggtgaacagcctgcaatgtctcctcgtcgtttgtgcctgttcaataccaaaacaggagcatcaaagagagatctgaactttaagacttcaattttggctgttcggttaagtaggaagaggcttgttgttgtattgcaggataggacttttgtttatgatctaaatagcactactatattggacgaaattgaaacggtacccaatacaaaaggtctatgcgcatttgctcctaattctgaagagtgttatttggctctcccagcaagcacatccaaaggatctgctttagtatacaaagcatcaaaaccggaattaatatgccagatagatgctcatctggctccgttagctgcaatggttttttctttgaacggcatgtacctggcaacggcttctgaaaagggtaccatgattagggtgcatcttgttgcacaagcaaccaagtcacatagctttcggcgaggaacatacccatcgacaatctattcactggcatttagtccctctgttgatctgcctgacgttcttgttgccacaagttcatcaggatctttgcacatgtttttccttgatgc

SEQ ID NO: 885 - DNA, 4572 bp, Zea mays
ggcccagctgatggagcctgctatttaaagtttcaacacataggagctatttttacaaataggcctgcagatgcctctactcttggagacggtcttaggtggttagagtagtactcctcggttccttggtttgactttcgttggagtgattttctggctgtggttaaaaaaattatatcgtttgtccaatgtcaaagcatagatataaggcctagtatagccgcggtcgttctcacatgggttacgacgtcgctgtttttgggtgggacagagggttcgggttttttcgacctgcataagaatatcttcttaatataataggtcgagtttttttaatgacattgaaattcaggctaggaaacatttatagcagtctatatactgtatatatgcgatttgttttctgaagaacgaatttgaaacagtactcaaaacatttttgtaacttaacttaattcgcacctgtacacgactacaaggtaccgcttaaacgaatacaacgaatctcgaaatgcctaactccacagaccacaggccagacacgcagttcagaaaagagttggatcgtcgagctgtacgtccactgagagagttagctatcgaacaacttgaggccgaagccgacgtcctcgcagtgccggacgtacggcttgacagcggcgacgtcgacgtccgtcttggccctgcacccgaggatcggcggcgagtgcaggcacggctccacggacgtggaccggacgcacgcgacgtcggaggtctccctgttccagtccggccggatcaggatccacggcttcacgccggcgaagctgtacgcgacgtagccgaaggtggaccaggcgctcatcgtgatcttgtcgcagtagctgagcaggtagatctcggccagcgccttctggttgtggtcgttggacgtgtactgctgctgctcctcgtggctgggctggaacaccgccacgatctccccactcttggtggggctctcgtagtacatgccgcggatcttctcgtagtaccccgagtagagcgacgcgatcagcaccgccttcaccttcccgtcgccagcgtcggccgtcgcgttcgtcggcggctcggcggggccgagctccggcagcagccgctgctccctgacgcaccgcatcagctgctcgtacatgttctcgaacttgatcggcttctccgggaagatccggatctggaacccgatcttctcgtcgaccctggcaaggtacgcctcgtagtacctcctgacgatcccccagactcggttggtcgggtggaagaggtaccgtcccaggtggtggaacacggcctccctccgcgggaacatcttggccagctcggcctcgaacatgggcgtcaggaacagcgccggggcgaagtagctgtcggacttgagcagcatccagttgaacttgctgagcgtgacctggtcctcgtcgcagaagacgttgtcggacagcttcagctggaactgctccaggtggaggtagacgtacggaggcagcgacgacgacgccggcgcgccggggccgtcgtcgttgcggacgatgttgttcttgagcatgttcgcgtagctctccggcgcgccgatgtggagcttgtggggattgttctgcgggaagctgcccgggagcacccacgagctgaccgggaacggctcgcagaagaggccctcctgctccgccgggacgtgcacgaggagcacccggtcggtgagcagcgcgtagaggaaggtggaggcgatggtgagcatgcggttgccgaggccgttgcaggggaaccacaccacggtacttgcactccgagtcgtccgtgttgcgcccggccttgagaagcttgacggcccgccggtaccgcttcgtcctcgggccgcacttcttgtgcctcgcctcgtacttcctcagcttctgcaccaggtagggggacagcgggaacggggatggcttccggtacaggttcgatttgtagcggctctggcaggaggattcgtcgaatgccgcggacagcaatccccggccgggaagcttatcctgggacactgatgttgccgtcgatacagagacgttgttcagaccaacaggtcctgcagagaaaaatggtaggtgaataggctatcagagatgacgagttgaaaaatgcaggaaaaaaattgttgcaaacatgtgtgaattgaattttttgaattgcgcctacccagtgtgtgaggttgacatgtgagtattggggctacaacactacatgtcaccatttttttattaaccctgatcttttcttttgctaattactttgatgatctaaaattgcgtccatttaaattaatgcccaagtcacgtgtcatcctcaactaaatatcgcagccaaaaaaaaaacgtcgcaatctcgactaaatatcgtagcaacaaaatacggcagacaataaagcgcaattcctcacttcctatttagacttggacactactttgtatttttcttttatataaaaaacactacattgttaaggctaaaaatactagtaacagtttggtctcctaaagccagggaccactcaagcgaaaactgtgtgcatctagtctagaagagcagaatacacccagcgtttacgcagaagcctttggaaggaactgtgatgagtgatgagattgaggcaggacaagatccggatagtgatgcatcatgcgccagtgcgatggacgctgagccgctgacgcaacaaacaggatcgcctctgtacagcatcagcatggccacaaactcaactgctgcagtgttgctgtacgcagcaagccggatctgaattccgatcctggcccaaaatgaattgctcgttcatgcatgaagcagcagatcagcgatccgatcacgaatccggactgcctgcacggggacagctccatagtgccacgcacgatccatgtgatctgattgatgcgcgcggtgtgctccgccaatggccatggcgccacagcgaaccgtagcaagtaccacgaacgaagcagcgagcgagcgacgacgtcttctagaatcggacgctgagctagtgagcagcgagctgcctcccgacaaaacgccaactcgcttttcgccatgacgaacaaaaaaaggcgcagggaaattgcatacgatacgacagcgtctcccccttcggttcgtaggcccagcggcccaacccgcgtctgagaatccccccagttccttccttcccacgcgtcgaatggcctccggtcaacgagctacgtgcgacgacgtgagtacgtgacccccgaaacccacaggcccagaacggagcgcggagggcagggcagggaggcttactttggccctgacgaggcgtcgcgccgcggtcgccgccgccgccgtccacgcggcgggcggtaggcttggggacgacgggcggagaggaggtagcggacgacgacgacgacgacggcgaggggccgctgcccctgcccccgccgaagacgaggaagaggaggggtagcgtgaggaggaagccgacgagcaccatctccgggcggacgccgccggagccgcgccacccgccgccgccgccggcacgcttcctgtcgtcgtcgggcggagcccgagggctccgcgaccgcttcacgtccatctccctcccgcaactccgccgcgcgcggcctgctagctgctagctcgatccgctcggactgctgcctctctggtgtcaattaaaagctagctctcgtttcgatttttgatccgtgtggcgacggcttgcttgtgccggcttctctctctctctcctccgcttggagcaggtcaacctggtggaagaagctacgggcggggcggggggcttgaaatggaaggagagagagggagtgacgccgacgtgtgcccgctcgtgcatcgttggtttatgcagcacgcaccgcttctattctaattcgctactactaattcgcatttgcggcaagtactcatcaactgctgtgtgcagtgcacccgcgcgggagctgttaggtttgattaccgttgaattaattagttagctggcttgtgggttgttgtcactgtgtgggaacgaggaacaatttcctatagcttcggccggttccatggaaaagtctctgctctttctagcctaactataactttctttttgcactggtatcctcgcctccaaggctccaaagttcatatgttttgaccgtgttttcttccgaagcaataggtggtagtaatcgtcatatcgaactgttcgttaaaattcttgtaaaaaaagggtacgacgatatgtattgaaattgcttgcccgctgtcgacttcctttcgcgcttctcaccttgctgcagggagacgccgcacgttcctttgcatgcaggggaattgcatccatagctccgtctccgaaccgcgatcacggtcacggccatgctgccgtgcgtgcgctagggtttcttccttcgcttccgcggcccgcacatgttttcgttttccattggcaggactctcacatggttttttggtagtttgcgacgtcctgctgcacctctgatgacctgtcactagctagtttccgtgagaccggggggggggggggggggg

SEQ ID NO: 886 - DNA, 1038 bp, Zea mays
ccggccggggttggtggcagaaccgaagattgtattagggaaaaaaagaagggaaaagagggggggaaataccggttcgtccccccgccccgcaaacgaaatccagcagaccgacgcgaaccgagaaaaatcccacgaaatctcgtggccgcggcgaccggaagaagaggacgacgacggacggagcggcgatggcgtgccgcgcacttgccctccgctccctgctcctccccgacccgctacaccgcctcccggccgcggcgccacctgtttggagagcgtcccgcggtggccgccgtccgcacctccgctgctgctccggcggcgggggcggggagcccgggcagccgccgcaagaagctgtgctcgaggccatatccaagatagcaaggtctaaaggaagggttgcactcacaacaaatatggtcatgggtggtactgtgactgacgatgcaagtgatgaatggcttgttctggatcagaaggtaaattcctaccccacagatagaggatttacagcaattggcactggaggtgatgattttgtccagtcaatggtagttgctgttgaatctgttcttcaagaatcaattcccaagggccgggtatctcagaaattatcttcaagagggaaatatgtttctgtaaacattgggccaattcgtgttgtttctagtgagcaggtccaagctgtgtatcgtgccatgagaagagataacaggatgaaatacttcttatgaagtgcaatttcatgtcctggatgttccctagtccattccatgttgtatcctacgatgcattttcgccatatttgctggacctccggtgaattccaatgacttttatgtgccattcaagcccaaattgaagcttctctactacaaaacaatatgttgggtccagctacgttatttagtgcagggggcgtatatagctactatgtattccctttcttctataatgaataagattcaaaggttcacagtttgtcctaaaataaaaaaaaaaaaaaaaaaggcccctccgtcgacctcgagg

SEQ ID NO: 887 - DNA, 1639 bp, Zea mays
gcacgagaccattacctagaacatcctaatcaaaaacgacctcgagagatatctgagcttgctccactcatagccatcacacactagtcacaagtacaccaactagcccagtgggctacacgagctgagcttgctccgctagcagctcaatctcacaaagcctcagagccaccaccaccagtgtgttctagccagctagctctagctccgctctctgatctcaaagcttgataacgaacgggcaaacaagagctcagaggtgggagctagctagctagagagagagagaggacgacggagagggaaaaaaaaccagctagcgagcgcgcgtgcgtggcgatgatgcatgtcatgtgttaacatgtacaatccagagcagcaccaggccgcgccgcccttcatggcgccgcgcatgtccttctccagcgacttcgccgtggagccgccgcccccggcggccgcgcgcgggggcgcggcggggccgggggacgccgacttcgagttctccgtcggcagccacccgatgatggccgccgaccagctcttctccaagggccggctcctgccgctgagggaggcgccgcagcaggcaggcggcggcgcgcggcccgtgacgctgcgcgaggagctgcgcgccgacgagcgccacggccgcgtgccccgcgcgccgaacatccggtggaaggagctgctcgggctgaagaaggcgcccaagaagcaggccgccgccgacgccgccgccggcacgtccgccgacgcccatatggatctcggagggcagcagggaagcacgagagactgaaaagccgcaggatatatatcagattcagctgtgacttgtgagcgggtgaaatatattgcattgttaggcgtggccatcgaagtgtatctttcagcgcgctctggctgtttggcatcgagctagctgatctgtacctctcgatgtcgatcatcatgtcattggcttagcctacgggagatgaggaaaccacacacatacgaagacgcgcgcgcgtacgtacgtctatggcggtggctcacaccaccaatgcgcatttcctctttacctctttattgccggccgcagcttgtttcctctctttaatttatcctgggtgtataagggaatttgaccatttgtttcacgtacggcagtaattcgttcgtgtcgagtagctagatgtatcatgtatccaaccatgcatggataatgatggatgtttcatgctttgcattattgtaatggtcgtcgcgtgtagtgtagcagtagtagtgaaattaactctccgcttgctgtgtgccgtgcctatctactagtatatctctggtgttttgaaaggggccgggccgggccggttgaatgcagtgctttctccccctttcacatggcgtggtccctgctggtgtacgtgttgtttagctgttcccatgcttgtctgcttttggcacagccgccctggcctcatcaggtcatgcattatattggtggctaatcatgagtagtagtatctagcttttgagtcgtccaatggagattatgtatgcatgtcctgaatttcgcaggaaatatgatgtttttaattttaaaaaaaatctgcaaaactactattacatggctcaaacaaaaaaaaaaaaaaaa

SEQ ID NO: 888 - DNA, 1702 bp, Zea mays
actcctgactccgatattggcgtcctctccaggccggccggcgggacggccaccacacatcccttcctctctttctccctcgaggctcgagcattcgtgctgctccgaccccaccgccacaggctcggcggtccggcgatctcgctcaccggcgggaacatgactacttcaaggcgccttgctgacaggaagaccgcaaagttccagaagaacatcaccaggaggggttctgtgcctgaaaccactgtcaagaagggaaatgactaccctgttggccctctagtgcttgggttcttcatctttgtcgtcattggatcatcgttgtttcagatcatcaggacggcaaccagcggcggggtggcttgagagccggcccacatctaatccccagtatagagagttgcttgttatacatgcatccagctaggattgggtagcagctaaaatgttaaacgtgacaagactgccctgcattccgttcatttggtgggccttgaatctggaactgaaccataaggcagaatcatgtaccttatataaagtgttgaatgggtaactggatctcagtgtttcatttaatcttaaaaaaaaagaaaaagctgccggattttttgtgtgtgtgattctaagatactatgcctttgttcacctgtgttggcttgtgacaattgaagtttcagtagctgcaaaaaaaaaaaaaaaaatttaaagcccgcggccgcagcttctggccaccaaaagctgttgcggactgtcaaacgctcagtttttgagccagcttttataaaatttattgggggtaaaaatcattcaaaatcaacataaacacataatcggttaagttgtaatagtaggaatccgtcactttttagatcctgaactctatagacaactttacttcctccacacgtaattctaatgatattcagattcttcccgtcaaattttcagaaaagctagtcagaaaaaaagatgaaccaaatagacccacagtccctcttatccaagtcgctttttgtgtgatttagctagtccctcttatccaagtcgcttttttgtgatttagctaggctccgaacctatatgtaatgtattgagaaaatcctttagaccatgttaggtttaagaggggattgggaggatttaatccttcctattccattttgattagggagagatttaatctcctttagaccttgttcgtttccattggattgcacccggaatcgttccagctaatcaaagtttatataaattagagaagcaatccggtcaggaatcgtttcgacccaccaatccggcacaaacgaacaagcacttaggctttgttcggcaggtcaggatctaagtcaggttagttcctattcggtttgtagggattggagccccggattgaatactagccagattacttctctaatttatatagattttgatgagctggaactaatcctgatttattcctgtagaagcgaatagatccttagtaaccaagccagcctaggattgagtgaatgatgagttatcactcgttcctgctcactagcttatttctagatcaggaaccaatctggaaggtaggtcatctgggcttgttccaggccgaggattgagggatgaaaatcaaaatcaggtgggttgtttccggtccaggtcaaaatgaacaattttagtaggctagaccagattctaaaccgaactg

SEQ ID NO: 889 - DNA, 727 bp, Zea mays
gcgagaatctgggcgtttggtttcagcttcagcttctggcggcccctcgagccccccacaagctgacggccaccacacatcccttcctctctttctcctcgaggctcgagcattcgtgctgctccgaccccaccgccacaggctcggcggtccggcgatctcgctcaccggcgggaacatgactacttcaaggcgcctcgctgacaggaagaccgcaaagttccagaacaacatcaccaggaggggttctgtgcctgaaaccactgtcaagaagggaaatgactaccctgttggccctctagtgcttgggttcttcatctttgtcgtcattggatcatcgttgtttcagatcaccaggacggcgaccagcggcggggtggcttgagagccggcccacatctaatccccagtatagagagttgcttgttatacatgcatccagctaggattgggtagcagctaaaatgttaaacgtgacaagactgccctgcattccgttcatttggtgggccttgaatctggaactgaaccataaagcagaatcatgtaccttatataaagtgttgaatgggtaactggatctcagtgtttcatttaatctttccccggtgttggatttttatgtgtgtgtgtgattctaagatactatgcctttgttcaaaaaaaaaaaaaaaaaagcggccaagtttcagtagctgcactcgaaaaaaaaaaaaaaaaagcggcc

SEQ ID NO: 890 - DNA, 678 bp, Zea mays
  misc_feature (644)..(644): n is a, c, g, or t
  misc_feature (646)..(646): n is a, c, g, or t
aggccgccccgggccgcccggccggcccctcctctctctctctcctcgagcattcgtgctgctccgaccccaccgccacaggctcggcggtccggcgatctcgctcaccggcgggaacatgactacttcaaggcgccttgctgacaggaagaccgcaaagttccagaagaacatcaccaggaggggttctgtgcctgaaaccactgtcaagaagggaaatgactaccctgttggccctctagtgcttgggttcttcatctttgtcgtcattggatcatcgttgtttcagatcatcaggacggcaaccagcggcggggtggcttgagagccggcccacatctaatccccagtatagagagttgcttgttatacatgcatccagctaggattgggtagcagctaaaatgttaaacgtgacaagactgccctgcattccgttcatttggtgggccttgaatctggaactgaaccataaggcagaatcatgtaccttatataaagtgttaaatgggtaactggatctcagtgtttcatttaatctttccccggtgttggattttttgtgtgtgtgattctaagatactatgcctttgttcacctgtgttggcttgtgacaattgaagtttcagtagctgcactcaacntnaaaaaaaaaaaaaaaaaaaaaaaaaaaaaaaa

SEQ ID NO: 891 - DNA, 1390 bp, Zea mays
gtaccctccgagggccttggccgggctttcatcagggccggacactacactaccatttttcctttcgcagcgtcccgtctgtctgtctgtctgcctccctccgctcacctcctctgcttcttctcgctttcttccatcttggtccagcctccactcttcctgctgagccatggcggctgccgaagaagggccagagccactcaggtatcagactctggccctgagggtgagcatccactgcgagggttgcaagaagaaggtgaagaaggtgctccacagcatagaaggggtgtacaagacggacatagacacgcagcagcagaaggtggtggtcataggcaacgtctctgcagacgcgctcgtcaagaagctcctcaagtccgggaagcacgcggagccgtggccggagcctgctccagccccaccggccgccgacagcccgcccgggcccgacggatctcccggcagcgcaggcaagaagaagaaaaagaagaagggcaacaagagccccgaggcggcgaacaacaagcccgccgatccggcgccagcgcccgcgcccgcgccggcggagggcaacggcggacccaaccccccggagcagcacgacaaggctgacggcggcgcctcgtgcgatgaggcatcggatggtgagcaggataagcctgaggctggcggtggcggcggcaacggctcccctgacgccggagaagccaacgagggcggcaaggtggccccttccgccatgacgccgcacggcccgcagcccatcgcggctgccaccaacagcaatggtggtggtggtggtggcggcggcggcggcaagaagaaaggcaagaaaggtggccacggcaatgccaacagagacggcgccgggccaatcgtcgaggtccagcccccgccggacgcacccacgaagccggccgccggcaactccggccctctcactgtcatcgacgcgggaccgtacccaccaccggcagcggcggcgatgagctacccagggtactacgccgccggggtccacccgccggcgtacgtcatgagctacagcacggcgcacccgagctctgcgctccggagcagcgcgtactaccacccgatggccggtgcgccgtacacaccagggagcggcggcgggtacttctactcgacggcgccggcgccggcgccggcggcgcccggatcgtactacatgttcagcgaggagaacgccaacgcatgcagcgtcatgtgagaagattagacggttaataatcaactcaactcaattattaactgcaagaagatgttgcagagagtggatgtgctagtcattatgctcttgttgtgcccaagaactggttgtcattgcaacgttattttgctgtatctgcaaaatacatggattttg

SEQ ID NO: 892 - DNA, 3407 bp, Zea mays
  misc_feature (2787)..(2788): n is a, c, g, or t
cgcatcaccctaaattgctacaggggtaggagaggggaggtcggcgggcgttgaaagcagtttaagcagccacctggccacataacccaagcatccgccacgaaacacgccagctcagctgtgtcacgctcatgtttcgccaacgtcgccgaagcaaagcgcctcctcgtcctccagacctccacgactgcatgcaggtggggccactgggtccagcatgtcagtaactcaacccacgaaaaaaatctgtacgaaacgcggtagctagaggaggaaatgcttcgaggtgaatgaggggcccacgcataaaagtccaattctttgttcactttttttcttggcgtcttatctcttcccttctctgcctcgcttcgcttcctacccacgccacgcgtgtgttcttggcagccacccaatccccgcctcgcgaaatcagacgccaaatccccttatcttatcatcaaatcgatcgccaacgggcatgatctgatggctccctcatcatagcctctgctgctgcaccgcagcaaaatggccctggtttagtttagtcctcaagatcccgcctttctggtgctctgtttggctagtgtcgtgccgccgcgcgaggacccggagattcgattccggtccggtgtatctctaggctgcttggtttgggttaggatttagtgggcagggttgtgcagctggtgtctcgtggaggaagaatttcgtgggaggattttgaccgggtttgggcaaagagcgcgccgttcgggaggaggtgattctcgcgtggttgcgtgctttgctgggagtctgctgcggccaccgccggtatggcgacgcacttcacgccgtcgcaggcgcacgcggcgtcgcaccacgcggcgcaccaccactcggcggccgccgcggcggcggtcacggccacggccaccgcgcgactgcacccgtccgcgccgccgccctcggcgtcggccgcggccgcggcgctgtgcccgccacacctcctcgcgggcggcttccccggccgcctcctcctccgcggcgtgccagcccgcccacaggcctatcttcgttggccacggcgcgccgtgggcgcagcagccccagcgcaccgcgccggcggccgccgcgctcggtccggagtttcggcgcgcgcgcaccaccaagaccatctccaagcgcacccgtggcggcggcggcggagggggcgcacaggaccgcgggcgcgtgtcctcagccgccgcgggtcgctgtgtcgagaagctgctccgcgtcgcgcctgaagataggcgagggcttggttcggccctctcgtcgtttcggggcgagctacttggtcctgaggactactgccagatcctccgggggctcggcgacagggataaatctgcacttcgtgcattcgaggtgttctatgccgcactacccttagttgggggtggtgctgttgacaagggaaaacttctgactgccgccattggtgcacttggcaagatgggccggccagacctcgcgaggagggcttttgatactggcattgcagggagctatggcaatacggtgtttgcgcactctgcgcttatctcagcttatgccaggagtgggcttgcaactgaggccatgggggtgcttgagtcgatgaaaggtgcaggattgcggcctaccacggtatcatacaatgcagtgattgatgcatgtggaaaagggggtgttgaccttaggttcacacttggatatttccgtcagatgctgcaggatgggctctgtccggaccgtaaaacatttaactcacttcttgctgcatgtagccgggctgggcatttggaagatgctcgcactgtctttgatgaaatgatccatcttggtagtgggcgtgacatttacacttacaacacattcgtcgatgctatttgcaagtgtggcaacatggggctggctctgcaagttgtattggatatggaagcaaacaatgtcaagccaaatgtcgttacatatagtacgcttatggatggattctccaaactggagaaatatgatgaggcactcaagttgcgtgaaaagatgaagtctttgagaatacaactggaccgagtttgctacaacaccttactggccatatatgtgaagacagggaaatatgatgaaattgctactgtatgtgaagaaatggagaaattgggcattgagaaggacactgttacttacaattccttgattaatggatacggaaagcaaggacgcttggacatggtcgctttccttgttcaagatatgcgggcgcaaggcgtagctcctagtgtgctgacatactcaactttgatagatatctattcgaaggcaggaatgcatggagatgcatttaatgtctatttggattttaaggagtctggtctaaaggcagatgttgttctgttcagctcttttattgatactttggccaagaatggcttggttgagtgtgctttgtctttgcttgatgagatgatgaagatgggtatcaagccaaatgttgtaacctacaacacaatcattgatgcatttggcaagtcgaagatttttactgaggaggattctgatattggtgacatgcgaattgttggggtttatggtggccaggttgtaagggtcactaatccagtgataagaggacggcgctctgccactgatgttaggatgaggaggtcacaggaactatttttcattctggaattgtttcagaagatggtccagcagggtgtacggccaaatgttgtaacattttctgcgatcctgaatgcttgcaggtactcttcatcnnatttcattggagacttcagatgccactgctgttgtagctctttgtatcgatgccagtgtttctataaaaatagcagctgtgtcagtcgtaaatgcaacaattgccaatgtgttaacctggacattaaactgtattttagcagcttaaactaggtaacttcgattttggaattatgtttgcactgactaaacttcagctttcatgtatttcattaatgcacaagattactctatattctacaacctgtatttttttaatactagaaaagggtgtcctaaatgtgtccttgccttattcaaaagaaaattaatactagaaaaaggtgtcctaaatgtgtccttgccttattcaaaagaaaaagcacataagtgaaagacgacactgcaaattcgtatagaaaatcacgtttacataagtgtgcctctttaagttctgtgtggttctaactatttgctttgttgttcttgtagtcgctgtaatagttttgaagatgcagcccttttactggaacagcttcgcttatttgataactctgtctatggggttgcgtatgggcttttgatgggccatcgagaagcttggtctcaagcacggtccctctttaatcagctgggccgca

SEQ ID NO: 893 - DNA, 770 bp, Zea mays
gccgccctcggggccgaaataaaaaaaacgggaagacagccttatcctcagccacgaaccgcccctcagtccctcacccttgagtccacacgctctggcgcacgcgcacggcgcacaccatggccgctgccttagcttcgcttctccacctcgcgaccccgacccagactcgctccactcacctcgccgtccgcctccccagcgcccagctgccgcgctggccgtcggggtcacgcatcgccgccgcgcagccgccgcgggcgtacaaggtgacgatcgagcacggcggcgagtcgcgggtggtggaggtggaggaggacgagacgatcctgtcccgcgcgctggacgagggcctggacgtgccgcacgactgcaagctcggcgtgtgcatgacgtgcccggcgcggctggtctccgggacggtggaccagagcgacggcatgctcagtgacgacgtcgtcgcgcgggggtacgcgctgctatgcgccgcgtacccgcgctccgactgcaccatccgcgtcatccccgaggacgagctgctcaaggtccagctcgccaccgccgacgactgacgccccgccgatgaccagcaggcatcaacctccggcggtgaaatgatgctggccctgggacttgtacaccattgttgactaagtagcactagtgacagagctttttctcgagaatagatgctgtgtgatatgcctctgccaaatttcttgtgtccaaatcgagcatttcccgaaaaaaataaaaaaaaaaaaaaaaaa

SEQ ID NO: 894 - DNA, 760 bp, Zea mays
attgggccgcccggggccggcaggagaaataaaaaaaggggaagacagccttatcctcagccacgaaccgcccctcagtcccttgcacaccatggccgctgcctcagcttcgcttctccacctcgcgaccccgaccctgactcgctccactcgcctcgccgtccgcctccccagcgcccagctgtcgcgctggccatcgggggcacgcatcgccgccgcgcagccgccgcgggcgtacaaggtgacgatcgagcacggcggcgagtcgcgggtggtggaggtggaggaggacgagacgatcctgtcccgcgcgctggacgagggcctggacgtgccgcacgactgcaagctcggcgtgtgcatgacgtgcccggcgcggctggtctccgggacggtggaccagagcgacggcatgctcagcgacgacgtcgtcgcgcgggggtacgcgctgctctgcgccgcgtacccgcgctccgactgcaccatccgcgtcatccccgaggacgagctgctcaaggtccagctcgccaccgccgacgactgactgacgctccgccgatgaccagcggaccggccagcaggcatcaacctccggcggtgtaatgatgtccctgagacttgtacaccattgttgactagtagcactagtgacagagcttttctcgagaatagatgctgtgtgatatgcctctctgccaaatttctggtatccaaatcgagcatttcgccaaaaaaaaaaaaaaaaaggcgccccggcccg

SEQ ID NO: 895 - DNA, 4640 bp, Zea mays
  misc_feature (211)..(211): n is a, c, g, or t
ctaactttagacagaaaagttagataaaatatgacaacgaggtagtgaaccaaataggcccttagttttgtttagactggacaaatcggttaggcggatttttaggggcaaacggtctgctgtcgatacaacagttttcgttgggtgcatttcgctttcgcatcgcccgcatgtgcatctcgtccgccacgggccacagccggcctcactncgcaagtccgcgaccatgcggtgcaccctctccgcccctctccggcgctgtctctcctccaccggcgccgccgatcctagcctagtctcttcagctgagcatgcgtaccggctcctccgccgccaccactccgacccgcagaggctctccgccgcgctgtccgcgtcgggtctcgacgcctcctcgccgcacctcctcgacgccgtcctccgccgctgtggcgctgcctcctccctcgcgctgcacttcttccactggtgctccccgtcgctgccctcgccgctcccgtcctccctagcgctcctcgccaagtccttctcccgcgcctcctccgcgccgtccccgtccctactcgcgccgctcccctctcaactccttggcccctccctcctctgccccgtcctgcgccgcctcccgcaaccgcgcctcctgccgttcgcgctctcactactctccgcccgccccgaccacgaccagcccgccctctttctttccctcctcgagtccctctccaagttcggcaccgtcctcaccgccgagcagcttgtcgaggaggtccagccccggctcccgctttcgctccgccactatacggccttgctctacggatggtgccgtcagggcaagctcgacgaggccaagcacgtgctcgctcgcatgaaggctgcggatgttgcccttgacgtcgtcgtatttaacaccctgctcgctggcttcgtcgcggaagggagattcgaggacgcgttcgagctggcggggcagatggagcagcgtggctgtccaccgaacgcggtgtcgtacaccaccctgattcaggggcttggcgcgagggggagagttgatgaggccatgcgcgtgtttgtggaaatgcgaaggaaggggtgcgcgcccgatgctgtcacgtacggcaccctggttaacacgttttgcaaggctggcaagatatcccaggggtacgagttcttggatgctatgtcgagggatggcctgcgggtggacgctgccgtgtaccatggtttctttgtagcacacgagaagaaggagcagcttgaggagtgcttggagctgatggagaggatgcgggagtgccggtgtccaccagatctcaagatatacaatgtggtgattcggttggcctgcaggcttggggagaccaagcaagccatgacattgtggaatgagatggaaagtgctgggctcagtcctgtggtcgatacatttgctatcgtggtgagtggccttgttgggcagggtttgctgattgaggcatgtagttattttaaagacatggttgggagggggctctttgtggtaccgcaatatggggtgctgaaggacctcctcaatgcgttggtcagagatgagaaacttgagcttgcaaaggatgtttggaaatgtattgtgagcaaaggctgtgagctcaatgtgagtgcatggactatctggattcatgcactgtttgcgaagaaacatgtcaaggaggcctgcctgtattgcttagacatgctagaggcaggactgatgccacagcctgacacatttgcaaagttgatgaaggggctgaagaagttgtacaaccgtcagattgctgctgagattactgagaaggttaggaagatggcggaggagagacatgttagctttaagatgtataagagacgtggggtgagggatcttgaagagaaactcaaggcaaagaggagaggacagaaaaagaggcatctgcggcagcctggtcatggtcagtctagtagggatgctggcaatttggatgcttctgatgaagtagaattttccggctaattgaaatagaattcattgggggcaatgcatctctgttcatttgaattgttttggggagtgatagacttactaaacaataaaggagtgctggtgatcatgccttgccatcataatattattcttatgctaaagatgtattgggtttcaggcaagagccaagtggtacatcgattacatgtgaagttgtgtgccaagagttactgaccatgaggaggtaactattttcatcctacctacactgtgcaaattagaacttcattcaggtgtttattgctgtttttgtaggtagaagaatatgacgggtgatttatttgatctgcacttaggccttgtttggctgtacctcaatccactccaatccacgtgtattggggtggattaaggggccgttcggttactgcagaatgaagtcctggaacaattcctatccgaattgtttctctcatttatataagttttgattagctggaataattcctggtggattcctatgcaaacgaacagggcctaagggtttgtctagctacactgcaatccatctcaatccacatgtggattggggtgaattgcaacgtaaccaaataagggccaaggtggaagcaatgtttcagattattatctttttttactcctgaaagcagtgggttttgaaacccgtttttttcttcgaaatgagggaaacagagataatcatgtatacgtaagtttggtgctggtgcaaccagttgggccaaaatttgtagctgatgaagcttcgttgttacttttctttgacttgcttatctcttcactcttccatccgtccaagaatttttacgagccaatcacaggtgcacaccactattggtgaatacaccaaaaagagggataaaagaggagagggagggattaaatgagtgaccaagtgtccacttgacccctttttataggggctctgtttgttttcttttaagattatataatcgagctcatagattatataagcacctgatattctacttatggattacataatctaggtatctagattacataatctatttaataatctgtgttgtttgtttgtctcttaacttatttaagctggattatataatttagaggataaacaaacgggaccatagaagggaattttgtagctgatgaagcttcattgttacttcgcgcttttacttgcttatcccttcactctttcttccgtccctccaagaatttttatgagccaatcacaggtgcgcaccaatgttggtgagtacgagaaaattttatatttgggacttcaaacaaaaagattcatagttttgccatctgaatcgttcgctttgcaaaaacaagattcataacatcttccaattgatttcaatatcatttcatgtattttcttctttttcctattttttcaagtatttggagaccttgcccttaagtatttctacgttccaatggagctcgactgtcgcctgctcccgtgctcgccccggccgccgccgccgcatgcgatcccgcgctggcaatgtcagccgccaatccttgtgaatttttggtcgtttgctccaatcttgtggattctggtcgctggttccaatcctaaacttgcaaaggtccacataccctggccctgctatgtaggagtctgctacggcgcatgagcgcggtctgaagtgacggcttcggccttatccgtctttggcgatcgtccgagagaggtggctccaacaagaacaagcactgaggtcggtgcgggactcgaggtgacatcgagcagcaggacgactcgaggacgaagccccagccatgattttgcagcgcttaaacgcgattcatagcactaattgctgcacgatcaggggacaaagagacgttgttcagatgcgtacgtagaagataaaatatgtataagggcaaagttatcttttcagacttcaaatacaaggaaaaattaggaaaaagaagaaaataaataactaaaatgtatttaaataactgattttcactttacctctaagaaatttatttcaaatgtatgtaaatcttcaagtggataactaagaaataaataactaaaatgaatgattgggcatatcttttacaaatcctttaatcctagggattagctcagtatctgaacagatgctaacgtgtatgagcagtaatttattaggacaatcctcagtgtagtggttttgtgtagttcaaatttagcaagagtaaattaagattcttctccttacatcaacaacacattaaggtgatcccacaaaggcacttctattgaagtgttcgtagctattgaaattcctaacattgtaaatataatgaacaccaagttgattgtcattatgtagagcatatcggacatggtaaacataactgatgttttaatacaaaagcatggatgcacaaaaaccgtggcatcaatgggttggttgaccacacaatctatgacaagaagtggctcatcacttgtctgaatctttgtttaactgaaacatctcgtagatgtactggcagaggggagaggctttgcagtaatttggaacagtgaaagctctgcgcaactttcttagtatctcctaagttatgttagtatatactatatctgttctcgaatatttgtcgactgcta

SEQ ID NO: 896 - DNA, 1751 bp, Zea mays
ccgtccgcaagtcccagccaggggttgttagaacaagtccagtctagagagggagcgaaccaaaagggagaaataacaaaaaaagaatagagacacacacacacagctctgttcttcttattccaatcctctctcatcttgctggttcatccttgggatcggctctgtcgtcccctagctagttcgttcggtgctgtggtttctgccgctgtatccaagaactcttgctcttgctgagtctgggacttcagttcctcgcagagccaggctttacatatcttgggtgccgcacacagtatctatgcacctttgacaacaccaatctgattctgatgacaacaacagccactatctcccgtcatccttgcatcgatctgtcagctggcgtcgcctcgtgcttctgaagacgatggccacattcttctccacttccacgaaccagagggacctcgccggaggcggcggcgacatgtcgtcgttccaccactacgcctactcggacccaccagccggcggcctcatgcctttccccgccaccatcgtgtcgtcggaaggccacgtcgcgcacggcggtgacgacggcggcaggggcgcgttcgtggacgtgaacgcgagggacgggccgacgggcggcgccgcgccgagatgggcctgcagacgcagctgctcatggcgaacgccgcgtcggcggtgcagcaccaggggctgtcgcttagccttggcacgcagggcccgccggtgtctctttaccagtaccgccaggcgcaggcaggcatggccgccgccgcctttctaagcccggaccaggcgtcggcggcggcgagcaggagcgcgcagagcatctacgtccagaactccaggtacctcaaggccgcgagggagctgctggacgaggtggtcaacgtccaggacgcgatcaagcggaagggggacaagagccagcagggcaaggattccggcggcggcggcggtggcggcgagggcaaggacgccgagacgagcgacgagaaggctggcgagcacgaggggaactcctccgcgccggagctgtcgccgtcggagaggcaggacctccagaacaaagtgtcggcactgatggcgctgctggatcaggtggaccgcaagtacaggcactaccaccaccagatgcagatggtgatgtcgtccttcgacgcggtggccggcgccggcgcggcgaggccgtacacggcgctggcgctgcagaccatctcgcggcacttccggtcgctgcgcgacgctgtcggcgcgcaggtgcagtcgctgcggcggagcctgggcgagaaggacgggtccgcgcagggaggcgggctgccccggctgcgctacatcgaccagcagctgcggcagcagcgcgccatgcagcagttcggcatgatgcagcagccgcagcacgcctggcgcccgcagcgcggcctcccggagtccgccgtctccgtgctccgcgcctggctcttcgagcatttcctccacccgtacccgaaagattccgagaagctgatgctcgctaggcagacaggcttgtctaggggtcaggtgtccaactggttcatcaacgcgcgcgttcgactgtggaagccgatgatcgaggagatgtacagggaggagttcggggcggagatggactcgcactcgtcgtcggagaacgcggcgggcaacaagggcaaggacgaggcgatatcctcggaggaccacgaggagttccagagcccgtcgagcgccgccgcggccgc

SEQ ID NO: 897 - DNA, 3012 bp, Zea mays
atagccgcacggtgcgctgtcgcgtgccgaatcgcttgtgccgtcgtgcggtttcgtctcatctccctttttcgccgcacgccttggcccttttccagtagaagaagcgtcgaaggggacgcgcacatgcgccggcgtggcagagactgacccggccccaaggccgatcaggggaagggcggccgcccctgcctcccggggccagggggctgagctccccgcctcgtctcggcctggcctggttcgccctcgctccgacgcgtggtggacgcaaccagtgcgcgacgcccccggctcctggtccgttccgcagttccgcaccccgcttcgaccaaccaatcgccgccgcgtcgcgtcgcgtcgcctccttttttttccccgccctcccggacggcggcctcgttcgccagaagaaacccaggctgcagccgaaatcctcaagtctccgtcgtctgaccccacctcgacggcccagatccactcgccctcgccgccctcgtgcccctcagtccctcactccctcgcctcctcagcggcgaagacagctgcgaacggggccatttttaggcgggagcgcgggcggcggtgctagcagattggttggtttgagtggttgggccggctcttcgaaacgccccgccgcggcgatgggatgcttccattccacggccaagcggcagcatcctggctacgaggaccccgtggacctcgcctcccagacctccttcagtgttagtgaggttgaggctctattcgagctgttcaagagcataagtggttcagtgattgacgatggcctgatcaacaaggaagaattccagttagcattatttaagaatcagaggaaagaaaatcttttcgctaatcggatatttgaccttttcgatgtcaagaaaaggggtgccattgattttggtgactttgtccgagctctaaatgtgtttcatccaaatatcccaatggatgaaaaaattgatttctcgttcaagctatatgatatggatagcacagggtttattgaacggaaggaggttaagcagatgttaattgctcttctaggagaatcagaaatgaggctatctgatgatatcattgagacaatcctggataagacattctctgatgctgatgcaaatcaggatgggaaaatagatagaacagagtgggagaattttgtcacaagaaatccttccttgatgaagataatgactctgccatacctcaaggacatcacaacaacattccccagctttgtgtttaactctgaagtcgatgatctcgtcacgtgaccacgattttctctccgatgtatagttaacaaggagaacctgtcgagggttacgactggagatttctagcctctggcattatgaatggagggtatattcatgcggctaccaggaagggtgcgtcaaaattgtctgccacagatgtacttgacgagctgtagtttttactcggtgataatgttgatgcttttgtgttggtgatgattgggacttgagttagtatgctgagatgaacatttttcatttttaccagtgggaagtctctattttgtttgtgaaactgcgacgtgcgtgtctgtactgatcaaatatgattcttgtcaaagtagtactgcattctactattttagcgtaaaaaaaaaaaaaaagaaccaaaacttgcatcacatgtcattgaagtctctgagttattagtgtccacttatatatcttatactgtatcaacttaacactacatcctaaatataaggattttaaattgtcgagttgaaatgttccaaatgtgaccagctttataaaaaaaacaataataatgacggcatcaaattagcttcattagatttgtgagacaattttataatttgccactttgatgtgatagatattagctttataaaaaacaataataatgacggcatcaaattagcatcattagatttgtgagacaattttataatctgccactttgatgtgatagatattgatagatattgggtgtttggtttccagggactaatttttagtccctctattttattccgttttagtccctaaaccactaaagtttttgtatttggtaatttaaggactaaaacggaataaatggagggactaaaaattagtctctataaaccaaatacccccttagttaaaaatagaataatttaatttaacttcgtgtcgaggatacgatccacggtccctagggtccatccgtcagcgagcacactggggaaaggctctgggtccatcggttagctagaggattaacgtctaccctggaagaacccgccgccggacgaaccccacgacatcgagcccggggtcgggcgtggtgcaacctgactggagggttggacatgccgaagggaaatcaatcgagtggatcccacgactggccaaagaccaacctgtcagaaatgaccgggcgtattaactgcgcctcgcgccgagccatagcgaaggtgtcggtctgcctcccactcatgtgacctatgaacccctcgggccgtagtgcactcatgaccaacaagcccctcggactgcgtcgcatttatggcgcacacatccccggccaacacacttatgacctatcggacatagacttgagtgcgtagggcgcaatacgacgaaccgcgtcgagccccaggctacgaaggccaggggtcaacatagcccgaatgatggcgcttgggctccatggcgcccgcgccgcctgccataaagaatatgagacagccaggcgaccacgagaacgtgtgactttactcccatggtagaacgatcggtttaccgctacctggtgactccttcctaaggaagccaccactagctgaacccttctttagcctataaaagaggttggcccctagacgaggggatcccgaaacggacagacggaaacacccagaaggatgaaccccagacgaggaggaggacaaggaggctgaagccccgctgccaagccaaaacttagctaggactccaccttataaccacctcc

SEQ ID NO: 898 - DNA, 2414 bp, Zea mays
gatgacacaatccatgaaatctgtctagaaggtgattctgaattgaactaaatatatagatttttaggaatatgttgttttattgtacttgttcttgagattttagatttttggtagtgaatttggttcagaaaagtcaaacaaacacacccttaacagactatcgattatataagtgatgatacattccacggtcgatagttataaaaaagctaaaatatgtatggttgaaacaactattaactatagattctgtaaaaacatgatagtttggtaacatggatggcaacaatatagaaaatctgagtacaagttgtttctaaattgaattagagacatatgtagatttttagaaatatattttattgttgtactcgtttggttgagatattggatctttagtagaatctggtttagaaaattgaaccaaacataactttaagcgacgtaaaaaactaaaattgtgcataaaagaaaatttgaactgtgtttgtgctttaaattaaactcacgtccatactgcccggtccccctgaacaaacatatcatgatgttttatacgtctcctatcgttttcagccataattctgggtatcgcgagcgacgcgcgaggctgggaatagccgcacggtgcgttgtcacgtccgaatccttctgccgtcgggcggcttcgtctcggctcctttttcgctgcacgttttggcccttttccagtagaagaagcgtctaaggggacgcgcacatgcgcccgcgtggcagaggctgacccgaccccagggccgaacgggggaagggcggcagccccagccgccgggtagcgcagcggggccaggagctcagctccccgcctcgtctgggtcggttcggccccgctccgacgcgtggtgggcgcgagcgcgaccagtctgcgacccccggcttcaggtccgttccgcaccccgcttcgtccaaccaatcgccgccgcgtctcgtcgcatcgcctccttttcccccgcccgcgcccggacggcggcctcgcctcgccagaagaacccaggctgcagccgaaacccccggtctccgtcatccgaccccgcctcgacggcccagatccacttgccgccgctgccctcgtgctcctcactccctcgcctcctccggggccgcggctccgcggcgaagacagctgcgagcggggcggccatttctaggcggaagcgcgggcggctgggctagcagattgattggtttgagtggttgggtcggctctaggaaacgccccgccgcggcgatggggtgcttccattccacggcgaagcggcaacaccctggctacgaggaccccgtgcacctcgcctcccagaccgccttcagcgttagtgaggttgaggctctattcgagctgttcaagagcataagtggttcggtgattgatgatggcctgatcaacaaggaagaattccagctagcactatttaagaatcagaggaaagaaaatcttttcgccaatcggatatttgaccttttcgatgtcaagaaaaggggtgtcattgattttggtgactttgtccgagctctaaatgtgtttcatccaaatatcccaatggaagaaaaagtcgatttctcgttcaagctatacgatatggatggcacagggtttattgaacgaaaggaggttaagcagatgttaattgctctcctaggagaatcagaaatgaggctatctgatgagatcattgagacaatcctggataagacattttcagatgctgatgcaaatcaggatggaaaaatagatagaacagagtgggagaattttgtcacaagaaatccttccttgatgaagataatgactctgccatacctcaaggacataacaacaacattccctagctttgtgtttaactcggaagtcgacgatctcgtcacgtgaccaccactctctccgatgtatagttaataaggagttttttctcccctcaaccgcaaaaaggagaacctgtcgagggttacgagtggagatttccagctttctctggcaatgaatggagggtgcgtcaaattggctgccacaaatgtacgagacgacctgtagttttcactcagggcttgtttgggagcaagtggaatgaagggtattgataggactataatcccttgctatctaaaattgaatagtggaggattatatgccctccaattcactccattacctttactcccaaacaagccctcaatggtaatgatgatgcttttgtgttggtgatgattgagactgagttagtatgcagatgtgaacagtttccatttttaccagtgggaaggctgttttgtttgtgaaactgcgatgtgcttgtttgcacactgtactgatcaaacctgattcttgtcaaagtagtactgcattcttcttcaaaaaaaaaaaaaaaacggcc

SEQ ID NO: 899 - DNA, 744 bp, Zea mays
cattgggtccctcgaggccggccgtggccggccgggcccgggacaaaaaaaaaaaaaaaaaaaatagcacacagccaaagccaccagcgctcgtcacctccaatcaacaaattcccaatccgccgcttcccatcccgcgttcgccgctccatttgatcgaattcccgatggcgcccaaggccgagaagaagcccgcggagaagaagccgacggaggagaaggccgagaagaagcccagggcggagaagcgcgtgccgggcaaggagggcggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgacatcttcgagaagctggctgccgaggccgccaagctcgcccgctacaacaagaagcccaccataacctcccgggagatccagacttcggtgcgcctcgtccttcccggcgagctcgccaagcacgccgtctccgagggcaccaaggccgttaccaagttcacttcctcttagatcgccgccgcacggtgcgacggctctgtttcgtttcctcgtacttttaggccagtgctactaggttgcccgaggaacaatgtagtgtggaaatttctaatatattccaaattgtgctgaaaaaaaaaaaaaaaaaggcgcaaaaaaaaaagcccctagggcc

SEQ ID NO: 900 - DNA, 3827 bp, Zea mays
  misc_feature (4)..(4): n is a, c, g, or t
gccnggccggcgcgggtcgccccggcgcggggggggatagcacacagccaaagccaccagcgctcgtcacctccaatcaacaaattcccaatccgccgcttcccatcccgcgttcgccgctccatttgatcgaattcccgatggcgcccaaggccgagaagaagcccgcggagaagaagccgacggaggagaaggccgagaagaagcccagggcggagaagcgcgtgccgggcaaggagggcggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgacatcttcgagaagctggctgccgaggccgccaagctcgcccgctacaacaagaagcccaccataacctcccgggagatccagacttcggtgcgcctcgtccttcctggcgagctcgccaagcacgccgtctccgagggcaccaaggccgttaccaagtttacttcctcttagatcgccgccgcacggagcgacggctctgtttcgtttcctcgtacttttaggccagtgctaataggttgctcgaggaacaatgtagtgtggaaatttctaatatattccaaattgtgctgatataatttgcttcaaaccttgaggaggcgctgttttaatttggggttgctacagccgtacaatttttggcgccaatatcttgcttcgtattcactggggttcaatcacctgaatcatgtaatttgttcagggggataaataacatttatcaaaggattgtgagatagtacagataacaaatcagctggcagtgctatgcaaaatctggtctgtggcaatgtttgccttgtggccagtttttcataattcatgtaatgtgcgttcatggacttctaattgaatctaccaacaaaaatggcaagagagcgggagcttggacgatttctggcaacatgtatctgaccggaggcccaccttcgtttgttctcgtctttagggcatgaacttgcacctttcctttgccgttgggatcgagggagtgacttttattgttgctacagcagtgcatgatggctggaatctgattattcattcttccagcaacatcaccgaagttcagtacggtctagtgttttccacatgtaagattaaaaagatgatgacaagtaaaccacatttgacacacttgggtactcattggttatcatcacacaattgagtgttcaccttcatcttccatggaataaaaacatgattcgagcatcgaataaatttcatcactctggtgatgcctacagtctccattgaagaagacatggaccttctcctggacctcaatccaactgcagccggtgatcctcttcagccccttctccttaatctccctcctgaccatagacacactctgccaacttcctgacgcagagtatacatttgacagaagaatgtaggaagatgtgtcctttggatccaatgcacgaatgcgctttgcaacgctctcagccagcttgctgttccagtgaatctgacagccccctaacaaagccttccagaacccaatgcctggctcaaaggggagctcctcaagaaaccttctggcctcgtcgaaccgcttggcacgagatagtagatcaaccacacaagcgtaatgctcaggtttcagtatgcccggttgctccctctctgcggtcttgaacaatgcataaccttcatcaactagaccagtatggttacaaccaaacagcaagccgagaagagtgacgttatctggcttgaggcccgttgctctcatcattctgtaagcgtccaaagcctcttcccccttcccattctgcgcatacccgcagatcagtgcgttccaggagaccacgtttttccgattgatttttttgaaagccaaaacactgtcctccaagctaccgcacctggcatagaagctcacaagagaattacctatataaacgtcaagcttgcccaagaacttgatggctgatgcatgaatgcttctgcctacgccaagtgtccctgcactggcaacagaggtgagcacgcaggggaaggtgctttcgttcggtgagacgcctcctcggcacatttccaggaacagattgacagcctcctcaccgagaccggcttgactgtacccgccgatcatcgcgttccacgagaccacgttcctctctggcatgcgccggaacaatcggtctgcctcatcaaacatcccattcttcagcaaaccggcgatgagggcggtgtaggagaccacattcggctcgcgggtgtcatcgagcgcgcgctgggcctccgtcatggcgcccatcttggcgtagtggtcgaggagagcgctgccgacgaagacgttggagcagaggccgagcttggcagcgcaggcgtggagctgcacgccgacgcgcggggctcggactcggagcgcggtggccgagcgcaggacggtaccgaaagtgaactcgttgggcgcgacgccgtcggcgagaactcgggagaacagtgcgagggcgtcgcggtgtcggccgccgcgggttagcgcgccgatggcggccgtggccgagatgacgtcccgatgcggcattccgtcgagcaagttgcgcgcgagtgacagggccctgcgccttgggctaccagcctaccaggctaccacatgacgagttgggcaacaggcgacggccaggccccgggctggagcggcagctacgctgcctacgcagcggcaatggggtggcgtggcgtggcgttggggacttggggtcgagcagcatggctgcgcggcgctggcgccgccgccgcctgtggtcgattagttttcgattaggatgttctaggtaatggtctcgtgctggtgccggatgagaattaaggcctattgtcaatgggccactgggcttccatcctaggcttcgaagttgaaatgcgacgtgacggtccatgcaacatttgggttaggtctaatggaccgatctaaagcataaaaaaacacggttcaacaagataagggctgaaatattttaatgctagtctggccaaatatatcagatcgtgcttgagccgaggttgtagactatagtcggacatgatcacaacttatttatgtcaagaatggttcatatagagtcagaaaaaacccatatattttcattaaaatagtacttcattccacactttcatgtactgtaaaagaacataaaaccgaagatgatactatttagttattttttgcagcttcaaattaaaatatgtgatataattttacttttattatgaacgttagacaataaagtgaaattatgaacttggtttggagctggttatactcttttttcctctaacaaaataatttttaataaggtagtcaatacatatctctagtaaattaatagaaatattaaccttttcttttggccaaatttatttgtcttatctttttattatttttgttaaatctgttttaaattttgggttctaagatgaatttcgagccgtccgaaaataaggtcagcacatttaaacaattacgtatagggtcgtgggccgtcccacacaacatgtaaaaattatgattcggacctttttcgataggatgggaccggaccgaaccgttgcaacgctagatcttgagttcaaactttagtatagataaaaacacacgctctaaagtacataagttcatatgagattcagccagcactatattttccataagctttatactcaatatgagatcccgttccacagttacgttccatagatatcagaagg

SEQ ID NO: 901 - DNA, 758 bp, Zea mays
tgggtcggtcaccccagcccggccgggattcacacagccaaagccaccagcgctcgtcacctccaatcaacaaattcccaatccgccgcttcccatcccgcgttcgccgctccatttgatcgaattcccgatggcgcccaaggccgagaagaagcccgcggagaagaagccgacggaggagaaggccgagaagaagcccagggcggagaagcgcgtgccgggcaaggagggcggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgacatcttcgagaagctggctgccgaggccgccaagctcgcccgctacaacaagaagcccaccataacctcccgggagatccagacttcggtgcgcctcgtccttcccggcgagctcgccaagcacgccgtctccgagggcaccaaggctgttaccaagttcacttcctcttagatcgccgccgcacggtgcgacggctctgtttcgtttcctcgtactttaggccagtgctactaggttgcccgaggaacaatgtagtgtggaaatttctaatatattccaaattgtgctgaaaaaaaaaaaaaaaaaaagccacaaaaaaaaaaaatagcggccttttggccaggaatcatttcaattctcgaacgataagattggattacattcg

SEQ ID NO: 902 - DNA, 1976 bp, Zea mays
  misc_feature (640)..(640): n is a, c, g, or t
gccatgctgtccttaatatcgactccaatggccatggtgtccatgctttcttgaataatgtgctcataggtttgttctttattattactttctaactaatatatcctgtaacacaaatctttgagtgggctttcactaggaggtttcctaggtcctagtcaacccatatgaactttcatagtatccatatattcccatgtggtcaaaaggtatccttgaggagtagagttcatgtttctaccagcatcactgaatactgctcaaccattaatttctgtggtgcctccgactcttagctactagctcgttagtttcacagttctctcctgattctttagttctgccatcgttactagttgcggatatctctttcctccaggtagtgcatatggtaatggctcacaatcaagattcagtgtcaaattgcccatcaacctgaggactggaaagaatgaacttgcccttctaagtatgactgttggtttacaagtaagtacttgctacaaaacatgatcatcattaacatgcttatcattgagttatctgtttgaaaaatctttgccgctgattctttgtgcatacaaatatcacctatagtgagaggtgagacacccctgtgaaaaaaccggacaaatatatnatctttcaatacaaagttaccatattgattaagattatgccccctataagaatgcaggattcgcttatgaatggataggagcaggctttacaaatgtgaacatctctggtgtgagaactggaaccatagacttgtcttcaaataattgggcatacaaggtattgtcaccaatagtcttcggttttttggggcaaatttatattctagaatttaacatgaaattacatgacgaactcgatacaattgatccatctttttttacagagtatgatagtttcttccctctgctgatatatcctgaaattgatatgaaagtgtgttcttttctttttaaaatttatagattggactggaaggggaatattataatttgttcaagcctgatcagacaaataaccaacggtggataccacaatccgagccaccaaaaaaccaacctttgacatggtataaggtaaatgttgatgttccacaaggagatgacccagttgggatagacatgcagtcgctcggggaaggcttggcttggttgaatggaaatgccatcgggcggtattggccgaggaccagttctattaatgataggtgcactcccagttgtaactacaggggaacatttattccagacaagtgcaggacaggttgtggacagccaactcagagatggtaccatatcccacggtcatggtttcatccctcagggaacatcctcgtggtctttgaggagaagggtggggatcccacgaagatcacattctcaagaagagctgtgacgagcgtgtgctcctttgtgtcagagcacttcccttccatagacttggaatcctgggatgaaagtgccatgaacgaaggcacacccccagccaaagcacagctgtcttgccccgagggtaaaagtatatcttccgtgaagtttgcgagcttgggaaaccccagtggaacctgtagatcataccaaatggggcgctgccaccacccgaactccttatctgttgttgagaaggcctgtctgaacaccaacagctgtacagtctccctgacagacgagagctttgggaaggatttatgccctggagtcaccaaaacacttgccatcgaagcggactgttcttagtgacgtacggagtactaagtatctcggtgtgcatctaggttccaagtatgcccgtcaaaattctaaaattgtagtgcttcttgcacggcaatgctattgtaacctggatttacccgctaaatatgtttcctagattttaagagtcttcagaggcattactcaatatgataagtgtcctcagcccaaaaaataaaaaaaaaaaaaaaaaaggcccctagggcc

SEQ ID NO: 903 - DNA, 2865 bp, Zea mays
gcacgagaccattacctacccgccggccggcgcggcagttcgccaccatcgtgctccgtacacgctccgctccggccatggccgccgccgcggcctccttttcggccctgccgttccttctacttttgctgctggtgccgtcgctcgacggcgcctccaatgtgacgtacgaccaccgctccctcatcatctccggccgccgccgcctcgtcatctccacctccatccactacccccgcagcgtccccgagatgtggcccaagctggtggctgaagccaaggacggcggcgccgactgcatcgagacctacgtcttctggaacggccatgagatcgccccaggccagtactacttcgaggaccggtttgacctggtgcggttcgtgaaggtcgttagagacgctgggctgctcttgatcctgcgcatcgggccctatgtcgccgccgagtggaattatggaggcgtgccggtgtggttgcactacgtgccaggaacggttttcaggacaaacaacgagccattcaagaaccatatgaagagtttcacgacatacatcgtggatatgatgaagaaagagcagctcttcgcttctcagggagggaacattatcctagctcagatagagaacgaatatggagattattatgaacaagcgtatggagctggcggcaaaccatacgccatgtgggcagctagtatggctcttgctcaaaacactggtgtcccttggattatgtgccaagagtctgatgcccctgatcccgtgataaactcttgcaacggtttctactgcgatggattccagccaaattcgccaaccaagccaaaaatttggactgagaattggccaggatggttccagacttttggtgaaagtaatccccacagaccacctgaagatgttgcattcgctgttgcacgttttttcgagaaaggtggcagtgttcaaaattactatgtgtatcatggtggcacaaattttggtcgcactactggggggccattcattacaactagctacgactatgatgcaccaattgatgaatatggacttcggagatttccgaagtgggcacatctgagggaacttcacaaatctataagattgtgtgagcacaccctgctttatggaaatacaacgtttctttctctgggtcctaaacaagaggctgatatttacagtgatcagtctggaggctgtgttgcattcctggcaaatattgattcagccaatgacaaagttgtcactttccgtaacaggcaatatgatcttcctgcttggtcagttagtattcttcctgactgcaggaatgtggtgttcaacactgcaaaggtgcaatctcaaacttcaatggtgaccatggttccagaaagtttgcaagcatcaaaacctgagcgatggagcattttcagggagagaactgggatttggggtaaaaatgactttgtccggaatggatttgtggaccatattaatacgacaaaggactccaccgactacctatggtacacaacaagttttagtgtggatggaagttactcctcaaaagggagccatgctgtccttaatatcgactccaatggccatggtgtccatgctttcttgaataatgtgctcataggtagtgcatatggtaatggctcacaatcaagattcagtgtcaaattgaccatcaacctgaggactggaaagaatgaacttgcccttctaagtatgactgttggtttacaaaatgcaggattcgcttatgaatggataggagcaggctttacaaatgtgaacatctctggtgtgagaactggaatcatagacttgtcttcaaataattgggcatacaagattggactggaaggggaatattataatttgttcaagcctgatcagacaaataaccaacggtggataccacaatccgagccaccaaaaaaccaacctttgacatggtataaggtaaatgttgatgttccacaaggagatgacccagttgggatagacatgcagtctatggggaaaggcttggcttggttgaatggaaatgccatcgggcggtattggccgaggaccagttctattaatgataggtgcactcccagttgtaactacaggggaacatttattccagacaagtgcaggacaggttgtggacagccaactcagagatggtaccatatcccacggtcatggtttcatccctcagggaacatcctcgtggtctttgaggagaagggtggggatcccacgaagatcacattctcaagaagagctgtgacgagcgtgtgctcctttgtgtcagagcacttcccttccatagacttggaatcctgggatgaaagtgccatgaacgaaggcacacccccagccaaagcacagctgtcttgccccgagggtaaaagtatatcttccgtgaagtttgcgagcttgggaaaccccagtggaacctgtagatcataccaaatggggcgctgccaccacccgaactccttatctgttgttgagaaggcctgtctgaacaccaacagctgtacagtctccctgacagacgagagctttgggaaggatttatgccctggagtcaccaaaacactcgccatcgaagcggactgttcttagtgacctacggagtacgaagtactcggtgtgcatctaggttccactgcaagtatgcccgtcaaaattctaaaattgtagtgcttgttgcacggcaatgctattgtaacctggatttgaatgtatccatctgagataggttatgtttcaggagctttcttaaactaacgttgttgctgagcagcatggattgaaatagcaggctatggcaaatgacggctaaaaaaaaaaaaaaaaaaaaaaaaaaaaaaaaaaa

SEQ ID NO: 904 - DNA, 1082 bp, Zea mays
gtttagaaggacaacgacagcagagcgcccgcgcgccgcctgaaacctgccgggaactctgatggcgctggacgttggatgaggaaaggaagctctggatttaatgtgctcacggcccccccggcgcccgccggaaaggggagccgtagcctgtagagtgcggggagcaggagccggcggagccatggcgaccactctttcgttatcctctcccctcttcctcggagctccggccagagctagagatgtggttccgtacggagtgacttcggctagtgtatcactgatgactctaaatatgccaggcaagggttacacgagtagagttcgttgtcgggagcagcagcgacgaacgacaatagtatctatgcttggaaggaaatcaacggctagagcaactgttgtcccagaccccgactataggttaccaatcgctatacttgggattgctagtgcttttgcatatgccgacaatcttctcgctgctgcacctgtaggactgctggggcttcttcttttgttccagactacaagagtgaggttcgtctttgataacgaggccctggaggtgaaggttggagagcagctgcaggagtcaggtgaaaatgtattcgtcggcggcaagaaccgttggaagtactcaacgttcgtaaactgggagctgtggtggccacagtttcctgtcttggtttacttcaaggagacccaaacgaagcccgaaggacagatccacttcttccctgtgatattcgatggtcgacaattgtacgatgtgatggtggagcgtgctgggccctcgaagacgagtggccctaaatagttgcagctgatcttcctaccgtcgttttgctccctcgggctccctcacatttaaattgtaaaaatggtaaaattatatacaaacggggttcgattccaaccacggttcttagctttaaacccatcttcatacgtacctaaccaacaaaaacacacatctatgtgttttatattttatattttgtatttaaacataaatataaatataaatcgtaacaatatatatatatatatatatatatattgttaggatcgtaggtggg

SEQ ID NO: 905 - DNA, 788 bp, Zea mays
caggagcttgacgcaaaggggagccgtagcctgtagagtgcggggagcaggagccggcggagccatggcgaccactctttcgttatcctctcccctcttcctcggagctccggccagaggcaagggttacacgagtagagttcgttgtcgggagcagcagcgacgaacgacaatagtatctatgcttggaaggaaatcaacggctagagcaactgttgtcccagaccccgactataggttaccaatcgctatacttgggattgctagtgcttttgcatatgccgacaatcttctcgctgctgcacctgtaggactgctggggcttcttcttttgttccagactacaagagtgaggttcgtctttgataacgaggccctggaggtgaaggttggagagcagctgcaggagtcaggtgaaaatgtattcgtcggcggcaagaaccgttggaagtactcaacgttcgtaaactgggagctgtggtggccacagtttcctgtcttggtttacttcaaggagacccaaacgaagcccgaaggacagatccacttcttccctgtgatattcgatgggccgacaattgtacgatgtgatggtggagcgtgctgggccctcgaagacgagtggccctaaatagttgcagctgatcttcctaccgtcgttttgctccctcgggctccctcacatttaaattgtaaaaatggtaaaattatatacaaacggggttcgattccaaccacggttcttagctttaaacccatcttcatacgtacctaaccaacaaaaacac

SEQ ID NO: 906 - DNA, 1393 bp, Zea mays
gcaacagaacaagatatttgcttgcacgcttgtatataatagttgcttgcatattagttgtcgccaattatataagacgttttggctgattgttaccagaaaacgagtggatgcgtcccagagcacgcccaaccagaaaacgagtggatacgtccagagcacgtccaacaaaacctaatccccgtggtgatacggatcgttttttttttttttttgcacactagaggaccttcggcaatagcagtcagtggagcgaagcgcagcagcctcccccaagttagctgaaccagctaagcgcatatacaggtctagcagaatcaaggttcgggcgccaaacgataagtcgcagtatctagcggctgctcacagccaaaacacgatcagttttagaactgacacagcctagccaccgctcccccgcggtagtcaatatggcgtcaaggcagcaagcctgcgcggaggagtcctagatcttgggcgtgatggccttgcactcttgaaattctgtataggacctctgctgaatgcccagtcaacattgatagtttttgtgaacagctgactcccgttcattgctctgatcgctgcttgtgcttcctcaaagttttcgtattcaatcagcgcgtatcccttggcatatccagtgcggcgttctagattgagatgcaagtccttgacatgaccaaaatcactgaaagcattgtaaagatcatcttcttcagcatcgtctttaactccagaaacaagaattgcccagccttcgatagagcgctgcggtagtgggatgggaccatggtctccgttgttagtggtgaagtcgaagcggtagcggctggaggtgagaacggaggggctgcgaccaacgaagcgcccgcgggtgcgcaccacggcgggggagacgatgcggggcacggggagcgcacgggcggcgcggccgtcctcctccatggcgtcctcgtcgtccaggtcgtagtcagcaaactccacgtcaccctcctcctccgccgctcgtcccatcgccgccaccgtcacagagagcgagaacgggaagactggtaacgtgagagactgagggtccaagtggcggtttaagcctcttattttagtcatgttatattaaatatttaaatggtagttagtagtattaaatactagtctaacaagtataatattcaagcgtgcacacaattatatttaatatttataaaaaataaattaatattaaagtgaatgtatagtccacatatcatatagtaaattgataaaaataaatattacactttatcttagtcaaacatatttaatatttataaaaaataatattaaagataatgtatagtctaatattagataataaatggataaaaataaatattatactttatcatagtca

SEQ ID NO: 907 - DNA, 1611 bp, Zea mays
gttggtattattagttgatacatttgatgtgccaaacgcatgaaagaaatttgaagtttaaactaaattcgaaaacataaaataaaagaagagaaaaaggaaaactccatacctgctaacggaccacgtttccttagcctaagtcactctaataacgtcatcctctcacatctgggtgattctgcatgctcggcatccaatagaaattcactctcgctcgatttcgcgtctgcatccatgtgtgtcgctgctcagtttcccctccgcgctggatcttcgccatgaatgtcgcggctgcagctgtctagctcttgcatacaccggcgtgttggacccgcaggccaaaaaaatcaccttgcgttcttggggaatctgtggctggtgtgtacggctggtcatcgtttagctgcgcgccatggcaatctgaaacagaagctccatttttctctcaccagacgcacgccgtaacaactccaccgcggtcgccgtaacaaaggccaaatcctcggccgggatcttcgctcccgaatctcgctgctcgccccagctcggacttcgccgcctgggtataaatctgcggcctctcctccccaaacaacggcgcgcagagaagaaataaagagagagcctcgtcgtaggagagagagtagagcgcagcgaataggagagagaccgagcgtcacgattgccgtcttcaccatacccgtgctcagttcggggggccgttagggaggttctccgggcgcggcgaagctctctggcgcggcagtcaattgaccgatgttcctcgtcggagtcacgacaacaccatggatccgcctgtcatcgtggctaggcgcgccaatgtcaatccctaaggtaagaactcaactggtagattcactttttcccccttagcgtatagaacctggcagaacgtgtgttggggcgttagtgcgtcgatgtgcgtgctcgccggcgtattgccaccgctatctaagcgccgcgatcggtgggtgtggctggaggaagaatatggatgctgaccgttcgattgtagttggacgatggagattgggtctggagaacggctcggccaggagtgctgtgggtcgtagatcaagggagggacggcacggattaaatctcgcgtaccggttcggccaagtcggtagtggccattgatccttgatcggatggctggaagatcgtgtagttcattatcttttatgggccgttggatcgggatccgatgaccccggtcgcgtactgatttgagctaggcgtgatctaatctggatcgtttaaattggatcggacgactcctgtttcgggataccctttcgtgcgggaacatttgcagaagagccccttctcttttcacaaatcaacctgccgtctatcggtaggttaatctgtgtctagggaatctttcaaactatcccctggtcttttgtttattcatgcacccagttcagaagcttagaaaattcaggaaaataatttaggaaatggtttttatgtataaaaatatatccagaacttatttaattcatagaaattccatttttactcctttttaacccattccagttgcaataatattgtattaatattgtctatcaataagta

SEQ ID NO: 908 - DNA, 2572 bp, Zea mays
tcggtacccctgcggtatcgcggtggctgcttcctgctcgcggcagcatgtcttgagtgcttgcctagaggcattgtcgtagcggctgtggccgcgtgctcgagcagcacttggacgggtggcttgcgacttgcatattggaaacttggagcaaagaacaagtaaaaatgccggctgcgcacagccatgagaggatgaatttgtggtcatgggactttagattttttaactttctctagtacctttgcgaactctagattgcaagagcaattgtgctgataacgtgttaagaaccctttgctaccgagtgtagtctaaagacttcttaacttataaacataggagacacaaagatatatgggacactgttattctcattcatctattctgctcactggttacaacaaatggtagtgtcctcctctatatatagtgcacagttagggtttcggctagataggccacatgggccttcggggccaaactggtttcttaacagtatttactacgcatccatccacagttccacgcacgccgacgccgagcacatgacacccaaagctacgaccaccggaaaacggcaagctgactataactgtatcgaggaggtagcagctcgtgcagaccagaggccgacagcaaacccgtgaagccgagagtgaagaaggggacaagtcagatttgtcatttgtcgcaccccccgtgactccaggccaatctgatctgcctcaacgagatatctacgctgctatctagagacagccgtgacgagttccggtcgagcgaggagcaaccaacaacatggcactctcgtttaggctggtcgccggcgttcttctggtcctggcattagctctgctctcttcgagcgcggaggagaggagcgccgggcgcgctgccactgtcagcgcgatgggctcagatcacgatcagacgtcggaagctccggtgccgccgttgaggcctcttggctcgaggaaaccggtggcggctccgccaccgccgaggccggcacatccacgggcgagtataaggccatttcctccacctcgtccgtcacagccgcagccgcagccgcagccgccgccgccaccaccacgctcgtaggtgtaggctgtgtacgtctaggcagccggcaagctctagccctctaggtctacagacgtgagaaaatggtttgctggcgttggcattcctccagtattcctgtgaacctgttgtagtgttcttcagttgtgagttttcaacgaacttttggaagttctatgtctctgtcggttatggttcaggtatttgggagctttcagccccaaaaaccatcggttgcgtattttaatatttccttcttggctgctcaacaaaaaaaaaaaaaaaatttatcagatgacctggcatttgtcggttgtttccaagatgctagtgctacaagctcatgaacttgctcacccgaatcaccagaggaccagaacgcgttgtattgaatttctgactgtgcagtgaagtggctggaacgcctcaaagacctcatttttttttgtatcgaactccggatccgttgacctgacctgccgtggcatccatgtgttcgttcagatctcaagggacctcctacctgagattccaccgacaaaaccctgggtcacctacctgagttttagtataaattcaggtaaccagatcactcggagcaatcgttcgcagccatcaatcaccatgagactggtcaagctccttgctgtcttcgccatcctggctgttctgttcgccgtgacatggcccgttgctgtgctagggaggctgggtagggcgcccccgacgccgaaatctggccccgtcaagcaccatcgtccaccacggctacagcgcccgccgccgccgccaccaccaccacggccgcaccatcggcatgatggtcttcgtcggccactgccatatccggcaccaccaccgtgtcaacactgattgctgctatcggattcgatgatggcactcaaaatttcagtattcgacgagcaatgtagcttccgtgtactgcattcatagtttcagcattcttgatgcatttggtgttacaagaaattagttttttttgtactccgggggaaatactaccaatgagattcatacgaataaccgcactggattttccaaattgtcttgatctcaaaaataatttgacgtaataagagactcatcgggaaagagggttgcaaaaggggggtttaattgaagagcacaagaaggattcagagacgaagaaacagatgttcttgagagttactagactggcctcaacgaggggagatctccccactcagccgatctgaagagcacaaggtttgttctgcgagcaacgcaacacctccattgccattggaatcggacaaaggggctgcctgaatcgttgatgttctctccttcgagacgagattgaactgatgcaaaagggggaccgggacgcagaaaaaaaacgaaacaaaaaaagaaaacgaggatccggcagcgagtggaatcgagaggaaaaatcacacgatccccatagtggcgacgccgcggtgcggctgaagagatg

SEQ ID NO: 909 - DNA, 709 bp, Zea mays
tcagatttgtcatttgtcgcaccccccgtgactccaggccaatctgatctgccttatctttttatgagtagcattagagctcaacgagatatctacgctgctatctagagacagccgtgacgagttcgggtcgagcgaggagcaaccaacaacatgacactctcgtttaggctggtcgccggcgttcttctggtcctggcattagctctgctctcttcgagcgcggaggagaggagcgccgggcgcgctgccagtgtcagcgcgatgggctcagatcacgatcagacgtcggaagctccggtgccgccgttgaggcctcttggctcgaggaaaccgaaggcggctccgcccccgcctcatccacgggcgagtataaggacaaggccatctcctcgatctcgtttgttacaaccgccgccgccgccaccaggctcgtaggtgtaggctgtgtacgtctaggcggccggcaggctctagtcctctaggtctacagacgtgagaaaatggtttgttggcgttggcatccctccaatttcctgtgaacctgttgtagtgttcctcagttgtgagttttcaacgaacttttggaagttctatgtctctgtcggttatggttcaggtatttgggcgctttcagccccaaaaccatcggttgcgtattttaatattttcttcttggctgcacaaaaaaaaaaaaaaaaggccccta

SEQ ID NO: 910 - DNA, 2522 bp, Zea mays
gagtgggagtaatacaacagagccaaaccgagggaggagagagagggccagagaacacaaagaggcaaggcaaggaagcagggacagactccaagattgggggcgactggtaggcaagaaaggaagctcttctttttcgagtatcactgggcgattgatttccgccgccatcctttccgctcaattcttagctgccgcagataagagcgaggagcagaggcgctgttttctctctccgattccctcagcttcctgtggcgtggtggggtgtgtggcgacgaagggaggctcgccggggcgcggacggacgcccgcgatggccggcgtcgacgttgccaggcacgcgcacagcccggcgcaccacgccgtggcggcgcgggaccacgtcgcgctgcgccgcgtgctggaagcgctcccgccggcccgccggcccgaggagatccggacggaggcggactccgtcgccgaggaggcccgcgccgaggccgtctcggcggtcatcgaccgccgcgacgtgccagggcgggagacgccgctccacctcgccgtgcgcctttgtgacgccacggcgaccgagatgctcatggcggccggcgccgactggagcctgcagaacgagcagggctggagcgcactgcaggaggccatctgcgcgcgcgaggaggctctggcgcgcgtcatcgtgcgccactaccagcccctcgcctgggccaagtggtgccgccgcctgccccgcgtcgtcgccgccatgcgccggatgcgggacttctacatggagatcaccttccacttcgagagctctgtcatcccattcatttcccgcgtcgccccctccgacacctacagggtatggaagcgcggcgccaacctccgcgccgacatgaccctcgccggtttcgatggcttcaagatccaacgctccgaccagaccatactcttcctcggggaagggtcggaggatggaaaggtgccgcctggttcactgtgcatgatcaaccacaaggacaaggagattatgaacgcgctcgagggggcaggcgccccggcctcggaggcagaggtccagcaggaggtcgctgcaatgtcacagaccaacatcttccgtccggggatcgacgtcacccaagcggtgctgctcccacagctcacatggcggcggcaggaacggacagaggccgttggcccgtggaaggccaaggtgtatgacatgaatcatgtgctggtcagtgtcaagtcaaggagggtcccgggagcgatgacggatgaggaattcttctcatctagcaacgacaatgatacagagagcgaggggtttgacgatgttctgacagaggaggagaagaaacagctggaggctgcgctaaaaatggattctccggatgccggtggagaagaccagtcggactcatttgctggccctcgacatagttgctttgagccaagggagagggagatacccatcgagggcatgagtgtttctggaaatgtggagagtaagcatgacaagaaaggttggttcagtaattggggaaagagagctcaagttagcaagccagaaagggtgaagaagatggcacctccaaggagctcgctctgtgtagatgagaaggtgagtgacctcctctttgaatcaccctcaaatgcacaaacaagaccaggaaggcattcagtagatgtagtcagaccagatgacaacagaaggatcagggaaagggagagtaggaggcatgttccttctgcagagaatgggcataggcgcaaagaaggttccaaagaaagtgagtataaaaaaggcctaaggccggttctctggctctctccaaatttccctctgcggactgaggaactgctgccgttgcttgatattcttgcaaacaaggtgaaggcaattcgtcgtttgagggatctacttacaacaaaactccctccagatacatttcctgtcaaggttgccatcccagtcgtgcctacgatcagagtgcttgtgacattcacgaaattcgaggagctacagccgctagaggagttcggcacaccaccttcaagccctgacaaaagcaagagcccagcagtgcagcctccttcgagctcctggattcaatggatcaaggcgccttattaccgccagatgaacttgtctacggcgccaggcccgagcagccgcgtggaggacatccaccaccaggacccgttcgccatcccttcggattacgtgtggaccacacccgaggagaagaaaaagaagacacaggaaaacaagaacaggtccaagaaaggcaggaacgggtgatagagcattggtgggatgggatctaacaggagggacgagtggaagggaaggtttggagatttcggctgtgctggtctgagtctgacgtcgaatattgggaagcgaccgcttgtcttcttttttatttgtgttaacggatttgctgccaacattctttcgtttaacccaaatcgtttcggtcctgattactgttgcaatctgttggtagattttcaaaaaaaaaaaaaaaaat

SEQ ID NO: 911 - DNA, 3479 bp, Zea mays
tgtataattatatatatatttgtgtgtggatgggccctccatttcgaatttcgcactgggtccctgaaaagtcaggaacgaccctgttgcaagaaacatgctcgcatttagaagatctagtttccttaggattgttgggtattcaacggctgagcaactatatgggtagatttataatctcacagcctgatggaaaatggacatgaatagaagaaaggaggaaaggcaggagaaagtagtagtaagcaaaggcaaaggagaagctgtagtgttccacgtcgatgtcagcagtgaaggcgggctttgattgccaagtcagtggggtgagagggacccataggggcaaaatcgagataatagtggggagaatcaaaaaaccgcaccccggaggccacaaatcaagcttgtggctctcggccaccgcccgctcgcccacgtggcccccacccccgactccggctcccgctccttaaaactatccccaattccccgtccgctatcccgatcgatccatccatcgatcgcccacgcttccgtccatccagactccagagagataaaatctaattcctggacctggagtgcagaccgatcgccgccgccgccgcgttgtttcttgtgtgcgcagctgtggtgatggtgcggtaaaagaaggctgctccatcgctccaacaaaaaaaaaaggtcgagatcgcacgcggcaggcgacaagcagtttccaaagagaagggaagcctagaggaagggagctagagatgggggagggcagagcaggagacggcctcatcaagctgttcgggaagaccatccccgtgccggagacggccgccgtcggcgaggctgccaaggttcgtctcgtttctcttctccctccgcctaacatctctctttcccaagcccaacccacgtttgaattggagcgaacggtaggggtgagtgcttgcttggacatagccagtgatcagggcaaccagaatttttttttcgcacctactaggtttaggttccatcgtacgtggcagctggtttttctgttgcccagttgctccctcaggatttatgtaaacataggatggtgattttctgttcttcctgttttaaattttttgtatgtagaagctatgtgatatggtgtcatgtttgacacttttgccttccattagcatgcgaattttaccgggttttttttgggtaccccttctctctctctctctctctctctctctctctctctctctctctctctctctctctctctctaacagcagtgttcttgctgtttgcggccaaacctatggctatggttttattatgtcagccgaaaagaaacattatttagcagtttattcagaggtggtgcaggattcagctgtacccttccgattgttccctttgcccttgctttcaaggatttcgccaccaaatataggcagaagctgctgtatcaaccactacagcatgcgccgtgtggtacgggatcagttacatcaccatgttttgattagtgttaaagtcacacgatcaacagctgctttattagcgatcaagagtgaaaaaaaagaaaataaatagcattagagttcataggtccaaccggaaaaaattattcatgtatgaccttttggctgtgaactagtattttttttctacaacaaacaaagctgaaacctgaaaactcttgcgagagctttgagtaggtcaagaactcagcgagcttgtatgcatgattgcaggacatgcaacaaagcggcggcagcggcagcggtacgactgatccgaaagggcaagagaacaacgttcaggactccacaggctcgcctccgcagcaggaggtcgcggacaccgaagactcgtcggcagacaaacagcagggcgaggcgggcaacccaaaggagaagctcaagaagcccgacaagatcctgccgtgcccgcggtgcaacagcatggacaccaagttctgctactacaacaactacaacatcaaccagccgcgccacttctgcaagaactgccagaggtactggactgccggcggtgccatgcgcaacgtgcccgtgggcgcaggccggcgcaagagcaagagcgcgtcggccacttcccacttcctccagagggtcagggccggtctgcccgtcgacccgctcgtctgcgcggcagccaagactaacggcacggtgctcagcttcggctctgccatgtccagcttagacctcacggagcagatgaaacagctcaaggaaaagctcgtcccgatagcgggggacgagcgctcagttgggtctcgcactcaaggaccttctgccaaggcagaagacccggaccggaaggagaatgttacagcagataaatccgcgagagttgttcagcatccatgcatgacgaacggggtggccatgtggccatttagctgtgcgccaccagtaccggcctctgcctgttacggcccaggcagcatcgcaatcccgttctacccggcagcagcggctgctgctgcctactggggttgcatggttccaggagcttggagtggcgcatggccgcctcactccggccagtccgagacgggctcatccattacctccgcctctccagcagcatccaccaagtccaacatctgcttcacgccaggaaagcaccctagagaccgcgacgaggaaggaggcgccaaaggaaatggcaaggtgtgggtgcccaagacgatccggatcgacgacgtggacgaggtggccaggagctctatcctgtcgctaatcgggatcggcggcgacaaggcaggcaaagatggcggcagaggctgcaagctcgcaagggtttttgagcagaacgaagaggcggcaaggacggcaactcctcactcggcagccatcagcggcttgccgttcttgcaggggaacccagctgcgctctcgcggtcactgaccttccaggaggggtcttgagcctctcgctcgattcacagctgagaattttgtacattagagggttgtatgtaatctaatctaggtggggggtggggctcatagctgccagcggacattgaaactatacaatagatagatatttgtagatagccaatatatatgggtcgggggaggaaaaaaaggataatgagagcaagtccccttatttgtatatattataatggattggaatatttggttgccaagtggtcttccagcaatagcgccagatgttctgatccactggctgttggcccatcgatctcagtggacaaaagtggtccaccttattctgggaaatttcagcatatattcagtttgtttccacttgtctacttcttactgctgcataagaattgtctgcaggtgctgacgaaacaatatccgactcgttcttttcacaagattgcaccataggcccaaaacttgcgcagttgtcgtctcagctagccctccgaactcacactttgcatccttaaccccaaatgagcttgcaattcaaaggggattaggtgaaat

SEQ ID NO: 912 - DNA, 885 bp, Zea mays
  misc_feature (7)..(7): n is a, c, g, or t
  misc_feature (28)..(28): n is a, c, g, or t
  misc_feature (104)..(104): n is a, c, g, or t
  misc_feature (136)..(136): n is a, c, g, or t
cctcagntagtcaatcagcattcagcantggtatagagcggctactgaaaaggcttcaaattttcaggctcccgaaagtagatgggtgagaagtacatgccgtngttagctgtgagaaagagtatcggctatgtcnaaggattgcgatatggtgatgcagtaaaacttatgtcaatgcttgaggatgcttcaaatgggttttctagtgctgtgaactccaccatttcaagtctgcaccctgtccaatgcacccgcgaaaggaagctcgacgtgcagctagacttgacaacacttcctgcttttctagctgtatttttgttgctttggtttcttctacgtccaaggagaccgaagcctaagatcaactgaacaccgagccaatgagcagcataggccatagactttttgtgaatacgcgcatggattacagatggcgctggagcatggctcgggaattccaaggtccaaaacaccgggtggcagggaacaaggtttcagaagattacaatcctgacacttccccaagttgtagcagagttggaatgtcatgaaaactttaattcatccagtcctgtcccggggaacaaggcttagccaattctgccccgttccgggtaactgagattaatttgtccatgctgtaatgtttagccagtcctgccccgttccggggaactgagagattgtctttatcgcaacattaacggctagcggttagtatcatcttccagtcacctggaatgttactagtacaacccagttgtctgtttcctgccgcttacatgtaaaagtccatattcaagttttacggaaagaaacatgttctgtcatttattacaaaataaagccaaataaaatgttatgggttgtcgccgaaaagcggcc

SEQ ID NO: 913 - DNA, 3997 bp, Zea mays
  misc_feature (1879)..(1879): n is a, c, g, or t
  misc_feature (2125)..(2125): n is a, c, g, or t
  misc_feature (3785)..(3785): n is a, c, g, or t
  misc_feature (3871)..(3871): n is a, c, g, or t
aatcggctttcatctcaaagtcaggttagcaaacatcgtcatgtcaggatcatcatgatgagcatttcatgcccgtcggcagtgcggtgccacttctattagtcaatggcacctataagtcaactgttagcacataccttgattctgctattctccaacatcagctacagaagctaaatgagcacaattcactgaaaggaaggcattcaaatcacaggtcaacattagaggtcccaatattctggttcatacataatgaacccatattattggacaaacattatcaagccaaggctctctcaaatatggtcgtagtagttcagtcagatgatgattcctgggaaagccatttgcagtgcaatggaagacccatcttatgggatttgaggaaaccggttaaagctgctattgctgcaactgctgagtatgtatctggtctacttcctccacatctggtttatagccatgctcatgaaactgcaattgaggactggacctggtctgtgggttgtaatccctcagctgtgacttctgaaggttcacaactttcagagttccagcaagatgtgattgctcgtaactatattattacttcagtggaggaatccattcaagtagtcaattcagcaattcagcaattggtaatagagcggactactgaaaaaggcttcaaaattttcaaggctcacgaaagtaagatggttgagaagtacaatgccgttgttagcttgtggagaagagtatcggctatgtccaagggattgcgatatggtgatgcagtaaaacttatgtcaatgcttgaggatgcttcaaatgggttttctagtgctgtgaactccttgcgctttctggtttctgcatgcatgcagtacttgcattgtttggtttgtaaagtatgtatgttgagttttctatcttaagtatgtaataggcaaactgaaattcaggtgcataataaaggctcttgaaacgtacgttgaccgtcagttagacacgatatatcattaattgctagtttgctacaaaaattatattgaaagttatgtgggatgtgaatctattgacactactatctacttgccatgcatctaatttgaatatttttggtcaatatttacataattatttctaaaatcataatacatactttgttttgcaacaggaagtgtggttattttgggttcggtgcacactttgctaggataaataatggtgcattgtaaacctttctatagcgtttcttgatgttgagttttgtttcaaagttccgctgaaatgtcaagtaaaatttctatatgctttatggacgcagatgaagttactgtccacatttagacgaaataagcttctcaggtttttgtattatttggttgaatagttaaattgggtacaatctgggaacctaaactaaattatgatttttttatttgtttgcgctcttttactcgggctatccccaacagctctcatattccatcctctattttaaactttactctgcaaacagtatcatctacaatgcaaatcctctattttgcacgatccaccgaagaaaaccttacaatgcatatgcacatatgggctaaattttccacttgaattgatactttttggcctttttctgaaatgcagtaataaaactgtaaaataaactgccgagcgagcaccaaaacttggaatgaaggaaaccttaaaatacttcaacaaaacaggagttttttctttgtgtgcacatgctcttttaatgcttgtttactctgctgagtagcaaacttgtgcggtggccattggaaccaactggtcactgatctgggatgtgaacccctggtcttgcataaatttctaacccttcactgtgtgcttgtatccgttaagatcnagtcataggctgtgccgcactggttaccgctcctcatacatgcatgccttgggggagataatcctgtcgtgggatgaggttttttaccgggtgaacatagtatactgttttcaagtcgtaagattaatcgcccaagtcgtccgactaatcgtgattaatcgcccaagtcggtcaatcataacaaccagcaagttgtccgacttagaaaacaaaacatagttatatctgcgactagaatagggcccntgattcattgtacttcttgtgatgctgtaaaacttatatcagtgcttgacgatgcttcaaatgggttttctagtgctgtgaactccaccatttcaagtctgcaccctgtccaatgcacccgcgaaaggaaggtcgacgtgcagctagacttgacaacacttcctgcttttctagctgtatttttgttgctttggtttcttctacgtccaaggagaccgaagcctaagatcaactgaacaccgagccaatgagcagcataggccatagagtttttgtgaatacgcgcatggattacagatggcgctggagcatggcccgggaattccaaaggtccaaaacaccgggtggcagggaacaaggtttcagaagattgcaatcctgacacatccccaagttgtagcagagttggaatgtcatgaaaactttaattcattcagtcctgtcctcgttccgggtttagccaattcttcctcgttccgggtaaggccttgttcgtttgtgtcggattggtgggtcggaacaattcccggccggattgcttctctaatttatataaactttgattagccggaacgattccgggtgcaatccgacgcaaacgaacaagccctaactgagattaatttgtccttgctgtaatgtttagccagtcctgccccgatccggggaactgagagattgtctttatcgcaacattaacggctagcggttagtatcatcttccagtcacctggaatgttactagtacaatccaattgtctgtttcctgccgcttacatgtaaaagtccatactcaagttttacagaaagaaacatgttctgtcatttattacaaaataaagccaaatagtaaaatgttatgtgtacgtagggacagtatgattagatgtctgcctggtggaaagtataattcttgctttcggactttcggtggatgagcactctagagaagagagattcatatagccctcgtgatcatgctctcatatggcaaccgtacaccagtcctggttcttctgcccctactatccgcggcgatagcataaagaaatagtgaaaaacaaatcgttccggtaaaacttctgtcgcggcagcggcatacacagagcaagaaacatctttcgttacagctttgccttgcatgcaaaaaataaatgtatttttaagatgatagatgcgtatgaatttggataagagaaaacatatagagaaaaataggagtgcgaaagaatctaatttaagtatagtttggcaacctcatttttctaagaaatttttattttttctaaataaaattactttactttttttcttgaaaaattaaaaatcttttggtaaaatggagttgtcaaattagctcttagagagacgaaaatcttgctcaccaggctacaatatttatttagagtactcgacatgctgatttccgcaatccgtccaactcctcgtggtgattcaccgctcctcctttttctctttacgtagcacattatcaacgtgagtcagggctcaaaaggagtcaattctatgcatcatcggacacagaaatcttcgagagcatgataaaaaaacaatatgtatattataaatatataactttgcctaatttttatccacatttaactatattttaatgcttggtgcatgtttacatgtttantagcacaaacataagaaatctgggagattacttgcacttgggtccgcccataattctatgtgagacattagaaaggacctcaattnttatgttgcaaaaatatttaatagcaaaagggcctctgacccgctagtacggcagtccagtgggatgctacttactagagtttaaacctaggcgtcacacttttttctagagttctttttctagag

SEQ ID NO: 914 - DNA, 2740 bp, Zea mays
atcaatttgctcagggagaacaagaccctgcaagctcggcccccccggccgcccacgcgcgacaaactcttccttgatatcgagaagggagtcaatagaaggccgttatatgaaagtcatcctctatcatcattttcatggacccgaactgacagtatggatatgggggattggtccaagaaatgcaaggaagcattaagcaagtttgagctgctgaaggaagggaagagtaaagaggacattgtttatgaaaaggctgttcagatattacatggtacaaaggatgaggtgcatgacattgttcaaagtgctcttaagtccagtgatttgaagggtctccatgcacaatgtcttacagatatatggataggcagaggcggagttccctagcccccccccccccccccgccatttgcctgggggccttctgttggtggtgatggtgtccgtacagaacttagtctgccaaatgttgcaaagactgtcggggctgttgcagaagttacagaagaagaagctgaagaaaaattgcaagacacaataagggagaggttttcgtcctttggtgaggattaccatgctgttgatattctattagcagagattgatgtgtatgaactttttgctttcaagcattgtgtgggaagaaggatacagcttgccctttgtaaagaacttgatgagaggatgcatgacctgaaaaaggaactggagggttacaatactggagattttgatgaaactaacaagaagaaagctcttgatgcactgaagagaatggaaagctggaacttattcagagatacttcagtggaacatcatagttacacagtggctcatgattcatttcttgcacaacttggatctatgttatggggctctatgaggcatgtaattgctccttctgcctctcatagagtgtaccattactatgagaagttatcgtttcagttgtattttgtgacacgagagaaagtcaggagtataaagcagttacctgttaatgtaaaatccatcagggagagcctgaattctgtgctattacatcatcaaaactccatgtttagccaaaacatgctgtcattgtcagaggatccatcattgatgatggcattttcaatggcacgtcgtgcagctgcggtgccgcttctattagtcaatggcacctataagtcaactgttagcacataccttgattctgctattctccaacatcagctacagaagctaaatgagcacaattcactgaaaggaaggcattcaaatcacaggtcaacattagaggtcccaatattctggttcatacataatgaacccatattattggacaaacattatcaagccaaggctctctcaaatatggtcgtagtagttcagtcagatgatgattcctgggaaagccatttgcagtgcaatggaagacccatcttatgggatttgaggaaaccggttaaagctgctattgctgcaactgctgagtatgtatctggtctacttcctccacatctggtttatagccatgctcatgaaactgcaattgaggactggacctggtctgtgggttgtaatccctcagctgtgacttctgaaggttcacaactttcagagttccagcaagatgtgattgctcgtaactatattattacttcagtggaggaatccattcaagtaatcaattcagcaattcagcaattggtaatagagcggactactgaaaaaggcttcaaaattttcaaggctcacgaaagtaagatggttgagaagtacaatgccgttgttagcttgtggagaagagtatcggctatgtccaagggattgcgatatggtgatgcagtaaaacttatgtcaatgcttgaggatgcttcaaatgggttttctagtgctgtgaactccaccatttcaagtctgcaccctgtccaatgcacccgcgaaaggaagctcgacgtgcagctagacttgacaacacttcctgcttttctagctgtatttttgttgctttggtttcttctacgtccaaggagaccgaagcctaagatcaactgaacaccgagccaatgagcagcataggccatagactttttgtgaatacgcgcatggattacagatggcgctggagcatggctcgggaattccaaggtccaaaacaccgggtggcagggaacaaggtttcagaagattacaatcctgacacttccccaagttgtagcagagttggaatgtcatgaaaactttaatttatccagtcctgttccggggaacaaggttttgccaattctgccccttccggggaactgagattaatttgtccttgctgtaatgtttagccaatcctgccccgatccggggaactgagagattgtctttatcgcaacattaacagctagcggttagtatcatcttccagtcacctggaatgttactagtagtacaatccagttgtctgtttcctgccgcttacatgtaaaagtccatattcaagttttacagaaagaaacatgttctgtcatttattacaaaataaagccaaatagtaaaatgttatgtgtacgtaaaaaaaaaaaaaaaaaactcgagggggggccccggtacccattcgccttatagggagtcgatacaatccactggcgccgttttacacgtcggactgggaaccctggcgtaacccactaatcgcttgagaactcccccttcgcagtggggaaaaacgaaagcccgccaatgcctttcaagatggcgaccg

SEQ ID NO: 915 - DNA, 1507 bp, Zea mays
aattcggcacgagggaggacttgagttatcttgggactcgggacttcgtgagtcggggactcggtaactcgcgagggccggagaccggagcacacaccataacccccagtgccgccggcggacgccctccagtttccggtcttcactaactccccgttttccgtactgctgcggcgcctcggcagtcggcaccacagccggcaagatgccccccttccgaatgccttcccacttcctcgcgcttccgctcctactcttgctgctcctccaggcgccgtccccggaggcggccgagtctacgccggggacccggacgcgcaagatcggcagctcgggggcgtcctcggtgttctcgctctttaacctcaaggacaagagcaagttctggactgagtcgatcatccgtaaagagttcgatgacttggaaggttctgcgtcgcgggactctagcaaaaacggcctgctcaacttcacaagagctggtaatattgcaaactatttgagcctggcagaggttgattccatatatcttccgatccctgtgaacttcatctttattggatttgatggaaatggacggcatgagtttaagttggggcctgaagaactggagcgctggtttacaaaaatagatcacatatttgagcacacaagaatccctccagttggtgaagttcttaccccgttctataagactactgttaagaaacttcagcattatgatcttcctttagtcagccatgtgaaccacaatttctctgtgcatgccatacacatgggagaagatgtcttatctgtttttgagcatgctataaaagttctatcctgtaaagatgatctcgtggattccagagaaaatgaagagatttttttgcaagtggatagtgctcaaatggaacatatattttcaactcttgttgatcaccttcagatacaagaggcttacaatatctttgttctgaaccccaagcctattggcaagaggattaattatggttatcggaaaggcttctctgagtctgagatcaatttgctcagggagaacaagacccgcgacagcaacgccccccggcccaccagtcccgacaaactcttccttgatatcgagaagggagtcaatagaaggccgttatatgaaagtcatcctctatcatcattttcatggacccgaactgacagtatggatatgggggattggtcaaagaaatgcaaggaagcattaagcaagtttgagctgctgaaggaagggaagagtaaagaggacattgtttatgaaaaggctgttcagatattacacggtacaaaggatgaggtgcatgacattgttcaaagtgctcttaagtccagtgatttgaagggtctccatgcccaatgtcttacagatatatggataggcagagagaggtttgcttttgttgatctgagtgcagggccatttgcctgggggccttctgttggtggtgatggtgtccgtacagaacttagtctgccaaatgttgcaaagact

SEQ ID NO: 916 - DNA, 763 bp, Zea mays
  misc_feature (2)..(2): n is a, c, g, or t
anttgaagcatgtaagagagccaatctcatctgctgctgctcttctgcgcactctgtgagggcgtcgattaatcgtcccccgacgccgagcgcggaggaggatcgggacaagcagccttctctcggagagatcattaacatcaagttggtagagactggggagaaggagaagctaatggagctactccgcgagcgactcgctgagtgcggctggagggatgagatgaaggcactctgcagagggcctatgcaaggaagaaaggaagaaataatgtgccagtagatgacctcattcatgttattactccgaaaggaagagcatccgtgcctgattcagtgaaggcagaactcctgcaacgcatccggtccttccttatgtttaccacacttcggtagtcatttgtcgcgacggttggagcctatatgtaccattgtaggatcattgggaagtcgattttgttggggaccaaaggtgcaggaaaacagtgcgtaggggaatattgtgagcatgaaaaaaaacagtgtgattttcatgacactgtcgacatgttcctcgtcaggcgcaggcggttggggtaatttcaggggtaccaatagagttgtaagttgtaacccctgaatactgtattgttaaagcaaccttcccccttgtaatggtacattgtactataacggctcagcgctgatgcttaatttcccaattaggaaccagaaaaaaaaaaaaaaaaaaaaaaaaaaaaaaaaagtaaaaaaaaaaaaaaaa

SEQ ID NO: 917 - DNA, 864 bp, Zea mays
gggagagtaacctctactacgcctcggaatcagaggaacccgaacggtggaagagtacgcctcggaatcagaggagcagcgaggaagctgaaggaggggcgaatctaagcccaattgaagcatgagggcgtcgattaatcgtcccccgacgccgagcgcggaggaggatcgggacaagcagccttctctcggagagatcattaacatcaagttggtagagactggggagaaggagaagctaatggagctactccgcgagcgactcgctgagtgcggctggagggatgagatgaaggcactctgcagggcctatgcaaggaagaaaggaagaaataatgtgacagtagatgacctcattcatgttattactccgaaaggaagagcatccgtgcctgattcagtgaaggcagaactcctgcaacgcatccggtccttccttatgtctaccacacttcggtagtcatttgtcgcgacggttggagcctatatgtaccattgtaggatcattgggaagtcgatcttgttggggaccaaaggtgcaggaaagcagtgcgtaggggaatattgtgagcatgaaaagaaacagtgtgatcttcatgacactgtcgacatgttcctcgtcaggcgcaggcggttggcgtaatttcaggtgtaccaatagagttgtaagttgtaacccctgaatactgtattgttaaagcaaccttccaccttgtaatgctacattgtactataactgctcagcgctgatgcttaatttcacaattagaaaacagaaacgcaatcttgatacaccccgcggcccgcatgtgaaaaaaaaaaaaaagactgggtcatcttcaattgttaaaaaaaaaaaaaaaa

SEQ ID NO: 918 - DNA, 1826 bp, Zea mays
ccggccggctcggcttcagtggcgcccgggcgcggcctaggtacgcctcggaatcagaggagcagcgaggaagctgaaggaggggcgaatctaagcccaattgaagcatgagggcgtcgattaatcgtcccccgacgccgagcgcggaggaggatcgggacaagcagccttctctcggagagatcattaacatcaagttggtagagactggggagaaggagaagctaatggagctactccgcgagcgactcgctgagtgcggctggagggatgagatgaaggcactctgcaggtttgacttctctcgcatcaaactcaaatattattcatgctgagtgtattctttcttgctactaacaaattacgtttattgattcatagtaataaacacatgcatccaatgatgctgagcaagtgcttcacattcctaaggttctgatatttgcattagcatatgaattgtttgcacttcttgagaatgcatgatgttttttccccaacttctcagtggtcctctcaatttaaatgcctttgacgattacaactgaatgcatgtgaaaggcacacattaatatgtcacaaccccaaacattgttctatctttctcaaatatgtgcagctaaattctgaagcagaagtgtgatatcctagcccaagccttaatagggttgatagaatactcaacaaggtgcatcttctcttttgaaaggctatctcgaaagaacctctgtttaagagtgcttggcccagagtaatcttgagatgggtgatcgaccgagaagttttctctgatgtgcatgaatgaggacaaattgcacataaaagactcatgttggtctgtggggatgatctatggtcttagagagctgtcaggagtaagtatcgttggttcgagagtgaacagggcgttacaaatgatattagagccgactctcacggtttcatggttgtgtgggcgctaggggttcgggcatatgatgcatgacgcttgtgggcttagagtggtcacatggcatgacatatgacgacactagacatacatatatgaccaagaggggaggttcctggcttagggttgaccgacgaggacgccgattttctaagaggtggtggattgtgatatcctggtcaaagcttaataggtttgatagaatactcataccaaaaatgtgcatcttctttttcaggagcctatctcgaaagaatctctggattaagtgtgcttggcccagagcaatcttgagatgggtgattaactagaaagtcctctcgggtgtgcgtgagtgaggacaaagtgcgcacaaaatattctttttgtttgtgcggatggtctatgatcgtagagggttgccagaaataaatatcgtcggtccatgagtatatggggtgtcacaataagtagtttcttcaattccttgtgaagaaatgacctgaaggggatcatttgcttcctaataaattgggaaattttgtaaatcttatgcaactcaagttggtttctcatggaaactacttatggttggttctctcaaattttctggtaaataaataattgcaatgattttacaagatggctactgcagctgcgattattgcaatctatgcaagtgtgccacatttgcaatttgtttaaatttcgtgctttccttttcctgaaactatattcttttcaaatgaacttgtgttgcaaaaacaggtgtgagtaacccactaaacacttgcacgctaaaatcttcttgctgacaggattcatctggttcatttgcttaatttcacaattagaaaacagaaacgcaatctagaaaaaaaaaaaaaaaaaagcggcc

SEQ ID NO: 919 - DNA, 1993 bp, Zea mays
cttatgttataatatatattcgagcttattatggatttcttaaatatgggttgaattcgaaaaaatatgattccgtaaaaagggacgaaatagactcatgtttctatccccgtttttatattttttttctattaatacaaaaaccgactagtcaaatatggaaaacggtacggatcagaaagatattttttttagtccgttttcaaccctactacgcctcggaatcagaggaaccgaacggtggaagagtacgcctcggaatcagaggagcagcgaggaagctgaaggaggggcgaatctaagcccaattgaagcatgtaagagagccaatctcaatccgctgctgctcgtctgcgcactctgtgtctgttattgacccccagattgctgtgttgatgcttcgatcaaggttttgcctgtgccctttttatctgagaaaaggaattgactttgatgcggtggggcgacggtttcaggagggcgtcgattaatcgtcccccgacgccgagcgcggaggaggatcgggacaagcagccttctctcggagagatcattaacatcaaggtaatgaccagtactgttccccatctcgctgaaatcgagcaaggaaatccttgatcatgggtgtgtgtgtgtgtgtgtttcacgctcgggattagagttcttgaaccttgatgctcactcacaagctggagttcctcagtttatggttggtggtccaagtgggtagtctcggttagatttggttagggcttggctgtaagaggggagaggttttgatgtaattgaaacgatagggaactatttggtggatcaactatgacggctattgccgctgctgttccttgggcaatgaggtgggttttgatcttttgatttgtgaagttggtagagactggggagaaggagaagctaatggagctactccgcgagcgactcgctgagtgcggctggagggatgagatgaaggcactctgcaggtcggccctctcgcgcatcaaactcaaatattattcatgctgagtgtattctttcttgctactaacaaattacgtttattgattcatagtaataaacacatgcatccaatgatgctgagcaagtgcttcacattcctaaggttctgatatttgcattagcatatgaattgtttgcacttcttgagaatgcatgatgttttttccccaacttctcagtggtcctctcaatttaaatgcctttgacgattacaactgaatgcatgtgaaaggcacacattaatatgtcacaaccccaaacattgttctatctgtctcaaatatgtgcagctaaattctgaagcaaaagtgtgatatcctggcccaaaccttaatagggttgatagaatactcaacaagttgcatcttcttttttgaaagtctatctcgaaagaacctctctttaagagtgcttggcccagagtaatcttgagatgagtgatcgactgagaagttttctctgatgcgcatgaatgaggacaaagtgcacataaaagactcatgttggtctgtgtggatgatctatggtcttagagagctgtcaggagtaagtatcgttggttcgagagtgaacggggcattacaaatggtattagagccgactctcgcggtttcatggtcgtgtggcgctaggggttcggccatatgatgcatggcgcttgtgggcttagaatggtcacatggcatgacatatgatgacactagacatacatacatgaccaagaggggaggttactggcttggggttgaccgacgaagacgtcggttttctaagaggtggtggattgtgatatcctggtcaaagcttaataggattgatagaatactcataacaaaaaggtgcatcttttttttcaggagcctatctcgaaagaacctctggattaagtgtgcttggcccactaactggaaagtcttctcgggtgtgcgtgagtgaggacaaagtgcgcacaaagtacccccccgggcggccgcta

SEQ ID NO: 920 - DNA, 4818 bp, Zea mays
  misc_feature (839)..(839): n is a, c, g, or t
  misc_feature (863)..(863): n is a, c, g, or t
  misc_feature (893)..(893): n is a, c, g, or t
tgcccgcttctgttagtggtagacggttcgtgacccagggtcgaacggtccaatactagagcgaacgatctgacagctccacttagacggtccacgacctaggaacatagtgcgcctctgattatcagattttaagaaatatgggatagttatactcaatgggtatttacccattgtcgtaactactcatgagcaacactcctttttgttcttgtgagaaaaaacagagtgggtggggagagctaggggtcaaaatattgagagagagagagagggctccgagccaccaaatccaccactaaaggagagagatagatgaaggatttggagcctcaccttatttgttggctcctacgacctgtattgctttacctcatagtgtatttatctcactatttggagtctctttttatgctgtatataatgtcatttttgtgtggatggtatgttgatatgtactcctccatcctatttataattcatttaatcttttttaccaagtttgaacaactcgtttattcaatttttttgcgaaaacttgaaaaattcaaagccacgcttaaaagaatattatatgctaaacaaaattacaataaaaattaataataattatatttttttaaataagccgagctggtcaaatttaaggtaaaaaagtcaaacagacggatggagtattataccgtgtttttactgactttttaggatatataaaagttaatcacttacgtgcaataactgtattaccgatggtcttaggctgtctccaacaacgtccactaaactttattctctaaaagaatattccctgtcctgtacagtatactctaaaagatttngtcccctaaatctttctcgtcacnaacaacgtcctctaaaatacatcctctacntctcatctgtttcaatatatcaacttaattaaccgaatatattattttataaaacaacaaatactaattaaataaagtcttgacttcaatctgtcagcataaagtaccagaagtgaattcacaattaataaataattttttttttttttttggaacaaaagctggtactagacgtcagctgaccatttcatcaaacatgtatcatgcgtcgtccagcatttggcacagatcactgttggcggcctagctgctcgcacacgcgatgtccatcgctgcatttgtccacatcgttgcattcgcaagctactccacctggccgtcatagtaggccttccccggcaacaatggcggcctcccctgttggctcgagcacgctgatgcggaggtcgcatccgaggctactacctgcactgccgcagcgtcgaagctctgcccccacggccatggcgtcgagggcctccgtccccgcttgttggtcctcgagctgcaccaccgtggcgtggaagctccgcccccgacagccatagcacggtggtggatgagtaactgccgtagcattgctggcgacttgtacgaaaatatcgagcgcacacatggatagaggatggagagagaaacgccacatttagcgatcgccggacagacgctatgttttagcggatgttttaccgatccttgttggatgcgtagcaaacgactggaaacgctaaatatagcgcaccggatgctttatagggtattgttggagacagtctaacaatgtagacatagcactatagcacagaattcattaaaagttgaaacaaacgccatggcttctctagttctttttcgcaacacaggtcacaagataccattataccaccaccaggactccagaagtaacacaacaagaaccatcaccgccaagaagagcgaagaagcctttacaccttgtgctgctcaagctggtcacggcttatgtcctgcagctggttcactgtctgagcatggttgtgctagttctcttcacctgaaccacatcctcacaaggctctgcttcagtgcacaaagaaacaataactagatccgattggttgacagaacttgggtttgcccaggaattctctgtaacttaaacttaaacaccttggagcctggttggccttctctccagcaatctacaacattatatagcccgtcatatgtgaatattgtggtttctttggccatcgaatggttgccttcctctctgtccagacatttgaaggtgtgaattactcggacaggactttttgttcggatgcagttcttcaaggctagattacccctctcaagcttttgatccccctcacccttgttaccagaaatctttcctccagaaccggtgtataccaattcacccaaccgagatagctgatcaggataacctccagaagcaacgatactgattgcgataagcacattatatttatctcttgtggtgtctatgcctccctggtatgggcggtggagaccaacaatgttcaactcgactctgtagagaaactcgtcaccaacttctattccaagcacattcccaacaataggcccaggctgcgtaaatcctggcattttcttgattagatcagcagctgcaagatcaattctatgtaacttcaatggctgttctttcatagcttgtattatagccctgcacataaactcgaacctcctgctcagcatcttggccttgctcctagcatccacattctggatggcatatttttcttcacgagcagctagtgccttcagaatgccatcttccacgttagatggcagcatcgatttctgttttatatttcccttcttcttgggaccaaaggagttcctaattgtggcagcaacatctccttctgttcggacgcacttttttctagatgcgtgagccttcacaacttgttgtttagcaggcataacttccaccttccccagcaatggcaaacgcactttactgactcctcgagcaaccagagacgctcggaccctcccgcaaccaggtgggaagcggcgaatggcagaaatcatccttggcttgggtagcaaacgctgcgtacctggcaccaacacgttcctttcaaatccagcactcctctgtgaaccagtgtcaaggaaaccagttgcactaggcacactgctccagcatgaactctcagatgatctctgcagctcagcctccagaccgtgatggccactgtcagcaattggtacggagacaaccgcagcagatgactccacctccatgacactcgaacccgccttgcccaccgaaagagcaagagccgtcttcttcagtgcatcagaagcaactgcaaccacgagcctagaatcgtcgtccgcgggcgtagctgcagcttctctcccgtagccgggcgagaaacggcgcgtggccgacactagcctccgcttaggcagcggcggcacgacgtccgccgccaagcccaggcccatcttcctccccgcgtcgctgactcccttctcctctgccaagtcgagacacctcttgccgcccaactcggcgactcccttgtccttccgcgccaccccaggcgccccgtcgcccgttacaacagccaccgagtagcacgtcatcacgccgctgccgtgccgcgtgtcccgatcccgagtaccgcgcacctcgtccgccttccccacgccgccgctgcgcgtcttgcctctagaagtcggagggcgaggaggaaggcagcggcggcggtcgccggcgccgagatgctggggctggggctgccccagcgcggaggaggtcggcgcccccgtatacacccgctggcgcgcggcgtcgagcctcgccgcttgcaagtccatcccggaacccttatcggtcgatggcccccgcctgcgacctgagcacaaaaccacaacaaaaccccactaattaggccactacattccaatttccaaacataaatcgccacggcagggcaacacataacggaagcagaagcaagagtcgagcgggcggaagcggaaccaaggaggcaacgactggcttttggtcttcggagccggagacggcgaggtggcgggtttgttcccgtcccagcctcccaggcgaggcgacgagcacgttggagccttcagaaaagagaagagaacaaacgggtctcctaatattttacgtgactgaaattttgtttgttctgagtcaaggcgccggcccaggccgggcccctgcgtttgttcggctgtaaagtgagcgtaagaaatgcagggagggagagcaaattacggctaaatatttgatggccattgaagctgagaaactgaagaatttagaacgccattaacggtggcatgagtggaagaaactgccggtggcgtgcgagcgagcgttcagccggcgtgcacaagagtgaatggcgcaagaaagagaaactgtcgcaaacatcgccactaatggcgagcataggaaggaacgttgtagtgggaggaaggggacgagccacggcagggaaaaggtcggtgaggtggcttcactacgaggagacgagcaggcagcaagaacccgggcgaacggctctgcgtcggcaggagccgaacggcggcgcgctaacgtcccaacgaacagagcaagagagagacgttaggagatagatgtaggatttgataactgggacccatgcacaagtgatacaaagagagagggatcgaggctgggagtggtcggccgggcttgagaaaatgggaatgactgcgcgtgggttttttctctcttttttaaatttcgaaattctttttttaaatagcagaatatatatatatataataaataaatatattccaaaaatttagaataaagtctttaatattattaacatatttaaaatgcatattttcacaacaagattgtaccaacttattatatttttatagaaagattcacacc

SEQ ID NO: 921 - DNA, 3961 bp, Zea mays
  misc_feature (83)..(83): n is a, c, g, or t
  misc_feature (3080)..(3080): n is a, c, g, or t
  misc_feature (3289)..(3289): n is a, c, g, or t
gctcaccaccggttactacacgcttgcccgtgccgcggtcaaacctgcattgtcgcgctgccgccacagctcgcaaccgagcnttgatgtcgcgccgaacgacaagcctcacactcacgttggcccgtagccaccggcccaccgtcaggtgtttggcgcttgcaccgccgtcgtcgaaccataccactcgcttgtgcctcgctcaactgccacagttgaaaccctaatctctagtagtctctgctatgttttatagacgacctggagcctaggtttgcttgaggtggagattcctctagttattaaaaacacgagactcataatatacaatatatataaccttcttgtagaaaacactatattgtctccactcaaatcattaagccaaagctcacatccataaaaaagtctcgtgttggtttaaatcacgcaatcaatcacctcaacaagtccaaaaagatctcccaaattctcccaacaaaccccaataaagccaaaaccaaaaagttccttcatgtccaatcgcagaggctttcacccaattcatattcatagtagtagcgaaaaggataaccaagcacgatgcttggtctttggctgcccacatcattcagacaccgaaacaaaaaacaaaacagataagaagatcccaaacattatataaataataatataaagttttttattcggaaatttctttgatattttcctctcacctgactgtactactacctcagcctttgactccccacgcccacggtgcacccacatcacctcgttaaatgggggccccctccgggccgcccgggggaccacacaccctatacgcgccgtcatggccctctctatcatcccgagtacaagcagcggggagcacgctgcggcgtcagcatcggccacggccacgaccacgacgaagctgggtcagctgaacgcggcggtggagcggtcatgggtggggcgacggttccgcctcgcagcgcgcgggactacgttcaccacggagctgcgtgccggcacggccacgttcctcaccatggcttacatcctcgccgtcaacgcatccatcctctccgactccggcgccacgtgcacggtggacgactgcgacgtgccgtccccagggtgcaagttcccgcccgtggaccccgggtacgccgcttgcgtggcgcgcgtccgccgggacctgatcgtggccaccgcggcgtcgtccgtgatcgggtccttcatcatgggcgccttcgccaacctccccatcgcgctagcacccgggatgggcaccaacgcctacttcgcctacacggttgtcggcttccacggctccggcacgctcccctaccgcacggcgctcgcggcggtcttcctcgagggcctcatcttcctctttatctccatcgtgggcttgcggtccaagctcgcgcagttcatccccacacctgtgcggatctcggcgtccgcggggatcgggctattcctggcgttcatcgggctgcagagcaacgagggcgtggggctcgtggggttcagctcgtcgacgctggtcactctgggtgcgtgcccagcgtcgcagcgcgcgtctgtggcgccagtgctgacgttccccaacggcacggtggcgctgatgccgggtggcaccgtttccggcggcatactctgcctctcggggcgaatgacctccccgacgttctggctggccgtcgtggggttcctcatcatcgccttctgcctcatcaagcgcgttaagggcgctctgatctacggcatcctgttcgtgaccttcgtgtcctggccgcgccacaccgccgtcaccgcgttcccggacacgcccgccggcgacgacagcttccactacttcaagaaggtgttcgacgtgcaccggattcggtccacggccggcgcgctcgacttcagcggcatcggccagggctacttctgggaggcgctcttcaccttcctctacgtcgacatcctcgacacaaccggcagcctatacaccatggcgcggttcgccggattcgtggacgatgcgacgggagagttcgagggccagtacttcgccttcatgtccgacgcgacggccattgtgtttggctcgctcctgggcacgtccccagttacggcgttcatcgagtcgtcgacggggatccgagagggcggccggacggggctgacggcgctcacggcggcgatctacttcgcggcggcgctgttcatcacgccggtgctcgcttcgatcccgtcttgggcggtcgggccgccgctggtgctggttggcgtgatgatgatgcgtgcggtggcggaggtggactgggacgacatgcggcaggccgtgccggcgttcctaacactagcgctcatgccgctcacctactccatcgcctacggactcatcggcggtatcgcctcctacatgctcctccactcgtgggactgggcgtgccaagcgaccaggaggctcggctgcctcaagaagggcggaggcggcgccgacagcactaatggcggcgtggcagagcagagcgtggaagagcagagaaaggatatggaatcggcataacatttctttcgcctttttgtcctctctgcctttcaaatttcttattttttagggaatttaggtacttcggtcaacctcaatggccattgtttcattttacagtttttaacagtgctacgtcaggtccataagatagttttatgttgcggtttcatagcccatactgaacctttgacagggcgtaaattaatagaggaactagggtagatgattacatgacagtcaactgaactactacaagaagaaagtatatctcccagtttccttcttgtacaccaccttctccttgtacattaccttcaaaagttacacagaaatcagcttacgttcaggaatataagtttcaggatagagccggcccatctgattgccaaagaacccatgtaactggagtgaggttcatgttttttcacgcccttggtttattctttctttcacaggtacaaaaacaaaatgtatagcagagaatttggattcggaattgcaaggggggaaaagaaactacttggccaataagatgtanaggagagcagacgcaagatcaaaacatgaacaatcctcacttttttgctcacttgttgacctgcggattcacagaattacagaaactatagcagccaaattattgcggttctagagtggatcccgcagagctttcaaactgggcggtgccggtggcggctgccgcaggacaggagccgtgccgaggttgctcgccgccggatgtccttntcgcgcttctgtcggatttggtatgtgacgggacgaaggggatccagccatccagggcacatgcagatgatgctggattcgggagattgagagaagatggcagcagagggaggcgctggtgtaaagccgcagcagatcggagaaagtgacgcagatgaaacgattaggctctcttggaacaacgttgggattggcctgaataggagctcggaatttcatgaacaaatggtcgtctattttattttaaaaatatatagtcatgtacatcctgagacataagtcaaccttttggcataaattgttcccgaggacaatcagagtaaaaaaactagaggtgttttctatattttacgaccaaatttaccaaacaaattgcacacagacttaatacaccataaaaagtaataactcatatcatcggataaactcatctcccttagtaaatacactggataatattatttggatcatctctcctcttcctctagcaactctattgcccctagtctcctcccaccctatgtcccctcccccacactcacgttgacgttaacaaacttaatacaccataaaaagtaataactcatatcatcggataaactcatctcccttagtaaatacactggataatattatttggatcatctctcctcttcctctagcaactctatg

SEQ ID NO: 922 - DNA, 1292 bp, Zea mays
gcgacgactgtgtggagtaccgcccccgccccctcaccctcaccccccgacgccgacgccctaggcggctacgccaggtcccgagggacgggcccttcatcttcgtcagtctattcgccgggcgacgagcacccgccagaaagaagatcagcggtttgttggagtatcgaaggtggtgatttcgtagcgtggtgttgcagtttggttggagcttggagtttagagggaagatttggtgatgagcagccgcagcctgccgccgaaggatcgcaggatgcgtactgaacgcacctcataccgtgatgcaccatatcggagggacagccgccatggtccaagcaggtttcgtaatgatttgtgcaacaattgtaagcgtcctgggcattttgctagagagtgtcctagcgtggctgtctgccatacctgcgggcttcctgggcacattgcagccgaatgttcttccaaaggtgtttgctggaactgcaaagagcctggccacatggctaacagctgcccaaatgaagggatatgccgtaactgtggcaagtccggtcacattgcaagagactgcaccgctccaccagtgccgccaggagaagtgatcctttgcagcaactgctacaaaccagggcattttcgtgaggaatgcaccaatgagaaggcctgcaataattgccggcagagcggccaccttgcccgtaactgcaccaatgatcctgtttgcaacctgtgcaatgttgctggccatctggcccgtcagtgccccaagtctgatacattgggtgagaggggtgggcctcctcccttccgtggtgttggcgctcccttccatgatgttggcgctcccttccgtggtggcttcagtgacgtggtctgccgggcctgcaaccagattggccatacgagtcgtgattgcatggctggtgccttcatgatctgccacaactgtggcggccgtggccacatggcttatgagtgtccctctgccagtctcatggaccggttcccccctcgccgtttctgaaggaaggacatccaagggctgttcagatggctgttgttttcagcccattttgtcaggagcacctgttttgctttgctttatgtatttctaaacccgaatggattctagatatttcagattcataactcgtcagcgctatttgtaattctggatatgttacccgactccgatgttcttgatgataatgtttgaagacggggatacttgcccttacgaactcaaaaaaaaaaaaaaaaaataaaaaaaagaaaaaaaagcggccggcggc

SEQ ID NO: 923 - DNA, 1274 bp, Zea mays
gctgcgctccctccgagcccgagcccgagcccgaggaccgggctactgccgtccgccgcaagcccccccccggacccccgggtcccggaacgttttaccccgtccggccgtccccctcgttctttctctcccccttctctctcgctgcgacgactgggtaggctgccgccgccgccctacgccaggtcccgaggaccaaggcattcgtattcgtcagtctcttcgccgggcgacgccagtttggttggaacttggagtgtagagggaagatttggtgatgagcagccgcagcccgccgccgaaggaccgcaggatgcgtactgaacgcacctcataccgtggcgcaccatatcggagggacagccgccatggtccaagcaggtttcggaatgatttgtgcaacaattgtaagcgtcctgggcattttgctagagagtgtcctagcgtggctgtctgtcatacctgcgggcttcctgggcacattgcagctgaatgttcttccaaaggtacctgctggaactgcaaagagcctggccacatggctaacagctgcccaaatgaagggatatgccgtaactgtggcaagtccggacatattgcaagagactgcactgctccaccagtgccgccaggagaagtgatcctttgcagcaactgctacaagccagggcattttcgtgaggaatgcaccaatgagaaggcctgcaacaattgccggcagagtggccatattgcccgtaactgcaccaatgatcctgtttgcaacctgtgcaatgttgctggccacctggcccgtcagtgccccaagtctgatacattgggcgagaggggtgggcctcctcccttccatggtgttggcgctcccttccgtggtgttggcgttcccttccgtggtggcctcagtgacgtgatctgccgggcctgcaaccagattggccatgcgagtcgtgactgcatggctggtgctttcatgatctgccacaactgtggcggccgtggccacacggcatatgagtgtccctctgtgagtctcattgagaggttcccacctcgccgtttctgaaggacgtccaagggctatccagatgactgttgttttcagcccattgtgtcaagaacactcatttccgttttcttttttttttccaaaccctaatggattctagatctttcagattcttaacttgtcagcactatttgtgattccctaatggattctagatatttcagattaataactcgtcagcaccatttataattctggattttctacc

SEQ ID NO: 924 - DNA, 1376 bp, Zea mays
accctgcgggtgcgctgcgctccctccgagcccgagcccgagcccgaggaccgggctactgccgtccgccgcaagccccgtcctgcactcctgcatccgttcacgttttaccccgtccggccgtccccctcgttctttctctcccccttctctctcgctgcgacgactgggtaggctgccgccgccgccctacgccaggtcccgaggaccaaggcattcgtattcgtcagtctcttcgccgggcgacgccagaaagaagaccagaggtttgtgggagtatcgaaggtggtggtgattttgtagcgtggtgttgcagtttggttggaacttggagtgtagagggaagatttggtgatgagcagccgcagcccgccgccgaaggaccgcaggatgcgtactgaacgcacctcataccgtggcgcaccatatcggagggacagccgccatggtccaagcaggtttcggaatgatttgtgcaacaattgtaagcgtcctgggcattttgctagagagtgtcctagcgtggctgtctgtcatacctgcgggcttcctgggcacattgcagctgaatgttcttccaaaggtacctgctggaactgcaaagagcctggccacatggctaacagctgcccaaatgaagggatatgccgtaactgtggcaagtccggacatattgcaagagactgcactgctccaccagtgccgccaggagaagtgatcctttgcagcaactgctacaagccagggcattttcgtgaggaatgcaccaatgagaaggcctgcaacaattgccggcagagtggccatattgcccgtaactgcaccaatgatcctgtttgcaacctgtgcaatgttgctggccacctggcccgtcagtgccccaagtctgatacattgggcgagaggggtgggcctcctcccttccatggtgttggcgctcccttccgtggtgttggcgttcccttccgtggtggcctcagtgacgtgatctgccgggcctgcaaccagattggccatgcgagtcgtgactgcatggctggtgctttcatgatctgccacaactgtggcggccgtggccacacggcatatgagtgtccctctgtgagtctcattgagaggttcccacctcgccgtttctgaaggacgtccaagggctatccagatgactgttgttttcagcccattgtgtcaagaacactcatttccgttttcttttttttttccaaaccctaatggattctagatctttcagattcttaacttgtcagcactatttgtgattccctaatggattctagatatttcagattaataactcgtcagcaccatttataattctggattttctaaaaaaaaaaaaaaaaaaacctcgagag

SEQ ID NO: 925 - DNA, 1583 bp, Zea mays
cttaatcgaaaatgtttagcagatatgtgttgcggaaatacgtgtgtagcgttggatttgtgttcgtacaaaaagggatcgaacccagaacgatgacatacataataagctaggggtagcactaattgaaggaaagattgtctaacactgattgagatgatttgaacacctccagagccactagtgtgtggtggaataagacacgatagcaatcgaaagagaggcaggggaagacaaagttgacatgaaaatagacaataaaaggagatttgaaagaaagaatatatccaaagatttggtcttgaataggagtgcatgaaaaacaactacctatgtgtctgaaccttagtttatgctgggtttcagctctagtctacttgaacttgcttgggaaaaggctttgttatcgttggctttttttatgcatcttcagtagtatgaagatgggtttcatgtctccctaagaacacaaactccgtgttctagcttatgttactgttttgatgttcatgtcatcctgcatgtcacttctagcatcatttgtctagtcaagtttaatccatataaacactattgttttagcttcttattgcatgggtatgattaaggatttggttttatttttacgatattttagttttgattaataattacaaaggccttgaagcttaactgtaaggcgtcctaattccatgtgattagggaggctgcactatgaccatgtaccatctcttgagttggtatcgctttttcatacttaaattcgtttaaatgttgcaggcacattgcagccgaatgttcttccaaaggtgtttgctggaactgcaaagagcctggccacatggctaacagctgcccaaatgaagggatatgccgtaactgtggcaagtccggtcacattgcaagagactgcaccgctccaccagtgccgccaggagaagtgatcctttgcagcaactgctacaaaccagggcattttcgtgaggaatgcaccaatgagaaggcctgcaataattgccggcagagcggccaccttgcccgtaactgcaccaatgatcctgtttgcaacctgtgcaatgttgctggccatctggcccgtcagtgccccaagtctgatacattgggtgagaggggtgggcctcctcccttccgtggtgttggcgttcccttccatgatgttggcgctcccttccgtggtggcttcagtgacgtggtctgccgggcttgcaaccagattggccatacgagtcgtgattgcatggctggtgccttcatgatctgccacaactgtggcggccgtggccacatggcttatgagtgtccctctgtcagtatcatggaccggttcccccctcgccgtttctgaaggaaggacatccggctgttcagatggctgttgttttcagcccgttttgtcaagagcacctgttttgctttgctttatgtatttctaaacccgaatggattctagatatttcagattcataactcatcagcgatatttgtaattctggatatgttacacgactccgatgttcttgaaaaaaaaaaaaaaaaacgggggatacttgtccttacgaact

SEQ ID NO: 926 - DNA, 1317 bp, Zea mays
attgggtacctcgaggccggccgccgggagtttcacatcccaaatcctcatcgttctcctttccccaaaggccaaaaccgaccccgctccacgcctccactcccagccccagcggatcttctcgagcggcggccggcgatggcagcgagcaacatcgggatgatggacggagcctacttcgtcgggcgcaacgagatcctcgcgtggatcaacactacgctgcagctcggcctctccaaggtggaggaggcggcgtcaggcgcggttgcgtgccaactgatggacgcggcgcatcccggcgccgtgccgatgcacaaggtcaacttcgacgccaagacggagtacgacatgatccagaactacaaggtcctgcaggatgtgttcaacaagctcaagatcactaagcatatagaggtgaacaagcttatcaaaggaaggccccttgacaatctggagttcatgcagtggatgaaacgatattgtgattctgtcaatggtggcttcatgagcagctacaatgcttctgagagaagggaaagcagcaaagggggaaaggagacgaacagaagggcatcggtgccctctcacacaccggccaagtctgcatccacaggtcacaaggctcaagcatcacatggtgccaagcgggcaagcgggcagacggcgggtgcaccacagcgcagcgctaagccatcacctgcagccagctctggcggaccagcttatgacgaacaaataactgagctgaagctccttgtggatagcctggagaaggagagagatttctacttctccaagctgcgggacattgagatcttgtgccaaaaccctgaggttgagcacgtgccggtccatgctatccagaacatactctacacatcagaggaggaccctcagcagcaggctccagccctgagccccatcatggaggcgtccgaggagaggccgaagcaagaggcggcgcacaagagaaagagcatctcggacctggacgagtttggtatgtcgtccagctcaaggcagaggctctccgacatctcggacgtgcagctgtgtggatccccgctgacgagtttcagctaaagaaactgtcatctctacaaaatgggtgtctcgtctttctgttggattggttcgtggtttcgtatttcatgtgttgtttggtggtgaactgtcgtgtgctcttagcaagttgtctgccacagaatttgtggccataaatgctacaagttcctcctgctatgttatctgccacccattccaagctgcataatcgcagcggccgctatgagcatttccgtaacacttgcgcccccc

SEQ ID NO: 927 - DNA, 1489 bp, Zea mays
gcacgagaccattacctagaacatcctaatcgaaaacgtggccggcgcggcccgggagtttcaaatctcaaatcctcatcgttctcctttccccaaaggccaaaaccgaccccgctccacgcctccactcccagccccagcggatcttctcgagcggcggccggcgatggcagcgagcaacatcgggatgatggacggagcctacttcgtcgggcgcaacgagatcctcgcgtggatcaacactacgctgcacctcggcctctccaaggtggaggaggcggcgtcaggcgcggttgcgtgccaactgatggacgcggcgcatcccggcgccgtgccgatgcacaaggtcaacttcgacgccaagacggagtacgacatgatccagaactacaaggtcctgcaggatgtgttcaacaagctcaagatcactaagcatatagaggtgaacaagctaatcaaaggaagaccccttgacaatctggagttcatgcagtggatgaaacgatattgtgattctgtcaatggtggcttcatgagcagctacaatgcttctgagagaagggaaagcagcaaagggggaaaggagacgaacagaagggcatcggtgccctctcacacaccggccaagtctgcatccacaggtcacaaggctcaagcatcacatggcgctaagcgggcaagcgggcagacggcgggtgcaccacagcgcagtgctaagccatcacctgtagccaactctagtggaccagcttatgacgaacaaataactgagctgaagctccttgtggatagcctggagaaggagagagatttctacttttccaagctgcgggacattgagatcttgtgccaaaaccctgaggttgagcacgtgccggtccatgctatccagaacatactctacacatcagaggaggaccctcagcagcaggctccagccctgagccccatcatggaggcgtccgaggagaggccgaagcaagaggcggcgcacaagagaaagagcatctcggacctggacgagtttggtatgtcgtccagctcaaggcagaggctctccgacatctcggacgtgcagctgtgtggatccccgctgacgagtttcagctaaagaaactgtcatctctacaaaatgggtgtctcgtctttctgttggattggttcgtggtttcgtatttcatgtgttgtttggtggtgaactgtcgtgtgctcttagcaaagtgtgacacatttagccacgaaccaaacagcctcttagtctgtgaccagagcgcatgacctcgtctactaatttctctctcagaatcagcttttttttcgtacctattgcgcatcagttgatttttccttctctcttttctttttggccgtatttcatcaggttgcatataaaaaaagtaagatctactggttctggcgttcggctataatgggatctttgatcaggcaaaaaaaaacaaaaaaaaaaaaaggaaaaaaaaaaaaaaaa

SEQ ID NO: 928 - DNA, 2133 bp, Zea mays
tgcatgcctgcaggcatgctggctcctcggcttagccaagtttgcatttctattttgatatattcgacaggtacatgatacaacgttgcatagtaatctataataatgcttgtgtgcatggagctagagcctctagcagcggtgctaaacgagatatatgtagacatatcgtctgattggttgccacatctacgtgcgccggtctcgcacgagcctgcatcgccagcaaacaccctcacctacttctccacacatgcaagatccgacaggtaaaagtcgcgtgtaagaaagatagaaaccgatttatgtaacagcatacgtgccacttttatgttctatgttttctttttgtttatatataaaaaaaaagtttacataattcggaaagacttacagatctgagaggcacagaatgcacaaaagacgtgtggcggccgaacagcgagcgcgtggagtcaacactggacttgacagtgatgggccgcaatagatggagtataatatttcgcagtgggcttactgttatctgagtacgtgacggatctgattccctttcgccagcttggttgggcgggctgcttatcttcagttattttgggctcccacttgttgcagtgggcctaattcgggcgccttgctctggctaaagacagagactaatgtcgagacaacatagctttgtgcaactataatattttgatagtaacagtacgatctaaacacacacagcagtgtccatataataaaaatcacaccaacgaagtcacaaactagctcgaggcacagaatcacaccaacgaagtcacaaaccaaataaaaatccaaaacaatctgcaatttttccctcatacatagtcaatatacataatagctcagccacacaagggactgtactgcgcgcaggaaagccggacactatcaatataatctgtaattaatagttatagatatgaaaaaacataagtcatggcgcctactattcaaagcgaagaatgaaagagaaaagttcactttgcagctaaatagtatttgaatcttaaaaaacttatgcatggctttaagattttgaaaccatctaagtaagttttttataagtaaaagaaagtgtaacagtacaacaaaacaaatactatctaaagagtaagctaacccttttccacaacgtcaaaccaacaaaactgcattccatatcaaactgatttaggttctaaacaatcacacgtgcaactatctttcctataaaaaaatgaatggggtgcaacaatcctagaataagcccatcgctggcagatgtaaaactgacttttctcaaaaagaaaataagaaactgtatggaatgcccaaaatcagtagagattctacacgtacaattgctcaagtgttgtgttgccaggtcatgagcaaagaaacttataggatcagctgcagctggtgtcacttgcaaatctgtgtcgttgcttgtgccgaaagcagcagagaaggtggatctgcagctttgcaaagccaggagtaggtggattggtggctaggtttaggctaagcctcacttgacaacaggtttagtcgacgcaaaggtcgcatgcaattgcctccatggccatgagccacaccaggatgagatgcaattgttatatgcagataaggagagcgagatagatggtcagatggagcaggaacccagcgagaaatggcagattaggtggcagcatgagcaagcacaagcgggttcaggttcaggcttaagctgagctgctgacatagcaaagtagtatcagtacaggaggaggaggggggatagcaggagtggggggtggcagtggcagacactcatgtgtgtctgcagaatctccagatccgaggccaccggttgggtatatctataacagagtagtatcatgtatatctataaaaatgaagaaagttacataagtacaaaattataacagaggaagatacaagacatccaggcccaaaaggaaaaaagaagaaaaaaaaacagaaactaagagtagtgtctctccaagggcttgttcggttattttcaatccatatggattggaagggattttgacttgctagggattgaaaccccctcaatccctctcaatccatatggattggggtagaaccgaa

SEQ ID NO: 929 - DNA, 2360 bp, Zea mays
tcgaggccggccgggccgggaatgaatatgtacaatgtgtgtgcattcgtcacaccgcccaccattcggcccctcgcgatccaagggaatccgatcaatcccggactcgtcctcccggccaaccctagcttcccttctcttcccctcccccgatggacccgccgccaaccagggacagaggggaggagctggagcctgaaacccgcgccttccccgacgccgacgacccggagacctcccgatctgaacgcgaagagggtatccctccaccgccaccgccaccgcctctgcgccagcagctcatgggggcttgccgcgccgacgagcgcctcaggccgctcctcaccctcaacgtctcctgcggcgcagcggacgaccgactcatcgcacacctcgcgcagcacttcgaggtgtcggaggtgggcatgctcgcgcgttgcctctgtgttcccctcgtttccctgcgcgttggcaaggttcagagggaaggggccctcctctgcccaacacacattagagggaagctgaaccttgttcttctgccatcatctagcatgcggcttacctttgtttgtgatgatggttatccagagcaactagctctcttgagcaatggctttgaattttcggaagttatgattgaagaaatatcagctgataattctggacgctctttcctaatcagaatttcagaatctaaagtgttttactactggtgtgctgagaagtcgaaggaacatggaatggaacttcttgcaaagatgaaaaaccttttggacgggaggccaacactctctgatctcactggcatctctaattcacgacttgatgcttttgccactcatttacatgcttatcttcttgcatcaagtatcggtgatgttacatcattgggctcacttaatgacttcctgagtacttcaagatcacatgatcaatatttacagctccagtcagatttttccaaaacttccaggttccgtgcctcggctgctagtgcaattaagccaagctctgtctatcaagccagcctaagtccgagatctggcacttttaaagatggggtaccaagggcttcatgtgcaagggttgttgggagggacaagctgaagcgtcgtgtggaatggttaggcccgttaactgctccgcttgatacgaatcctttgacaatcaaccctgattctgccagtgagaagtgtgatgcagattgttcaaagaacaatgttagctcagttccgttggacctgcctctttcgtttcccctgttgccttctatttactcccttggcactcgtccggttcctgaggtttctttggagaaacagtttaagccttactattgctggtgcccaccatgcccatcatcgctgcaatacactgtcacccatttgcatctgccagctacacctgtagatccgttgcccctaccacctttgagttcactgctagcaagtgagcagccaccttcttcaacagtttctgtaaagctggatacaactgatctcccttcccttaatcttccgtccatactgcattcaccacttattcccctacatggtccacaagtgccaacattcacaccattgatgtccgatcccattgtgcatgtcccagtcattgatgtttgttcggcgggtcaggcctatctagtgagttgtgggccgtctataacttcagcagttcccctgctcccgagcttgaagcctctgctgccagaagcagagtcgttagtcgagagaagcgcaagggaaacactgatgaggctcatagcttcgacaccacctgcaagcaatcctctacctggaagtatatcctgggcgaataacaatgtgaagaagcatgttgatgtgtgtcccaatgaaaaagcatccggtacgtcttgtgttgctgctgtgtttggaagtgggattgcacacgctgaggatgaagttccaagcggaggtgattcacaagagccgtttgccgaatacgatggtaccagcaatgaatgtgatgtacatcattggcagaaattctagcttggctgcatcagcatggtaaatagggttttgaggattcgggggtttgatgtcctgtacgcagcagcagccttaaaagtttctgtgcccagccagcatctctatttggtttgcaaatgtaattactagtttgtactgtcttgtttttggcaaacttgctgcgagcctcgtgcttagtttggtttatttatttatgaactttaggcctgttcgaagcacccagtttgtaagaaaatggattatataaactgaagtgattccaaatatatcagtttatgtctcagtttataaaaattggattaccagtttctaaaaaaaaaaaaaaaaagcgggcctcgagct

SEQ ID NO: 930 - DNA, 1723 bp, Zea mays
  misc_feature (1536)..(1536): n is a, c, g, or t
  misc_feature (1608)..(1608): n is a, c, g, or t
  misc_feature (1639)..(1639): n is a, c, g, or t
  misc_feature (1668)..(1668): n is a, c, g, or t
  misc_feature (1680)..(1680): n is a, c, g, or t
  misc_feature (1709)..(1709): n is a, c, g, or t
  misc_feature (1723)..(1723): n is a, c, g, or t
ctcgaggccggccgggccgggcgccccgcgcgccagccgccaatgccccaatcccgtaatcgcagcctcgccccgctcgcatcttcctctccctctcagcactggtgctcaatctacaggttgtcccgctccctacacacccgccctccggtgtgaacctccatgacgtccacaaccactctccggtatgaatcccgcgtgcgcttacacgaagattggtaatagtggcgacccagtcgcagccgtggaccttctcctcctcatcgcttgctcgttgtcgtcttttgcctacgtctgcacccgacgctgctacccttcgctcacctgttcatcatcctttcagatctgctgtcgtgacctcatccagccgtgctgtggcagtggatcgaagttcgctccagctctgattgggggaaaatgactagggtatcaagtggaaaaacataatggtccaggttctactgcggcacctctttcaggctaagcatctaaacaacaatatgtaaattatccttttccaataaaatacatgcttaaatcgtggctgctaggcgaatggtcctactttggtcatcaaatgcaggaattccactactatatgtgccacttgaagttgttatgtcaaaataatatggtgaaaacgagcgtctattgggatctattttttatcttgcaaatgatcttcctgaaggagattgatatgtcaagatacgcttgtttcatttgagctcaatgttatctgaaaatatatagactgccttcgtccccttcatcactgctaatgaccgtgacttggagacccgacagcggccctcgacgttgtcgccgccgagcccatgctggttccaccagtggtccaccacccggatgtggtccgccaagacgagcagtaacggtggcagcgaggcgaggtggtagatccagcaccgcttctgcacgaccatccattcctccacccagagcatgtacccaggcttgcctctcctcggggaacatgccgaggtcgtccgactggagcagaaggcgacatcgctcaacaagctggtcgaggagcagtgcgagagcataaacgatctcaagtccaagagccatccgattctgggcccagaacactttgccaaacaaaaagttatcgctcttcatccttgataggctacagaaagggaagctgaaccttgttcttctgccatcatctagcatgcggcttacctttgtttgtgatgatggttatccagagcaactagctctcttgagcaacgactttgaattttcggaagttatgattgaagaaatatcagctgataattctggacgctctttcctaatcagaatttcagaatctaaagtgttttactactggtgtgctgagaagtcgaaggaagattgaatggaacttcttgcaaaggtcttcaagggagaagcggcttaaaatgtgtgagcaggtattttcggactcgtaccagaaagggaaaagctacaaaggttgacacagtcgccgaagctgtgaagcaggaaagcttcggcatgttcgcaganaagggaaccgacttaaagatgaaaaggccatttagacctcgatagagtgctatagaattatcaccaaatgtnaagggcatgtatgtaattttgtatgggttgnaccccgtgcctataaataggtgaacagtncccccgtactgntcacgttgacttggcatttgcttttgcgncacacttgtatttn

SEQ ID NO: 931 - DNA, 1977 bp, Zea mays
  misc_feature (1899)..(1899): n is a, c, g, or t
acggtctcgaactcgaagcccagcaccacgtgaccacgagccgcccttctccggcggcgtcacagtgagcccggcatggccatgctactccgccgccgactcccgctgctccgcctcctccggccgctgcatactggatcgacggcttcgatctcctcgtcctccacacctccccctcctcttcagaaacctcacgccgccttcgtggggccaagatcacgccgcctgcggttccccaatgccgcgcccgttgagtcggggcggggggctgggaaatcatctcccgctgccgcctatctcgctatgggcgcggccgccgccctcgcgtcactgccggtggcctacgcagacagcaatgagcagggagcggtcgacacagtagcgagtgccgatcccgcggttggggaaggatttggcccgcaaggagaggaagaggatattggagcttgtccagagccgagggatgcagcgcgggtcatacccgaagtttgatgttgcagtgaagggccagaaggtggttgttaaattcaacatgccatctaattgcaatgtatcacaccttatcgttgatcttgtaacacatattggacttgaggcagaacaacatggtggtggctcagaggttttagtgcgtgcttgggacagtccagctgcacgtcaaatcacactgaaccctcccaagaagactagcactggagatcacaatgaagatggtctctgtgttctgatatttgaaccacttattggatcagattattctgaaattgaattcatcaagcctgggagttttagtttgaaagaacttgaggctttgataagtgctttaaaaatagcctctgaaaaagggtcatcagggaaaaacacaccaagaaaaggaaatggtcaaagatccaagcatttgccctctttggagaaagttgtatctgatttggaggctatgggtgttagagtctatggatttgatgaaacatcaagtgttccaatggatggcactgtaatctgggagaaccttgcaggatatgaacctcagaaaagggaaatagaggatactgtactcttagctttacagagtcctgaagtgtatgatgatattgctcgtggcactcgctgcaaatttgagacaaatagacctcgcgctgttctttttgagggcccacctgggacaggcaagacatcttcagctcgagttattgccaaacaagcaggaattccactactatatgtgccacttgaagttgttatgtcaaaatattatggcgaaagtgagcgtctattgggatctgttttttcacttgcaaatgatcttcctgaaggaggtattatattcctagatgaggtggattcttttgctattgctcgagacagcgaaattcatgaagctacacgaagaatcttgtcagtaattctgcgacagatcgatgggtttgagcaggatagacgggtggtagtcattgctgcaacaaatagaaaggaggaccttgatccagctctcatcagccgttttgattcaatcatctgttttggcttaccagatcagcaaactcgtgtggaaatagctgcacagtatgccaagcatttgactagatcagaattggttcaattttcattggccactcaagagatgtcaggaagagatatcagggatgtgtgccaacaagctgaaagacactgggcgtcaaagttaataagggggcaggttccaaaagatgagaagggggagccgagtcttcctccaattgacgaatacctttcctgtgctgaacagagacgtaagtccttgcctggtagaacgagccagacatccaggtcccctgcccttaagttagcatgaggaatgtacctaccagtttacctttacatgttcatatatcacatatagtattaccgaatgtagttcanatggaagtatgtaggcggttctaaacagtttttgttatgcgacatatgctaatacttaggaaatgtgacatctatgat

SEQ ID NO: 932 - DNA, 1328 bp, Zea mays
aggagtttgcacctgaacgacaggagggtagggcgctggctggctacaggaagtataggacgacggtgtggggccgaaggaggatgaggagggcatagggggccgatgttgcagcagtgtctggtcggaggtcgtcgaggcgtcgtgcgtcgagtggcggcacctggtcggaggtcatcgaggtgtaggtgcgtcgatgcggcgcctggccggaggcggcgacggagagggcgaggctaagtcagaggtggccaggacaaggccagggcggcgcatggtcggagttaggctgcgtcactggatctagcgatgactggatggggtttgattgcagtttggataataggtgaggggactcattgtaaaagtgcagcagggatgggttatacacgttagatatagatccagttacgggcgtcgtggtttgcacagtttgcacgagacgtgcagtttgcacctgatctgcagctgcaggcctgcagcccccgagtccgaaatcgttggacggggaaaggaaagcgaaacaagccacgctaagcaagatgcaccgaaaccctcgcgccgtcatccgcgccgccgtctccctcacccgccggccccccgccgttcctgccgcggaggctctccaaaccctgcctaaagcgacgccctcgcctgcgcttggggcgtggcggccagaccaggcggtggggcctttgggtagcgtcagccgccgccgcgccttctcctcctccgcggcagagtatggcaaggatgtggacgaggtgaaccgcaagttcgcggaggcgcgggaggagatcgaggcggccatggagagcaaggagacggtctacttcaacgaggaggcctccatcgcgcgtgacgccgccaacgaggcgctcgctgctttcgacgcgcttttagcgcgcctcccgcccaccgacgccgacgcgctccgccgctccatggggctaaagatggaacaactgaaggccgagctcaagcagctcgaggactagccgactaggctgcggaaaggtttgagttttgcgagaaaatttgggcggaatgtttggttatacacctgttcttttgagatagagattcctaggtgttccgcttggtgaataaattttagcacaacaatctgttgcattgcctgtttctgttggttcttggtgagaggagatccgaagctaatttgtaatgtgcctggtttaccaccttcacatgattggccactgttgaggccttaaattgatttgatagaagttagaccgatgcgttcctgtgttgttcggattaaacttcatttgcaatttttcttccttaaaaaaaaaaaaaaaaaa

SEQ ID NO: 933 - DNA, 5127 bp, Zea mays
  misc_feature (1263)..(1263): n is a, c, g, or t
  misc_feature (2128)..(2128): n is a, c, g, or t
  misc_feature (3987)..(3987): n is a, c, g, or t
  misc_feature (4855)..(4855): n is a, c, g, or t
gatcccactaaacacatgagatagctaacctaaactgtacagtaaagagtgtttggtttgagaaatcactccttcaaagataaagtgatgcatcataagttcattattcaaatttggtagaataacattatttctcatatcagtagttcagtactactaagtattactaaccataagaaatgaggtggtgatgaatcaacttattacatttaataaaccaaacaaaaaagtgagcagtgagaagatgattgactaacttactcaacaaaccaaataccctataatttttgttgacaaacacatccctgcaggactgtattattgcctctcttctctttgttttgctttgttgatgcaactgtaacacgtgaatcccaatacgagaaaaaaagttttgtgggagagacaagtggatcatacattaataatgaaaacataactgctatacaaatgagaaaaaagtaggcggtaaagatcctaacaattagcattctactatattaggttgtttccaacaatgactgctaaatggttcggtacgctaaatttagcggacgaggacgtgcgcaatacgtccaacaacaaccggtatatggcgcgctaaattttagcgctcgtttgggagacgccaaacgtagaggttgtcgagcgtccgctacacgccgatcgtttctctctcccgcgctcttgaagtgtttgcttcctctccgtgacggacacctgctaccgccctggtcccaccagagacgtccggcctcgctgtgctagtttctaccggccaaggcgaggtcctcgatagcagtgtcgggccgtcgtcgtcgtcgggccgtcatgatctttgccccgaccttcgccaacgccaccttgctcggccgggcaagatgtgcagccgtacttaccaatgttgtcctcccagcatcctccagtcatgggcgggggctatagtagccaccgctcggctctgtacctacggggagagagaaagcatgtgggagcaaccgagcaggtgagcgcgagcaagcatatgtgggggaaggcgagagaggagagctgttgtctcggatgctgatgtgtggaaccttgcggaaaccaggagagctgtcgttcttggatttgtggtttttgttgtgggaaatggagtgattttgccggggagccaaagaatattggcgtatggtgcttgcaaattacttgcacaaattctaccattcaatgtgttcaattgcaagtgttaaaaaattcgtatttcccttattactttangaggccactaatttcgaaattaaaataactaaattataattaattctaaatatgtacttaatttacaacagggagataattcaattttgaaagaaaaacaaatgagaaaaagaattttgttatcaccgtatatatagaggactgaatttaggggacgttgttaaagatgtagaagatataaagaatgaaatattttagagtgtgttgtaaaggacatggtatatttctttaaaagatgaaatttagagtatgttgatggagatagcctaatgctctaagactgactcgaacaaagacttctaaatggttgtgtaccctaaatttagagcacggggtcgtactctacatatccaaccgtgtcctctaaacggtcctctaaatttagataacgctgttggatcctctatatatagaattttctcaatcatctcctctatccattttcatactgtaaacaatagatccagcaaaataatatatatatatatatatataatacatttgagagtacgacaaatatgtatgtataaaaattaaaagtaaaatatgtgtctaatatcgatatttatacataaaggatgaaatatagatgactttgctgaagattaaaaagatatagaggggagaatcttttagataagactgtaaaggacattaatagagaatgaatataaagaacgtcgctggagacacacatcctcggtgcaacaggcactatagctagtacatcacagttgtaatcatgtttcctcacatttgatgagacaacggaagtccggaaccgagctgaaagggtacacgacgtcgttgtattaggacatgtacaactcaattaaacgaggagtcttttaagggatcgctagangtttaagtaaaaaaacaaagagacatattttcacgaatagttcgtctctacacgactcacacgactttctatatattgtgacttagactatatttattatctaaatatttaaagttatatgatacaatctcttaactatcttttatatttaaaaaccgatccaaaagctcgaaccacaggttgtacatgcccttaatattagacagcgagcggctcgccggctcggtgatggtaagtgtcaatggagttaagctaatcaacgtacagctagcatgctgcatgcccggccgattattggaagcctcgctcatcctgggcatcaggccgaaataagtagccaccacaccttggtcgccgtcgccacaatataataaagagcagcgtagagtggttgggaactaggccgcgcgagcgtgatgccacaccccaactcacctacacacgtccaccaacacgcatgggatcacggatcatccgactccggtccgatcgacccagctcgagctagcgcacgtacggccatcgcacgccgctggcaaagtgtggcaacgtgacgaacgcatgcatggcggccggccggccggcacgaattaaacgcaccgccttttcccgcctcggccgcccgctcgacgacgcctccaccgatcgtcctcctgctcgggcctatatatgtaagcccgggcgcggcgtcacccggcacggcagtcgtcacaccacgaaagcagcagcaaagtcatcagcaacccacgatcggtcgatcgatcgggtacctgctagcgaattcgatcggtcgggtacctgctgctagcgatatatagcagcagcagcagccagcagatcccgtcgtcgccggcacgatggccagcccgtcgtcgtcgtcgtcgtcagctctggtcgtcctcgtggtggttctagccgcggcggtggcgtgctccgcgacgcgccccgtccccacgcggcagcgggcggcggcggaggagggcgtgaggcggccggacacgctgcacgagggcacggtgctgatcccggggatggggcgctacgagatcggcagccactacatcccggacatcggcgggctggaccacagcgtccccgccgccacccacgggcagttcatccccggcgccgacgacacctgggtgcccaaccccggcttcgaggtccccaaccccttccgccccggcgcggccactccatgaacacgtacgagtacgaccccgcaacgccgcgctgaataccgtctcgcgccgcgctgaataacgctacactagctacgtactagtcgcctagtcggtcggcttgccgtgcttgtgcttggctgctgaatgcaagcatgtcctttgttgtgtggtttaatttgtcccacgtacgtctgtgcagtgtttttgcagtttgtgctccagtgaagaagtgtgcacgcgcgatgcgtagaaagcgcatcagaactttgcatggcccggttggtagcagctgcttgtttctcggtcactactgttacaaataaaatttgctggactggacacatagctatcatcatctatcgctgtgtcaactgtgcattgccatacttctcttctctaacgtgacgtgaagcactgcggcggtggaccaaaaccatgctgggtagcatcagcacgcacgaagttcaggtaagcagcaccgtactcctgttagattgaagatactccacacattgctgcaggaaattacaatattttttaaataaaatttaagtagagatatgacatggatatcccatgctaagagattaaaatttagtgatataatgtagctaatagtaattaagagatgatgtagctgtagatagatagtgtaaaatgaaaacgaatattttnattttcatatcgatcgagatagaaagaacctcgagtgtattttaggggcaaagtacccgcacctgtactgatctccgtccggttctgcccttctggtgacctttattcttgttcagctttaatttctttgcgtgaaaagggggttgaagatgaataaagggcgagcttaggccccatggccggaggagatcgggtcagatacgagaggtagatgtgcctgccgagtgccgacccacaggaccacctgtagggcgagccaaaaaaaaaaggtgcgcgccactgcgggtatggcgttgtcctacaccgtccgggtaattaccaccaacgctggcatttttgtccagagcatgtttatggaaatgatgtagcttgtactacctctacatgtttgattatacccactctgtttttttatttgctgtagtttaatttaaaaattaataagcagacgacaaatattcgagaacggatgttaccatgactgggtcgatactaaaatgtacctccttcgttcctaaataaactaactcctaaagctatctaaaataatatctaaaataacttcaacaaaaaatttgattgttgaaccgaatttatagagaaacaatatttatgacactgaatgatcatattgttaaaaatacattatgatgtgtccaatgctactaatttagtcccataaacctcgacgctcttttctataaacttaaaacttaaatttttttatgatttaaaataactctaggtattgatttattcagaatgtgagaaaataagaacatttagttctatatctattcgtaattttttttgtaaacacatggatagatttgggatgctacaggaccgttatggcatgtacagtgantgttttaagttgtgtcttagagtatgtctagggggtaaatgtaaaaagactcaagacatgtatcttgacgaagacacagtgtcttagctctatgttcgagacagtagattatttgattgatcactttaatttattgaatgctctgatttgtataatgaatatgataagacatatgttttagacatgaccattatattatgttgtgttttagttatgtcttatatttggagtaccgtgcaacagtgtctaggttttacatgcccttagcacct

SEQ ID NO: 934 - DNA, 790 bp, Zea mays
  misc_feature (2)..(3): n is a, c, g, or t
tnnagtaagctacgggccgcccggctcggaacggcagtcgtcacaccacgcgaaagcagcagcaaagtcaccagcaaccagcagatcccgtcgccggcacgatggccagctcgtcgtcgtcgtcgtcagctctggtcgtcctcgtggtggttctagccgcggcggtggcgtgctccgcgacgcgccccgtccccgcgcggcagcgggcggcggcggcggcggaggaggtgaggcggccggacacgctgcacgagggcacggtgctgatcccggggatggggcgctacgagatcggcagccactacatcccggacatcggcgggctggaccacagcgtccccgccgccacccacgggcagtacatccccggcgccgacgacacctgggtgcccaaccccggcttcgaggtccccaaccccttccgccccggcgcggccactccatgaacacgtacgatcgagtacgaccccgcaacgccggagaactcgatcgatcgatcatatcgtctcgcgccgcgctgaataacgctacactagccgtgcttgtgcttgtgcttggctgctgaatgcaagcatgtcctttgttgtgtggtttaatttgtcccacgtacgtctgtgcagtgtttttgcagtttgtgctccagtgaagaagtgtgcacgcgcgatgcgtagaaagcgcatcagaactttgcatggcccggttgggtagcagcagcttgtttctcggtcactactgttacaaataaaatttgctggagacacctccccaaaaaaaaaaaaaaaggccccta

SEQ ID NO: 935 - DNA, 3197 bp, Zea mays
  misc_feature (726)..(726): n is a, c, g, or t
ggtggcatgtggcattaccaaacatttctaccaataatgcgatcaactttccaatcattgtgcaaggagaatatacaagtcttttgcttggtcttgatcaagatgcttcagctgctcgaaaattacaatttgacaccggagcaaatgatacaaccatgtagtagcatttttcttttactcaaataaattcaatacattgtgtatcgtacaatatacaattggttgcatactgctgcgccaaattttatatgttgctgaacctgcacatcaagggatttctgtatgtgccaaattatgtatgtctgagtctcctggttcatgtcttctatttttagcgacggggcaagtaaatttggaagtctatcggcttagccgatgatttgtttgatatttgagacggagcagctagccaaacgccgggacgagccgcaagaagaaaagtcttccgattcctgctaggtgggcgtgcgcgttgccgggctccacggttggttgtttggaggcggtatccagagattttttttccctaattaacaacaacagccacaattaactcgccgtccgcgggagatgggtccccatgccgtcggcgcgacggaacgactacgaagcagtggttccatccattggaagcttccaattttaacatgcagagccggcggtcccacgccagctacggctcactgaacaaactgtgagatgtactggtgtggtagtggttagtantatactcaccactccgaagtccgatctccgaagtacgctgccattaatctccgcgtctgcgtgcaggagcatcaatccacctgttctgtggtttttgaccttcgcatggtagctgaagatgcatgcaacgatttcattggacatggaaaagcctgcatcacacacagcaccaagccaccagctgccaacctgcccacgggtagaggcaacacaacacgtagtagggaccatcatggtttttttttttataacaggcggcatggatggatcccacgagccacaccacacgagctaacacctaaacagtagtactgctagctaatagctatatccagaatgagcatgtaattgctttttttccttgggaacccatcagctcgagttatcgagcgcggctgtttactcatcggttaggaactgatggtacattgaccggtaagaactctgagcaagatatacctgaggttcttgtgcgcaagccgttcgtttgagctagagaaacggctgcggctgcgggtgcggctgcgaactctctcacagagcactatagcaacagtagcagccgaacagctttgactaggtagttgctaaaaggtcagacactgagtgcccgggtgttggtcattatcagcggagctacgcacgctaatcagcgtagctgcaactgctagcatgccgggccgaatcgtcagtcctgggcatcaggccgaaataagtagccaccccttggtcgccgtcgcggtcgccgcctcaacaataaagagcagcgtagagtggttgggaactaggccgcgcgagcgtgactgccacatcccaatcaatagccacggaagcggaaggggggcgggggcgggaccggggctcggtcgatgcggatccgtcgccgtccaacaacaacgcgccgacgccgactccgactcgcctacatgtccaccaacacgcacgggatcatccaacgccggtccgaccgacccagctcgagcgcacgcacgcacggccaacgaacgccgctgggcgctggcaaactgtggcgacgtaacgaacgcatggcgcctagccgcctagcccgggagagagcgaggcgtgccaagaggaggccggaggcggcggccgggcacgaattaaacgcaccgccttttcccgcctcgaccgcccgctcgatcgctctcgctccacgcctcctccactccacggctccaccggtcgtcgcggcatcgaccgtcctcctgctcgcggtcgctgggcctatatatacgtctgggccgctcgggccggcgggacccggcagtcacacctcgaaagcaacagcaagtcagcaacctacctagctagagctatcactatatcagtatcaggtacctagacctagcagcagccacacccacaccgtacgtcggcatggctaggtggtcgtcgtcagctctggtcgccgtcctcgtggtcctggccgcggcggtggcgtgctccgcggcgcgccccgtccccgcgcagcagcagcaggcgggagaggacgtgaagcggccggacacgctgcacgaggggacggtgctgatcccggggatggggcgctacgagatcggcagccactacatcccggacatcggcgggctggaccacagcatccccgccgccacccacggccagttcctccccggcgccgacgacacctgggtgcccaaccccggcttcgaggtccccaaccccttcatgcccggcgcggccactccctgaacacgtacccgcgctggcgaaggtggctctcggtcgatctgatcgtcgcgcgccgccgcccgccctgaacgaataatactactagctactactcgctctgctacgtattagctagccgtgcttgcctgctgcatgtacgcatgtcttcgtgtggcctgtcccacgtctctcttctagtctctgtgcactttacgctccagtgaagttactgaagtgtgcgcgcgcgatgcgtagcagatcttttgggccggtagttgttgctggaagtgtacgtagtatgtagccgcttgtttcttggccactatatattattacaaataaagtttgatggatgtagttatgggcaaaaaaaaaaaaaaaaaagccccctaccccaaaactgtagttttgttatactttacatagtcataatctgtatttttttatttttttcaagaataaaaaacagattatttgatccgtgctggtataaagaccattcacacaatttataattatttttacagcggacaataaaaaatgacatgtcatgatatagcgacaaacaacaaatcataaaaaataacagtctacttatgctggttagcaatagtgtttttccatcacgtgccaattatcgttaactatcgctgtcaactgtccattgccatcactgcactgcaccttcaaaacttgtcgtacgtcctcctccttcccatgcgtcctccacacaatttagcgaaatataaaaaagtacctac

SEQ ID NO: 936 - DNA, 825 bp, Zea mays
aaacggcagtcgtcacaccacgaaagcagcagcaaagtcatcagcaacccacgatcggtcgatcgatcgggtacctgctagcgaattcgatcgatcgggtacctgctgctagcgatagcagcagcagccagcagatcccgtcgtcgccggcacgatggccagcccgtcgtcgtcgtcgtcgtcagctctggtcgtcctcgtggtggttctagccgcggcggtggcgtgctccgcgacgcgccccgtccccgcgcggcagcgggcggcggcggcggaggaggaggtgagacggccggacacgctgcacgagggcacggtgctgatcccggggatggggcgctacgagatcggcagccactacatcccggacatcggcgggctggaccacagcgtccccgccgccacccacgggcagtacatccccggcgccgacgacacctgggtgcccaaccccggcttcgaggtccccaaccccttccgccccggcgcggccactccatgaacacgtacgagtacgaccccccaacgccggagaactcgatcgatcatatcgtctcgcgccgcgctgaataacgctacactagccgtgcttgtgcttgtgcttggctgctgaatgcaagcatgtcctttgttgtgtggtttaatttgtcccacgtacgtctgtgcagtgtttttgcagtttgtgctccagtgaagaagtgtgcacgcgcgatgcgtagaaagcgcatcagaactttgcatggcccggttggtagcagctgcttgtttctcggtcactactgttacaaataaaatttgctggacacaagaaaaaaaaaaaaaaaa

SEQ ID NO: 937 - DNA, 1111 bp, Zea mays
cgctgggcgctggcaaactgtggcgacgtaacgaacgcatggcgcctagccgcctagcccgggagagagcgaggcgtgccaagaggaggccggaggcggcggccgggcacgaattaaacgcaccgccttttcccgcctcgaccgcccgctcgatcgctctcgctccacgcctcctccactccacggctccaccggtcgtcgcggcatcgaccgtcctcctgctcgcggtcgctgggcctatatatatgcgagcccaggcgcggcgttcggccacccggcagtcacacctcgaaagcaacagcaagtcagcaacctacctagctagagctatcactatatcagtatcaggtacctagacctagcagcagccacacccacaccgtacgtcggcatggctaggtggtcgtcgtcagctctggtcgccgtcctcgtggtcctggccgcggcggtggcgtgctccgcggcgcgccccgtccccgcgcagcagcagcaggcggtagaggacgtgaagcggccggacacgctgcacgaggggacggtgctgatcccggggatggggcgctacgagatcggcagccactacatcccggacatcggcgggctggaccacagcatccccgccgccacccacggccagttcctccccggcgccgacgacacctgggtgcccaaccccggcttcgaggtccccaaccccttcatgcccggcgcggccactccctgaacacgtacccgcgctggcgaaggtggctctcggtcgatctgatcgtcgagcgccgccgcccgccctgaacgaataatactactagctactctcggtctgctacgtatagctagcttagcttagctagccgtgcttgcctgctgcatgtacgcatgtcttcgtgtggcccgtcccacgtctctcttctagtctctgtgcactttacgctccagtgaagttactgaagtgtgcgcgcgcgatgcgtagcagatcttttgggccggtagttgttgctggaagtgtacgtagtatgtagccgcttgtttctcggccactatatgtaataacaaataaagtttgatggatgtagttatgggcagaaacttgctacaattcatattttacatt

SEQ ID NO: 938 - DNA, 2450 bp, Zea mays
gtgtatatttagttatgtcgcataatctatgaatctagaaaatctaaaatcacttgcaatttactgcctttcttttgttatagaattgctgtttaatttctgtttcagatgtttattgtctgtttcatttgattggtgttctgtatactcttgcttgtattacctgctgaaatttgaaaaaaatattcacgtactctgtaatgccatcatagctagggagggattacttgtctgttgtacaagttgaattcaatggtggttcaacacttgcatcaagcgtttaataactacgcttatagaggtgtgtttttaacgaaaatttggtgtcattgctgatagtaaattttcttgtagcctggtcagggtatggaagagcataggcagatgtcggagtttgacatgccggtttcacagggaagcggccaagccactatccagtttagcagcatgaattcatctttctcgagtccacctgttcagcaaccccaacggccacatcagatgtcacaatcgttacacatgtttgggaatccacaccattctcagatccagggaactagttcaagctcacaacagcaggcatatgctgtgcacttggctaaagaaagacaaatgcaacagcatatggcacctcaacagcatagtgatctttctggagcaagtgcagtacccaatgtgcagagtaatactcaaacattgcagcagggccaaacctcatctgccaattcagccccttgttcaaaatcacagcatcagcgacagcaagcggcacaaaatctgccggatagctcttcatctcccaaccaacctgccacttttacacaacagaagcagaagaaacaacaggaacaacagcagtctagacaaaatgagccacaaaggaaccgtggcagtcaacaagctaagcttatgaagagtttaggacgaggaaacatgatggcccagactcctccaattgactgcacaccaaccaatgctgcttctactccatcaaaaaaccatgtgtctgaaaaactggtgcaacatggccaaggacatttccctgccaatacaacaccagtaccgtcaatgcctcaacctaggctagtcacttcgttgcctcagtcaccaacgaaggtggcagacattggtaaccaaggtttaaaaaagggtggttctttgagtcaggccatgttagctttgcaacaacctccacatggttctaaatcgacattgaccactcagctgcagcagcggcaggtcaatccgccacagaacaacaatgggagagcagtggtgcaacagaaccgccaaatgaactctgactgtaggacagacttgcacgtcggtcaggtccgtcacaatcagatggttccaacatccatgccacagagtgcagattcgtgtagccctgtactgtcatctgtaaaccagcagaagcgtgagccatcgctcaatcagacttcagttacctcgccgtctaacctgcttaggtctcctaaagatacttcttttgggtagccaagacatgctacaaaggcaagttttcaggtggcttccctatacaggctcatggtgttggtgaccagtggaaccaacatggcagagagcaattgcagtctcagcatcagcagagacaaccggttgttcaaggcagtgcatatgctccttcaaattctgggcctggctgatcattaattatttcaggtttgtaggtttgagatagcgagctttctttccattgtaaagttactgtgcaggtacgtgatttgcattatttcaggttttaatgtgagctagattaggtaatttaattgttcgtgtttaatcttacctgaagtggggataggttgcagtctagtagaatgtagaaacactgcttccacttctttagcgggcactgcacttgtgtctgtcgcttctgcgtgggacgagcacgctgccatctcttacgcgagtccaagaggtggtctctgcacacctgatatgttccttttgtatcctcgtagatcatagtatatgtgtttgtacaagttaaaacaactcccgcccatgaatgaattggtactctatctatccgtttggttacctgcatcatgtagttctgagctaccgtttgtattgactttatttgagattctgtttggttgattgtatgttcgagatgtatatcgtatgagtagatacaaaataagtgattttggttgcatacgtttaaaatgtaattatgcagccggccatgatatattgagttaaggttccaaaatgtattgggtgtcatgcaatgctccagcacgtttgctagtttatttgactcggttcttcatgtagagtagcatcttcggagtttttaataaaatgttttagcaagaaaaggcactaattgtagttttgtaataatttgtgttaagtttgagtagttaggaaaaagcacattttaatggctccggctcctcttgatggttccctgc

SEQ ID NO: 939 - DNA, 976 bp, Zea mays
cccccctcgggtcgaccccgccgtcgccggcccccgcgccccccagtaccaggccgccagtcccgacctccccggctccagcccccgcgcacgaccagctctgacgaccccgctcctgcctcccacctcctccggtggcctcgcgcctgactccctcctccggcacccaggccagccgcgccccgcctctcgcacaggacggaaatgatgccttctcctttttgttagctgattctgatcaaactggttagttcgatagagaatatcagtaatatcttgctgcccaaactgcagcttcaactgattccgcgtcaggagcacttagagcaaccatgggggggaaatcggagcagaagtctcgaaaagagaggcggaaagaggcgagatcagagaagcacaagctgcgatttctttcttgggttgggcatcagggtggcaaaaagaagaagccgtcaatgtcagtagtagagccaagttcggttgaggagaagccaaagaaagagcctgatggcatgatgaagaagaagagaaagagggaagcagagggtaagcggaagcccaggtccaacttccaggaatatcttgagatggagatgggtggacctgtgagcatggaggaggatctagagatggagaggaagcttgcaaaaaagctcaagttgaagaaaggaaagttgggaggtcctgatgatggtatggatgacctttttgcggaccttgggtttggtggtgactttggttcagatgatggtgaaacaaaagcatatgattggaatgtggtggaggacactaatttagacaagagaaaaggtaaaaagaaaaataaggagaaaaaggatgacacagtgatggaggaaccagatgacattgatgaagagaatggtcggaaaaagaagaaaaaaaagaagaaggatggtatggagaaggccgaactgggtgccggagggcaggaggatggtcaagagaaagagggaag

SEQ ID NO: 940 - DNA, 1932 bp, Zea mays
gggacccctcgagccggccgggccgggccttcggccacgggccacctaccgacgctccccactgcttggtcccgcgctcccgccctctactgcaggtcagcacccagcaggagggaaagggcgactcgccgactccgaagcccaaaccctcaacctacagcagcgcgccagcgccgctccgcccgcccatgggctcctcatcccactctctcgccgtctcacggcgcggccgcagcgcgcggcagtcccccttctttcgagacctcgccaccccgatcccgtcccatcgtggcgtgtcccgctttgcctcgggggcttccccctcctccaccccaccacccccgccgcccatcttcaccctcgatgaccgctatgcctccgcagacttctccccggaccccaccgcctccgaccttctccccgtcgcgtcgtctccctccccccgcaccgctgccagccgctcgccgccatgggacctgtcccggggcaaggtggcgctctcggcaccaggatcccccatggctggggtcgtcgagccgacccggaaagagatgctcgctttgccggcccctgcgagccctggcaccccacctcctgccgcgacagcggaggcgcagtcaccggtgtcccccgcgcaggcacctaggacggagccggtggcgaacgcaggggaggtcgaacgggaggagtgggtcactgtatttggattctctattggtgataccaaccttattcttcgggaattcgagaaatgtggagtaatattgagacatcactctggtccaagagatggaaattggatccacatattgtaccagcgttcttatgatgctcgaaaggcccttcagaaaaatgttatccaactaagcagcagtctgatagttggagtaaagcctattgatgcagtgcaccggcagcagctggacaagagtttcgctccaagcaatccaggtggatttatggtttccttgccttcgaagtcacttggcttgaagagcacaggcgcatcgaaccagttaggaggctttaaccggctgtatgacctcaaagctaacacaaatgttagccgagatgcaggccgtcgggcaactggcagtgttgctgcaccagcaaaatcaattgtaaccaatgtaatggatttggtatttggcatttgatttggcaatgaggattgaggaccaatgcatccggaaccttctctgtttcttccgtttacttgttcgagaatgcccccattccaaagattcaacagcaaattttgctgaagtctaagcccttacagagtgaactttcttttggcgatgtaacattaatactatgcattttttcacgtttaattgtactaatgttgtctcatgatatgttcatatgtggtccgttgtgtgttaatcaccatgctacagcctacagctcttgtagtgggtgatttttttcatatttttaactggtttgtgtattttttttactgtcgtttaagtgttaccttgcttctgcctccccgctcgaagaggtgctggcgagtttcgtaaaaaaaggaagaggtgatgcttgctggtttaatttttgaaaggttccatttttttccaagagtgtcgtatgatctgagtgccttcagttaaagaaggaaacactcgtctgaagtgttgctttgttgcaaggttccttttttttgttccaaaactgctgcattgtctggagtgttttgaggtgaagaatgaagtgatcctcttcggtgagcatttttttttgttctttcaatttttaaaaatgctatcatctagtgtgtttctgtgatcctcttcggtgagcattttttttgttctttcaattttcaaaaatgctatcatctagtgtgtttctaaattgatgagggactaaagaagtcgggtgattaattgaagtggttgatccttgggaacgtctgcaggtcaa

SEQ ID NO: 941 - DNA, 2351 bp, Zea mays
ctgcagcagcggccggccagcaggagggaaaggacagctccgaagcccgaaccctcaacccccagccgaccccgcccatggcctcctcctcccactcccggcgcggccgcagcgcacggcaggcccccttcttccgcgacctcgccaccccgatcccgtcccaccgcggcgtctcgcgcttcgcctcgggggcttccccctccgcggccccctccgccacgccgccgccgccgcccatcttcaccctcgacgacctctatgcctccgcggacttctccccggaccccaccgcgtccgacctcctccccgtcgcgtcgtccccctccccccgcgccgccgccagctgctcgccgccatgggacctgtcccggggcaaggtgtccctctcggcaccaggatcccccatggatggggtcgttgagccggcccggaaagaggtactcgctttgccgccgcctgcgagccctggcaccccacctcctgccacgacagcggaggcgcagtcaccggtgtcccccgcgcaagcaccggctaggacggagccggtggcgaacgcaggggaggtcgaacgggaggagtgggtcactgtatttgggtgagaaaataatgtttatgctttgctttgtactggattattgcttataaatatgttgacagacgcttatgaacacggtagagttggctaggatgctatggtaattgtttatcatgagttgagtagttgacacactccatgctctctcggcagtcatttgctaaccccaaattgtaggtgccttgtatgataaattgattcagttctgttggtacttctatagattctctattggtgataccaaccttattcttcgggaattcgagaaatgtggagtaatattgagacatcactctggtccaagagatggaaattggatccacatattgtaccaggtaattatacatttatctactgttgtgcttccgtatttctgttgtactatttactttaattttctctaactatgtttcacaaagtagtcatattagcttaggctgctctgtagctaaccagcgagattagttgccagtgaactgaaacaactacataaactcatttgggctcccccattaggttgagtaatattcttggactggtttaatatagggtcaatttttaggtgcacaacatatccttgtgtgtaaatgtgatggtatatgtttttggttatcccttgaacatgaagcatataggaaacttgccttgtgtgtaaatgtgatggtatatgtttttggttatcccttgaacatgaagcatataggaaacttgtttttgggtaggttttcagcgtatcatcctcagggtagcatcacagggaacttataaaatgatgcattgttatgtgtctgctgacgatgggtttacaaatatccttgttaagatgctggaaaataaatagaaatgtcatgtgctttctgaattcccttggcacagtcaagttattaggcttctccagatagcaactattcagagcttttgttgatatcagatattcagtttgttcttttgttgatagtgtcaatttgttgtacatattttctatattgaaatcctgtatggtcactaccaactttaccattctagatgtattgttcggatcgttgtttccagatctcttaattttgagatgttacaatctgtatttatttgactattttgtcacttctgatgtttacatgcatcatagtaaatgtttctagattgctatctgacagtcttaaaactgacaacttcaccatcatgtatgtggtcctgcagcgctcgtatgatgctcgcaaggctcttcagaaaaatggtatgcaactaagcaacagtctgatagttggagtaaagcctattgatgcagtgcaccggcagcagctggacaagggtttcgctcaaagcaatcaaggtggatttatggtttccttgccttcaaagtcactgggcttgaagagcgtaggtgcatcaaaccagttaggagccttgccccgcccatatgacccgaaagctaacacgaatgtcagccgagatgctggccgtcgtgcaactggcagcgttgctgcaccagcaaaatcaattgtaaccaatgtgatggatttgatatttggcatttgatatggcaatgagaaccaatcatccgggaaaataaaaaaaaaatattctctgtttcttctgtttacttgttcgagaatgccagcatgccaaagattcagcagcaaattttgctgaagtttgagagcttactgagtgaacttccttttggcgtgtaacattaaaattattcaattttcacgtttatcgaagttatgtgtctcaaaaaaaaaaaaaaaaa

SEQ ID NO: 942 - DNA, 784 bp, Zea mays
gcgggctggacattgtaaagagatcaaagagtcatcagcagcatatggcagtgatgaagaagaggaagaagaagctgatgtccgtcctaattcagggagtgatgaggacctaagtgaagaagacaccatggagatcgatgaggagatggaagggtctgtggacgaggactgcaacaggtctgatgaggaatatgacgacctggccatgcgggacagtttggagaacggctatttaactgacgatggtgttttctgttctggtttaagcaactcgtcaagcggcaagttctttggtggcaatcaactaagccacagcacgccaaagaaaccccaagagaagttcgatgctggtgttcctgagacgtcacgctcttattctgctgcagtccctgctggtacaagtagcaagcggcatgctactaggaagtggaagcgctcgctcagtgaccccttccgttcacggccgcacagtgctccggaattggtgtcaggatgcaagggatcaccgcccgtgcctgtggctccagaggagaggtagccgatgagctacagaagacgtatcgtgttatgttttttagcataaattgcaaatgaattatgaatattgttatctgaggcatcatggatgtgaaaaaagtactatgcaactaactttttaaggtgttgattttgtaagaggatgtttggtgaaaggaccaagatgtccataggaattgaattaggctaatgtaattttttaataattaaattatatcaaatagttcactcgaaaaaaaaaaaaaaa

SEQ ID NO: 943 - DNA, 2159 bp, Zea mays
cctcgaggccggccgggattctgtttcgacccgccggcatcccgtcactctcgtcctccccagtcccctccgtggctgtggctcctggctccgctcccagtccgccaccgccgcgtcatgccatgctccctctcctcctcgctctcctcaccggagctgcccctacggtgtcagcatccggggacggttgccgcgtcggctgcccgctggccctcgccgcgtactacttctcagcggagtccaacctcagcttcatcgcctccctcttcggcatcgccgaccacaacaagctgctcccctacaaccccggcatcgtggacccgaactacatcgtcaccggggaacgcgtgagcgtcccgtttccttgctcctgcctcgggctccccgctgacccagcctccaccttcctcgcggggtcgctcccctacacgctctccggcggcgagacgtacgacgacgttgcctcggaattcgccaacctcaccaccgcctcgtggctgggggtcaccaacgcggacccggcgggcaagttgcccgccgctgggaagatcaatgtcaccgtgaactgctcctgcggcgacaagagggtatcgccgcggtacgggctgttcctcacctatccgctctgggaaggggagacgctctcctcggtggcggagcaatacggattctcgtctcctgcgcagttggagctgctcaggaggtacaaccccgggatcgggatggacagggcctccgggaaggggatcgtgtttgtcccagtgaaagatgcagacggcagttaccgccctctggaatcagatgctggaaatatcctttctggaggagcggtagcaggaattgtgatagcctgtatcattattttgattgctggcatctggctgtttgcaatgtattataggaagcagaaaatgagaaaagccataccactcacatgtctagaagattctgtccaacttagcaaggtttcacaagatgagggcataaaggttgacagatccatagagttctcatatgaagaactttctgatgctacaaacaactttagtatggaccataagattgggcaagggggttttggttctgtttattatgctgagcttagaggcgagaaagctgccataaagaaaatggatacaaaggcatctcaagaattcctcaatgaattgaagattttgacacgcgtccatcacacaaatctggtgcgcttaattggttattgtgttgagagttgcttatttcttgtttatgaatttattgagaacggaaacctaagccagcatctgcatgggacgggttatgaacctctctcatggaccagtagagtgcaaattgcccttgattcagcaaggggtctagagtatatacatgagcacactgttccagtgtatgtgcatcgagatatcaagtctgcaaatatcctgatagacagagacttacgagcaaaggttgcagattttggactgacaaaactttcagaaattggaactacatcacagtcactcccatcactacgagttgttggtacatttggttacatgcctccagagtatgctcgatatggtgaggtttctcctaaggtggatgtctacgcttttggtatagtcctgtatgaacttctttctgccaaagaagctattgtgagatcaacagaattcactgatgcacaaggcctggtttatctgtttgaggagactctcagcatgccaaaccccatggaagctcttcaggaaatgattgatccaaggctaggaggtgactaccccattgactcggctgtgaagattgcgtaccttgcaaagtcatgcacgcatgaagagcccaggatgaggcctaccatgagatctgtagtggttgctctcatggcgctttcatccaaggaccatgagttaactcggggacacgattagcatagcacattgtccctggggctgctttccatgtcagatgaaaacaatacaaaagctatcgtgtacagatgcaatgtattttcgttctgattttgtagcgcttaagttggctagtaacattgtgtgtagttttctttgcctgcttctctataacaacaaaaaggggatgaccgagcggtctaataagagcccccacccaattaagatgataatggatatggctcggccacttccgagccggcaatattt

SEQ ID NO: 944 - DNA, 791 bp, Zea mays
cattgggtacctcgaggccggccgggagttccacccccgccggccacactcgtctctctcacgagccacagcccacaggtaagcgtcgtcttttcacgccgcgttcccatactctgcgctacagttacagtcacggcgcgtccgtcctgacgctcgccggccttgcatttaccggttctcaccgcctgtccgcgctgcccgtcgccagcaggctagctctctagcggtctagccagtccacgcagcgcagggatggcgtcgttcgccgtggcaacggccccgtcgctagcggccccggcagccaagaggaggcccgccgccggcgtcacgtacgtggagggcatgaacgcctacagcggcctcaaggggctcaacaaggtgaccatgctcggggtgcgcaagaccgccgactactccttcgccaaggtcgtggcgtcgctcagccccgcgggcaggaagcggcgcggcggggcgttcggcgcccagatgaacgccgccgccgagatcttcaggatcgccgccaccatgagcggcctcgtgctcgtcggcgtcgccgtcggcttcgtgctgctccgggtggaggccgccgtcgaggaggccgagtagggcgctcgcgcctgcttcataagccgtgatatatatataacgtgatgtatgctttcgattcaatctttggtatgtactgtatcaacgatgacaattgatgaatactgtggaaaacatgttttcagaaaaaaaaaaaaaaaaaaggcccctacggccgttctaaaaaaaaaaaaaaaaaagcggcc

SEQ ID NO: 945 - DNA, 837 bp, Zea mays
  misc_feature (739)..(739): n is a, c, g, or t
  misc_feature (826)..(826): n is a, c, g, or t
cctatgggccattgggtacctcgaggccggccgggagttccacccccgccggccacactcgtctctctcacgagccacagcccacaggctagctctctagcggtctagccagtccacgcagcgcagggatggcgtcgttcgccgtggcaacggccccgtcgctagcggccccggcagccaagaggaggcccgccgccggcgtcacgtacgtggagggcatgaacgcctacagcggcctcaaggggctcaacaaggtgaccatgctcggggtgcgcaagaccgccgactactccttcgccaaggtcgtggcgtcgctcagccccgcgggcaggaagcggcgcggcggggcgttcggcgcccagatgaacgccgccgccgagatcttcaggatcgccgccaccatgagcggcctcgtgctcgtcggcgtcgccgtcggcttcgtgctgctccgggtggaggccgccgtcgaggaggccgagtagggcgctcgcgcctgcttcataagccgtgatatatatataacgtgatgtatgctttcgattcaatctttggtatgtactgtatcaacgatgacaattgatgaatacagtggaaaacatgttttcagaaaaaaaaaaaaaaaaaaggggcccgcaggcgttcaaaagaagagcgagaggaacgcaaccaaacccatttttaaccacgcggcccctggggtacccccggcctctgatctttacgctggatgatgcgaccnaagatagcatctgtctgaaatgcacaccgtaataacgataaacaaagatgtttcagataaaaaaaaaaaaaaaagcggccctcgagnctcagcttttg

SEQ ID NO: 946 - DNA, 780 bp, Zea mays
ttgggaccctcgaggccggccgggctctctctcggccccgcccattctccgccccgccttatccttccctcatcccccgtacaaaagggggctccctcccgcccggccggccgggaagccacctacaccaccaccccgccggccacactcgtctttctcacgagccacaggcacaggcaggctctcgagctcagtccacccatcgcaggggatggcgtcgtcgttcgccgtggcaacggtcccgtcgctggcggccccggcggccaagaagcggtccggcggcgtcacgtacgtggagggcatgaacgcctacagcggcctcaaggggctgaacaaggtgaacatgctcggggtgcgcaagaccgccgactactccttcgccaaggtcgtggcgtcgctcagccccgcgggcaggaagcggcgcggcggcgcgttcggcgcccagatgaacgccgccgccgagatcttcaggatcgccgccaccatgaacggcctcgtgctcgtcggcgtcgccgtcgggttcgtgctgctccgggtggaggccgccgtcgaggagtccgagtagggtgcgtgggcctgccactgtcggctgtcgccccgggccgcagtctgcttcagaaaccgtgatatatatataaccagatgtacgctttcgaatcaatttactttggtatgtatccatgacaattggaaaaaaaaaaaaaaaaaaaaggggcccgccggccaggcctgcaattgatcgatctcccagtgatcgaaaaaaaaaaaaaaaaagcggcc

SEQ ID NO: 947 - DNA, 833 bp, Zea mays
ccattctccgccccggcttgaccttccctctcccccctcccatggggggtttggtccccccgggccggccgggaagccacctacaccaccaccccgccggccacactcgtctttctcacgagccacaggcacaggcaggctctcgagctcagtccacccatcgcaggggatggcgtcgtcgttcgccgtggcaacggtcccgtcgctggcggccccggcggccaagaagcggtccggcggcgtcacgtacgtggagggcatgaacgcctacagcggcctcaaggggctgaacaaggtgaacatgctcggggtgcgcaagaccgccgactactccttcgccaaggtcgtggcgtcgctcagccccgcgggcaggaagcggcgcggcggcgcgttcggcgcccagatgaacgccgccgccgagatcttcaggatcgccgccaccatgaacggcctcgtgctcgtcggcgtcgccgtcgggttcgtgctgctccgggtggaggccgccgtcgaggagtccgagtagggtgcgtgggcctgccactgtcggctgtcgccccgggccgcagtctgcttcagaaaccgtgatatatatataaccagatgtacgctttcgaatcaatttactttggtatgtatccatgacaattggtgaatactgtggaaatatgtttttgggagtcgaggcctgcaattgatcgatctccaggtgatcacatcaatgaccgagtgagaggaatgcaaccaaagttttttttttgggtgcagaaaaaaatcccttcgatgcgacttttcaaacgttagtattccctcaaaaaaaaaaaaaaaaagcggcc

SEQ ID NO: 948 - DNA, 778 bp, Zea mays
  misc_feature (39)..(39): n is a, c, g, or t
  misc_feature (43)..(43): n is a, c, g, or t
  misc_feature (51)..(51): n is a, c, g, or t
gggaccctcgaggccggccgggaaaaaattttccaaaanaaanaaaaaaanaaaaaaaaaaaaaaccggccaggaagaagcccggccacctacaccaccaccccgccggccacactcgtctttctcacgagccacaggcacaggcaggctctcgagctcagtccacccatcgcaggggatggcgtcgtcgttcgccgtggcaacggtcccgtcgctggcggccccggcggccaagaagcggtccggcggcgtcacgtacgtggagggcatgaacgcctacagcggcctcaaggggctgaacaaggtgaacatgctcggggtgcgcaagaccgccgactactccttcgccaaggtcgtggcgtcgctcagccccgcgggcaggaagcggcgcggcggcgcgttcggcgcccagatgaacgccgccgctgagatcttcaggatcgccgccaccatgaacggcctcgtgctcgtcggcgtcgccgtcgggttcgtgctgctccgggtggaggccgccgtcgaggagtccgagtagggtgcgtgggcctgccactgtcggctgtcgccccgggccgcagtctgcttcagaaaccgtgatatatatataaccagatgtacgctttcgaatcaatttactttggtatgtatccatgacaattggtgaatactgtggaaatatgtttttggagtcgaggcctgcaattgatcgatctccaggtgatcacatcaaaaaaaaaaaagaaaaaaaaaaaaaaaaaagcggccaaaaaaaggggcggcc

SEQ ID NO: 949 - DNA, 850 bp, Zea mays
  misc_feature (811)..(811): n is a, c, g, or t
  misc_feature (823)..(823): n is a, c, g, or t
ggccggccgggtatcgactcccgaccgccattgggcacccccggccggcccggaagccacctacaccaccacctcgccggccacactcgtctttctcacgagccacagcccacaggcacaggcaggctctcgagctcagtccacccatcgcaggggatggcgtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcgggcaggaagcggcgcggcggcgcgttcggcgcccagatgaacgccgccgccgagatcttcaggatcgccgccaccatgaacggcctcgtgctcgtcggcgtcgccgtcgggttcgtgctgctccgggtggaggccgccgtcgaggagtccgagtagggtgcgtgggcctgccactgtcggctgtcgccccgggccgcagtctgcttcagaaaccgtgatatatataaccagatgtacgctttcgattcaatttactttggtatgtatccatgacaattggtgaatactgtggaaatatgtttttggagtcgaggcctgcaaaaaaaaaaaaaaaaaatgagcacatcaatggccgagtgagaggaatgcaaccaaagtttttttttttgggggtgcagcttatggtcccttcggtgctagttttcaaacgttagtattccctctatcgatcccgacnataaatacgatnaatattctatttaatttttaagcacta

SEQ ID NO: 950 - DNA, 4735 bp, Zea mays
  misc_feature (4521)..(4521): n is a, c, g, or t
tggtctggtctggtttctttctgaaacgtttcttctacttacgtccatttgcgtgcgatggtggtaaatatgcagcgcaatttgagaatgttccgagtggcatggcatcgatgaccaggaaatccgtcctgccagtagcaataagctgattgagttacgcaaaacccgtctctgtcacggactgatgtcgtattccttgtggactgtatgacagaagaattgtgacctggtttattttaccattaatcaatctatagtgcagctgcaatctataaagataaaataccgtagaagccatgatcatagtcggattaaagcctagatcggattaaagcagcagggaacaagctggtttgttggtggggccccttgagctctttcaattcaggtccggccggggaacgaaataattacgcaaacagccacctgaatcgttgtagcgtacgtgccgaaaattggtgggtgctttccaattttttaaaatcatccaagtcattctggtacggtcggtgacctcgctcacctagccacctgaatcgatatgcaagaatctagaacggagaatatcacaagaaacccgtgtagggaatgaggaggaagcctgtaagcgaaagggacgtgcagagtaggttccaaactactcatctgtcgatgaaaataaattgacctctgcactccacaagcgtccatgtcaacttgcttccttgttcttgtttgcgtctttgcagaatagcatctccgccagttcatccggactggttggtacccatcgtcgaagagttcctccggccaagcatttcatcaaagtccaaaatgtgatcacaccctttatcactaatgaacctgaaatgataacttacccttgcttatattcctaagattatcatggccccataatacaagataaaatccccttcagctagccactgcatgctaagacagcctaacttttccaactctttggcccattaactagtgaaggaaactgttatgctagttactctcactactagagaaacatgctgtagtcagtcctggctgtcttgaacagagactaaacagcctactactaggctaaaggaaataataacacaacacaaggcctttcactaccttattgactttatgtgtgataagtttctataaactaaagatgattgttcttatgcattgctcaccgttcttgtttgacaccaggttttttcacgcacattgatgggcaaaaccgttctcccccttctgtaattgtcattgggggagggatttcaggcatcgcagctgcacgtgctttgtcgactgcttcatttaaggtaaatttcttgtttacattcctcaagcagctcaggtgtttgatgcttatacgaagctaaacaattgcaggtcacactcttggagtccagggaccgacctggtggccgtgtgcacactgactattctttcggttgcccaattgacatgggagcatcatggttagttgcgtctcaaagctaatgttttagctgctgttatccaccttgccttgattttttttttgcagtacgatcttatgctttcgtcctgtgattcaggttgcatggtgtttgcaatgagaattctttggcaccactgattaggatgcttgggcttaggttatatcgcacaaccggtaaagaggaatttggtatgcccatgatttggaaaggtaatagataatccataatggcaacacgtgtggtttctgttaagtcgattggcttcccttcccttatagttaccattttttttttctcttccttctccagttatgctctttttgataagcatggtcagcaagttccccaggagatagtaagcaaagttggagagacatttgagagaattcttaaggaggtactgcagtcgttagcacttaacattatctattcaatgcttttgtggacatttgtgataagcttacttcttgttaatgtttcagactgtcatagtaagagatgagcatgcaaatgacatgcctctttttcaagccatagcgatcgtgcttgacaggaatccgcatatgaagtaagtggaacttaggatccacctgattgtgtcacagggatttgtcaggtcatgtgatggcgtgcacttacattcacaggctgcagggcctggaatatgacgtcctgcagtggtgcatatgtaggctggaggcatggttcgctactgacatggacaatatatctctgaaaacttgggatcaggtatgcagtgcagaacagaacttgcagatactgcacatacgggatgtgctttattctttgccagaatcatgccaaggatgagtttacttgccagaatcagagctgcatcagcaagcacacactcgcatgaaaagcgcgctgagctttgcaaatttgcaggaacatgtgcttaccggtggacatggtcttatggtgaatggctacgaccctgtcatcagagctctcgctcaaggtctcgatattcacctcaaccacaggtgtgcagaagaaccatgcatcatgtgatgtcaaattgatgaatcccaaataaatagcttgctcactgtctcttcttcgtcttctttgttgctcagggtcacaaagatcatacaacgctataacaaggttattgtctgtgtggaagatggggcgagttttgtcgcagacgctgctatagtaaccgtccctctcggggtactcaaggcaaacatcatcaagtttgagcctgagctaccgaaagagaagctctcggcaatcgccgaccttggcgtcggtatcgagaacaagatagctctcaagttcgacactgtgttttggcccgacgttgaagtgataggtagggtggccccgacgtcaaacgcctgtggctactttctcaaccttaacaaagccacaggaaacccggtcctggtgtgcatggtggccggaaggttcgcgtacgagatcgagaagctgtcggacgaagagtccgtgaacttcgtcatgtcccagctcaggaacatgctgccgcaggcaactgacccggtaaaatacagcactggaaaacacagtacatgctttcggttccagactgtatggtgggtggatgatggttccatggctcctgacgtttttttgggttctcttctccaggttcagtatctggtctcgcgctggggtagtgaccccaactcacttggctcctactcgtgcgacctggtggggaaaccagctgacctgtatgaaaggttctgcgctccggtgggcagcctgttcttcgccggggaggctgcctgcattgaccactccggatcggtgcacggagcttactcgtcaggcatcgctgccgcagaggactgccgaaggcgtctgtcggcgcagctaggcatctcggccggcctgttccaggtcgggaaggctgccatgagggaggagatgacggctgaagccatggtccccttccagatatccaggctgtaagagagaatctattcaacaccgtctttgtgtcaccggtttgttgcttgatgtaattgtaaaatggtgtaagaccttgtttgttggaatattcgatggtggatgctgtttttcgtcaggtaaacaacagaaaaagctgggccagatgaatgaatattcgcattgcgcgctgaacgcattcccatccaccagccctccctgcactgcagcctgccgaccactccaatccacgagctctcgctgcactgcagcttgccgaccactccactccacgtacacaatgcaaaagcccgagagggaacccttccacaatccacacccgtaccatgaatctaatcggcacaacaaaatctgtcattcagcgcagactttctatttcagtctccagcagactttctattgactctgggagcgtttggttgtcttcctggatgcaactatatctgcatatacaaaatgcagtgtttgcttggttcgctgtatttcaaaagacaggccagcacgaacctcaaagaaccacgagccaagtccggcgggaacggtcgcacgcgcgaggccaggcttgactgagcggttgtttactcaaacacgcaaatcaagacgttggttttgttggttttttatatcttgtagttaaaagatttaattaccgagccgatttcatatctgtgtttctgatatttttacgaacaaaactagacactacacatgctatgtatattttaaataaaaaaattacatgattaagattagtatataattagtgtttattaacatgtagttagtgtccattaaatgattttaacatataattactatctattaatataattttcatttatttaataactttttaaacgcatacgacaaatattcatacatacaaccaatcaacatctgtcatgaaccagactgatcacatgcagacaaccaaacaaaagaagatgcatgtgtctagctagaccagtcagagctaggctcactagatacgagccaggctcagccatgcaggcaacaaaacaggccatgtatcactatctatttcaaactccactaacaatactccagtacatccatattagcngatggttagaattacagttgttgtcaaccattgaaaactggtatcttgtgtgatgtccagtgtaccaccagacacgttggcatcttatgatgttctctagcttgcgctccaaactctctaagtactatgtctggtacgatatttgatgcttcaacaaacacaatcgatgcttggtataagggtatacctgtctgttcaatacattggctgcatg

SEQ ID NO: 951 - DNA, 2218 bp, Zea mays
cacggcgcggcgcctccgatttttttcacgggggagcgcccggggcgaggctataaaaaccgcgtctcctccacgccacctccgcaccgcagagagaggacagaggagcgagccatcatccccccccgagccgtgccaaccaagagccatccacccaccaccaccaccccggccgcttccttgtccctgcccctccgttggtctcctttgcccatctcatcctctctctctctctccctctctctctctctctggcggtcggcgtggctccgggggcgcgaagcgcgggctcggcggggcgactcgccggcggcgacctgcaggtttgggtatgagaggggtcacccacgcggcgcccaccacaagcgccccccgcccccgcggacgcctcatggacggcctcctcatcttcgtcttctacctctcgctgcccacccgtgccggccgcgaccactcgtcaatcgccgcctctaattgttagccgccgccggcacgccattgctcggcacgcctcccgagaagctcgatctgcggcctagccagccagcctcacgcgggatcaggatcgatggaccagccaccgaatggattcgccgccggaggttttttcacgcacattgatgggcaaaaccgttctcccccttctataattgtcattgggggagggatttcaggcatcgcagctgcacgtgctttgtcgactgcttcatttaatgtcacactcttggagtccagggaccgacttggtggccgtgtgcacactgactattctttcggttgcccaattgacatgggagcatcatggttgcatggtgtttgcaatgagaattctttggcaccactgattaggatgcttgggcttaggttatatcgcacaagcggtgataactctgttctgtatgaccatgatttggaaagttatgctctttttgataagcatggtcagcaagttccccaggagatagtaagcaaagttggagagacatttgagagaattcttaaggagactgtcatagtaagagatgagcatgcaaatgacatgcctctttttcaagccatagggatcgtgcttgacaggaatccgcatatgaagctgcagggcctggaatatgaagtactgcagtggtgcatatgtaggctggaggcatggttcgctactgacatggacaatatatctctgaaaacttgggatcaggaacatgtgcttaccggcggacatggtcttatggtgaatggctacgaccctgtcatcagagctctcgctcaaggtctagatattcacctcaaccacagggtcacaaagatcatacaacgctataacaaggttattgtctgtgtggaagatggggcgagttttgtcgcagacgctgctatagtaaccgtccctctcggggtactcaaggcaaacatcatcaagtttgagcctgagctaccgaaagagaagctctcggcaatcgccgaccttggcgtcggtatcgagaacaagatagctctcaagttcgacactgtgttttggcccgacgttgaagtgataggtagggtggccccgacgtcaaacgcctgtggctactttctcaaccttaacaaagccacaggaaacccggtcctggtgtgcatggtggccggaaggttcgcgtacgagatcgagaagctgtcggacgaagagtccgtgaacttcgtcatgtcccagctcaggaacatgctgccgcaggcaactgacccggttcagtatctggtctcgcgctggggtagtgaccccaactcacttggctcctactcgtgcgatctggtggggaaaccagctgacctgtatgaaaggttctgcgctccggtgggcagcctgttcttcgccggggaggctgcctgcattgaccactccggatcggtgcacggagcttactcgtcaggcatcgctgccgcagaggactgccgaaggcgtctgtcggcgcagctaggcatctcggccggcctgttccaggtcgggaaggctgccatgagggaggagatgacggctgaagccatggtccccttccagatatccaggctgtaagagagaatctattcgacaccgtctttgtgtcaccggtttgttgcttgctgtaattgtaaaatggtgtaagaccttgtttgttggaatattcgatggtggatgctgtttttcgtcaggtaaacatcagcgtcagctgggccagatgaatgaatcttcgcattgcgcgct

SEQ ID NO: 952 - DNA, 1636 bp, Zea mays
  misc_feature (1625)..(1625): n is a, c, g, or t
cactggcactcaccaaacaacctgcatctttcttctccggagtttccttttctcccaagaaccatcattaaagaaaaaaaaacttttagcaccttaccatctgggccggctgatatgaacgaacggtcttccggtactcaccaatccctgtcccattctcgccgtgcagacccgctgtcgctggtccgggactaccgcgtcaaggagcagctggcggccgagggcatcgacgtgcagtccttcaatgccgatctgctgtacgagccgtgggaggtcctcgacgaagaccgccgccccttcaccatgttcgcgccattctggaacaggtgcctgtgcatgccggaccccgccgcaccgctgctgccgcccaagaggatcaattcaggtgacctgtccaggtgcccgtgggacgagctggtctttgaggacgagtccgagaggggcagcaacgcgctgctcgcgcgggcgtggtcaccagggtggcagaacgccgacaaggcgctgacggccttcctcgacggtccgctggtcgactactccgcgaaccacaagaaggccgacagcgccagcacgtccctgctgtctccgtacctgcacttcggcgagctcagcgtccgcaaggtcttccacctggtgcggatgaagcagctgatgtggagcaacgacggcgaccgcgccggcgaggagagctgcacgctattcctccgcgccatcggcctgcgggagtactcgaggtacctcaccttcaaccacccctgcagcctcgagaagccccttctgtcgcacctcaggttcttcccctgggtcgtcgatgaggtgcacttcaaggtctggagacaagggaggactggctaccctcttgtcgacgctggcatgagggagctctgggccaccggctgggttcacgaccggatacgtgtcgttgtctctagcttcttcgtcaaggtgctccagctgccatggcgctggggcatgaagtacttctgggacaccttgctggatgctgaccttgagagtgacgcactaggctggcagtacatttctgggtctctccctgatggccgtgagcttgaccgcattgacaaccctcagtttgaagggtacaagtttgatccgcacggggagtacgtacggcgatggctaccggagctggcgaggctgccgacggaattggatacaccaacccctgggatgcacctgagtctgtgcttcaggctgcaggagtcgagctaggctccaactacccacgccccattgtggagttagatgcagccaattccaggttgcagggtgccctgtcagagatgtgggagcttgaggcagcctctcgtgctgccatcgagaacgggatggaagaaggcctcggcgattccacagatgagccgccgatcgacttccctcaagaattacggatggaagtggaccgacaaccagctcaacctgctatcatccacacgtcggtagtggctggttggagacgagaagaccagagggtgcctagcatgacttcctcgttaattagagctgagaccgaactcactgcagactttggcaacaccagtgaggacagtaggccagaagtgccgtcaaacattcatctgcaggctttcccggggggggtgttnctagatcgcga

SEQ ID NO: 953 - DNA, 1845 bp, Zea mays
ccggccggggggggagcactgtcccaatggctggccgccgttcgccgtcggcggatcccggtctcggtctctgcgaagctcccgaaatgagatccggtggcgctttagagccctcgtccgttccaatacgcagtcggatgctgggttacgctcgcctctaaataaataccgggcgcgtaacgttcctccgctccatcggcctgcgggagtactcgaggtacctcaccttcaaccacccctgcagccacgagaagcccctcctgtcgcacctcaggttcttcccctgggtcgtcaatgaggtgtacttcaaggtctggaggcaagggaggaccggctaccctctcgtcgacgccggcatgagggagctctgggccaccggctgggtccatgaccgcatacgcgtcgttgtctcgagcttcttcgtcaaggtgctccagctgccatggcgctgggggatgaagtacttctgggacaccttgctggatgctgaccttgagagcgacgcgctaggctggcagtacatttctgggtctctccctgatggccgtgagcttgaccgcatcgacaaccctcagtttgaagggtacaagtttgatccgcacggggagtacgtccggcgatggctaccggagctggcaaggctgccaacggaatggatacaccatccctgggatgcacccgagtctgtgcttcaggctgcaggagttgagctaggatctaactacccacgccccattgtcgagttagatgcagccaattccaggttgcaggatgccctgtcagagatgtgggagcttgaggcagcctctcgtgctgccatggagaacggaatggaagaaggcctcggcgattccatcggatgagccgccgatcgacttccctcaagaactacggatcggaagtggaccgacagccggttcaacctgctatccacgcaccgggagtgactggtcggagacgagaggatcagatggtgcctagcatgacttcctcgttcattagagctgagaccgaactcactgcagattttggccacaccagtgaggacagtaggccagaagtgccatcaaacatccaccatttgcaggctcgcccggagagggaagagacagttgacggtggcactggcaatgctgtcagggtgcatggcaaccatcaccagcagaaccttcagaacaacatgcaccgcgtgctaggtatcgctccatcgatttcagaggcatcaagcagttggacgggcagggatggtggagtggtaccagtctggtcgcctccggcagcttcgggacactctgattcttatgctgccgatgaggctgacatttccagtaggggttatctggacaggcatccacagtcacatacgatgatgaactggagccagctctctcagtcattgacaacagggtgggaagtggataattagcgctgtgtgtccggatttaattgcttaggatttcggcagagagaattatacatatgtaaattatcagattttgttcgtctatatagccttggtgtgcatgcaagtcatcaatcatgcagcttcctggatgcaataatggttatgtgaagctagttgtacagaaccttgtggtataggttgctaggtgtccacaagatatatgtattattcgtcagaagagttttctagcatcaggttcattttgtatctggttactgtcttattatagtctttggtgatgacaaaggtgtgttctcagtttggtagacaaagaacatacctgctatcggtgaggacccaaaagggaacatcttggcagtgagattgggtgccactcttacctgctgctagttttgccgaagtaaagaagtttccgcatg

SEQ ID NO: 954 - DNA, 2079 bp, Zea mays
cattggactcaccacccccggccgagcgaattgaagaagctccccctctgaactgaagcaatggcaggcggcaatgccggtggcgccgctcgagtcctgttctccatcctcggcctggcgctggcgctgccgctgccgctgctcgtggccggcgacgacccgtaccggttcttcacgtggacggtgacctacggcgacatctacccgctgggcgtcaagcagcaggggatcctgatcaacaaccagttcccggggccgcagatcgaggccgtcaccaacgacaacctcatcatcaacgtcttcaacaagctcaacgagccgttcctcctctcctggagcgggctccagcagcggcggaactcgttcgaggacggcgtggccgggacgacgtgcccgatcccgccgggctccaacttcacctacatcatgcaggccaaggaccagatcggcacctactactacttcccctcgctggccttccacaaggccgccggcgggttcggcggcatccgcgtgctcagccgcccgcagatccccgtcccgttcccgccgccggccgccgactacaccgtcctcatcggcgactggtacaaggccaaccacaccgacttgcggtacgtgctcgacagcggcgtggcgctcgggttccctgacgggctgctcatcaacggccggggcttgaatggctacaccttcaacgttcagcccggccggacgtaccggttccggatcaccaacgtggggctggccacgtccctgaacatccggttccaggggcacaccatgaagctggtggaggtggagggctcgcacaccatgcagaccacctactcgtccctggacgtgcacctgggccagtcctactccgtgctgctcaccgccgaccagccgggctacgactacgccgtcgtcgtctccacgcgcttcacgagccggatcatctccaccacggcggtcctgcgctacgccaactccgccggcagggcgccgggtcccctccccggtggccccaccatccagatcgactggtcgctcaaccaggcccgctcggtccggtggaacctgacggccagcgggccgcggcccaacccgcaggggtcgtaccactacggcctggtgccggtgacccggaccatccgcctggccaactcggcggcgaccatcggcgggaagcggcgctacgcggtgaacggcgcgtcgtacgtgggccccgacaccccgctcaaggtcgcagactactacaagatcggcggcgtcttctccgtgggcaccatcgccgacagcccccccgcctacggcggcgccgcctacctgcggacgtcggtcatgggcgccagctacagggactacgtcgaggtcgtgttcgagaacggcgaggacgaggtgcagtcgtggcacatcgacggatacgccttctgggtcgtcgggatggatggagggaaatggtcgtcggcaagcaggcagggctacaacctgagggacggcgtttcgcggtacactgttcaggtgtaccccagatcgtggacggcgatttacatgcccctggacaacgtgggcatgtggaacgtccggtcggagaactgggccaggcagtacctggggcagcagttctacctccgcgtctggacgccgtccacgtcgttgcgcgacgagtaccccatccccaagaacgcgctcctgtgcggccgggcggccggacgccggaccaggccgctgtgagagtgacactgccgccggatcattcacagcttttgtcatgagaggatgacacactattggtttggtctttggagaagagcaggaacatacacaagtttatataccctcaactgaagggaggttcagaggaacgaaagtgttgcttgccgattttttttcattttagtttttttttccctttaaagtttcatatttacgtctctgctgaactaaaaccgtgttggaatttctgggtcaacactataacttatactccctccgtcccaacatagtatttgttttagagtgttaacggattcatgcaaaaaaaaaaaaacaagtatcatacatgtgtctagatttaccgttatctatttaaat

SEQ ID NO: 955 - DNA, 1491 bp, Zea mays
  misc_feature (2)..(2): n is a, c, g, or t
  misc_feature (12)..(12): n is a, c, g, or t
gntgttcttagnatacttatagatgtgttggctggaacattagctctgacaagatagaagcttgtttgttctgttatttagtcatgtctgcccctcaaactactgaaacctaaaatctgaaactgaaaatctgaaaatataaaactaaaaatatgaaactgaatattgtatgtcatgtttgtgtcatgttttcttagactgcattgaactccaacagagactgagaaacatggaattatagctagaacttggatctatggctgtgatattcttgcttgcggaaacttggaattatagagagacggaaatactttttaaattagaatctaactacaattcgatttagttcaagtcaatattcagagttctactttctggaattattcagagttcagttattcaaagttattaatagctatacttagccacccatgatgtagtcaagaaaaaaataactgaactcttctgcttataatttcaactatattaatagatattgttatcaggtgtttaaaaagaatgtggtcatcttgtgtgacatttgtgttcttaaattgttgctctgcttataaccttttttacaatgtactcatcagttctatactcgcagccaaaatctatagtgggaactcctgcatacattgctcatgaggttcttctgaagaaggaatacaatggaaaggttttatgcgtagtgtcgttaattattctacacttgacatactgtttttgtttagtgtgcatgttattattctccacttgaacaacatgtttgtttgtcaaaacattttatacacgcacgatttgtagtcatgcataacagggaactatgttggaaggttcgaatgctaaattagtcactaactctttgttactgaactaaggttgctgatgtgtggtcatgcggagtgatgccatacgtgatgctgacgatcaccatccctgagataagaaaccatccatggttcttgaaaaacctcctagctgaccaaatggatgacaatacgatgagtaagcagtacgaggagcctgaacaaccgatgcagagcatgaatgagttcatgcagatcctggttgaggcgaccattccagcagttggttcacgtggactcaatcagtttctgaatgatgacattgacctcgacgatgacatggaggacctagactcagatgccggtcttgacctggaaagcagtggggagatcgtgtatgctatttgacaacattgaatactttgttgtgtcgtaggttaccaagataattagagacaaggggcaggttgttgtgcttgcaagtatctgttgcagctgttgttcatgcctgatgttgatgcctcttttcatactgttgtgtttggatggtgtaccaccagtgttttacaacagtttggcccttggaattgctattgctaaaacttggttcctctgagaagaccttttgttttaaaaaaaaaagaaaaaaaaaaaaaccgaggggggggggtgtgtaccc

SEQ ID NO: 956 - DNA, 921 bp, Zea mays
gtcgctgatgtgtggtcatgtggagtaacgctgtacgtgatgctggtcggtgcatatccgtttgaggacccagatgagcctaagaatttcaggaagacaattcagagaatattgggtgtgcagtactcaattccagactatgtccacatatctccagagtgccaaaatcttgtctctaggattttcgtcgccgacccagccaccaggatcaccatccctgagataaggaaccatccatggttcttgaagaacctgccagctgacctaatggatgacagcacgatgagcaagcagtacgaggagcctgagcaaccgatgcagagcatggatgagatcatgcagatcctggccgaggcgaccattccagcagctggtccccgtggactcaatcagttcctgaacgacggccttgacctcgacgatgacatggacgacctggactcagataccgatcttgacctggaaagcagtggggaaatcgtgtatgctatttgacagcagcgaggcaatgtgtatcatcagtcgtgctcagatcgtttgttgcgccgcaggttaccgagataattagagagacaggggggaggtatctgctggagatgctgctcgtgtctgatgccgtgatgccccccttttttttcatcctgttatgtttggctgttgtttggttgtggtgcacctccagtgttttacaacagtttggcccttcggaattggttgtgctagaacctcgtccatctaagaagaccctttgtttttgcatccccagctaagagacagtgaagtacttgtataattatactgtttgtgtcatatgtatttggtgtaggaaaataaagaaactccattgcccgttcttgtacaaaaaaagacccacgaagcggccgagaaccctctcaattttagtgtctttttggctgctgt

SEQ ID NO: 957 - DNA, 1394 bp, Zea mays
gggatgagaaaggggttcatgcatgtttagggcacctgacctggctgcccaggtaacttgtgattggtgtaccgtactaaagtttttaccaatccaccactattgcgtctaatgttcagcttcactttctagcatgagtgtcaacacatgttctgatcttgtatatgtcactcagggtaagaaaaaaagcatgatgagtgtttatgtttctgcactcacatgcagtgcacaacagatagataatgtggtcgtagcagcaatcagtcgaagaaaaacccacaaccaggcattgccacggcaaatgttctcaacagctgaaatgaacataaatacaaatcactaaccataaactgacaataatacagtttagcgcatccaaggactctgttctagatacagttaggagaacagcacaaccataagcataaaactgtacaatcccaacaagatgaagagctggagagagacagataatgcgttaacacctacggacagaactatacctatgttcaaactgatttgaggctgaactgaggtggtcgatggtaaggacatcaacctgctaacagcacgatcagcagtacacactggcagcctcacttcgatgcaaccttgcttaaccgcaatccttcgcataaatttgacagatatgaagaggggtgatctagaacttgatcagatttggtgtcaaaatttgatgtccctaataatgggggatatatgcttctaaattctacattcggtccgcctgtgaaatctggtaggatcccagatcacttctcttcaattttgctaaagcttgcaaggctgcccataaaaaagaccaacaagggggttccacaggtgcgcatgaacttgattctggcattttacctgctgaccgtgtatccagggattctccagggtgttcatgcgcatgcagtcactatatagtagtgaggagaacatgaccattcctgcatgccatgacaccagccactcaccgaacagcagacgtgtatggagacagaaagtactccctaatgcgtgaggccccatccctggctagcatgccctcgaggtctccaagaattcttgccagccaaatctccaagcttcgctggatttccttgaagttattccttattgaactaagtgctcttcttgtgcacattttggcttctgctgttagctcatctccaaagctgccttttgcggtctctgcttgcagtgtgccgagcttctgcctggtttcagttgcacgatgctgaaggtgaaacgcttccagcaagaattctgtttgccgctgtgttctaaactccgagttaagtgttgaatcacaagggtcacttgtttgctgcacaaatacatatccgttaggtttcaccttctgcaatagttcaataataagaatt

SEQ ID NO: 958 - DNA, 1701 bp, Zea mays
cgggattcacgaccattctagttcacactcaattcggtcgttttctgcattaacggagtcaggcccaggcctaacctcagttcatccgagcagccgaacacgcccgccgccattctacgccctgctgcccaggtcggacggaccctttgccggagacgagcacacgccacagcaggaattatcgggcgtagagcagcgcgaagcgagagatccaatggcggcggcggaggggcagtgggtgctcatggcaacggggcggacgccgactaacattgcggtgatcaagtactgggggaagcgggacgaggcgctcatcctccccatcaacgacagcatcagcgtaacgctcgaccctgaccatctctccgccaccaccactgtcgccgtcagcccctcattcccttccgaccgcatgtggctcaatggcaaggagatctcgctattaggaggaaggtttcagagctgcctcagagaaatcagaaagcgtgctcgtgactttgaggacaaggagaagggcgtcaagatcaagaaagaggactgggacaagttgcatgttcacatagcctcgtacaacaacttccccactgctgctggtttggcctcttcggctgctggccttgcctgtttcgttttcacccttggaaagctgatgaatgtgaaagaagattatggagaactttcttcaatagcaaggcagggatctgggagtgcatgccgcagtatatatgggtggttttgtgaaatggtgcatgggagaaaaagatgatggaagtgacagtattgccgtgcagcttgctgacgaaacacactggaatgatcttgtaattattattgcagtggtcagttcaaagcagaaggaaaccagtagcaccagtgggatgcgagatagtgttgaaacaagtcctctcttgcagtacagggcccagacagtggtgccaggtcgggtgttgaaaatggaagaagctatcaagaaccgtgactttgaatcatttgccaaattaacttgtgcagatagcaaccagtttcatgctgtatgcttagacacgagccctcccatcttctatatgaatgacacgtcacaccggataattagccttgtggaaaaatggaaccactcagaaggaaccccacaggtcgcttacaccttcgatgctgggccaaacgctgttctaatcgcccaaaaccgtaaaactgcagcacatttcctccagaagctcctatactatttccctccacaggataatgatttgagcagctatctggttggcgataaatcaattctaggtgacgccggattgcattccatgaaagacgtcgaggctcttccagcacctccagatacgaagataccggatcagaaattcaagggcgatgttagctacttcatctgcagcaggcttggggcaggtccaaaggttgttgttgacgaaggtcaagcactgatcgattcagtcaccggacttccaaaaggcgtgtagttctagatttaggttggaataatggtttaagctggggattaaagacaatggtatcatacaagcaacctgggccggccaataaagatagaacacgttctcgccttttgtttttctccctcgcctagtatgtggctgaaatatttgtttcgctattttattgagcacttcagctgagacgcaagcggagaataataactttgtatggccaaaaaaaaaaaaaaaa

SEQ ID NO: 959 - DNA, 3756 bp, Zea mays
agtcgcaccatgggcagaaccaccagatgcaccaaccaccaagtcgtggtcacatcttgtagccccacgtgccatggagacaccagcacctccgttgagacattgtggctccacggtgcagcaaggtgcctagacttgatcgactaattgtcattgtgttgcaactggcctcgttgttgcgtcgtatgtcgtccgtcgtccgaggcttcaatccatcgtagtcagggcgttaccgtatgctaggacagacaaccaggggcaaggtctcatcgtgccaatgtccaaacctacctagctagtggtcacccgacctgacctcccctactttactgcttgcagtactaggctgcatatggagcattagtgattagaaaataccaaagaacacaagtagcccgctaacaaatgagcaaccaccaacatatacatttcgatttaaaacttttaaaatagttgtatgaaatttgagtttagtagactagttattgaatcagttatgaccatagtgtgtgtttaatcatatgctatacatatatataattaaatatatatgtcgatatatatgttttaatcttctaaaaatcatcctataaaaaattttgaatacccacctctaaattctaggccagccactgtatgtccttgattacatcagcttgctaaaacatccatggaaaataggggaaacagtattcacgaccattctagttcacactcaattcggtcgttttctgcattaacggagtcaggcccaggcctaacctcagtacatcagagcagccgaacacgcccgcggcaaccgccgccattctaccccaggtcggacggacccttgccggagacgagcacacgccacagcaggtatgcccgtccctcttctgtgcaaaactgcgcccccgaccccaatttaagctgttctgtattcggatatgatctaatcactagtgtaatcgtatgcatgtattatgcctactaacttccctttttggcaaggaattatcgggcgtagagcagcgcgaagcgagagatccaatggcggcggcgggggggcagtgggtgctcatggcaacggggcggacgccgaccaacattgcggtgatcaagtactgggggaagcgggacgaggcgctcatcctccccatcaacgacagcatcagcgtaacgctcgaccccgaccatctctccgccaccaccactgtcgccgtcagcccctcattcccttccgaccgcatgtggctcaatggcaaggtgtgtcatcgccagtaccccttctctgctcgctaatttgtctctaccgctgcttcgtcacctcagtggtctgttcattagggagggaaaaaacactacacactggtttggtggacaggtaaatgaaggatccatgacggaggaatcccatcgctatttaattttgaatagaggggattcctccccatgcatctcctccatttccatgcccaccaaatcagcactacatgccttttgttttttacgtgtcactctggaatctggacgttgactaagtggcagataaagaattctagtatataggactttgatttgacgataaatggtataaattcgaaacgatggtcctcttgattactttggtatttggtttggatgattgagcaggagatctcgctattaggaggaaggtttcagagctgcctcagagaaatcagaaagcgtgctcgtgactttgaggacaaggagaagggcgtcaagatcaagaaagaggactgggacaagttgcatgttcacatagcctcgtacaacaacttccccactgctgctggtttggcctcttcggctgctggccttgcctgtttcggtaaagtttcttctgctatcatcataatctgattgtttccctatgttctcaacataagttgtcatgacttctggctatccttacaatgatttgactgtttgttggtctgttgtattagcaaaaactacaacatgaaaatgttttaaaagttcacagcaattttactagtgttgttctcgtgtcgccttcctcgtgctttttaccaatttggagcccaagttggaatgcgtgcctgcagatgcatcaaaacgacttattaggagcagatgtagtatttttctagtttctttttttttcattttgtcctcctgtgactgacattaaaacatgaaaaatatatttagggacagatagagattgcgaatgtaagttttctccctttattttcactaaaaacatggaaaatagtactattcgagtattactaacttttggtcactggtatctttccccattactataatagctactcggcatgcttctctggtagaaaacagcagttccttggaaattcataacttctattcaaggccaaataacggttcacgatttcttagttctccataaagatttgtgatcatgtatcaccacataagcatttgttattgaatgttgctgcagttttcacccttggaaagctgatgaatgcgaaagaagattatggagaactttcttcaatagcaaggtctggtcatgttttggtaaaatgattttatttttattcttgagatactgcaagggctgtactaagtttgtcaatctgtgcgctaataacttgtgagtcttgcaaatccatccttgtattttatcaacttcattcaggcagggatctgggagtgcatgccgcagtatatatggtggttttgtgaaatggtgcatgggagaagtgagtaatcatatggtcatgacagagaaaaaaccctgtttcgatgtatgtctggcctgttcaataatgactgagtgaggcctgattgtttgcttgcagaaagatgatggaagtgacagtattgccgtgcagcttgctgacgaaacacactggaatgatcttgtaattattattgcagtggtatgtattgactctcttattgttttatagctgtgcctttcctccatattgtgctctttctgatcataaattgttgacacgttcatctgtggaatcaggtcagttcaaagcagaaggaaaccagtagcaccagtgggatgcgagatagtgttgaaacaagtcctctcttgcagtacagggcccaagttgactatattttcattctaggggaccttgaattgtcttcagctttaactatttggagactaaagtgctaaaaagatcatgatttactttcaattttggaattttaatattgtaagtgttttggcaatttgatttgttgctttgactattatttcttttcctatgattaacgtgtgctgcactggttgtccatgtgtttcagacagtggtgccaggtcgggtgttgaaaatggaagaagctatcaagaaccgtgactttgaatcctttgccaaattaacttgtgcagatagcaaccagtttcatgctgtatgcttagacacgagccctcccatcttctatatgaatgacatgtcacaccggtatacgcttttatcagtgtgttggcttgggttttatgttaatgctgaaatctgaggcaatttctttttctggtctcaatcaaccacaggataattagccttgtggaaaaatggaaccactcagaaggaatcccacaggtatttatattgctcttgaacatctgttagctttttttaaaaaaatgttaccttataaattactgtaacatataataagctctgttcgtcagttgtgctaccctagttggatattgctcaaataggacaaaaccgttgaataagatttgatacacgaaaccatcaactgcag

SEQ ID NO: 960 - DNA, 1854 bp, Zea mays
attcaagaattgttcggttacattttgcctgtttgctgtttttttcgtcggttcgcctcgtcttctccgcctggcccgagactcacactcaattcggtcgttttctgcattaacggagtcaggcccaggcctaacctcagtacatcagagcagccgaacacgcccgcggcaaccgccgccattctaccccaggtcggacggacccttgccggagacgagcacacgccacagcaggaattatcgggcgtagagcagcgcgaagcgagagatccaatggcggcggcggaggggcagtgggtgctcatggcaacggggcggacgccgaccaacattgcggtgatcaagtactgggggaagcgggacgaggcgctcatcctccccatcaacgacagcatcagcgtaacgctcgaccccgaccatctctccgccaccaccactgtcgccgtcagcccctcattcccttccgaccgcatgtggctcaatggcaaggagatctcgctattaggaggaaggtttcagagctgcctcagagaaatcagaaagcgtgctcgtgactttgaggacaaggagaagggcgtcaagatcaagaaagaggactgggacaagttgcatgttcacatagcctcgtacaacaacttccccactgctgctggtttggcctcttcagctgctggccttgcctgtttcgttttcacccttggaaagctgatgaatgcgaaagaagattatggagaactttcttcaatagcaaggcagggatctgggagtgcatgccgcagtatatatggtggttttgtgaaatggtgcatgggagaaaaagatgatggaagtgacagtattgccgtgcagcttgctgacgaaacacactggaatgatcttgtaattattattgcagtggtcagttcaaagcagaaggaaaccagtagcaccagtgggatgcgagatagtgttgaaacaagtcctctcttgcagtacagggcccagacagtggtgccaggtcgggtgttgaaaatggaagaagctatcaagaaccgtgactttgaatcctttgccaaattaacttgtgcggatagcaaccagtttcatgctgtatgcttagacacgagccctcctatcttctatatgaatgacacgtcacaccgaataattagccttgtggaaaaatggaaccactcagaaggaaccccacaggtcgcttacaccttcgatgctgggccaaacgctgttctaatcgcacaaaaccgtaaaactgcagcacatctcctccagaagctcctatactatttccctccacaggataatgatttgagcagctatctggttggcgataaatcgattctaggtgtcgccggattgcattccatgaaagacgtcgaggctcttccagcacctccagagacgaagataccggatcagaaattcaagggcgatgttagctacttcatctgcagcaggcttggcgctggtccaaaggttgtttctgacgaaggtcaagcattgatcgattcagtcaccggacttccaaaaggcgtgtagttctagatttaggttggaataatggtttaagctggggattaaagacaatggtatcatacaagcaacctgggccgggaagatacattaggctcgtgtcacgttggtttcgtgctgattgacttgacggtgtattggtcatgtattatgcatttgcgctggtgttcgttgctgtccaataaagatagaacacgttctcgccaaaaaaaaaaaaaaaaagcccagtatgtggctcaaatatttgtttcactattttattgagcacttcagctgagacaaaagcggagaataactttgtatggctgcttgtcacagtggatg

SEQ ID NO: 961 - DNA, 1607 bp, Zea mays
attcacgaccattctagttcacactcaattcggtcgttttctgcattaacggagtcaggcccaggcctaacctcagttcatccgagcagccgaacacgcccgccgccattctacgccctgctgcccaggtcggacggaccctttgccggagacgagcacacgccacagcagagcagcgcgaagcgagagatccaatggcggcggcggaggggcagtgggtgctcatggcaacggggcggacgccgactaacattgcggtgatcaagtactgggggaagcgggacgaggcgctcatcctccccatcaacgacagcatcagcgtaacgctcgaccctgaccatctctccgccaccaccactgtcgccgtcagcccctcattcccttccgaccgcatgtggctcaatggcaaggagatctcgctattaggaggaaggtttcagagctgcctcagagaaatcagaaagcgtgctcgtgactttgaggacaaggagaagggcgtcaagatcaagaaagaggactgggacaagttgcatgttcacatagcctcgtacaacaacttccccactgctgctggtttggcctcttcggctgctggccttgcctgtttcgttttcacccttggaaagctgatgaatgtgaaagaagattatggagaactttcttcaatagcaaggcagggatctgggagtgcatgccgcagtatatatggtggttttgtgaaatggtgcatgggagaaaaagatgatggaagtgacagtattgccgtgcagcttgctgacgaaacacactggaatgatcttgtaattattattgcagtggtcagttcaaagcagaaggaaaccagtagcaccagtgggatgcgagatagtgttgaaacaagtcctctcttgcagtacagggcccagacagtggtgccaggtcgggtgttgaaaatggaagaagctatcaagaaccgtgactttgaatcatttgccaaattaacttgtgcagatagcaaccagtttcatgctgtatgcttagacacgagccctcccatcttctatatgaatgacacgtcacaccggataattagccttgtggaaaaatggaaccactcagaaggaaccccacaggtcgcttacaccttcgatgctgggccaaacgctgttctaatcgcccaaaaccgtaaaactgcagcacatttcctccagaagctcctatactatttccctccacaggataatgatttgagcagctatctggttggcgataaatcaattctaggtgacgccggattgcattccatgaaagacgtcgaggctcttccagcacctccagatacgaagataccggatcagaaattcaagggcgatgttagctacttcatctgcagcaggcttggggcaggtccaaaggttgttgttgacgaaggtcaagcactgatcgattcagtcaccggacttccaaaaggcgtgtagttctagatttaggttggaataatggtttaagctggggattaaagacaatggtatcatacaagcaacctgggccggccaataaagatagaacacgttctcgcctaaaaaaaaaaaaaaacgcctcgggtcggccggtagtatttgtttcgc

SEQ ID NO: 962 - DNA, 716 bp, Zea mays
ctcggatctaagtggcggattacgtccctcgtcaacaacaacgaccaagttatgtacgattggagtgggatggcagcgccaacctccggccggggcaagggctgcgaggggggcagcgaggacgccatcaatgcgcgattgagatcctggacggggagcggagggggaggatgttgaggggcaggtagccgatgattgcggcgacaaaagtgtgaccggatcctggcaggggagcatcgggaggctggcagaacgatggcgcacggtgtgcacgcctacacaccgtgcttatagagtagtagggattatgcctactaacttccctttgcaaggaattatcgggcatagagcagcgcgaagcgagagatccaatggcggcggcggaggggcagtgggtgctcatggcaacggggcggacgccgaccaacattgcggtgatcaagtactgggggaagcgggacgaggcgctcatcctccccatcaacgacagcatcagcgtaacgctcgaccccgaccatctctgcgccaccaccactgtcgccgtcagcccctcattcccttccgaccgcatgtggctcaatggcaaggtgtgtcatcgccagtaccccttctctgctcgctaatttgtctctaccgctgcttcgtcacctccgtggtctgttcattagggagggaaaaaacactacagactggtttggtggacaggtaaatggatt

SEQ ID NO: 963 - DNA, 3366 bp, Zea mays
ctcccgcacccactcttccaccgcacgcacgggcgagtgcggcagatcgctggcggatccaatgctgctgccctggtagctgctagcctgctgcgccgcgcggctgctggtttggtgcccttcggctgcggcgccgggtcactttcgatgtgactatctgaggaggaaaggatggcggcttcggcggcggcggcgcctgggtcggctgagaggcaggcgcgcggcggcgcggcgtcggcgatcggcaacgcggtatttaagagtggccctctcttcatatcatcgaaaggaattggatggaaatcatggaaaaaacgttggttcatcctcacacgaacgtcactggttttcttcaagaatgatcctagtacattaccacagagaagtggtgaagtgaaccttacattggggggggattgaccttaataattctgggagtgtagtggtcagggaagacaaaaggctgctgaccgtcctttttccagatggccgtgatggtcgcgcctttaccttgaaggcagaaagttctaaagatttgttcgagtggaaaacatcactggaagaagctcttgcacaagctccaaatgcagctcttctgatggggcataatggaatatttcgcaatgacacaacagatgtgtatgaagaggctattccaaattggagagagaagagacctaccaaatcactagttgttggcaggccaatactacttgcactggaagatatagatggcagtccttcttttctggaaaaagctttgtgtttccttgagaaacatggaataaaggtggaaggaattttgcgtcaagctgcagatgtggaggaggttgacaggagattgcaagaatatgagcaaggaaggacagagtttgcaccagaagaggatgctcatgttgttggtgactgtgtaaaacatgttctccgggagcttccatcttctcctgttccagcttcctgctgtacagcattattggaagctttccgtctggacatcaaggaatctcggatcaaatctatgcgtgcagcaatatctgaaacatttcctgagcctaataggcggctgctacagagaattttgaaaatgatgcataccgttgcttctcatactgccgagaatagaatgactccatcagcagttgctgcatgtatggccccactcttgttgcgtccccttcttgctggtgaatgcgagctggaagatgattttgacatgagtgatgacagtgctgctcagcttattgctgctgcaaatgctgctaacagcgctcaaggcattgtaactactctattagaggaatacgaaagtatattcaatgatgagcactttaggtgctccttatcacctgattctcaaacaggagatagtggaagtgaagaatcaactgatgatgaaactgtggatatcaaggataatgggtttcatgatgcagaaaatgatgtagatcaagaattagatgatgccgagcgagtactgagtggaaaattgagtgaaaccagtgcatgtgtccatgctgacctccatgactacaaggaagttaatggcaatgattcagacgctgagctctctgttgaggataacacacttgaaccaaatgtaaatttaaatgatactcccctaagtcgtttaatagaaaatggaaagaaaccatcaaatctggcgtccagtcatgaaactccattatcagtgggagaaattcttttgtctttggatgctggagttccattacctggtcgtgcagctgaatattccaaggacagacactctagcaaacccaatggaattcagcagcatgtgaagcgtactaacttatggggacggagcaatgcaagaaagggccaacgttcagagttagttgatccttcaagtgaagaagagcttgctattcaacgacttgaggtaatgaagaatgacctacaggtcaggattgcaaaggaggctagaagtaatgcaatcctacaggcaagtttagaaagaagaaaacaagcactacatgagcgccgtgtggctctggaacaaaatgtgtcaaggttgcaagagcagctacaggctgaaagggatcttagagctgcactggagattggattaagcatgtattcttcacaattttctagctcgcactccatggactcaaagacaaaggcagagcttgaggaaattgctctcgcagaagctgatgttgcaagattaaaacagaaggttgcagagctgcatctccaactcaatcaacagcgccagcaccagtatggctcttcggtagatgcaaatgattgtcctccgcaccttccaaatcatctctcacagaacactgtccaaactggatttgataggaccgttgctttttgtaatcaagagaagcaaagaaatgaggagagcttgccgtgcacatcccactggagaagcatcaaacagcatgtgctctctcagggttcttcaaggcctttctcccgaaagcattcctcagacacctccttgagtgattcaagggaggcatcaacaagtgtgcttgcagagggcgggccactgttggtgaacatcgcccgaacaacagaaggtgttgaatacgggagacctccgactgtgccgtcatctactctagttgaactaacaaccaggctagatttcttcaaagaacggcggtcacaattgatggaacagctccacagcctcgatttagggcatggatccgcgtcccatgatttcccatacaaaccttcatctccctggaacagcccaaggtaggggggcttgttcagttgctgcattacccgcgcatctgtatattcttggtatagaatctcttttgtttcactttatctctgtagaagctggtctcgtttttgtttcacttgttatctctgtagaagctggtagtgagaatgtatataccccttgcctaccttcacttattttgctagtgcttgcagcagacatttttcgagcgtgatttttgttttgcttttgtatttattgtgtatgtaatgactcaaggggaaatatatagatgcgtctttttttcttggggatatattcccccccaccccccgcaaatgttgccatttcgaaaacctgatctgtgtccattatgtggctgatccttattcggttaattctctccccaaagggataggaggaaatgcgtggacttttgacaatccctatctaactcaacaagagcattggattctgcaaagagtctcgatgccaaccttcacaaatcagagcaaatgagcgaccacaccacaggcatgatgtcaaaaaaaatcagctttgttcattcacgaagcaagcattccaatccaaacatttacgagctaaccaaaacataaatacacagggcaacccggcagagacccggagggtac

SEQ ID NO: 964 - DNA, 3302 bp, Zea mays
  misc_feature (2477)..(2477): n is a, c, g, or t
atcaaatccatgcgtgcagcaatatctgaaacatttcctgagcctaataggcggctgggacagagacttttgaaaatgatgcataccattgcttctcatactgccgagaatagaatgactccatcagcagttgctgcatgtatggccccgctcttgttgcgtccccttcttgctggtgaatgcgagatggaagatgacttagacatgaatggtgacagtgctgctcagcttattgccgctgcaaatgctgctaacagtgctcaaggcattgtaactactctattagaggaatacgagagtatattcaatgatgagcactttaggtgctccttatcacctgattctcaaacaggagatagtggaagtgaagaatcaactgatgacgaaactgtggataccaagggtaatggatttcatgatgcggaaaatgatgtagatcaagaattagatgatgccgagcgaatgctgagtggaaaattcactgaaaccagtgcaagtgcttgtgctgacctctatgaccacaaggaagttaatggcaatagttcagacactgagctctttgttgaggatcacacatttgaatcaaatgtagatttaaatgatgctcccctaagtcgtttaacagaaaatggaaagggtccatcaaatctgatgtccgctcatgaaactccattatcagtgggagagattcttctgtctttggatgctggaattccattaccttgtcgtgcagctgaatattctagcaaacccaatggaactcagcagcatgtgaagcgtactaacttatggggatggagcaatgtgagaaagggccaacgatcggagttagttgatccatcaggtgaagaagagcttgctattcaacgacttgaggtaatgaagaatgacttgcagatcaggattgcaaaggaggctagaggcaatgcaatcctacaggcaagtttggaaagaagaaaacaagcactacatgagcgtcgtgtggctctggaacaggatgtgtcaaggttgcaagagcagctacaggctgaaagggatcttagagctgcactggaggttgggctaagcatgtcttcttcacaattttctagctcactctccatggactcgaagacaaagtcagagcttgaggaaattgctctcgcagaagctgatgttgcaagattaaaacagaaggttgcagagctgcatttccaactcaatcaacacccacgcgtccgcccacgcgtccgcgtagatgcaaatgatcatcctcaacaccttctaaaccatctctcgcagaacattgtccaaacaggatttgataggagcgttgctttctgtaatcaagagaagcaaagaaatgaggagagcctgccgagcacatcccactggagaagcatcaaacagcatgtgctatctcatggttcttcaaggcctttctcccgaaagcattcctcggacacctccttgagtgattctacaagtgtgcctgcagagggcgggccaatgttggtgaacatccctagaacaacgaaacagggtgtcgaatatgggagaccgccgtctgtgtcgtcatccactctggttgaactaacaaccaggctagatttcttcaaagaacggcggtcacaattgatggaacagctccacagcctcgatttagggcatggatccacgtcccatggtttcccatacaaaccttcatctccctggaacagcccaaagtaaagtaggggatgatcatttgctgcagtacgacgtctctgtatattcttggtatagaatctcctttatgtttcactccatctttgtagagcctggtagtgagaatgtatatcccttgccttcacttgttttgctagtgcttgcagcggatctttttttagcatgattttgttttattgtatatgtaatgagttgaggagattgtgacacggcttttatatgttttagcaattttgttctattgtgtatgtaatgagttaaggggattgtgacacggtttttatatgttttcgcaatatatagatgcgtcttttttcttggggatatatagtccactgcaagtggagctactgttgtcatttcgaaaacaatgtggctgatccttgtaggcagctaattctctcccccaaatggattggaggaaacgagtggacttttgacaatccgtatttaatccgacaaggccttttagggcttgtttctatttaattcgacaaggcttttttagggtttgtttgcacatagactaactgactaagggggatgtttggttcccacctaaactttagtgactaaaagttttagtccctaaaaataccatacgaagtgactaaatgagacatttcaaatagaaattttagggactaaaatttattccctaaagtttaggagagtgcctaaagaaacctttaagtgcactagaactaatagttagtgtgtaaaattagctgtagcatctaaacatcctatctaatagttcaactattatntatattagctatttttaacaaattagttaatagttagttaactagctaattccactagcaattttttagtcagctaactattatctctagtgcattaaaacaatctctaaggcctcgtttgaatgcattagagctaatagttagctgttagatggagatatccaaacaactcaactactagttacttttagttgaagatatcaaaacctctactaatagtcctgctaacaattagctaacattagttattagttgaattaatatagttaaaattaactattagctagagcatctccaataattatatagatttagctccctactagttttagggagttgctaaaacacattaatgagtaattaacgtttgtgctccaacgactctcgcttttttggttgctatattttttttaggtgtccatgtcgacacaaaaaatatgggttcgctttgtatttttaattggattggcgatagtccgtgttaacaatctttcctaacttttccagcggcgacacataggatctgccacatatcttaacgagatgaacttttccaacagttttcataaataatgtcaacaacgtcttgaaaggtcatagctatcgatggaagaccagacgactctggcgataggcacacaccgtccacagaggttctcacgacgatggcgtggaggtagcacatgatgtgctttggtgacaacgtcaagagcatctagaatagtggagatgcatttgtggtcattgaaacggtgggacgacgcaaaacagttacgggggtatactttttatcatggacttggcgccaacattgattttcagagt

SEQ ID NO: 965 - DNA, 749 bp, Zea mays
aggcatgaggcatctttctcatatcacaggtcacaacagtccatttcagtctcagcgctgtcgctcaactgctcaaggaggcacggggctggagagggcaagaggaggaaagctgaaccatggcgagagtagaagcggtggtcatctgcctcctggtcctcgccatggacgtcgccgccggcgtgctcggtgtctacgcggagaaggctcagaaccagggcaggcacctgcggatcctgttcgtcgagtgccggcagccggtccggcgggcctacgagctcggcatggcggcggccgcggtgctggcggcggcgcacgccatcgccaacgcggccggcggatgcgcgtgcgcctgctccggcgacaagctccgccgggcgtcgcccaaccggcagatggcgtccttcgccttggtcctcacatggatggtcctcgtcgtcgcgctctcgctgctggtgctcggcgcgctgcccaacgcgaagcgcaagctggcggagtgcggggtggcgcggcaccggttcctctccatcggcggcgtcctctgcttcgtgcacgcgcccttctgcgccgtctactacgcctccgctagcgccgcggcgcgggaggctcgccgcgacgcgacgcacgtgtagtctgttcggttctattagccacccctccatgagaccatgactgtatcgtgctcttgacgaaggtgctggcacagaagatggcgtcggacgggctgggcatgggatgtaattttgctc

SEQ ID NO: 966 - DNA, 2540 bp, Zea mays
atggtgcattgtgctaaatgcaatatcgaatggaacaaaaacgatggcattttcttggttgaagtgaacaggcttttgaggcctggcggatattttgtatggacatcgaatttgaatacacatagggccttgcgagacaaagaaaaccaaaagaaatggacagccattcgtgactacgctgagggcctttgttgggagatgctgtcacaacaagatgagacaattgtatggaaaaagacgaataaaagggaatgttacaaatcaagaaaatttgggcctgagctatgtggccatgatccagaatcaccatactaccaaccactaagcccctgcatatcgggcacaagaagtcagcgttggatccccattgaacaccgtaccacctggccatctcaggctaggcaaaacgcaacagaactggacatacatggtgtgcattcagaagtcttcgctgatgataattcaagctgggacaccatggtgcgaaactactggtctttgctatccccacttatattttcagaccatccaaagagacctggtgatgaagacccacaaccaccatttaacatgctaaggaatgttttagatatgaatgctcactttggtggatttaatgctgctttactgcaagtctggaaagtctgtgtgggtgatgaatggtgttcctacaaatgccccaaattatctaccactaatatttgaccgtggttttattggggttaacatgattggtcacgcgtccgcccacgcgtccggacgcatttgcaacttacccaagaacatatgatatggtgcatgctgatggctttctatcacttgagaagacccacaagcatagatgttctactcttgacatattcttggaagttgatcgcatcctacgaccagagggctgggtcataatccgtgacaccgcccctcttattgaagcggcaagatctgttgttactcaactcagatgggatgcccgtattttagatcttgacatagctagtgatgaaaagctactcgtctgtcagaagccctttctcagaaaataaggagcacaagcacagtagacactgacacaagatatgaacttattctttcaccctatactgttacagttattgtctgagcagaactgagtacaaagcttgggacgaaaacacgggaaggtgccattagattggttagtaagtgcatgctgcagagaacaggcttggtggcaaagctttccaggccaaggttttattgccaagatacagagatgaagccatgaaattactttagtggtgaaaaccatatccaataaagggatgacgctgcggtgtacataatcgcggtcaatgtgccatataggtataattcgttttctccttattacagtttctcttttttttgtagttgtaccgatttgtttttgtatcttgtatgtaaattgattggtctataaactggtcatcccagactacagtctagtgaaaccaatataattattatttggagatgaatgataagcaagaacaatttataactgttccactatatctttctaccatttgtacagttcatttgtacattatcgggaacaagagtgacactatcattattcaagaagaatacatggttactgtaagaggaatgtgtcaatgtttctttactgtggttattacaatcttgcagggtttttttttggccatttaacgttagtcggagctactgaggtgagctggtattgctctgtggcttcaacctcccgtgcttttgtggaggattgcgcgtccagttcatgttagctgtagtttggtatctgccacaaccaattgggctgccccattgcgacggtgatgtgccaccttaatccgaagggattagcttgtcattcttccgtggtttgggaaccatccccttttgcctgcttgtatgtttgactctgctaatactctgggctagcataaaaaaaaattaactagaaaatggtaacaacaggttagatcgtgtttaatagtttacccatatgtgttcgcttggctttaaccctaaaggacttttaatgtttttacagtgttttatttctatgaattgcagtagcagcagttcgaacagttgactttaatctgaaacgaacaacctatatttgaatacgatttatgagtatatggatgtgtaagctgttgaagatagccatagaggttttattatagcacacttcatgatgtcattaaagctatatcatcacattgtatttttccttttccagtttgttgtagttaaacctcacgtaattgattaaggccctgtttcaaacctctaaaactaatagttatcgactaaaatacctgagagatttaaaatgaatcagctaattattaattatacctcttaaatagctattagttgttagctactttgacccggttaaaaccagctaacaacttattagctgactaatggagtaattagctttacatgtttgtaaccgtgcctaaataaatagacactaaagaactatctgtcatcttaatagttcattcaaacattcgaaaagggtgggt

SEQ ID NO: 967 - DNA, 1414 bp, Zea mays
  misc_feature (1271)..(1271): n is a, c, g, or t
tttgacatttgattttgcagtgggaaagaaagataccctacactctacttacactgtataatgcacaattaccattacccatgaaggaatgcagcagaattatcagactagttttgcattgttgcactgcatatttccaccggccgtgtggactgtggagcactacgcatcagtcttcagtcataggattattttatacaagtgttgtctaactttttttttctgctcgtttgatttgatgcagggctgggtcataatccgtgacgctgcccctcttattgaagcggcaagatctgttgttactcaactcagatgggacgcccgcgttttggatcttgacatagccagtgatgaaaaactactggtctgtcagaagccgtttctcagaaaataatgagcatagtagacactgacacaagatatgaacttattctttcaccctacacactgttacaattgctgtctgagcacaactgagtacaaagtttgggtaaaaaacacgggaagcatgattcagcaaacttgtcatgcatcaccatggaaccgcaaggtgccattaaattgatcggtcaagtgcatgctgcagaaacaggcttggtggctaagctttccaggccaaggttttattgccaggatatagagatgaagccataaaaattactttagtagtgaaaccatatccaataaagagatgctgctgcggtgtacataatcgccgccaatgtgccatataggtataattcattttttcccttgttacaatttctctccttttttctgtaactgtgccaatttgttttattttgtatcttgtatgtaaattggttggtctatatactgatcatcccagactacagcctagtgaaatcaatataattattatttggagatgaatgataagcaagagcaaattataatcattccactatatttatctatcatttctacaattcattatttttgtacattgtacggaacaagagtgataccttcattattcaagaagagtaaaatacatttccagtagaatacatggttaatataagaggaatgtgtcaatgtttctttgtggtagttattgcaatcttgcaggcaagtttttgcttttgatggccatttagcgttagtcggagccacttgagatgagctggcattgctctttggtttcaacatcctatgcttttgcggaggattgagcgtccagttcatcttagctgtagttgctatctgccataaccaagtgggctgtcgcattttgatgttgacgtgcnaccttagtccgaaggaattggctttgtcattcttccgtggttctggagtaaagaccatcctcccagtattatattaaaaagatactaaaatatagttccgaccgataaaatctcaactttgcccccacatcactagcgagtcg

SEQ ID NO: 968 - DNA, 1138 bp, Zea mays
  misc_feature (82)..(82): n is a, c, g, or t
ctggccatctcaggctagacaaaactcaacagaattggacatacatggtgtgcatcctgaagtctttgctgatgatacctanagctgggactccatggtgcgaaactactggtctttcccgtcgccgcccgggttttctgaccatccaaagagacccggtgatgaggacccacagccaccatttaacatgctaaggaatgttttagatatgaatgctcactttggtggatttaatgctgctttactgaaggcaggaaagtctgtatgggtgatgaatgttgttcctacagatgccccaaactatctaccgctgatatttgaccggggttttatcggggttcaacatgactggtgtgatgcatttccaacttacccaagaacatatgatatggtgcacgctgatggttttctatcacttcagaagaaccacaagcatagatgttctactcttgacatattcttggaagttgaccgcatcctacgaccagagggctgggtcataatccgtgacgctgcccctcttattgaagcggcaagatctgttgttactcaactcagatgggacgcccgcgttttggatcttgacatagccagtgatgaaaaactactggtctgtcagaagccgtttctcagaaaataatgagcatagtagacactgacacaagatatgaacttattctttcaccctacacactgttacaattgctgtctgagcacaactgagtacaaagtttgggtaaaaaacacgggaagcatgattcagcaaacttgtcatgcatcaccatggaaccgcaaggtgccattaaattgatcggtcaagtgcatgctgcagaaacaggcttggtggctaagctttccaggccaaggttttattgccaggatatagagatgaagccataaaaattactttagtagtgaaaccatatccaataaagagatgctgctgcggtgtacataatcgccgccaatgtgccatataggtataattcattttttcccttgttacaatttctctccttttttctgtaactgtgccaatttgttttattttgtatcttgtatgtaaattggttggtctatatactgatcatcccagactacagcctagtgaaatcaatataattattatttggagatg

SEQ ID NO: 969 - DNA, 4070 bp, Zea mays
gattagtttggaaatcctaattttcaaaggcattttcatttttcaagagaaattaggaataccttggaaaaataggaattccttagaaaaatggagttcctaaactagcccttaaatacaaatctaggattgtggaattttttctatccggattctgagacattggacagatcaagatgacatgatctcccacgttcacaaggtaacaaatagcagatagcggattggtgtggacgctaagtcccaacttccaatagcgggatccagagcagagatacttataaatgtaagtatggaacatggttttctatcacattaaaaacctatataaaaattaaataatggtagatcaatatgcctataactcgagaataaaactagacatccaattgatgagtcttatgggatgtctaaagctggttagaagttgcattttccaaaaatgatccttaaaaaacatcacagctcaccaccatgcaatggccgtctaaaaagcactattgggccacaataacggtccactaacccaaatagcagtagctaatatagcatctccaactgcgcctcgtgaaaattagctctaacggtgtcttattttacaaatttctataaaaatataggacacatcataaagtgatctagatatactacaccctagactagactagtgcataactgcctatccttattttctatctcatcctcaaccttttctttccgagcattttaatttatttttaagataggcttatctgttggagcttaatttgtttttaatgttctaatctgtttaaataatgtagtgtttcaattttggaacactattgtgagacaccttgttgctgttgcctcgtagcggtggcagtactgagcagctacggttatatcgtgttcaacagtttacttatgtggtcatctaaaacactgttttacaccgcgaagtgaagtttaaatatgggtacggctaagctgccggagatagtcttattgcgaccctacgaagcgttcgttaccttgcacattcagaacactgaaacgaacgtagcagatgctgtcagctagggccaagacttgaacttcagtaaagcaatcctccacaggactaaaaaaacggaggcatccttctcaagtcgaacaactcacgagccacgactactgcgttagcagtaatgcatgaacaaagcatatggctattagatgtatcaattcagagcattgctcattcaacaaatcagatgtgcagacaagagaagaacagtgggaaagaaagcactgaccaggagatgaagaaaatcttgcttttccggcagttgtcgtcgcttacgaaatccagatcgtagacggcgtaccggcaatcatcggtcggtagcgacgccgtgaagtcgtcgtagctctccccgggcgcgccgatcttgtcgacgacgacctcctctctactgtcgtcgatcttgaagatcacataccggtggaccttcctccgcttcagctccatgaacgcgctcttgctccgctcaggcacgtcgatccacgccggggaaccgcctccctgaacaaacaagaagaaccatgccgccgtgagtccaacacgatcagacaacatatccccttccccgctagcttctcccttatcgctagttcatctttgctttcaggcaactgtacgatagaaaatgtggaaagtaatagatagcagaagggagcgaacgaccattgccgcgaaaccaagaacctccatggacggtcgaacttgtctgagcagaagatatgtatgtattctacctaaagcgcgagcaaggaaagcaggggcggggccgcgggggttaataggaaagaagatgaggaatggggacaaacccatggcaacgcggcggccgccgtagccatgtccatgtggccgtcacgatcccggtcttccggcgtggtggcgtggcgttgatccgtgggcggcggcggaggggggcgatcgcacggtccaagagatgggtccgattattttagcttttctcgcagagttggaatcgaggaagggcattgatgggatcatgggattcgtgcgcggcggcccgccgcgtccactcaaatctggatgtcatctccgtcaggactcaggatgctcgcgcgcgccgtccatctcccatcccaaaagccgattcgggatgggcctaaaaggccactgtttagtgacaaaaggccgacacaaccaatcctgcgaataaccaaacgccatacggcccattacggagcccactcttgctagactggctgaccccgcggcccgccggcgtcgcagcgagccgcgcctcgcctagtcgcttcccactgcgcgccgccacgcaccagcccagccagccatggcgttcgccgcgcggaggagcatcgccacccggctctctcaccatctcacgcgacgcctccatccctgcgttccacacgcgcgtacctccgactccctcgacgagcaggcgtcgagaccctcgccaccgctcccgctcccgctcccaccacttcacgtccagctcaagcaacgttctagagaagtccaaatcctaggcttcctccctttctcgctccgcctcgcggggccaacccgccgcaccttctcgtcctcagcccccgcccccaacctcgaggcggcaccagccgccgaggtcgatgccgcgggcgtgcttgcggatgcagcggaggcggcggcgtcagtgccagcgccgttcccaggggaggtagccgccgcggctgcggactcattcccccctgttgccgcacttcagcacattatcgacgctatccatacctttaccgggctgaactggtgggtgtgcatcgcgctgacaacatttattatccggagcgccacagtcccgttgctcgtgaaccagttgaaggccacgacgaagctaagagcaataaatccagagatggaagtcattaaagaccagatgaatagtatggatccaaaatcagtgcaggagggacaagctaaaatgaaagcgctgttcaaaaaacatggtgttagtccacttactccaatgaaaggactcctgatccaagggccaatattcatgagctttttctttgccatatcaaacatggttgagaaagtaccttcattcaaaggaggtggaacattgtggtttactgacctgacgactccagattctctttacatcttgcctatgttaacaggactgaccttcttggccacagtggagcttaacttgcaagaaggaatggagggaaatcctatggctggtaaaatgaagtacttttctagaggagtagctgttttgacagtcccatttacaatgaactttgccacggcagttttctgttactggacctcatcaaacatattcaccctgttatatggtcttgttatccggcgaccagctgtgaggaagtggtttgatcttcctgctttggaaaatacgccttcgctcacggcaaagccagtattcaatatgtttggtggatccaaggcaataccagccgcacagtcaccagtagcgatcgcaggagcccagcaatctggtctggaccaacctgatgcttctgctcttggctataaggtcaaaaatcttgagaagaaagtgaaatccaggggtaaatctcggaaacacaggtaaaattttgtgcatctgtgccccagatgagcaatctgtacttccaccatcggaatgatggatacttgatttgtcctgatatgccccccaaaaatcagattttgtattaggaacctatcttttcgtcgtttttggctgcttttgttttgatttttcaggggggaggggtgaaataagccacataaatgtttgacttagtaccagagttgattatacacaaaatgtatttcagtaacttgtgatagttaaaacattgggggtcatcttccaaggattggtatgaaagctacgttgaagttcagggacagtcaatcaacttttgaggcaccattcgacattctgtagcaattaggttcaaagtgagctgggcagaattttgtggcctgaatgaatattgagtttgtatgtactaaactatcttagaataccatttgggggcctgtttgggcc

SEQ ID NO: 970 - DNA, 803 bp, Zea mays
ttttttttttttttttggttccacagtccacatcatattagagggaacctatgtagttaggcaaacatcacggaagtataactccaaaaggaaaggaagaagtaaaaagaaacaatgcatgcccgggtgtgatcggcagcctatacttctacgtcatgcctcatcagatcagcgacctccgagctgcattttgggttgctcgctagtgaatcaggttctgttagcacgccccctgagaacttctagattcatgtcatcgggatcggtggcttggatctcgaagtgcactccgtcaagctcatgacggaattggttccttgacacggcatatatggtcttggcacggatgcgagaatctgaaggagaccaggagatgaagaaaatcttgcttttccggcagttgtcgtcgcttacgaaatccagatcgtagacggcgtaccggcaatcatcggtcggtagcgacgccgtgaagtcgtcgtagctctccccgggcgcgccgatcttgtcgacgacgacctcctctctactgtcgtcgatcttgaagatcacataccggtggaccttcctccgcttcagctccatgaacgcgctcttgctccgctcaggcacgtcgatccacgccggggaaccgcctccccatggcaacgcggcggccgccgtagccatgtccatgtggccgtcacgatcccggtcttccggcgtggtggcgtggcgttgatccgtgggcggcggcggaggggggcgatcgcacggtccaagagatgggtccgattattttagcttttctcgcagagttggaatct

SEQ ID NO: 971 - DNA, 1388 bp, Zea mays
cgatctatgcacttccatttatttatgcatctaatttcatccacattcatgctatcgccgagcaagtttgtttgaataatcttatgaacatatctatctaatagctactctacaaataatagttacatacggcacagcaggcaccacttcgatgcgcatttacaaccatccgtttccacagattatcatctacctgcagacagctctatcgcttcctggttgtagaacgaatcctctccccagtcaaacctccgctgcatccgctcatattcttgcctccttgtcacctccacatgctgccactcttcccaccgttccgccaaaccctcgccttccagcatcctaaccacttcagacatcgatggacggtcctcaggtgatgcctgagtgcagagcagcgctatctgtattatcatctcgatatcctcgccgtcataattctggttaaggttgatgtccacgatggagtccagctccccttctctctgtagcttctttacatgatcgagcaatagcacatcatcttcgtcttccagccgtgagaagtcaatagcccgttgaccagtcacaagttcaagaagcatgatcccatatccaaaaacatctgtcctctcggaagacttccctgtggacaggtactcgggtgctatgtgacccatggttccgcggacttgtgttgtcacagacgtcttctgcacatctactagctttgctaggccaaaatcgccgacaacaggctcgaaatcctcgtcaagcaatacatttgcagctttaacatcacggtgtatgatcttggggttgcagtgttcatgcagatactccagtccacgagctgtacctatagccacccgtttccttgaaggccaatccaggatggcttctccaggcttaaaatctcttaagcggtaggcaacactcaaattctgcataaatggatagaccaacaagcgctctgtttgtgttgtgcagaagccaattaatcttaagagattgcggtgaactgcaacactgataagctcaacctcacgcaagaaggcagcctccccaccaggactctcatagtcagtcagtcgttttacagcaatcttagtgccatctggaagaactcccttgtacactttaccaaaacctccctgtccaagaacatttctttcattgaaattatcagtcgcaatctgcagttctcgccatgcaaatcttttgagctggccaaacgcaattcgtcgatcatcctcgcctgctacatccacaaaaacttcccgcagatggcttttcctccttgcattacagattagaaacagagctcccacgataataagccctaaaattcccccaactgttccaagtattaagccaatttttgagttatgggatccactcccggccgg

SEQ ID NO: 972 - DNA, 874 bp, Zea mays
attgggacctcgagccggccggagaagaaaacgcagcccttccttcattttccttcccatgctcgggtcgcgtccttctcttcccgacttcctcgcgttcatttcttcaccccacccgccccccaacgccaaatctaacagcaaaggtccggaaccttctagccgcacctagggtttggattggcgccgagcatggcgtacgtcgaccacgccttctccatctccgacgaggacgacctcgtcggcggcgccatggggggcccgcgcggggcgcccgtgaaggagatcgccttcgccgccgcgctgctcgccttcggggcgctcggtaccatcggtggcctgctaatggccgtcaaccgcgtcggaggggaccgcgcgcacggaattttcttcatgatgttgggcattgtaatgttcatccctgggttctactacacaaggatcgcctactatgcttacaaaggttacaagggcttctctttttcgaacatcccaccgatctgaaggagtgtgctgctgcctgctggttatgaagtggtgtcgctggtttaagagtttgtcgactctgtcgaatggctctgtagacacccttgttctacatctgtctgtggccattctctttgaacactctagaatgaactggtggatgtgtacagataaatgcagccatagttgtgctcctccatcgcggtttggccgattggaaggttgtttgttgtgctcgtgtgaccatgttcaactgatacgcattgctacttgtgcattactgtcgtttttgtcagggaccttaaaccattctatgagaataagatctcgtcgttccaattgtgaagaattaaaaaaaaaacaaaatcttaaaaaaaaaaaaaaaaga

SEQ ID NO: 973 - DNA, 884 bp, Zea mays
aagagcaactaaaaagtggatataatactcaaagtgaacatcccgaaaggaccagcatctctgagaaataagttctgatgggctaatgctcaaatatctgaaactgttttagcatataaagaccactcgcgatcacaaggatagcatcaaccttaacaaatccttactccatgttggtaacaaaaacatcaaggaggcaacaaacactgccaacaaaggtacttgagaagaactacaactaagactcttggacgaatgcagccactccggtagcttagatagctttccttggtgcgacgacgttgtcagcctccttcttcacaggctcttccttctctgacaagatcagctcaatgtggcaggggttggacatgtaaggattgatgcgtccgtgagcacggtatgtacggcgcctctgcttttgggcttggttcacctggatgtgtgaaatgtagaggttgtcgacgtccaagcctttaacctcagcgttactctcagcattcttcagcaaatccaacacgaactgggccgactttgcaggccagcgaccctgcccatttggctggcggttctttacttgcgcagtacgacccacacctctgcagtatctccggaagggaatcgcttgcttgtgggcgagaacatcctcaaggtacctcttagccttgcccaaaggcatcctgcgaagagcaaacgctgtctcgcgtgtgttcttgaagtggaccctgagatccttgccacaggccttggccgacttggtcgggttggacggatccctcgagtacttcaccatggcggcggcggtggggttgcggccggagaggagggatgggagggtgagtgctggccttggcacgaactctcccaaccccggcccgccggag

SEQ ID NO: 974 - DNA, 881 bp, Zea mays
aagaggaactacacttagacaattaacaaaagatacaaaacagaaccgcctccaaacagatctatatcagataccaatagattgtatgcagattactgataagaacacaatcacaaggttcaccgaccatgtctttaaatgataaataagcaacaaaacactagtcttcatgcattagaagatccaacatactaagagaacatttcaacttttgtgcttctgcccaacaaaaataccagcatccaccacagcccaatcacatgaacaggttcggcctcgtcgccttgtaggtggtcttcagcttcctggttggtggcctgaccttttggtacacaagggggaacttgatcttggagttgtggaactgcttggtgttgtctctcttgcatagcttgaagttgacagtcgcggtcttgatgatctgaatgcagggggatctcacacggtggcgagaggccatctcagtgtacatctgctccacggcaccatttagtgtggtgtcacggtactccttgtacatgttgtggtagccagtcctgctctggtaacgcagccaaatgccatagttcttgatcgtggttgggttcttctcaaagatctcgttgatggcgagcatctggccgttgctcttcttcaccttcttcagcttcctcaggaaataccagaacttgctcttggcgcggacctcattggtggcccagagcttcatgcggtagatcttcggctgctcatcgccgggcgtcggcagcgcacgacccaccacctggtactgatggaacctgaaggccaccatttccgcgagctctgtgaagcccctagcctaacctaacctaagcagatggggagggcaggaggcggcgggcgaaggcccggcccggccg

SEQ ID NO: 975 - DNA, 866 bp, Zea mays
cagcagtccgatagccaggaagcccgtgcacgtcgaccgacgtacgccaccatgccggggctcaccataggcgacaccgtccccaacctggagctggactccacccacggcaagatccgcatccacgactacgttggcgacggctacgctatcatcttctctcacccagccgacttcacgcccgtgtgcacgacggagatggcggcgatggcggggtacgccaaggagttcgagaagcgtggcgtgaagctgctgggcatctcgtgcgacgacgtggagtcgcacaggcagtggaccaaggacgtggaggcgtacggcgggaagcagcagcagcagcagcatacgacgacgaaggtgacgttcccgatcctggcggacccggcgcgggacgccatccggcagctgaacatggtggaccccgacgagaaggacgcggcggggcggagcatgccgtcccgcgcgctccacgtcgtcgggcccgacaaggccgtgaagctgagcttcctgtacccggccaccacggggcggaacatggacgaggtgctgcgcgccgtcgactcgctgctcacggccgccaagcacggcgggaaggtggccacgcccgctaactggaagcccggggagtgcgccgtcatcgcgcccggcgtctccgacgaggaggccaggaagatgttcccgcaggggttcgagaccgccgacctgccctccaagaagggctacctccgtttcaccaaggtttagctagccgacgtacggcacggacatctagctcgtctgtcagtccgcgtcgaccggggtgcgcggatcttttgtgcctgctgggggtttctctgactagtactagtatatatataggctctatgtat

SEQ ID NO: 976 - DNA, 1012 bp, Zea mays
cctcgggccgggcgggcagcagtccgatagccaggaagccagtgcacgtcgaccgacgcacgccaccatgccggggctcaccatcggcgacaccgtccccaacctggagctggactccacccacggcaagatccgcatccacgactacgttggcgacggctacgccatcatcttctctcacccagccgacttcacgcccgtgtgcacgacggagatggcggcgatggcggggtacgccaaggagttcgagaagcgtggcgtgaagctgctgggcatctcgtgcgacgacgtggagtcgcacaggcagtggaccaaggacgtggaggcgtacggcgggaagcagcagacgacaacgacgaaggtgacgttcccgatcctcgcggacccggcgcgggacgccatccggcagctgaacatggtggaccccgacgagaaggacgcggcggggcggagcatgccgtcccgcgcgctccacgtcgtcgggcccgacaaggccgtgaagctgagcttcctgtacccggccaccacggggcggaacatggacgaggtgctgcgcgccgtcgactcgctgctcaccgccgccaagcacggcgggaaggtggccacgcccgccaactggaagcccggggagtgcgccgtcatcgcgcccggcgtctccgatgaggaggccaggaagatgttcccgcaggggttcgagaccgccgacctgccctccaagaagggctacctccgcttcaccaaggtctagctagccggcggcacggacgtctagctagctcgtctgtcgatcagtccgcgtcgaccggctggtggtttctctgactagtatatatataggctctaagtatgtgtgtgtactatgccgtcccgtgttgtctaccgcgctagtattgtccacccatgcatatcagtgtcctcttctgaacttagcggcgcacatgtttgtgcgtgtgtgtagcaaaaaaaaaaaaaaaagttaaaaaaacaaaactcgagggggggcccggtaccc

SEQ ID NO: 977 - DNA, 2943 bp, Zea mays
  misc_feature (2618)..(2618): n is a, c, g, or t
ggcccatgaaagaatgaccttacgaattattgggcccttgggcttttcgtgaggccttttacttctttagtggacccaggggatatctatcccccacaattccaaaatgaatggagtatatgaatgtgtgcaccaaaatttaaataaaaataaagaacaaattaatctatatattgtaaagtggagagttgtagttgattaagtattttggattctaaatatattttatattaggtatatttatatcttggactcaaaaaatcccaataatgtaatgtatacgtatttacaattaatcttttaatattaattaattttaacatttcatatcactagtaatataagattactataattatttatttatcatataaatatttttaatattttaaatggtgcacataatttttctagtatattgtgaaaaataaaatcatttgtagtttgtaattcggaataaagatttttttttctttgatactatcggatattctacgattttttccaatacaaatatagattcggttagagaaaaaactagaaatcaaattcggatatttaatatccatattaaaattaaatatgagtacgaatatttatattagtattttaagtaaatataactacggataatttagatcttcatatccgaatccatctctagctagcaatagccgagtggatgtcagtatgtcacaactgagacgaccaaagcaatagcagttaggtggcggcaggtcaggtcaaatgccggagggcgaggcaggtggcacgaggctagctacgcggcgcccatgcatcgcgcctggatgccacttctccgcgcggtccatccgtctatcactgatcttggccacgtatatatacgtggtccatgtcagttcgttcgtctcagcagtccgatagccaggaagcccgtgcacgtcgaccgacgtacgccaccatgccggggctcaccataggcgacaccgtccccaacctggagctggactccacccacggcaagatccgcatccacgactacgttggcgacggctacgctatcatcttctctcacccaggtacgtctgctgccggtcgttcgctcggccatatgcatgctctcgctcgcgtgcacctgccgatcggatcttctcctacccagccgacttcacgcccgtgtgcacaacggagatggcggcgatggcggggtacgccaaggagttcgagaagcgtggcgtgaagctgctgggcatctcgtgcgacgacgtggagtcgcacaggcagtggaccaaggacgtggaggcgtacggcgggaagcagcagcagcagcaggcgacgacgacgaaggtgacgttcccgatcctggcggacccggcgcgggacgccatccggcagctgaacatggtggaccccgacgagaaggacgcggcggggcggagcatgccgtcccgcgcgctccacgtcgtcgggcccgacaaggccgtcaagctgagcttcctgtacccggccaccacggggcggaacatggacgaggtgctgcgcgctgtcgactcgctgctcaccgccgccaagcatggcgggaaggtggccacgcccgccaactggaagcccggggagtgcgccgtcatcgcgcccggcgtctccgacgaggaggccaggaagatgttcccgcaggggttcgagaccgccgacctgccctccaagaagggctacctccgtttcaccaaggtttagctagccgacgtacggcacggacatctagctcgtctgtcagtccgcgtcgaccggggtgcgcggatcttttgtgcctgctggtggtttctctgactagtactagtatatatataggctctatgtatgtgcgtactatgccgtgccgtgttgtctcgtgtagtggtggcaaccggttcgtggcactaccgcgctagtattgtccacccatatcaatgtcctcttctgaacttagcggcgcacatgtttgtgcgtgtgtgtagcatctgctagtgcaattgcatgatgcatggccgtgcgaaaaggccctcggcgctacgacagcagccagcacggcacgtttcaaagtatgcctgatactgtacgatgtcttatagcatcttcgaaagactatttaaatagctcgccaagccaaattttggctacttaacaccaaaataaatctccaatatagactcatcgagttatctgactatctaaattagtaaattagtctctcattagtcaaatttggctatctgactctctaaattagtctctcactctctaaattagtctctcactacctaaaggggaccgtgcaaattagtaaattagtctctcattagtcaaatttggctatctgactctctaaattagtctctcactctctaaattagtctctcactacctaaatttggctacccgactctaaattagtctcactagccaaatttggcatttggctatcacgtgattagtaaaattaactctctaaattagtctctcactagccaaatttggcatttggctatcacgtgattagtaaaattagatagatagtgagatgctatagagtgtaatctttatgaaaaagtaaataaatagttaaatatagagccaaaattaaatagtatctgggagantattaaaatctcacgtaacaatcacatcacgtaacaatcacttaggccctacagactagccaagctgactcttcaaattagtctctcactagctaaatttggctacccacgcgactaataaaactaagctatctgactctccaaattagtctctcattagccaaatttggctacccacacgactagttactaataaaactagatcaaatttggctacccacacgactagttactaataaaactagatagataatctgttggagtgagatgctatagagtaaaactagatagataatctgttgaagtgagatgctatagagagagt

SEQ ID NO: 978 - DNA, 1071 bp, Zea mays
gtgcggcgctcgaggcggccggccgggagcagtccgatagccagcaagccagcgcacgtcggtaggcacgccaccatgccggggctcaccatcggcgacaccgtccccaacctggagctggactccacccacggcaagatccgcatccacgactacgtcggcgacggctacgccatcatcttctcccacccagccgacttcacgcccgtgtgcacaacggagatggcggcgatggcggggtacgccaaggagttcgagaagcgtggcgtgaagctgctgggcatctcgtgcgacgacgtggagtcgcacaggcagtggaccaaggacgtggaggcgtacggcgggaagcagcagcagcagcaggcgacgacgacgaaggtgacgttcccgatcctggcggacccggcgcgggacgccatccggcagctgaacatggtggaccccgacgagaaggacgcggcggggcggagcatgccgtcccgcgcgctccacgtcgtcgggcccgacaaggccgtcaagctgagcttcctgtacccggccaccacggggcggaacatggacgaggtgctgcgcgctgtcgactcgctgctcaccgccgccaagcatggcgggaaggtggccacgcccgccaactggaagcccggggagtgcgccgtcatcgcgcccggcgtctccgacgaggaggccaggaagatgttcccgcaggggttcgagaccgccgacctgccctccaagaagggctacctccgtttcaccaaggtttagctagccgacgtacggcacggacatctagctcgtctgtcagtccgcgtcgaccggggtgcgcggatcttttgtgcctgctggtggtttctctgactagtactagtatatatataggctctatgtatgtgcgtactatgccgtgccgtgttgtctcgtgtagtggtggcaaccggttcgtggcactaccgcgctagtattgtccacccatatcaatgtcctcttctgaacttagcggcgcacatgtttgtgcgtgtgtgagcaaaaaaaaaaaaaaaaaaaaaaaaaaaaaaaaaaaaactcgagggg

SEQ ID NO: 979 - DNA, 901 bp, Zea mays
gggggcccctcgaggccggccgggagcagtccgatagccaggaagccagtgcacgtcgaccgacgaacgccaccatgccggggctcaccataggcgacaccgtccccaacctggagctggactccacccacggcaagatccgcatccacgactacgttggcgacggctacgccatcatcttctctcacccagccgacttcacgcccgtgtgcacgacggagatggcggcgatggcggggtacgccaaggagttcgagaagcgtggcgtgaagctgctgggcatctcgtgcgacgacgtggagtcgcacaggcagtggaccaaggacgtggaggcgtacggcgggaagcagcagcagcagcaggcgccgacgaaggtgacgttcccgatcctcgcggacccggcgcgggacgccatccggcagctgaacatggtggaccccgacgagaaggacgcggcggggcggagcatgccgtcccgcgcgctccacgtcgtcgggcccgacaaggccgtcaagctgagcttcctgtacccggccaccacggggcggaacatggacgaggtgctgcgcgctgtcgactcgctgctcaccgccgccaagcatggcgggaaggtggccacgcccgccaactggaagcccggggagtgcgccgtcatcgcgcccggcgtctccgacgaggaggccaggaagatgttcccgcaggggttcgagaccgccgacctgccctccaagaagggctacctccgtttcaccaaggtttagctagccgacgtacggcacggacatctagctcgtctgtcagtccgcgtcgaccggggtgcgcggatcttttgtgcctgctggtggtttctctgactagtactagtatatatataggctctatgtatgggcgtactatgccg

SEQ ID NO: 980 - DNA, 910 bp, Zea mays
cattgggtacctccgagccggccgggacctcgcgggccgcgcggcgcgtctccctcccctaacgcccctcctctccttccccacctgcgtgctgccgctgctgacaccttctcctccccacaaatctcgcctctgccgccgactccggctgcgaatccaccgcagatcggcgcgggggctccgcttgatgcccgatctgtgagagcggctcaccaccatgagggccgtgctgctgctggcgctgctcctgtctgcttgcgccgcggcggcggcgcaaggggccaactccacggcgttcgtgccgcgggacgacatccgcctggactgcggcgccaaggggcagggtaacgacactgacggccgggtgtggaccggggacgcgggctccaagtacgccccgccggacaacctcgcctcggtggcctccgcctccggccaggatccctcggtcccgcaggtgccgtacctcaccgcgcgggtctcggcctcgcctttcacctactccttcccgcttggcccgggccgcaagttcctcaggctccacttctacccggccaactataccgaccgcgacgccgccgacggcctcttctccgtctccgtcgccgccccggggggcaagctcacgctcctctccaacttcagcgcctaccagacggctgccgcgatcacctactcgtacctcattcgggagttctccgtcaacgtctcgtccccgacgctcgacctcaccttcaccccggagaaggcccaccccaacgcctacgcgttcgcaaagcggcattcggaggtcgtgtcctcccccgacctcttcgacatctccaccccctcttcgacatctccaccccaacatgctttgccggcgacggcaatctccagccgttcccgatcgatgctggcactgcgatgc

SEQ ID NO: 981 - DNA, 2194 bp, Zea mays
gcagtaaatccaatcgggcccaacccattcggctgagtggctgacgccgcctcaccccatgcagcttgctgccccatccggccatccccgattccccgtcccatcgccattcgccacgcctagacccaaccttggttcgttccggtccgttatcaccgctcccatttatttataacctcaccccagcctccccttcccagttcccagttcccaccacttcaccataaccaggtcaacccggcgcaaggagcacgaacaggaaccgtccagcggagcaaaggcacccgcagccgcaggccatggacgatgacatcgacagctcctgctccaccccgttcgccagcgcgccgtccagcccgggacgtccccaggccctcggcggcggtggcggctacttcttcagcgcgccggccagccccatccaccacctcctcctctcgacctcgtgctccgcctccgcgacccccagctccggtgttcgtgggtgcgggggcgacgcggagttcgagttcggtgggcctggcgggcccatgatctccgccgacgagctcttccacaacggccagatccggccgctcaccctgcccccactcccggatctcgaccccggaagcgacgacaacgagggccgcgcgccgacgcgcggccgcgacctcacgccccggagcgcgtccgtgcaccggcgcgcgcggtccatgtccccgctccgcagcgcgtcaccgcggctcaagctgatcaatgcgctcgtcgttccggcgccggatctcggccccggccccgacgcgacgggaacgcacggggaggcagccccgccggtaaccgcctcgtcccgctcgtcctcgtcctcctccacgtcctcctcgtcctcgtcgggcacgtcgtcagcgcgcgggtcccggcgctgggtgttcatcagggacatgctcctccaccgcagcaagagcgagcctggcagcggcgcccacgcgcacgacgtccccggggcgcccgccgctaacaagcccgaacgagcctggcccttctcctccccgtcctgggtaaccagggacaggctcgccgcgaggctccgcccctctcgcgcgccgccagcgacggagaacgcttgcggtctcggtggccaggatggccggccgcgggggcagggtaggggccggggccggggcaggcggcgacgttccactacggtggcggcggcgcacgagaggctctacgcggcgccgaaccgtgcgcaggcggaggagatgcggcggcgcacgttccttccctaccggcagggcctcctgggttgcctgggcttcagctcccgcggctacggcgcgcttcacgggctcaccaaaaccctcaaccccgtattctctcggtgaaaagtcatcgtcaaaaggaaaccagagatcgggccaggagcttgatttgccacctgttcgtcctgttcatgtctgcgagcatttttttttatcttcgttgtttgtgcgcgttctgtatatatagcagtgtcagtgtcgagttcggatcggaaggtagtttgccgatggtcacgtcaagcagaacatctgagagagaagcaatgcaatcgatgaatatggcgcgaaaacagtcgctggcgccttttctgtgtgcgtggtagtgtgtgtgtgccaagtataaaagcgtgtgatgttgcagtatcctgtgaaagcagtctcgctgcaccagatctgtagtacactagtactgctccattacgtgtagctccttcagctaggacgatgaagcagcttgggttcggctggcgacacgtccgtaaaatacgtgtattcctacgggggcatagtatgcgtcgtattgagcgcaactctcggcttttactgctggacgtggtcttgcagttgcacggatattttttttttctgtttgagaggcgtacgaacctgccctgcaacgtgcaaccatctttgcacctcctttacgccggccccgcttttgggagccggtacggaacgaacaaaaagataggcacgcgtacgttgacgcccgccggcaagcccggcatggcatcgacaatttcacacaggcacgacgcccgtcggcatggatcgacaggaaaatcatctgtatcgttcactcgcgtcaaagtcatgcgtctcctttcccgtcgtcaagaactcaagatgcattggacgtcgggaaagctgcgctcggatcgcatgcactgcag

SEQ ID NO: 982 - DNA, 2427 bp, Zea mays
aagcgggtcaaaggccgggataagaatcagaagaaaaggacccgagcctagggttcggtctgcctcccacagccgccgctacgctttggctgcatcactcgctcctcttcggagcctccctttcgccggcggcgtaggaagagatggcagagcgtttgacccgtatcgccatcgtcagcgaggacaagtgcaagcccaagaagtgccgccaggagtgcaagaagagctgccccgtcgtcaagactgggaagctttgcattgaagtaacttcggcatcaaaactagctttcatttctgaggagctgtgcatcggttgtggtatctgtgtaaagaaatgtccatttgatgccattgaaatcatcaaccttccaaaagacttggaaaaggataccactcaccgatatgggcctaataccttcaagttgcacaggttgcctgtcccaaggcctggtcaggttttgggccttgttggaacaaacgggattggaaagtcgacagctcttaaagtgttggctggcaagctgaaacctaacttggggcgcttcaaaaacccacctgattggcaggaaattcttacatactttcgtgggtctgaacttcagaactacttcacacgcatattggaagataacctgaaggcaatcatcaaacctcagtatgttgaccacattccaaaagctgttcaagggaatgtaggacaagtacttgaacagaaggacgagagggatatgaaatctgaactgtgtgttgatcttgaattaaaccaagttattgaccgaaatgtaggagatctttctggtggtgagcttcagagatttgcaatagcagttgttgctgtgcaaaatgcggaaatctatatgttcgatgagccatcaagctaccttgatgtgaagcagaggctaaaagctgcacaagtcgttaggtccttgcttaggcctaacagctatgtcatcgttgtggaacatgatttgagtgtcttggattacttgtccgacttcatttgctgtttatatggcaagccaggtgcttatggtgtggttaccttgccattctctgtccgagagggtatcaatattttcttggctggatttgttccaacagaaaatcttcggttccgagatgaatctcttacatttaagattgcagagactcaagaaaatgctgaggagattgagacgtatcagcggtataagtaccctactatgagcaaaacacagggaaatttcaagcttactgttgttgagggtgaatttactgattcccagattgttgttatgcttggtgaaaacgggacagggaaaactacattcatcagaatgctggctgggttgttgaagccagacacggtggaaggaactgatattgaaattcctgaattcaatgtgtcgtacaagccccaaaagattagcccgaaattccagaataccgtgaggcatttgctgcatcagaaaattcgggattcctatatgcatccgcagtttgtgtctgatgtgatgaaaccactgcaaattgaacaactcatggaccaagaggttgttaatttatcaggtggagagctccaaagagttgctatatgcctctgccttggaaagcctgcagatatctatctgattgatgaaccaagtgcttatcttgattcggagcagcgtattgttgcctcaaaagttatcaagagattcattcttcacgcgaagaaaactgcatttattgttgagcatgatttcatcatggcaacatacttggctgacaaggtcattgtttatgaggggcgaccttctattgactgtactgccaacgcaccacagtctttagtatctgggatgaataaattcttatcgcatctcgacatcacttttagaagagacccaaccaactataggccacgtataaacaagttggaatcgacaaaggacagggaacagaagtcagccgggtcctactactacctcgatgactaatgaggaagtgcagattcttcttggagagccatatgtcgcataatctttccagagcgtggaaaggagaagctactttgaagctaccactgcatcatggcatgtgacttgttgaataattggttgcaggagtagagtgcgccggttataacttataaagcagagcatgccgtgttgatactgagttttttgttggcttgacctatatgaagagaaggatcggtgttaaaatgagatttgcgagggggaactaatttctgtttttaagcaatactgtactgtcgttttgctatcaagtatatttgaccctcgattatatagattacattgaagtttttgggcaacaatgtgaaatcttgtgataaatctctgtgcttattggttatctgattgtaactcgtcctttgtaaactttgtttgaatgagcaagtgaactgattgtcgatagtttgttccaaaaaaaaccccaccc

SEQ ID NO: 983 - DNA, 2582 bp, Zea mays
  misc_feature (8)..(8): n is a, c, g, or t
  misc_feature (23)..(23): n is a, c, g, or t
  misc_feature (2496)..(2496): n is a, c, g, or t
gtaccctnccgagccttccgggnaaaataaacaacaaaaaaaaaaaaaaaaaaaagtcggacataaaaaccagaaacgcggccccccccccagggtttcgtctgtctcccgacgccgccgctaggctttgcgcctttgcctgcatcactcgctcattcggagcccctctcttcgccggcgtcgtaagaagagatggcagagcgtttgacccgtatcgccatagttagcgaggacaagtgcaagcccaagaagtgccgccaggagtgcaagaagagctgccccgtcgtcaagactgggaagctttgcattgaagtgacttcggcgtcgaaactcgctttcatttctgaggaactgtgcatcggttgtggtatctgtgtaaagaaatgcccatttgatgccattgaaatcatcaaccttccaaaagacttggaaaaggataccactcaccggtatgggcctaataccttcaagctgcacaggttgcctgtcccgagacctggtcaggttttgggccttgttggaacaaatggaattggaaagtcgacagctcttaaagtgttggctggcaagctgaaacctaacttggggcgcttcaaaaacccgcctgattggcaggaaattcttacatacttccgtgggtctgaacttcagaactacttcacacgcatattggaagataacttgaaggcaatcatcaaaccgcagtatgttgaccacatcccaaaggctgttcaagggaatgtaggacaagtgcttgaacagaaggacgagagggatatgaaagctgaactgtgtgttgatcttgaattaaaccaagttattgaccgaaatgtaggagatctttctggcggtgagctccagagatttgcaatagcagttgttgcagtgcaaaatgcggaaatctacatgttcgatgagccatcaagttaccttgatgtgaagcagaggctgaaagctgcacaagtcatcaggtccttgcttaggcccaacagctatgtcatcgttgtggaacatgacttgagtgtcttggattacttgtccgacttcatttgttgtttatatggcaagccaggtgcttatggtgtggttaccttgccattctcggtccgagagggtatcaatattttcttggctggatttgttccaacagaaaatcttcggttccgagacgaatctcttacatttaagattgcagagactcaagaaagtgctgaggagattgagacatatcagcggtataagtaccctactatgagcaaaacacaggggaatttcaagcttactgttgttgagggtgaatttaccgattctcagattgttgttatgcttggtgaaaacgggacagggaaaactaccttcattagaatgctggctgggttgttgaagccagacacagtggaaggaactgatattgaaattcctgaattcaatgtgtcttacaagccccaaaagattagcccgaaattcaagaacaccgtgaggcatttgctacaccagaaaattcgggattcctatatgcaccctcagtttgtgtctgatgtaatgaagccactgcaaattgaacaactcatggaccaggaggttgttaatttatctggtggagagctccaaagagttgctatatgcctctgccttggaaagcctgcagatatctatctgattgatgaaccaagtgcttatcttgattcggagcagcgtattgtggcctcaaaggttatcaagagattcattcttcacgctaagaaaactgcatttattgttgagcatgatttcatcatggcaacatacttggctgacaaggtcattgtttatgaggggcgaccttctattgactgttctgccaatgcaccacagtctttagtatccgggatgaataaattcttatcgcatcttgacattacttttagaagagacccgaccaactataggccacgtataaacaagttggactctacaaaggacagggaacagaagtcggccgggtcctactactacctcgatgactaatgaggaagcacagattcttcttggagagccatatggcgcatagtctttcgagggcgcggagagtgcggaaacgagaagctactatgaagctaccacactacatggcatgagacttggttgcaggagtagagtgcgccggttataacttataaagcagagcatgctgtgttgatactggtttttttttccctttttggcttgacctatatgaagagaaggatcggcgttaaaatggtattgtgaagggagaggtttttaagcaaaaatactgtaccgtcgttttgccatcgagtatatttgaccctcgattatatagatcacattaaatttttggagcaacaatatgaaatctcgtgacaagtcgttgtgctttttggttctgattgtaattcattcttgagtttgaatgatcaagtacgatggtaacagacaaaaaaaaaaaaaaaaaaaaaaaaaaaaaaaaaaaaaaaagggaaaaaaaaaaaaaanggggggccttgggcctccagttttggtccctttaagggggggtaaatggccccctgggggaaacaagggcaaaagctgttccctgg

SEQ ID NO: 984 - DNA, 2104 bp, Zea mays
  misc_feature (3)..(4): n is a, c, g, or t
  misc_feature (20)..(20): n is a, c, g, or t
  misc_feature (27)..(27): n is a, c, g, or t
  misc_feature (37)..(37): n is a, c, g, or t
  misc_feature (49)..(49): n is a, c, g, or t
ctnntggagctccccgcggnggggcgnttcctccaanggtcccccgggntgattcccccccccccccccccgaggaagcacgacgtcctctaggaagaagcacagccgcagccgcccgcaggctatggacgatgacatcgacagctcctgctccaccccgttcgccagcgtgccgtccagccccggacgtccccacgccatcggagcctccctttcgctggcggcgtaggaagagatggcagagcgtttgacaagtgcaatcccaagaagtgccgccaggagtgcaagaagagctgccccgtcgccaagcccgtggttgataagcggtgagtactgtcacatgcgccagacgatgcaaaatatacgaagtagtggttgataaacagtgagtactgtcacatgcgctagacgatgcagtggttgataagcagccacaggaccagggacctcttatcttggacaagctgatttctagaagcaaggatgatgctctccttgcataccaaactgctctcgatcttgctgaaaatgaaaaccaggctttcctcctaaatgtgcggaatcagcttgatgcattgagttcacatacttctgcccatgtgtacccatgcgagcagactggttgtacaaaataatcaaactaatgctgctacagaaccatctgaggatgtccagatgagggacgacataaccatgccaaatgacagtgttgccactatggatccaaatgcagcaacacatgctggtaggctgacaaatcaagggtatattgtgaggagagacatctattcagttgacgttgcagttcctatacaaccatatataatagttaataggcctgatcttcaaattttgaagactaagcaagctgtgaaaatgaggaacaatgtctgccacaacgcagggacaacagttgataccttcctcagagaaaacttggtgtggtttgttttatacagtgtacttgctataaactgcttagcattttcaattttaatagaaaccatagcgacgcacgggcacctaactatattatttatgattggcatttttttaaagtattaatcttagtttttagttgctatagtttgcatgtaggttttacatgaaataatcttattaacaacgttgtgatccctcgcccaccgccaagcctgtgctctctctagcatcgtctccctccgttggcaaaagcgcccagcggttgtcctcgcccgcaaacccaaattttgagtttttacagctacgaatgtgctattttggattttagctcatttgattgacaaaagttgcctgtaataggctgaatcaaactggagagactcttattatgtacttactattcttagacattgggagtttgtcatgtatgctatattgttgttgagtacaagtctcatgaagtcataattttgttttatttagctctcgttatagaagtattatttgtgtttttattcttctgtgctatgcatttttgtctacatttttagtaatattatttttttactattttagtggtatcattatgttgttttattccatttgcagattctataatctcttatattcaaagagatcatatggaaaccatatgtcccagatttagcatcaatatgggcaagaaaaactgtaatagtttttgacctggaggttgggatatgcaagaacgaggggttgtgcaatctgaagagcaaggactgggacctttccttcaggcttcagcacccacgtgttgcacattatattttagggccagctaattgagggataagtaggttctgctaatcaagggaaaaactacttttgaatttgatggctcctatgtattgaatttatcacttttgtggactcctcaatagtttcataattctaaaaaaaaaaaaaaaaaaaactcgagggggggcccggtacccaatccgcctatagggagcgtataccatccctgggcgccttttaaacgtcggactggaaaaccctggggtaacaaactaatcgctttgaacaatcccctttccccagtgggaatagcaaaaagcccgacgatgcccttcaaaattggccactgatggcaatggaattgaaaggtaaattggtaaatccg

SEQ ID NO: 985 - DNA, 1062 bp, Zea mays
  misc_feature (5)..(5): n is a, c, g, or t
  misc_feature (24)..(24): n is a, c, g, or t
  misc_feature (31)..(31): n is a, c, g, or t
  misc_feature (34)..(35): n is a, c, g, or t
  misc_feature (80)..(80): n is a, c, g, or t
  misc_feature (87)..(87): n is a, c, g, or t
  misc_feature (92)..(93): n is a, c, g, or t
  misc_feature (95)..(96): n is a, c, g, or t
  misc_feature (104)..(105): n is a, c, g, or t
  misc_feature (111)..(112): n is a, c, g, or t
  misc_feature (114)..(114): n is a, c, g, or t
  misc_feature (152)..(152): n is a, c, g, or t
  misc_feature (156)..(157): n is a, c, g, or t
  misc_feature (160)..(160): n is a, c, g, or t
  misc_feature (169)..(169): n is a, c, g, or t
  misc_feature (177)..(178): n is a, c, g, or t
  misc_feature (180)..(181): n is a, c, g, or t
  misc_feature (196)..(196): n is a, c, g, or t
  misc_feature (211)..(212): n is a, c, g, or t
  misc_feature (217)..(218): n is a, c, g, or t
  misc_feature (225)..(226): n is a, c, g, or t
  misc_feature (232)..(232): n is a, c, g, or t
  misc_feature (234)..(234): n is a, c, g, or t
  misc_feature (236)..(237): n is a, c, g, or t
  misc_feature (254)..(254): n is a, c, g, or t
  misc_feature (264)..(265): n is a, c, g, or t
  misc_feature (277)..(277): n is a, c, g, or t
  misc_feature (285)..(286): n is a, c, g, or t
  misc_feature (301)..(302): n is a, c, g, or t
aaggncgaccgcggcggccggaancactagnganncgagcggccgccggcaggaccctactagagcaaacacaggggaanttaagcnacggnngnngaggggannaccganncncagaagaagaaagcttttttttacgggacagggaaaanaccnncantagaaggcnggctgggnngnngaagccagacacagnggaaggaaccgacanngaaannccggaanncaaggngncnnacaagccccaaaagaanagcccgaaanncaagaacaccgngaggcatnngctacaccagaaaanncgggattcctatatgcaccctcagtttgtgtctgatgtaatgaagccactgcaaattgaacaactcatggaccaggaggttgttaatttatctggtggagagctccaaagagttgctatatgcctctgccttggaaagcctgcagatatctatctgattgatgaaccaagtgcttatcttgattcggagcagcgtattgtggcctcaaaggttatcaagagattcattcttcacgctaagaaaactgcatttattgttgagcatgatttcatcatggcaacatacttggctgacaaggtcattgtttatgaggggcgaccttctattgactgttctgccaatgcaccacagtctttagtatccgggatgaataaattcttatcgcatcttgacattacttttagaagagacccgaccaactataggccacgtataaacaagttggactctacaaaggacagggaacagaagtcggccgggtcctactactacctcgatgactaatgagttggagagccatatggcgcatagtctttcgagggcgcggagagtgcggaaacgagaagctactatgaagctaccacactacatggcatgagacttggttgcaggagtagagtgcgccggttataacttataaagcagagcatgctgtgttgatactggtttttttttccctttttggcttgacctatatgaagagaaggatcggcgttaaaatggtattgtgaagggagaggtttttaagcaaaatactgta

SEQ ID NO: 986 - DNA, 578 bp, Zea mays
  misc_feature (8)..(8): n is a, c, g, or t
  misc_feature (517)..(517): n is a, c, g, or t
cactaganccccccccccccccgaacaacatagaatgcattggcttgtactgtttgaagttaataaagccttctcttcactgaaatacatcttttaactattagacattgcaatgatatcccatgattagatacagtcatgtaaaacacacatctagaagcccttcagtaaataccgccattttctttaccttcaaattttatatattgttgactcttgccacttgttaccttatttttctgggggatgaacaagagatagaagaacttatggtcggccttgaaacctacctggttctacaatgtcctgtcaaaatataccagacatttccaaatctagattatttaaacagtttctagtgtcttatgttcttgagtcagcttaaaagtgttgcaagcatcttggacaagcttatttctggaagcaaggatgatgctctccttgcataccaaactgcttttgatcttgctgaaaatgaaaaccaggctttcctcctaaacggtgcggaaatcacctntggggcattgagttcacatacttctgcccatgtgtaccctctgtgcagactggttgtacaa

SEQ ID NO: 987 - DNA, 1691 bp, Zea mays
cctgcagtaaataattatacagggccaacccgtccgtctgagagtggctgacccctcctcgtgcccccgatccggccacccccgattcgccgtcccatcgccacggccaagtccaaccttcgtccgttatcaccgctgcaccgcccccattccattcttctccatttatttaagggaaccctcctatctccaccgccacttcacacgtcaacacggcaccagggggcaaggagcacgaacagcccacggaggaagcgcagccgcagttgcccgcaggctatggacgatgacatcgacagctcctgctccaccccgttcgccagcgcgccgtccagtcccggacgtccccacgccatcggcggcggaggctacttcttcagcgcgccggccagccccatccaccacctcctcctctcgacctcgtgctcggcctccgcgactcccagcaccggtgggcgtgggtgcgtgggcgacgcggagttcgagttcggcgggcctggcgggcccatgatctccgccgacgagctcttccacaacggccagatccggcctctcaccctgcccccgctcccggatctcgaccccgggagcgatgacgacgaggactgcggccgcgcgccgacccgcggccgcgacctcacgccccgaagcgcgtccgtgcaccgccgcgcgcggtccatgtctccgctccgcagcgcgtcgccgcggctcaagctgatgaatgcgctcgtcccggcgccggatctcggccccgcccccgacgcgaccggggaggctgcgccgccggtcaccgcctcgtcccgctcgtcctcgtcctcgtccacctcctcgtcgggtacgtcgtgggtgcgcgggtcccggcggtgggtgttcatcagggacatgctcctccaccgcagcaagagcgagccaggcagcagcgcccactcgcgtgacgccctcggggcgcccgccgctggcgctaacaagcccgaacgaacctcctggccgttctccccttcctgggtagccagggacaggctcgccgcgaggctccgcccctctcgctcaccgccggcgaccgaggccgctggcgaggatgcccggccgcgggggcagcgcaggggccgccggcgacgttccactacggtggcggcggcgcacgagaggctctacgcggcgccgaaccgtgcgcaggccgaggggatgcggcggcgcacgttccttccctaccggcagggcctcctgggctgccctgggcttcagctcccgcggctacggcgcgctccacgggttcaccaaaaccctcaaccctgtattctcccggtgaaacgttgccgtcaaaaggctccccaaccaaaaagtaaaaaaaaattgtaagaagcttcagtaaagttgttgggcgacttgattagccaccttttcgtacgttcatgtatgcgaacatttttgtttgtgtgcgttctgtacatagtcccgtcaagcagtgtcagttttgagtttgtagtttgccgatgatcacgtcaagcagagcagctgatagaatagagatatgcagacatgcaatgcaaatatgcaatcgataaatatggcgcaaaaaaaaaaacagtcgctggcgccttttctgtgtgcgtggttggtagtgcgcccatgtatataaaagcgtgtactgctgcagaagcagaatcttgaaagcagtttcgccgcaccag

SEQ ID NO: 988 - DNA, 1786 bp, Zea mays
tggaatttcaagcttactgttgttgagggtgaatttactgattcccagattgttgttatgcttggtgaaaacgggacagggaaaactacattcatcagaatgctggtaatgccatccctcctggcttccctctttatataactttttttatgctcatagtcattctgagccctcaccccccacttgatatggttaggattttaagtcctgggaatatcttgtgttgccttatgtgcaatatcaggaagttgtttcaacctcatgtactgttcaaaccaatcttgttatttgacatgcatatatcactgattttgtactgtttaggtgctttatagtagtgagttgcggttatcactatgctctattgctgtctaccacatgaacatgtcattgttctttttttgctaatgtgaatttgttggtactgcaaaatcttatgtgattgcattttggtctgtaatattatttttgtgttgggcttagtttcatatctgcttgctatacaagggtgcaaatcccttattcagatggatcatgttgaggggctaatgacttccatttttctctgattgtattgtactattcaagacttcactcctgcattcctttgattactagaaaaaagttcacaaggtctatgctacctttgtcacttctcttatctgtcatctctgtgctggctgggttgttgaagccagacacggtggaaggaactgatattgaaattcctgaattcaatgtgtcgtacaagccccaaaagattagcccgaaattccagaataccgtgaggcatttgctgcatcagaaaattcgggattcctatatgcatccgcagtttgtgtctgatgtgatgaaaccactgcaaattgaacaactcatggaccaagaggttgttaatttatcacgtggagagctccaaagagttgctatatgcctctgccttggaaagcctgcagatatctatctgattgatgaaccaagtgcttatcttgattcggagcagcgtattgtggcctcaaaggttatcaagagattcattcttcacgcgaagaaaactgcatttattgttgagcatgatttcatcatggcaacatacttggctgacaaggtcattgtttatgaggggcgaccttctattgattgttctgccaatgcaccacagtctttagtatccgggatgaataaattcttatcgcatcttgacattacttttagaagagacccgaccaactataggccacgtataaacaagttggactctacaaaggacagggaacagaagtcggccgggtcctactactacctcgatgactaatgaggaagcacagattcttcttggagagccatatggcgcatagtctttggagggcgcccagggtgcggaaacgagaagctactgtgaagctaccactacatggcatgagacttggttgcaggagtagagtgcgccggttataacttataaagcagagcatgctgtgttgatactgttttttttccctttttggcttgacctatatgaagaaaaggatcggcgttaaaatggtattgtgaagggagaggtttttaagcaaaatgttgtaccgtcgttttgccatcgagtatatttgaccctcgattatatagatctcattaaatttttggagcaacaatatgaaatctcgtgacaagtcgttgtgcttttttggttatctgattgtaattcattcttgagtttgaatgatcaagtacgctgattgccgaaaaaaaaaaaaaaaaaagcccccgactagttctctcctcgtgc

SEQ ID NO: 989 - DNA, 3142 bp, Zea mays
  misc_feature (1688)..(1688): n is a, c, g, or t
tgatatattcatgttatttagaacaagttatgatctatttcaaaaacaggccgggattttcgagcaccatgctcacgaaacatgaccgcgaacatgcgatccagttgttttaaatttgtataaaacacaaacaaagtcagaaaatcatgaaaattatcgacatatcatgatatcatatgtagatactacgattaaaaaattaaaaatgtttcgtgaaagctgtcatagattatgtgtagaaacttagacggcctccatagaagttttatgatttcatgtgaatgtcggctaggtttctacacatagtgtgtgacaacttttacgaaacactgacaattttttttatcgaagtctctacatatgacatcttgacatgtcaacaagtttcatgattttcttactttgtttgtcttttatacaattttaaaacaactagatcataagttcacgatcatgttttgtgagcatggtgtttgaaaattccggtttgttcctgaaatagggcgtacctgtgctaaataacatgaatatcatttttgccttcaccgttttccatttttcgagtgactagtagttcaaatctgaattatccgagaaaaatcaattaaacgaacaaaatctaagaattataaaaagacttttataattgtgccaaaattaaacatgtaggtctacatagtgtaggaacacaccacaaaaagttggtggaaaaagaaaaaaagtaaaatatactttgcagagtgtcaaaaaagacattcgacaaaatatagttgtggtagagtgttttgtaagatgacactcagcaaataagctattttgccgagtgtcaacgactgacgctcgacaaagttaacggccgtcaactatagatggctgctgacagccctttaccgagcgtcgcgttttgccgagagtttgacacgcggaaaagcccacttcaccgagtgtctcgctaaacaaagggtcgttgtcgagagtcttattttcgctgagagtggcattcggtaaagtattatttgtcaagtgctcgacaaaatacactcgacaaagcgtcgagcactcggtaaagaccggatttaagattatatttatcatctatatatactttaataatgagatttaactaggaactattgtgtacattatagtagatggtagcaagcctgctgccatcgcatgtggcggtggatcgcagatcggttggcagttgatgtagttccactgtcgattttttagtgtgtggctgaatggtcaccatcatataggtgcctagcctttctaatgttgcaggtgcaatttataaaaacaaaatactataaaaatagtagaaaccgatataatttaaagaacaggtctagtcgatcccacgcgccgtttgatatgggtcccttggcactgcacgctggttaattgaaaagaagatcgatcccgtcccgtgatgggtgccatgccatggtatgagctcgaggggtcagcgacaccagttattcatatcgttgaaagctacctgcattcatgttcttgggatccgatcggcgctcagcgtggcagctccgacgtccaaacctatgtcttccattccgcccatcctacgaattcattcaaggacggttggacgagaggtcgcctttgcaagccgcagacttgtcccttcgtccgtaaatgtgatctgcccggctggccctcancatgggcgtgcagtgccgacgacgtacgcagagtcgcagagcaacgaacggccggtcaggcgagcgcgacatcgcagggacacgggcgcggtgtggtcaccgtttccgcgcatgcaggatctgccgtgccggatcctctaagcttccacacactttccgtgagagcatgatcgacaaaaaaaaaacgagtacttagtatcaatggattcttcagactctgctgtgccggcgaactaaacaatgtgcggctacggttacggctacggcgaacaagcagaacacgcgacatgaaaagatagatctgtctcacttccatttcttattattctccagcacacgaacagtgaaccgctgcagacctattctgcagcaattcctttcgtgaaatccactttaacacacgtaaaattgaaataaattgatgtggatatatacgtgcatatccaaatagagtctcaatcctttcgtgaaaccgggccgcgcctgagcgactcggcgatgcccgtggcgaggcagtaggccacggactggatggtgaccatagggttgacgcccacggcgccgggcaggacgctgccgtcgcacacgtacaggctcccggcctcccagctctcgccgcgcgcgtccacggcgccgtcccgggccgtggcgcccatccggcagctgcccatctggtgcgcggtgcagcacagggtccacgcctcggccttcgactggggcccgcgcaccacgtccacgccgtccaggaactcctccagcgcggcctccgtggcgcccccgcacgcgaaccgctgcccgtcgctgcggtgggtgccgatctccgccgcgcccgccgcggccaggacgcgcagcgcgcgccgcatgccgtcgcgcatgttctcccggtccgtggcgtccaggtggtacgccacccgccgctcgccgtgcacggtgccggacccgcggtcccttaccatggagaagaggtgcaccgtgcgcccgtacctgagcatccgctccttcatgtcgcgcccggacacccaggggaactgcgtccccgcgccggccaggcccatcgccggcgcctcgaggatggcgcgggccggcgcgcccggaccgccgccttccaccttgtgcagggacgtgatgatgccgccctcgtacatcctgcccctgaggtccggcacggtgtccgggaagtagccccacaccagggccgtcgggtggaggtggaggttcttcccgatgtgccggttgcggagcccgctcccgcgcagcagcaccggcgtcaggagagacccgcacgccgagactgtcaccctggcggtcacctccagcgtcctcgtgatcgccgggttggtgctcctcgccaccacgccgacgcatcgcttcgccctgccgtccgcggcactgccaggctccagcagcagcttctcggccttgcaccccgtcaggatcaccgcgccgcggctcac

SEQ ID NO: 990 - DNA, 1779 bp, Zea mays
gggtacctcgaggccggccgaccccggcccccccgggacgtctcctcgttcaccctgtcggactgcagcgcgcacgccccggccggatcagagagatgggcaccgtcggcggcggcgagcttcccgtcgccgacccggccgccgccgacgcagaccgggcgcggctgcagcagctggggtacaagcaggagctcaagcgcggcctctccgtcgtttccaacttcgccttctcccgcgcccgcggccccgcgcgggcgggcgtgacgacgacctacaacaccgggctgcgctacggcgggccggcgtccatgacgctgggctggctcgtcgtggcgaccttcaacggctgcgtggcgctgtccatggcggagatctgctccgcctacccgacctccggcggcctctactactggagcgccaagctcgccggcaacgaatgggctccacttgcctcctgggtcaccggatggttcaacatcgtggggcagtgggcgtgcaccacgagcgtggacttctcgctggcgcagctgatccaggtgatcatcctgctgagcaccggcggggccaacggcggcggctacctcgcctccaagtacgtcgtgcttgccatctacaccgccatcctcgtcgtgcacggcctcatcaacagcctgcacatccagtggctctcctggttcggacagctcggagccttgtggaacgtcgcgggcgtgttcgtcctcgtcatcctggtcccgtcggttgccaaggagagggcgagcgccgagttcgtcttcacccacctcaacaccgacaacggcatgggcatccacagcaaggcctacatcctcgccgtcgggctgctcatgagccagtactccagcattggctacgacacgtcggctacatgacggaggagacgaagaaggcggactggagcgggccgatggggatcgtgtactcggtcgctctttccagcgtgttcgggtgggtttacctgctggctctcacgtcggtggtcactgacatcccgtacctgctggacaccggcaacgacgccggcgggtacgccattgctcaggccctgtacgacacattccgccggagatacggcaccggcgccggcggcatcgcctgcttagtcatcatcgccgtcgccgtcttcctctgcggcaccgcctgcgtcaccagcaactccagggatgggctacgccttctcctgggacggggcgatgccgttctcgcacctttggtaccgggtgaacaagcaggaggtgcccttcaacgtcgtctggctctctgtgtccgtggcgttcgtcatggcactcacgtcgctggggagccaggtggcgttccaggccatggtgtccatcgcgacgctgggtctctacatcgcctacgcgctgcccatcttcttccgcgtgacgacggcgaggaagtcgttcgtcccagggccatttcacctcgggagatgcggcatcgctgtcggctcggtggccgtgctatgggtggccctcgtcaccgtgctcttctgcctgccggtggcgtaccccgtcgccaaggacaccttcaactacacgccggtggccgtcggcggcgtgctggtgctcagcctcgtcgcgtgggtgctccacgcccggttctggtttcgtgggcctatcacaaacgtctgacgttgtttgcaggctttcggtagttactttcgatgcattttatgtagtgtcaatctgttttaatgtcattgaacataaacatgaatatgaatatactcctatacacaggtattgtggttggaactgg

SEQ ID NO: 991 - DNA, 2883 bp, Zea mays
  misc_feature (2179)..(2179): n is a, c, g, or t
  misc_feature (2352)..(2352): n is a, c, g, or t
cattgggtacctcgaggccggccggacagcctgccccccggcccgccagttaccccccggacctcctccgccgatcggcttcctcctcccagtcccgaaccgcacgcgctcgatttcccgcaccccctctagcctctagcggccatgtcgcccgccgccgccaccacaaccttcgtcgcaatctccatcgccgtccccaaccctaccgctccatcccgcggtcgcgtgcgccttccgctaggcggggtccccgctgctccacgccgcgccgtcgcctctatggcagtgtccgcccccaggtccggcgccgccacctcgtttctcgagcgccgcgagtcggagcgcgctctccactttgtcaaataccagggcctcggcaacgacttcataatggtggacaacagggattcgtcggtgccgaaggtgacgcccgaggaggctgcgaagctgtgcgaccgaaacttcggcattggcgccgacggtgttatcttcgtcatgccgggggtcaatggtgccgactacaccatgagaatcttcaactctgatggcagcgaaccagagatgtgtggtaatggagtccgttgcttcgctcggtttatagccgagattgaaaatctgcaggggacaaatagattcactattcatactggtgctggaaagatcgttcctgaaatacaaagtgatgggcaggtaaaggttgatatgggcgagcctatcctttctggactagacatccccacaaaactgctagctaccaagaacaaagctgttgttcaagctgaattggcagttgagggcttaacatggcatgtcacatgtgttagcatgggaaaccctcactgtgtcacatttggtgcaaatgagttaaaggtattgcaggtcgacgatttaaaacttagcgaaattgggcctaaatttgagcatcatgaaatgtttcctgctcgcacaaacacaggtaactctttaatatccttgccaaaaaggtaactcttaatttattttgcttctataggtacatcctggtgtttgtattttatttaagcgacttcttttttgcagaattcgtacaggttttgtctcgctcacacctcaaaatgcgggtctgggaacgtggtgctggtatgattaatcttatcttaaccttctttaactgtagcatatgtcattgcttgaatgttagaataatagaatgtcttatcttttgctgcctcctgcatctgtattttgaacttcgctcatatttttggtgtatgtatcaatgtcatcggtaccacattgtagtttgcaactccataatgcaaacggctaaaatatatgtttgactttaagtgacacctctgttatatttgtgcattcgtcatttggagtgaatatgcaaaatgaatgttaaggtttgactgtaggagcaactcttgcctgtggtactggtgcttgtgcagtggttgttgcagctgttcttgagggtcgagctgagcgggtttgtcattctttcctttctgtgtgtttgctattttggcatttcactcatgattcatattcactatagtttatagtttttgttataccttattctttaactttttatcatgaaacagaaatgtgtagttgatttgcctggcgggccattggaaattgagtggagggaggatgacaatcatgtttacatgactggtcctgcaggcgtcctcttttatggatctgttgttcactaggttagttttatgaggtctaagattcctacttgcatctcaacaattttagtcaacattagacactgatatgaatgaatactgcttggtcattataagcagacatgtttctatctaaaaagaaacgctgaaatctagtgctaaagtaggtagaatagcagacatgttgaaatctaacatgttggtattggaatctagttgtgctggtatcaaagtgtgttgctaatatactaatttatagtaatctaagaaactcacctgtactctttcgtaattgcattttaaggggaaatacagtagcccctactgtgcattttattaaaaagaatgaaaataaaaggagttacataaaggaagacaaaacctgtatagatgaaaagtagaattgatgacatgaaacaagcagccaagacagaaaaagagcacaagagctagttaatcatgttaggttactgtgtgtctttctaatntaatggctttggcccaacccatgtactgttactatatatatgctgagcctacctgaatcagggttaggattttcctctcccaacatggtatcaagccaccaatcatgtcttcctcttcccttcttccctcactcgcctaagcgccgccgggctccctccagtggcgaatctanccaagaatattattggggccattagaatcggtttcattatatgataccctatttttacaactttaatagtgttttactaaatgatttacaaattttatcggggtcaactgaccccaacaaaccccctagattcgcccctagctccctctcatggctggcacccctctcctctatggcagccggcacgtctccaccgcccgccctcctctactcagaccccatgcccacggccatctgctctgccctagtgctcgcggccatttgccctatgcttgagagagcccgaacgctggcacccccgcccgtctggccgccctcttctactgcatcgacgcccggtgtcctgcccctgcctctagtcgcgcccagcctctcaacgcctgcgcctaggtccctcatccccaccatcggagttcggttccacaaagaaactagaggtccacaaagaaccaggtctctttcaactagggatgttcctaaaacatctgaattatatgacaaatctaatattttagcatagatatgcataga

SEQ ID NO: 992 - DNA, 1612 bp, Zea mays
ttgggtacctcgaggcccgcaaaaaacattcaggtttatgtaccggtgacagcgaccgcgacacggcctctcccccggaccgcacccgctgtagccgccatgtcgtccgccgccgccacagcctttgccggagtctccgtcgccaccccgaacctcaccactccatttcgcggtcgcgtgcgccttccgctacgcggggtctccgctgccccacgccgcgccgtcgcttcgatggccgtgtccgcccccaggtccggcgccgccgcctcgttcctggagcgccgcgagtccgagcgcgctctccacttcgtcaagtaccagggcctcggcaatgacttcattatggtggacaacagggattcgtcggtgccgaaggtgacgccggaggaggccgcgaagctgtgcgaccgaaacttcggcattggtgccgacggcgtcatcttcgtcatgccaggggtcaatgatgccgactacaccatgaggatcttcaactctgacggcagcgagccagagatgtgtggtaatggagtccgttgctttgctcggtttataggcgaacttgaaaatctgcaggggacacatagcttcactattcatactggtgctgggaagatcattcctgaaatacaaagtgatgggcaggtaaaggttgatatgggagagcccatcctttctggagcagacatccccacaaaactggtagctaccaagaacaaagctgttatccaagctgagttggcagttgagggcttaacatggcatgtcacatgtgttagcatgggcaacccccactgtgtcacatttggggcaaacgagttaaagaccttgcagatcgacgatttaaaactcagcgaaattgggcctaaatttgagcatcatgaaatgtttcctgctcgcacaaacacagagtttgtacaggttttgtctcgctcacacctcaaaatgcgagtctgggaacgtggtgctggagcaactcttgcctgtggtactggtgcttgtgcggtggttgttgcagctgttcttgagggtcgagctgagcggaaatgtgtagttgatttgcctggcgggccattggaaattgagtggagggaggatgacaatcatgtttacatgactggtcctgcagaggccgtcttttatggatctgttgttcactaggtactggggagtggggaccaagatagaagggttggctgccactcaaagcttgtgagattggttacaatatccatgaaactgaatgttctggtgccagtacactcgtttagatattttaaattatggttgcttgatttgggtagcagtagaggcttccttttgaagcattctagtgttgtccaccttttgtactcctttagtctgtcaggtttgaactacattgttagcatgtctttccaaccattttctgtttcttttctttgcaagttaacgtcaatgcagcttcagtattgttttctacagatttatcttgatgcactgcagaatgaatgggcttactagtttgctggtatgaatgttgcctaaagccgccctcgcgctcccttctgaagtgcttctgacaaaagacagcatgggttattggttatgactcactgctcatttcacctgcaac

SEQ ID NO: 993 - DNA, 2213 bp, Zea mays
attggttatagagtagagtttataatataagagggagataaaaacaaactagagacattagtattagtgggttaggttaggtacatgcctaaacacaagcaagtgggcagaccactaaagtctacaacagcttcagctgcagcgttcctctcccgtatcctgtgccagctgactcgccttctcaagttctgaaacgcagcggagcgcgccggaggagagcaaagcggacagtggaggatagagagagcagaacaccagatcagatcagatggcgcctccgtctccccagccgccgctagtgcgcgtgctcgaccgcatccgcgtctcgccgccgccggctgattctgagcaagagcccgcgctccccctcactttcttcgacgttgcctggctcttcaccggccccgtcgagcgcctcttcttcttccgccacccggagccggcctccactctcccgctcctccgctcctcgctctccctcgcgctccgccgcttctacccactcgccggcaccatcaggccccacgcgcccttcctctgctcctacacccatggtaccgatgccctcaccatggtcgtcgccgagtcgaacagccccgacgatttcgacagcctcgtagccaggtcgcccagggacctggacgggatccgccccctcgttccgcagttgccgccgccgggggaagacggagcgttcgcgctcgccgccgtgcaggccactgtcttccgaggccgtggcctctgcctcggcgtctccgtccaccacgctgcctgcgacgatgcctccaccatgcatttcgtccgcacctgggccgctacctgccgcctaggactcgagaacgacgacggatccgaggacgccgtgctaccgccacggccggtgctggaccgctccgtcgtcgccgaccccgacgacctgcgcgggaagacgctcgccgggatggcgcgcctcgcccctcctccttctccgccgccgccgcagcaggaggagaagacgccgatggtgatggcgtcgttcctgctggggcgcgagcagatcgaccggatcaaggagggcgcggcagcaaaggcatcgtctttcgtggcggcgtcggccttggcgtgggtgtgcctcctcaagtgcggttccgttggcgtcgcgggcgcccggcgcagccacatgctcttctccgccgagtgccggtccaggctgacgccaccgctgccggccgaatacttcggcaactgcctgcgcccctgcttcgtggaagccgccacggcggaccttctctctggggaaactgaggacggggtggctgcggcggcgtcggcgatcgggagcgcgatccaggagatggagcagggcgtgctggaaggcgcggaggggtggttgggcagggtgctgtcggtgcttcccgagcggcccatgtccgtgggcgggtcccccaggcacggcgtgtacgaaaccacggacttcgggtggggccggccggcgagggtggagatggtgtcggtggagaagacgcccgggacggtagcgctggcagacagcccggagggagacggaggcatcgagctcggggtggtgttgccgccggacgccatggatgcatttgcttcgtgctttgcgcatgccgtcggcgccaacgtctgattggcattccgatccgaggtgcagctgctgcgccaaaagattcgattgaagcagcgtattatttgtgcttgattaattgatttactttactgtcttgagagtgagctcgttcttgctgcggatgtgcgaagtcaaggaataaacaaccggattgttccgaaatcaatcaagcgtcactatgatttatgaatgaaccgtttgcaatgaccatgagattatgactgtaatatagaacaaaaaagcagggaagaagtgaggaacgcaggaacacaagcttagctgcaagggaacggagctggtacgatgtaggaaaatcttggttcttgaaacacagagcctagctcctttgttggctactaaaattgtcatgccaaagattttgcaggtaaaagttaccaatagttggacaaagatatttactattgatttatcaagctaaaccgagagaggttggcatatcatgcttgcatgctagcttgaaagctaaaattttagtttgtccaaatgttggcaaccaaactttcatcaccaacgcgatggaccgaattcccgtaaaaccaaagttagcaaggtcatccag

SEQ ID NO: 994 - DNA, 1700 bp, Zea mays
tcccgtatcctgtgccagctgactcgccttctcaagttctgaaacgcagcggagcgcgccggaggagagcaaagcggacagcggaggatagagagagcagaacaccagatcagatcagatggcgcctccgtctccccagccgccgctagtgcgcgtgctcgaccgcatccgcgtctcgcccgccgccggctgattctgagcaagagcccgcgctccctctcactttcttcgacgttgcctggctcttcaccggccccgtcgagcgcctcttcttcttccgccacccggagccggcctccactctcccgctcctgcgctcctcgctctccctcgcgctccgccgcttctacccactcgccggcaccatcaggccccacgcgcctttcctctgctcctacacccatggtaccgatgccctcaccatggtcgtcgccgagtcgaacagccccgacgatttcgacagcctcgtagccaggtcgcccagcgacctggacgggatccgccccctcgttccgcagttgccgccgccgggggaagacggagcgttcgcgctcgccgccgtgcaggccactgtcttcccaggccgtggcctctgcctcggcgtctccgtccaccacgctgcctgcgacgatgcctccaccatgcatttcgtccgcacctgggccgctacctgccgcctaggactcgagaacgacgacggatccgaggacgccgtgctatcgccacgtccggtgctggaccgctccgtcgtcgccgaccccgacgacctgcgcgggaagacgctcgccgggatggcgcgcctcgcccctcctccttctccgccgccgcagcagcaggaggagaagacgccgatggtgatggcgtcgttcctgctggggcgcgagcagatcgaccggatcaaggagggcgcggcagcaaaggcatcgtctttcgtggcggcgtcggccttggcgtgggtgtgcctcctcaagtgcggttccgttggcgtcgcgggcgcccggcgcagccacatgctcttctccgccgagtgccggtccaggctgacgccaccgctgccggccgaatacttcggcaactgcctgcgcccctgcttcgtggaagccgccacggcggaccttctctctggggaaactgaggacggcgtggctgcggcggcggcgcgactcgggagcgcgatccaggagatggagcagggcgtgctggaaggcgcggaggggtggttgggcagggtgctgtcggtgcttcccgagcggcccatgtccgtgggcgggtcccccaggcacggcgtgtacgaaaccacggacttcgggtggggccggccggcgagggtggagatggtgtcggtggagaagacgcccgggacggtagcgctggcagacagcccggagggagacggaggcatcgagctcggggtggtgttgccgccggacgccatggatgcatttgcttcgtgctttgcgcatgccgtcggcgccaacgtctgattggcattccgatccgaggtgcagctgctgccttcaacaacacaggaccaaaagattcgattgaagcagcgtattatttgtgcttgattaattggtttactttactgtcttgagagtgagctcgttcttgctgctgatgtgcgaaatcaaggaataaacaaccggattgttccgaaaaaaaaaaaaaaaaactatgatttggaaaaaaaaaaaaaa

SEQ ID NO: 995 - DNA, 1291 bp, Zea mays
ccctctgaaaacgatcgagagcgctggtgcagagtagcactcaactgactcaacagctcaagtcagcagcaactcaccatgcaaagaaggtgtcggttcatggctcgtttcaactttgaaagctgttgagtgtctgtatttgcaaagcagaactactgtcttgctatcttcagtgtctgtcagctgtactttactaagtaccaaacctgttttcaggttgcttcacacaatgattctacaagattaattatgcacaaccggagagggtctttccagttcacaaacctctacatttcatctaacaatagacgatgatatcatgtgaaaaatgcgccaagaacaacgtagcaaaaaaaaagagaaaacaagcaaaaccaaatcacaagtacccttcgctgaatcacatcacttgttgtatacactacggaccagagcagagacctgaccttggctttcggctctattggacttgccattctacacaatcatcgaagtcactgctagagcagtcaagcaacgcgttctgctgccgctcgtaccggcagatgtagttcaggccgacgagcagctcgcagaccgccgcctccgtcttctcccggtcggcgaagtacagcgtctgcagcagcagcacgctccgctccgacacgacccgctgctgctgctgctgctcgaactcgaagctccgctcggcctgccaccggaccgtgttgtgggccatgggggcgagccacgccagcgtcgtcttctcgagcgtctcccgccagtcgtgcgccaggaacgcgtcgtagatcgccgtgctcctcgcgcgggctctcaggctcctcctcagcgccagcttcaggctccgcggcagcatctggtacagctcgtcccgcgcctcctcgcccacgaggtgcgggtaccggagcagcttctcgacgacgatgacgatgttcgcgtagtgcagcgcgagggcggagccgccgaccgtggacgccggcgcgagcgatgtcaccgtgctcttcggaccgaaccgccgcgcctttctgccgatactgccactgttcggcgctggcggcgttgtggtggtggtggtgggtaccccctgctcgctgctgaatggtgcaagcatccctgatctgattgtgctgctgatgcagctggaatcttccgagaactcgtcctcgagcccgtccgtccatggcgctgagctactcaagctcaagcagtgcatgaacatcttcccggggctggctccacagctcgattgaaaactcactggccgcgacatgtctggatgatcgactctgca

SEQ ID NO: 996 - DNA, 2681 bp, Zea mays
ctttcttcgtatttaattcttttattattctcaccactaaattattagaaaaaggtcgtcaggaaaaaaaaactgaaccggccgtatatagcatcgggtacctcgaggccggccgggctcactgcactccactgctcaggtcgggaacgcagaggcgggggcaacaagaaggccgggcgagaagacaagaggaagccaaaaggagaacgagttcggaagggagcggatggcaatggctctgctccagctattgctgtcgctcctcatcgtctcctgcgccgcgcagtcgccgtacgcgtcgaaggctcctccgctcagcgcctcggcgccggggggctctgtcgcgccaccgacaacggcggtctcggcgccgcaggcgtctgcacagccgccgacaacagtcgccgcgtctgggcctcaggcctcggccgcagcaccaacaaaagcagccttggcgccacaggcctctgctgcgccgccaactacagctgcctcgccgcagctggctgccacgttggccccggtttcctcaccgccactagctgccgctgcgccacctgcatccgctacccctccaaccacgccaccatcggcaacgcagacgcagcctccagtcgcctccccgcccacggcaatgccaccagcggcggcgctccccccggccacgctccctccagcgatggctccgacgccacttctcgccgcccccgtcatgcctcccgccgccccaccggccacggcgcccgcgccggcccccgtgtctccggctccaactccaagcgtcgccccgaccccgtcgccgacagaagcccccgccccgtcgcccacaacagaggccccggtcccgaccccgtctcccgcgctggcgccgctcagctcggtgtcggtgagcccgtctctgtcgcctggacccgctctcgcccaggatgagtcggcggcgccgggctcgcgcaccgccgtcgccgctctggtgtccttggtggcggccgggctcgtcgtcttgttttaagtagagctgcgttaaccgttacacgcccataccgttcctcatacgcagggacgtgttctcctgtttgtgttttatggatgcacggatcattcttgttgtacaacacgttggtaatttgtttccattcattcatgtatggctgacggcctgcgcctgcgcctgcctgctgctttcttttgcaaacattactgtgatgcgtgtcatgcacacgtctctgagccttgtcgctagtaaaaacgcgtacgacgctgcgcttttgtacgcgtgctgtcacgtaaatggacgtgaagatgcctacaataggtagatgcacgacgcaggcgccaggtgaagacgaaaaagaaggtctggcgcctagaggaatgtgacctgccgtgacagtatgtcgaccgacgatgacggtagatccggtgctcttgccgacattttgtgtgaggggagcctgggaggcaggaacttctagcggtaccgacacaagtgacacgaaacgcgacgcacgtacaacgcagccgtgcatgcggcactgcagaagcatgtgaaatttggtggcgcgagggacgagatccgtagggacacagacactaccgtgccgcgtcgtccatctggtggtgggtggcgaggggccagggcgggccgtggccgcgcgttccgatgcccgccaaaagctggtgaaacgagacggagcaagcccaatggtacatcctcaaatcattcagccacccaccgttggttcacatttgacatttggactgacacaccgtgcaacgctatgccagtgcgtcatcttcgtattattactgaacgcgtggtcgagctcgctgctcgcagttactgggagtatggcgcagagacttcatcagactcgcactgtgaatcctaggctagctctgtcgcagaaacgccgcacaagcccgtcgcccgtggaaagcgcgtggggtcgcggcgaaacatgcgccggtcggtcagtccgttggctgctggcctggttctgagagcgagggcatcgccgtatgtgtatgtatgaaccatgagcagctgctagctgggactggggagcgacgacggatccacgttcatcgttgggtacttgggtgcgagctagctggtccccgagtctagtcactgccgccgatgacgaggcgtacgtacgtacgaattactagcctcgtgtctcgtctcgtctgccatgcagatgcagcctgtcgtcatggcgttttgcacggttggttgcctatgcgccgccgctatgcggacaccggccagcagcctgtcatgcgggttcatctacgtccgccgtcgacatcgaggctcaaggaaagtgaaggttggaagtgatacggcagccgctgcccttgtccgtgcttgacaaatcacacacaccagcctaccgagggagcagtgcgtaatcaagccgtcgtggtacgacgaacggccgggcccgattcggcggacgaaaaaaaaaggcgccgtcggttcacaaatatatgaacggagggagtacatgttaaaatgtgatgactccctgtcggcgctgctagtaacgaggtaagtttgccaaacgttttttttttcgcatcgattgaagaacgaccttttaagcctcgacttttttttatcaatttgttgcgagtgttagcttaaaatgtgatgtctacaccacgttgttgtgacc

SEQ ID NO: 997 - DNA, 1071 bp, Zea mays
cattgggtacctcgaggccggccgggctcactgcactccactgctcaggtcgggaacgcagaggcgggggcaacaagaaggcttggcgagaagacaagaggaagccaaaaggagaacgagttcggaagggagcggatggcaatggctctgctccagctattgctgtcgctcctcatcgtctcctgcgccgcgcagtcgccgtacgcgtcgaaggctcctccgctcagcgcctcggcgccggggggctctgtcgcgccaccgacaacggcggtctcggcgccgcaggcgtctgcacagccgccgacaacagtcgccgcgtctgggcctcaggcctcggccgcagcaccaacaaaagcagccttggcgccacaggcctctgctgcgccgccaactacagctgcctcgccgcagctggctgccacgttggccccggtttcctcaccgccactagctgccgctgcgccacctgcctccgctacccctccaaccacgccaccatcggcaacgcagacgcagcctccagtcgcctccccgccgacggcaatgccaccatcggcgctccccccggccatgctacctccagcgatggctccgacgccaacttctcgccggcccccgtcatgcctcccgccgccccaccggccacggcgcccgcgccggcccccgtgtctccggctccaactccaagtggtcgccccgaccccgaccccgtcgccgacagaagcccccgccccgtcgcccacaacagaggccccgactccgaccccgtctcccgcgctggcgccgctcagctcggtgtcggtgagcccgtctctgtcgcctggacccgctctcgcccaggatgagtcggcggcgtcgggctcgcgcaccgccctcgccgctctggtgtccttggtggcggtcgggctcgtcgtcttgttttaagtagaactgcgttaaccgttacacgcccataccgttcctcatacgcagggacgtgttctcctgtttgtgttttatggatgcacggatcattcttgttgtacaacacgttggtaatttgtttctaaaaaaaaaaaaaaaaaagcggcc

SEQ ID NO: 998 - DNA, 1744 bp, Zea mays
gcgggcattggcgctggccgccgcgctcggcccggccacggcgcgcgcccagctgcggcgggaccaccaggcgccgccgggcccgcgcccgcacagcgtcaccatctccgagttcggcgccgtcggggacggcaggacgctcaacacggtccccttccagaacgccgtcttctacgttcgctccttcgccgacaagggcggcgcgcagctgtacgtgcccaggggccgctggctcaccggcagcttcaacctcaccagccacctcaccctctacctggaggaaggcgccgtcatcgtcggcgcaaaggactcatcacaatggctgatcgttgaacctttgccatcttatggccaagggctagaccttcctggtcctagacatcaaagcttgatcagcggatacaacttaaccgatgttgtcataaccgggaacaatggagttattgatggccagggcttggtatggtggcagtggttgcgctcccatgagctgaaccatagccgacccaaccttctggagttcctgtattctgaagatattgtcatctcaaacttgacattcttaaattcaccagcctggagcatacacccggtgtactgcagtaatgtaaaggtccacaatgtgacgattaagacctcattggacgctccactgactgatggcatagttccagattcatgttcaaacttatgcattgaggacagcaccataagtgtcagccatgaagccatctccctgaaaagcgggtgggacaggtatggcatttccttcgggaggcctacctccgacattcgcatcagcagagtggacctgctatcatcttccggagccgctcttgcattcgggagtgagatgtctggtggtatctcagacattcatgttaaccacctccggatccacgactcctccaaaggtatttctttcaagacctcacccggccgtgggggttacatcgaggacgtggtcatctcggaggtacagatggaaaatgtgcatgtcggcatcgagttcaccggcaactgctcgacccacccagatgacagcttcgatccgtccgacctcccggcgatcgaccatgtcaccatgaagaacatggccggcacgaacatctcggtcgccggagttttgtcgggaatcgaaggagccccattcacagccatctgcctttccaaccttaacttctctatggctgctggttctggtccgagttactggtcttgctccgacgtttccggctactccgaggctgtctttcctgaaccctgcacagagctccgtgatccgtcctccagctcttccgtctgctattccctggccagctacagcgccattgaaacagcataaatgtccatccatccttccatccatttcttgttctccccttgagcctgcatcgccgccatcttttgtctcagttcttttttccaatacacacagacagaccaggaaaaagaacaacatcactactctcatggccctaaggctcggatcataagctgcatgaatgatgacctagcttgaaggggaagaagaatcaagtggggggttgtggacagctaggtgcttgcttgtacagctacatttctttattcaatctgtaagaaggaaggatttttttttttttggtttggtaggtgttgagcgcagaacagttgcttcatactattggcatgtgggtataaattatgaaaccccatgattaaattatacgtgtatattccaaaaaaaaaaaaaaaaaaggga

SEQ ID NO: 999 - DNA, 720 bp, Zea mays
gttctagaaagtctatttttactgccaaaaggggcgagggttgttcagtgctttgacatgtgtgcaactattcaagcacaatggttagatgatatccccattcattttagattattacattgtggtgttcgacttcttcagtcaagcagcaatcatgcaacatgccttactgtagttttttatcactgcacatgttgctggataaatttatagactggaggattatagaggactaacaagtgctactgggagattctcgagcaccattgaactaagagattccaaatagttctttggagtctattgttgatgttggcggggataatctagcagagatttgtcagattttttgtgcaacacggaggctacatgaggcagcaacgatcccattcttctcgcatgccactttacacaagctaaggatagcttctggtctcactcatggttgtggcagggaaagccgagtcagtagggtttgtcatgtagctggagttatctcagaccgcatattagatgcagtgatgatgtttacatttaccgtgcaagcaagatgacttatattatgccttaggacaataagtattgttttcactctaatgaaatacttggtaaaaagttgtctctgtagttgtatatttgactgtgaatatttgaacccactattataattgttgctaattgagggccacgttcagagggccagagaatagtctctagagt

SEQ ID NO: 1000 - DNA, 1911 bp, Zea mays
ccgaacaagcccttaggtgggctctatctagagggtgtccaacttgaaccacaagtattagcacttagcagcagcagcagcaacacacccaaaggaaataaacacgcaacgcaacccttaaaaaacgagtgtaacaatcagaagacggagtagcctcaaattacacgaaacaaacaaataaaaatcccctcttcctcgtttcaatctcgttctgtcacctgttttatatttgtcgcctcgcctcctctccccaaaaaaaccgcaacaaatcaaaacgagccgcaatcgcagcgcagaggcaaagccgtccatctctctcaacgccgccgccgccgccccgccccgccccagaccctaccctccacctccagtccctcgtcccagcgcgaccgattctcctcgatccagcactgatccggcggcttcccggcccggccatggatttgctggcgtccttggccgccgaggagcggtggctgttcccgttgttcctcgccatgtacgccgccatctactgcgtgggccagctcctcgtgttccggcggtgggcgccgcggcagcggctggacggcgccagctgcctgatctcgctcttccacggcacccccgcggcgctggccgccgcgggggccatcctcgcgctgcccgcggggtcccggtccttcgccgcgcccaacgcgcgcctccaggaccacgtcctcgactacagcgtcgcctacttcaccatggacctgctccactacctcgccttcctgcccggggacgtgctcttcatcgcgcaccacctggccacgctcttcgtcttcctcacctgccgctacctcgtccggcacggcgcatacgcgctcctcgtcctcctccttctcgccgaggttaccagcctgctgcagaacgtctggacgctcgcggggatctggcgggaccagtcccccgccgccgcgcgcgtctacggtgccctctcgccgcccttctacgcgctctacacgctcgtcaggggcgtcgccggcccgctcttcctcctcaagatggccgccttctacctgtccggccaggccgtcgacgtcatcccgtggtgggtgcggatctcctggatcctcgttgtcggcaccgccattgccgtcagcaacctgtggatttggaacctctggaaggagctcgtcagggaatggaagcaagccccttccaagtcaaagaaagacacataggctgccacctcattctaaccacagtaccgtaccatgtacgggtgtacgaaccatatgtagcttcttaatctttccaaatacatccgagccagatgatgcagactgatgatatgctaaaagccaatttccgttgacaattggtggaggatgcttatctggaaaaaaaaaaaaaaaattcattctttgattggaaaatcaggtccatgtgcctgaaagactactttcacttaaaaaagtactccctccgttccaaacaaagtgagaaatataataatctggaacggaagagtactccggatcaaaagtcagcatctccgcactcagttgccccccttctcccctcatgggtgtttcttattgttgcatatcaaaattttgtcgctcaaatgtcccctttgaaacataacaccaaaaccagtcctaattaattggtttctaacaggctacttgctctatttgtaacaatggggaacattaaattaaataccatgtctgtttacgacagtgcatcttagatgacatcatattgtaatagttttagttacttggcatacaccttgtgcaaaaggaactgcttacagttgtatatttgtgccaaccaacttgacttaagaaaagttactgaccatcgacatgttgtcacattgccacaatataccttaagagctcttccatacttgtatggtttgtgttctagaaacctgag

SEQ ID NO: 1001 - DNA, 1869 bp, Zea mays
  misc_feature (1712)..(1712): n is a, c, g, or t
  misc_feature (1728)..(1728): n is a, c, g, or t
tgcatagtgtgataatattatggaagctagagtctatatgcaagtcaaacactattgaaccttatcttaccaatgtgttgaagttgtttcatgatgaatctggaaaatcaaatttgtaattcttggaatgaagtcctccaaaaaatataaatatccaaaaataaagatctaaaagtgaataaattgatattttttatcattagttatttttaaatatttctgtttagatctttagctactaaacgatctcaacttaagttacttttattttaacgcatgggatcaaacatatgccctcggtcgtaatcagacaaaactgagcacctcaaatcacacgaaagaaagaaacaaaaaaccctcctcgtttggatctcagtttggctttggcacacgtttatatttgtggcctcgctgccgcccccgtcccaatccccacccgcaacaaaccaaacccaaccgcaactgcaacacagaggcatctctctccgcctccacgccgccgcccccagaccctcctcgatccagcggtgattcgccgggctcccggcccggccatggatttgctggcgtccttggccgccgaggagcggtggctgttcccggcgttcctcgccatgtacgccgccatctactgcgccggccagctcgtcgtgttccggcggtgggcgccgcggcagaggctcgacggcgccagctgcctcatctcgctattccacggcacccccgccgcgctggccgccgcgggggccatcctcgcgcttcccgcggagtcccgctccttcgccgcgcccaacgcgcgcctccaggaccacgtcctcgactacagcgtcgcctacttcaccatggacctgctccactacctcgcctttctgccgggcgacgtcctcttcatcgcgcaccacctcgccacgctcttcgtcttcctgacctgccgctacctcgtccgccacggcgcctacgcgctcctcgtcctcctcgtcctcgccgaggtcaccagcctgctgcagaacgtctggacgctcgccgggatctggcgggaccagtcccccgccgccgcccgcgtctacggcgccctctcgccgcccttctacgcgctctacacgctcgtcaggggcgtcgccggcccgctcttcctcctcaagatggccgccttctacctgtccggccaggccgtcgacgtcatcccgtggtgggtgcggatctcctggatcctggttgtcggcaccgccattgcggtcagcaacctgtggatttggaacctctggaaggagctcgtcagggaatggaagcagcaggcccctcccaagtcaaagaaagacacataggccgccacctcactaccgtgtacgggtgtaggaaccttgtagcttcttaatctttccaaatacatctgagccaactgacacggatgatgcagactgatgatatgttaaaagccaaatttcggatggcattggtggagggtgcttatctgtaagctacaactattcattctttgattggaaaatcaggtccatgtgccacaaagtctacttttacctcaaaaggtactccctccgttccaaataaaaagtggaatataatttggaacagaagagtactcccccctcatgggtgtttcttattgttgcacatcgattttgtggctcaaatgccccctttgaaacatataacgccaaaataatcttaattaattaattggtttttaacangctactctgtttgcancaatggggatatgtaaccttaaataccatgtctgtttatcacagtgcatcttagattgcatcatattgtaatagttttagttccttgacatcctgcctgtgtaaaaggaagtgcaaaaggaactgcttgatgtatttactg

SEQ ID NO: 1002 - DNA, 1673 bp, Zea mays
aagaccacaccaagatctgaaagcaaacatggcttgttcagtcgggcagcggcaacagaggggatggggccaatgacggaggcggagaggagaacccatcgatttggtggcgtaagtgggagctcatcgaggccgccaccggccggtccacctcttcaataatcgtccttcatcgcccttcagttgacctgagatctagaaggacacaacaggcaaggtggatgtattcgtagttgattatatgttaaaagcaaatttcggatgacattggtggagactgcttatgctctaagacacatctactcattctttgaatggaaatcacatccacgttctagaaagtctatttttacttcaaaagtactccttctgttccaaataaattagtgttagcatctctgcactctattgcccacttcccccctcatcggtgttttttattgttgcatatcaattttgtggctcaaatgcccctttgaaacatatagcaccaaaattatcctaattaattaattggtttctaactggctactctatttgcaacaatggggatatataaccttaccatgtctgtttatcacagtgcatcttagattgcatcgtattgtaattgttttagttccttgacatactgtttgtgcaacaggaactgcttgatgtacttacggttgggtatctgtgtagctgtagctgccaagttgcctaaagaaaagttcccgacctttcacatgctgccacattgccacaataccttaagagcttttctatacttctatgatttgtgttttcgagatctgagttatttaaatgttgtctgctattttgaatttttatatgaagatcaaagttctcaattgataaagtaattaatataacaagcgaacaacacatagacaaactaattaatgtagcatatagacgaataaggaatcctgaaacattgaccgtgaagaaaattattgtgcacatatgcactctttctccaaaatttggcatttaatcttattgcaacatacttgtacagaggggcgagggttgttcagtgctttgacatgtgtgcaactattcaagcacaatggttagatgatatccccattcattttagattattacattgtggtgttcggcttcttcagtcaagcagcaatcatgcaacatgccttactgtagttttttatcactgcacatgttgctggacaaatttatggactggaggattatagaggactaacaagtgctactgggagattctcgagcaccattgaactaagagattccaaatagttctttggagtctattgttgatgttggcggggataatctagcagagatttgtcagattttttgtgcaacacggaggctacatgaggcagcaacgatcccattcttctcgcatgccactttacacaagctaaggatagcttctggtctcactcatggttgtggcagggaaagccgagtcagtagggtttgtcatgtagctggagttatctcagaccacatattagatgcagtgatgatgttaatggaggatgtttacatttaccgtgcaagcaagatgacttatattatgccttaggacaataagtattgttttcactctaatgaaatacttggtaaaaagttgtctctgtagttgtatatttgactgggaatatttgaacccctgtaca

SEQ ID NO: 1003 - DNA, 7803 bp, Zea mays
  misc_feature (5737)..(5737): n is a, c, g, or t
  misc_feature (7032)..(7032): n is a, c, g, or t
ctgaaatgattcctggatgaattcggaataaacgaacgaggccttagtcagttttattctcccttttctacttagattacaagaagcacgtatattgtacaaaatggcccccccaaatagccaagtatattgatatatttattataagcagtaaaaagggctctactgatctagatagatgttttaatgcacggcctttctctcttttttggtttattattattatttcaggagaaaaaaaagtatatagtttctactttctactggccagcattttcaaagagcattcggccgtcgagatgcgcctcatcaacctggggtgaaatcttggctccctgccgattgtaggaagcttcactgacctgcattttggcataaaaaagctttagctggaaatagtttcaaacaaacgattgtcgacagaacatcagagaaggcaaaaaatatcaggaatccaataccttttcggcacaaatggcttggagaagtccggcatcggatgtgctcttggaacctgctgcttcctcatgtacttgatctcaatctcctcatccgcctgcacaaagaatacgccgtgccatggcctcatttcttgcacccccgaacaagatcaactcgaaccagatggacaatagagccagagcgaaccttctgctgtctttccctctccagtctcacttgctccatgaagctgttgcgctcagcgacctgcatgcagccgccgtcaggaatcggcgagggcggcgccggcgagcgagcgagcatcgcagtgggcaacttacttggctgtcgaacttggcgcgtctggccacacgcacttcgctgtgcagcacatggtcgatcggttcggtgggttccttcgttggaggtttcatggggatctgcagggtcagagagaaactgagagaaagaaagggagggtttcatggggatctgcaggatacactatgaactgaaactacacaaggggcgtacacacctctggttcatcagtgctgtagggtaaaccttgcgcgagtgggttgcgcagcctctcctcctcttgctgcatcttcctcaacctctcgacgaaactcccttccttggcttttcctctttgctgcgttacaagaacagaacacgacttgtttcatccacactctacgccagaaggacaagcatgaacaaggccctctcgtcgtacctcggtcctgagacggaacggctgctgtgttgttgtcacccgtgtcaccttccgcctgcagctccatgccctgtccgacgatcccgcggtgctctgcgatgtgcaaacacagttgtccgcgcaaatttcagggcaaattcatcggctcaaagagaaataggaccagcgtgcgtgcgtacgttgtatgccctctgccgccgttggccccgtgcatggttgatcctagctggatattcaggagagcgccatcagcacaatagtgtgccaagaacagcacaaagcagaacatcattatatgcagctatgggtgcgggaatcggagacctggtgcggtcggaggcgtcgaggatgcaggcgacgccggggatggccgggaaggagacctcggacgacgaggcaacggaagggcacgacacgtcgatctcctcggcaccccgcggcgttgccgtcaacgtcgccgtcgcggttgcctcgtccttcctcctcctcctcgccgcgcctctgttccgcgccgtggggccgccgccgccgcccagcaagaggagccgctcgaacgtgtccaccaggtacttgacgcggccctcgccgggctccgggaggccggccatggcctcctccatcgccacgacactcatcgcccgcttccgcgaggcggaggccgcgctgcccctccgccgttcttggcccgccgcctcgctgacccgtgcctcgtcgccagcgcctgccgccggggctgagaacttgctggtcttggtgcaagggtccagcctcctcctgatcgccgtcccgggcgcccgcttcaccgccgccggcgtcttcatggaagagagacaaaccggggacggtccagagcggcacttcctggccgcctcgccgccggcgccaagaaccgcgggccccgcgaccttcccggcgcacgccacgaacctcctccgcaccggccgcgcaaacgaggacggcgcgtcctcgcgctccagccgattctccgcctgcgacggcggcgacaccgccacgggcgcgaacggccgccgcggccgccctctggctctcgtcgccgcagcggccgtcatccccccgatcaaaaagtgcgcaaaccaggaggaaggaagacgaaagcagaagaggtcccgagcgcggcggttgatgagcgggagtaatgaggcgcgatccgacagggatggaatgaaatttgcgtttcgaaatccgcgtggacgagccgaaacggaatttatagacgaggaaggaggagtcgtcgaggcgaagccggtgaagctgggcaaggtaacgttgccggcgtgaggcgctggtgtgcaacggctagcggccaagaggggcgggggtttcgtctctgcggaatttctgggccgttggatcggggagcgaggggaatccgctgccgttgatacgcgtttgtgcggggttgatgcgcgtatctctactataccatatgtatgcaacgagggcgtccacccggcgtcaccgtgcccccgcccccgccagtccgtcaccatcgcgcggcgccaccaactacgcccgagcccccgcctccacaccccgtccccacgcgcggcgcagcggagctatcagcgcccttccccaggccggcttcaacgctgatggagccatcctcgcctcgaatcctcgctgcagttttcgttccaaagttctcgccccgaatcctcgcccttccccaccgcaccttcggtgtctccaccacaatcaccgcggtggcttcaccgtgtccccgcaatcaccgtggcggccagatccactacctcgccttcctgccgggcgacgtcctcttcatcgcgcaccacctcgccacgctcttcgtcttcctgacctgctgccacctcgtccgccacagcgcctacgctctcctcgtcctcgccgaggtcaccagcctgctgcagaacgctggacgctcgccgggatctagcgggaccagtcccccgccgcggcccgcgtctacagcgccctctcgccgtccttctacgcgctctacacgctcgtcaggggcgtcgccggcccgctcttcctcctcaagatggccgccttctacctgtccagccaggccgtcgacgccatcccgtggtgggtgcggatctcctggatcctggttgtcggcaccgccattgcggtcagcaacctgtggatttggaacctctggaaggagctcatcagggaatggaagcagcaggcccctcccaagtcaaagaaagacacataggccgccacctccaagccgagtgccgagaagtagaaggacaagatctacatcctcatgccggtcatggccagttgcccaccccggcgcctacgctcgagaagccacccatcttggccgcttcggtgcgaggaggcgctaccgtcctcttcctccgatccacctctcctgccaacccgccaggttgccgctgccgagagcgagcggaggcctccctccgccgacgggggaggaagatgctcaccaagttcgaaaccaagagcaaccgggtcaagggcctcaccttccactcgctcagcccatggatcctgtctagcctccacagtggcgtatccagatgtgggactaccgcgtgggcaccctcctcatccgcttcgaggagcacaacgggcccgtcaggggcatccagttctaggtcacgtcgctgctcttcgtgtccagaggtagtatcgctccccttctcgactggatcgtactcctagcccactagcgtcggtcttaagcatgcacagaggtgacttcatagccgagtcagctgctctacgtctattgcttccctttctcaagttatttctagatacaaattggtctccttgttgatacaatatgatgacggttatttcttagaaaaaagatttgttcatttctactccctaaattcgttatttgctgaaatcatcatgctctggttgggattcactgaaccttacatctgttaatgttgtctctgtcaacttgctgccttacccaattagccactgacatccatagtacactgggaaatgttgccttcaccatgattcatgttcgaattataaagattcagttgcttagaatgtgatgagtgatgacaacattaattttagttttttgtgaaattttttgttgtcacatcgttatgctgttacagaactgtcacgagctcacaatcataagaattacgaaacaacaattgatccctagagcgtggacaacattttctcccgacagacatttatgcttattttgttttgagaacaaactatacatactaccttatttctcccgactgattaaatcaatagtaattaatgtagcatactaaccgcgtctgcagatgtccctcgttaccttgtgttgtctgtttggatttcagagaatttgggtcatacggttttggtgatcaaggacgctgatgtattgattttctgtttgatggatgtgctggtattggattgggcagtttagggggcagtcgttatgcgtctgtagtgtcagtgatcagcttggcctccatcttttgtgtcgtgctgtcggcagttgttctgaatggtttatgatttggattatattggatgtgtctcttcatctagaattgctggttgctgagaatttgaaggcgacaaacttaaatgggacatctgatccgtatgcattgatcacttgtggtgcagaggagagtttcaggtgatcacattgattcaatactttaaacctgttatttggacgatttcagttgttttattaactatatatagctttcgaaatagtttcatttctagcttatttatcaatctgagaattattggacattgtaattggtttcagttctgggcaacttagttggatctgcttgtttgatgtgtcagattgatatttgaatattgattaacacataaattaatataatgatctgattaagcttagttggatctgcggatctgcccgtttgcacaaatggataggatcaacattgtcagatctgctctcagattgtaggtatcaaaatggaaaatggcataaaaataatttgtctaatcatgtatctcagacccccatttatatgatcatattaacctgactgagaagtagtcactagcatgtattttcattaacaattgtaattcaatagagcctgacaatggcaagactctagcacatacatttatagagaagtagagccctgcctgttagaaaactacatcaaatatccttagcttaaagtttgaccgtctctttatagtgaaagcatgaaagaattgatttgttttgctcaatgcattgtgagggtgagtgagaagcaagttttcttccctttgattgttacaagttacagcctataaaatcttttatgtatccaatagattagatcataacaccactctccacaatactacaatagattgctcaatgcattgtctatcgaactagcttctgttaagatgctcttaatggcctaatattattcattttgttgtgtgctggctttctacttaactaggtagtaatgatgttctatagtcctatcacattttggtactctgcagttttcctaaaagatgataatnctaaataaagatgagtgaatattgtgtaggttggggacctcagggattctcccacgcgattccgacggcctccttcctctcgcgcggctgcaggcctcctccccccacctccacctgaatccacaacacgtgagaaaaagcgacgatgacgaagaacaacgtggttgacatcgggcggcctctcgattggtggtcgtgctcggatccgcacctcgatggggccaccctatccctcaccgccccatcgcgtcggattgagttcccttggacgggcgacagtgttatggcctgtaaataaactacattgtcatgttagttagagggaagtgggtctacatactgcttagctagattaattgtgatagtaaggtgtattttgctgctttgtcaacaatttcaatttagacacttgttttttgggatgagctgctagcgatcgagctgaaggctgctcctgcagaaagtgttgtggtcatgcttgtacaaagaatatttgtaaacaatgcttccgataccgtttccttagatggagcgcataaacctgctcctgtatggctgagtacattggttgttgtctaaactgtaattcttactgaagtactgtataatcttcttttgaatgtattaagtgtactgggagccagaacaaccattagtcctttggcaacccttgacaacaaaatttgttagatcaaacattgcatccaattgtctgatctgtaaaacaaatcttagtattctatttgtttcttgttcaacctttaaatgaagatattcgagtacctaagattttttatctggttagccaatatatttctgtagatataacaaccaaatgatataaatgatgatattgatgatctttcttggtctgaatggagtttttgcacctattcacaggctagagagtttcatgcacctattcacaggctatgatattttagctattggaggcttgtcaatttgtgttccgtcgcaacgcacggacacatacctagtatttattgagtttgagtggctgagtgggttgtctggactctggagtacgtatttaccatcggtgaaatccttttggtgtgagattaaacatccttttggcgtgagattaaacagtgaacctggcattgatctgatttttgctactggagtggatttggatttagagagtgtatatggtcgttgggatgcatggacaaaaaaaaatctcagttactttcactatggttgaaaacatacaaacgccatttgtaaagatcgtgtgcagcgacgaccctgtaggagcatgtatagcaaantctcaagaatctttgtaggagcgcatacttaggcccattttgcattgcagggctgtatgcgaaaacaatttcggcttagactactctggtttcttggcttttctaaagaagccaaaaccattttgcaattcgtttagtaaaacggtttttttctatattttttcgaatgatgtatgaggagaacgtaggagaagccgatagaagccatattttttgtgctctagctcctagcaataaaacgactcaaactctcgaaaggctctcaacgagaagccgatttttatgaccgtttaatagagcttcacgatgagtccgagctggagccgcccaaagagccatgcgaaaagaacccgattagttataaagatattttaccatgctcgaggtgatggcctcgtccagggaggagagagggatcgtcaacgtcgagcgtgggagaggaatgagtgtctccatcaataaacaaacgacgcacacgacgagaaaaggacgttgttggtcactcctttttattacttcgggatataaaaaacaaggcaacacaattaaatcaagcttccgtctatattaaggtgtgtttgattataatgacagaaccagataggatagaccgatccattaaataatgttgtttgattcagtgcctgaggttgaaacaggactatcctagtgttgtccctagttgtccctcaaaattagagggaccagagagaacgccaataagacgttcctatcctgcctgttgaaagggaattaggcttacacctagtt

SEQ ID NO: 1004 - DNA, 2997 bp, Zea mays
ctgcaggtccttttggaggaaaaactgaatagtctacagagtggttatgatgtgctgattaagaaggaggtatttgatgtttcttcagctgatttcaatacttgagtggacatatttgtcactgtgtcaatcttgcctgattctagtgactgagattctggggtagattgtacatagggcatctagggccatgacccttgatgcatgtataaaattcctataaagaactcagttataggtagatcaataactgtactcactacatattacgcactggagaggagttacggacaatgtagaaccttctgttctcctgatgatattggaaccccaaaatgacgagataccattttaagactatctccagcagcgcttacccatctccatatccatattaaaactccactctgcgagcagtgcagtctatagtgcagaacagtgaaaaaacaatgttttaggtaaactatgggtagactgctggacacggtctaagcttgtgccatcaactattcaactcagataccatattagggcttgttcggttagctctcaatccatgtggattgagcgggattggatgggtttgaatcccaaacaagtcaaacttcttcacaattttttccaatcccatccaatccatgtgtattgggaataaccgaacaagcccttagctgttgttagtttttttttctcgactacaaacacaacccttgtagggagttacatgctcttgttataagtccgtatcccctgatttcctgtaggaagttgtggataacaaagtcaggtgcatagacaacatcaatgataccttaactcatcaagaggtaacacatggattactagttttgcttgatattctgcaccgttgtgaaggctagtgttttttctttctttactttggctgatgtataactgatttcttcagtctttgcttaaagaaagattaagtgggctggaggaaacaaacaaatccctgttggtacaggtacaggtttttttatttgactatttcgttttgtatttgtatagagttggttgtgcaattctagctacctacttgaggaaaaaagtgaactactaaagtactttgaatttctgtttaaatttaaatatttcaacatgctgcatcatgtacagttaaagttctattgttctcatggtttatctgccagaatgtgaacatgtcaaatttggcactttggccatttggatgccatttgttgtatagataatgttagttctatcctctgatattaccatttaataacaaagtctggcaggtgaaggtgttggaggaagcttcaaacaatacttctgaggaaaatcagatgttggtaaaaaaaatatatgaacttgattcaagactacaagcacttgaagcaaaggctgctcctagtgaagccttaatgattgaaaaggtaaaggttctgcatgatattttagtggcaattctgattttttccatgatggctgtatgtttgaaccttttgattcctggtatttgctgtctaatatatctgttcctacacaataatctcagtgtttatatgtagagtgtaacaaaaactgtaatgcagttccctgataataaggtgatggatcaagtgcattttgccaactcgccacttcagcaacagacaattgatttttcagaggtgataggcaaattaaatattttttcaggctatactattttagtgtttctttcttttcacagtttcactacatatatgttgccctgtcatcaagtatttattgtaccaaattatttcttactaccattggcatgggaggagtcgaggagagtcattcgtggcaaaagacgggttggcatatataaagaagaaacacaagggttgggcaaagggaagtaatcttatgatagcatgaaataagggattatgatctatttataataatgtgggatatatttactcttgttggatcagaaggaatgttcatctcatgtttgtgtgccaacctatggatactgtagttagttctttagcatatgtattctttacgatggattaggatccaatcatttgcgtctctgttgagaacttagttacttgtatatgcaattaataactgtttgcacaaaataattgtttcttcctgcagggtaacaaactgtttgctgagagaggtctgagcagtccagtgaaacttaatcctgacaacagctatcgtcaaatctacgacattcccagcaatgactatgctagtaattatacagaggaaacatcaagtccacctccgcacccgggcaccagcaatactattgttcaaggtcatgttgatgtcaatgaacaccgatttgatggaccaagaacaatcgaagaaatcgttcctgttccattggatgagatacagatccatgaggatgtcccagggcaaccgggagcagccgatgagatagatgaggttccattttctgacgccccgatcattggtgctccattcagactgatctcatttgttgctaggtatgtcagcggcgctgatttggtcaaccaaaaataactgtctgcataccaggaattcaggacttttatgtcaggagttcctttttgatcccactgataattacgtcagtatcttgagataaagatggatagattggattcagaatagatatggagctgtattcattcgtgtcagtgctcacgtcactgccaattcttctccttcccctgtacttttttcaggcgccggagaaattcttgttccttggcttatactacctgttcttgaatatttgtcatccgctatttcatttttaaattaaaacacgacaaataaaaaagaacggaggagtacaatataagaagctatgtaccatgggcctctttacgggtctaaccatgcgaaaaagttgttctggaaattctattattaatgactgaattttggtgtgctgacactataacctgtgacagacacctatatgcttgatttattgcatcgtcttgttaatcttaatcttttttt

SEQ ID NO: 1005 - DNA, 893 bp, Zea mays
tatatgaacttgattcaagactacaagcacttgaagcaaaggctgctcctagtgaagccttaatgattgaaaagttccctgataataaggtgatggatcaagtgcattttgccaactcgccacttcagcaacagacaattgatttttcagagggtaacaaactgtttgctgagagaggtctgagcagtccagtgaaacttaatcctgacaacagctatcgtcaaatctacgacattcccagcaatgactatgctagtaattatacagaggaaacatcaatacaacttccagaaataggcaccagcaatactattgttcaaggtcatgttgatgtcaatgaacaccgatttgatggaccaagaacaatcgaagaaatcgttcctgttccattggatgagatacagatccatgaggatgtcccagggcaaccgggagcagccgatgagatagatgaggttccattttctgacgctccgatcattggtgctccattcagactgatctcatttgttgctaggtatgtcagcggcgctgatttggtcaaccaaaaataactgtctgcataccaggaattcaggacttttatgtcaggagttcctttttgatcccactgataattacgtcagtatcttgagataaagatggatagattggattcagaatagatatggagctgtattcattcgtgtcagtgctcacgtcactgccaattattctccttcccctgtacttttttcaggcgccggagaaattcttgttcctttatactacctgttcttgaatatttgtcatccgctacttcatttttaaattaaaacacgataaataaaaaagaacggagaagtccaatattagaaaaaaaaaaaaaaaaaaaaaaaaaaaaaaaaaaaacc

SEQ ID NO: 1006 - DNA, 970 bp, Zea mays
  misc_feature (902)..(902): n is a, c, g, or t
  misc_feature (923)..(923): n is a, c, g, or t
ggggtaccccccgcgccgcccgccagcgacaccgattgaccgacacgccaccggcgtcgtgcttcagccaacccccgtcctcgtcctggaggtccactcctcaccccgacgcagatccccagcatttaatcaaacaggcgcacgcttcccccttctctctccgaaatcaaccctcccagctcattttatcccccgctattctagtcgccagacccagatcgctaccctccatcgtttggagccagacaggagcggctgcggcggcatttctagggttttgtttaaggtctgagctgtgcaaagagagatggattccaaaaagaagaggaacaagaagaagaagggaaaccaagggaagaatgccgctgatgtcacatccattgctggggaagctgcttctcagaatcacaatcatgagttagccccaatagatcatcataaaggttctgatgcagatgatgtcatgtccagtgttggagaggaacttcctcagtacaagaatcatcagccaaatatacaggcagattataatggcacaagtgcttacgacactacatcctccattggagagtgtattgcatgctatcaaaacaacgaacctatgatgacacaggagaatcacaaggctagcaatgcagtccctgcagatcagaggagtgttggactgtcagagtctagtgtggagcttgacatgcatagacttcatgaagccaaactcgataaattacatgagacaataaagcagttggagaatgaaaagagtttgtggcttcaaaaagtgatcaccatgggagggtgaacttgaaaagttgcataacgaagtgggttgtcatgctcaaaatgaggtccttttggaggaaaaactgaatagtctacagagtggggtatgatgtgctgattanaaaggaggagttgtggatacnaagtcagtgcatagacacatcatgatccttactcatcagagtcttgc

SEQ ID NO: 1007 - DNA, 1003 bp, Zea mays
  misc_feature (11)..(11): n is a, c, g, or t
cctcgaggccnggccgggagagctgaggggtcctacccggttgggtcggccggggctctgggtggattctgccttttcttctccttccctcacctgctctctctctctctctctctctctctctccctttctttcccgcggcgacggtgacgacgaccgcgcgagcgccgccgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtgaagagcaaggttactgtcaagggtcacctgcacacctacaggttctgtgacaatgtgtggaccttcatcttgacagacgcaagcttcaagaacgaggaggccacggagcaggtgggcaaggtgaagattgtggcatgtgattccaaattgctcggacaataggcctgtgtaccctcgaggtcaaggaaggaagcttttaagtgcggcgaggcggggtctgtctgcgcgtcagctgtacacgcctaggctaccgcgaggcggggtctgtctgcgtcagctgtacacgcctaggctaccgcccgaacggcatttcatttgccttcttcgtactgtatgtgtatcttcttttttccccttgtatacaatctgctgcagctataccggccagagtatggcatggtatggcggcaggcagccgcaaacttgtttttacctacttggtgtagcgcctgtgtaacagttttcgatcgatcttgcttgttgtgttgtcgatgctaataccgcagtgtaattgacgaaatgactaaaatgaagagtagtgtagtagatgtccaactatagcatttcaccagtccaaaaaaaaaaaaaaaaaacctcgtgc

SEQ ID NO: 1008 - DNA, 954 bp, Zea mays
gtcgtggatgattctgccttttcttctccttccctcacctgctctctctctctctccctttctttcccgcggcgacggtgacgacgaccgcgcgagcgccgccgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaaggtggagatgcctcgtgccccccctttttttccttgtctcggactgtggggaaatctggtcattgattgttttgcccctctgtgttgttcgtctagtccatgacggatgctctggagaaccaagtgaagagcaaggttactgtcaagggtcacctgcacacctacaggttctgtgacaacgtgtggaccttcatcttgacagacgcaagcttcaagaatgaggaggccacggagcaggtgggcaaggtgaagattgtggcatgtgattccaaattgctcggacaataggcctgtgtaccctcgaggtcaaggaaggaagcttttaagtgcggcgaggcggggtctgtctgcgcgtcagctgtacacgcctaggctaccgcgaggcggggtctgtctgcgtcagctgtacacgcctaggctaccgcccgaacggcatttcatttgccttcttcgtactgtatgtgtatcttcttttttccccttgtatacaatctgctgcagctataccggccaagagtatggcatggtatggcggcaggcagccgcaaacttgtttttacctacttggtgtagcgcctgtgtaacagttttcgatcgctcttgcttgttgtgttgtcgatgctaataccgcagtgtaaaaaaaaaaaaaaaa

SEQ ID NO: 1009 - DNA, 988 bp, Zea mays
tgggaccctcgaggccggccgggccgggatccggcagcgagagtagcggtcgtggatgattctgccttttcttctccttccctcacctgctctctctctctctccctttctttcccgcggcgacggtgacgacgaccgcgcgagcgccgccgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtgaagagcaaggttactgtcaagggtcacctgcacacctacaggttctgtgacaacgtgtggaccttcatcttgacagacgcaagcttcaagaacgaggaggccacggagcaggtgggcaaggtgaagattgtggcatgtgattccaaattgctcggacaataggcctgtgtaccctcgaggtcaaggaaggaagcttttaagtgcggcgaggcggggtctgtctgcgcgtcagctgtacacgcctaggctaccgcgaggcggggtctgtctgcgtcagctgtacacgcctaggctaccgcccgaacggcatttcatttgccttcttcgtactgtatgtgtatcttcttttttccccttgtatacaatctgctgcagctataccggccaagagtatggcatggtatggcggcaggcagccgcaaacttgtttttacctacttggtgtagcgcctgtgtaacagttttcgatcgctcttgcttgttgtgttgtcgatgctaataccgcagtgtaattgacgaaatgactaaaatgaagagtagtgtagtagatgtccaactatagcatttcaccagtccaaaaagggccctaaaaaaaggccccgcggcc

SEQ ID NO: 1010 - DNA, 3484 bp, Zea mays
  misc_feature (1703)..(1703): n is a, c, g, or t
ctcgaggccggccgggccgggttccgactctcggcaacggatatctcggctctcgcatcgatgaagaacgtagcaaaatgcgatacctggtgtgaattgcagaatcccgcgaaccatcgagtttttgaacgcaagttgcgcccgaagccttctcccggagggcaccccggcccgggcggctcccaacaaggcagaacgcacccttctctcagtctcagcgccgtctttcttcgttacctgcccccgctccccgaaggctcgaaccctttacagccggcgaagaagatgcacctgtggccatcgctccggatccgcgactcgttcaagcacggctacctccagaagctggagctcaacctcggcaacatgaagcgcgcgcagcggcagcgccagggccggcagggagagagccaggaggaccaggacggccagcccggcggcaacgggaaggcgccgctgctcgaggaccgctcgccatcggggtccgtgcttgccggcgcgctcgagctcgcctgggacgccgtcttgctcctcacctgctgctgctgttgcttctgctgcggagcttgtagcgacgaagaggatcacccaactgcccgctaagaagcaacttcaggtgcctgataattcatcagatcacgaaaaccagataatttgtgggcataatgaattggagtcaaatagttcaaatagttttgatcagctttgtacatatggttttctattcatccttatgccgcccatagatgtcattgataaacgggaaaaaggatccttaatttttttgttggaaacccgttgtgtaggtattttgggcgtgtaatcaggtcgtatctgtatttaggataatctgtggggttgctgtttctcacctacacaaaggcgtttagtccaggtgatgcttgcagcgcatgaatgccgagtctcttgctccctcggtttacaaaaacttgttttagacaggattttgagttaacttttaaaacttcgataacaaataacttttagggcttatttgggagaaagaaatttgagggaattaagggttgctttgggagcaagaagatttttgccacttcaatccttttttaaataggattttaaataggatggatattttagccctccaattccctctaattccccttcgaccaaactagccttgtgggcctaaaatctttttccttgctcacaaacaagccgttaaggtatctaatttagtccccgtttcaatctcatgggataaaattttagcttccggctaaactttagctatatgaattgaattgaaatgctaaaatttagcttcaattaccacaattagctctcatgtttagattacaaatgactataagtagctaaaaaaagctgctaaagtttatctcgcgagattggaacagagacttagtacattgaacatcattagcatagaatatatatttatgttgaaaagtgctagtacatgagatacgaccataaaatttgttgggatgttctaataggaaatagtggtcaaagtcagagatgtgccgctgtccataacgtcaagcatttgcaaactggaggggggtaacttgagtgaggacgtttttacgtttgactcgaacttgttccatctcatagttacctagtagtaatctgtttagctgcggggtctgcatttctggtttctggtttgtgccagaaccaggaggcaggacganccaagggtctccgctgttcgctccgttccgctcggcggcgccttccaaaccgcacgtccgcagtccgctgtccgcagcgaacacctgtcctcctccggtcctccctgtgcggaacagtctcgccaatcgccatcactagtgtcgatctgcgccggcctacagcctacgtccgtcgtcgtgtgcgatggacgccttcttcagcggtctcgactcccggctgcgggaggcagtgaaggtggcggactccatcatggtggggctggtgaacgccgccatggaggacgcctacaagaagagcctctggaaggacggcgacctggagcgcctcttccagaagctccgcttcgccgagctcgctatcatgcagctcgagtggtgcctccgcttcgtgcggggggagatggaggccgacggcggtgccgacgacggccacgagcagctgctagacgacctcctcgagacgcgggaccggatccaggcccgcctcgacgaggccgaactcgccgtcgcccagacggactgcgactacatgcgccggaagcgcgatgaactcgacccgtcgcgccgccgggagacgccgtccgcagttgatcaccgcggcgccgaggtggagggcggtacgttcgaggaactcagggggtccgtgggccggaagatgacgaggatgagggctaggctggaggacgcgagctccgagctggcggcgctcatgcaaaaggtcagcggcgaggcgtcgccgatggcgaggctgcaggagcccggccacgagggcgacggggtcaagggcctctcgggattctacagcatggcgcagctgcttatggagttccaggagatggtcctggacgccggcgtcctcagagacagcgtcgcatctgcgttcgatgcgatggagaggtcggtctctgctcagcgggcagccatggaggagcagcagtggctcatggatgcagagaaggagatgtacagtgccgtcgttgaaggttttctccgggagatcaacgtggaatcgacgaaacgcaatcagtctgagggagagggatgcccgacacctacattgcatcatagcagagatgctcctgataataatagctcggacgaattccagtatctgaacgatgaaactagccagctgcactcagcaaggcgtatcccggcagagaagtcagagagcagactgcgtcatactaattcagaagagcattgtttctgcctctctcaagaggaagctgaaaggctaacagaaacaacgattgattcagaaattagatgtgaactgcagcgtgttttgtactcagcagcattcagagacctattaagcaaactttcggttcaggcatatcatgcacagaggcttacagaacaaagagatgaaacggaaatcagaagtaatatacagtatgagatggatagtatcatattcaaagacttggtgaagaacctatgtgttgaatccgttgatcatcttatcaagacctggatccaagatgaggtgcatagagctcttcttgccaagattatgaatccttggaagatcactactgagatggttcacagcgagagacttatcaaggaagagattgaatgcattgtttttggaggtttgataaatgatttggtaaatggtcaaaatttaagtgtggtcaaatatcaacaccaaaatagacccagcgataatctgggaagattcggtatgattgacagcgccgagcagttagtgaatgggaagatacaagttaatgtaactactgaagatgatggtgtaggctctgatcaacata

SEQ ID NO: 1011 - DNA, 1530 bp, Zea mays
gactcttaagatccccctgctggtccgttgatggacacgttactttgatgaatatcatttgtgttaatttcttgttcttacagggggagatgcaacaacttcgtgacaagctagctgttgcagaacgtacagcacgatccgaagctcaactgaaggtatataacttgtttgttacagttgagcagcctggttgcctactagctttctagcttgacatgtatatgaaacctgttacagcctttgtagtattatgtaatctaacatttgttaaatgagttagttcagatgacctaaacatctgcaccttactcaggaaaaataccagttacgtttgaaagtactagaagatggactaagggggccaccaagtggctctagtcgtccaactactgaaggaaagagctttagcaatggcccttcccgccggttatcacttggtggggctgataacatatcaaaattgtctccccctcgcgtcctcccaaggagacctccgtcttttcattcaagatcatctcttttgtcaaacagcagcttggtcctgaagcatgctaaaggcacttcgaagtcatttgatggcggaactaggtcactagataggggaaaaatccatggaagtggagctcatttactcaacagatctacagatgctgttagagataaggagactagtgatagttggaagggcgatatggatgagagaactaatgagagggcagacaacaacacagatgagaaaagtaacgaaaccacaaataaaaactcagctgagacagtttctggtttcctatatgatatgctgcaaaaagaggtaatttctttgagaaagtcatgccatgaaaaggatcagattctaaaagataaagatgatgctattgagatgttagcaaagaaagtagacaccttaaccaaagcaatggaagtggaggctagaaaggtcagacgagaggttgcagccatggagaaagaagttgcagcaatgcgtgccagtaaagaacaagaaaccagagccaagctgcttggtacgaaaggctctggtagttcacaactgcttcctggaaggaacgcagcacgaactgggtcgatgcgcaacttccagtgatggcagcactaacacgaagcagcattcttggatagatccttctccgttccaccatttgttctattcctatcctattaattttgtgtctaaaattatagtagagtgagatgacccaacggtacctagatcagggtaaagagtaggctcggatctgatgagaccattgtgggagtgaaaccgagcctgtgtctaaccttgtggcgcgccctcttgtttctttgtccaggaagcgcacccgatgcttgtataggctggggccgctggggatcttcggatgcccagtctgcaatgtatcttgagtgctcagttacacaggacacccgttgcccaggttgtgaatattgtatcctctcacatgcttgtttgcgctgctcaatttgccccgtgttctggttggaattaaaaaaaaaaaaaaaaactcgagagtc

SEQ ID NO: 1012 - DNA, 2172 bp, Zea mays
cagggtcgagctcacccgcctggagaacgagctcagggacaaggagagggagcttggggaggcacagacggagatacgcgcactgcgcttgtcggagagggcgcgggagaaagccgtcgaggagcttacagatgaattggagaagatggctgagaaactcaagctgacagaatctctccttgaaagcaaaaaccttgaagttaaaaagataaacgatgagagaaaggctgcattggctgcccagtttgcagcagaagcaactttgcggagagtacatgcagcccagaaagatgatgacatgccaccaattgaagccattcttgcaccacttgaagctgagctaaagctttctcgccaggagattgcaaatctccaggatgacaacagagctttggatcgtctaacaaaacaaaaggaggcagctctgctagaagcagagaggactgtgcaaattgctatggcaaaagctgctatggttgacgatttgcaaaacaagaaccaagagttgatcaagcaaattgagatctgccatgaagaaaataaaatcttagataagctgcatcgccaaaagattgcagaagttgaaaagcttagccaaactgtgagggagttggaagaagctgttcttcaaggtggtgcaacggctaatgttgtccgagattaccagcgcagatttcaagaaataaatgaagaaaagagaacacttgaccgtgaacttgcacgtgcaaaagttacagcaaacagagttgcttctgttgttgctaatgagtggaaagattctaatgacaaggtgatgccagttaaacagtggcttgaagagcgtaggttcttgcagggggagatgcaacaacttcgtgacaagcttgccattacagaacgtacagcacgatctgaagctcaactgaaggaaaaatatcagttacgtctgaaagtactagaagatggactaagggggccaccaagtggctctattcgtccacctactgaaggaaagagctttagcaatgtcccttcccgccggttgtcactcggtggagctgataatatatcaagattgtctcctaatgggttattgtcaaggcgatctccttcttttaattcaagatcatctcttacgtcaaacagcagcttggtcctgaagcatgctaaaggcacttcaaagtcatttgatggcggaactaggtcactagataggagaaaggtacatggaaatggagctcatttactcaacagatctacagatgctgttagagataaagagactaatgatagttggaagggcggtatggatgagaaaactaatgagagtgcagacagcaacgcagatgggaaaagtaccgaaaccatgaataataattcagctgagacagtttctggtttcctatatgatatgctgcaaaaagaggtaatttctttgagaaagacatgccatgagaaggatcagattctaaaagataaagatgatgctattgagatgttagcaaagaaagtagacaccttaactaaagcaatggaagtggaagctaaaaaggtcagacgggaggttgcatccatggagaaagaagttgcagcaatgcgtgccagtaaagaacaagaaatcagagccaagcggcttggtacgaaaggctctggtagttcacaactgcttcctggaagaaacgcaccacgaagtgggtccatgcgcaacttccaatgatggcagcactaacaccaagcagcattcttggataggtcctctgttccaccatttgttctgttcctatcctattaattttgtggctaaaatcgtagcacagtgagatgacccaacaatacctagatctgggtaagagtaggctcggatctgatgagaccattgtgggagtgaagctgagcctgttgtctaaccttgtggcgcgccctcttgtttattttagtccaggcagtgcacctgatgcttgtataggccagggatcaccgcatggccaatctgtaatgtatagcctgagtgctcagttacatagacacccgttgcccaggttgtgaatactgtttcctcgcacatgcttctttgcgctgctctatttgccctgtgtttgggttggaatttttaacatggcttctagcctgtctgagttctgttgattataaatagtgacacatgttcatctgcaaaaaaaaaaaaaaaaaaaa

SEQ ID NO: 1013 - DNA, 479 bp, Zea mays
gacaaccgcaaccgcagcagctagaccgacacgcactctactctcgcacacagccgccgggcgggcacagtgacgcggccacgcgggcgccggagctagggtttccctgatccggcagggccggggagccgccggaaaccgttgctcgatttcggcgccggaggcgcggcatcggtgtctccgaggacggcggacgcgaggcgggttggggagctgaggcgcggcgccgggggctcagatctggtatgaccgacggcggcgaagacgggaatgcggcggcgcccagggccccctcgcgccgaaggggacctgtgcgggccagcctcgatgccgacgagttcatggcgctgatgcacggctcggatcccgtcagggtcgagctcacccgcctggagaacgagctcagggacaaggagagggagcttggggaggcacagacggagatacgcgcactgcgcttgtcggagagggcgcgggag

SEQ ID NO: 1014 - DNA, 4913 bp, Zea mays
gaaaaaacttcttccttatattcacggggagcttatgtaggagcaccctatttaattaaaaacgtagttcctcctaattttatggaagagtgaatgaaagagagccaaaaaagtctgtttttagagctcctggccttgttcgtttttatggatgctttttctttttttcatggagaagttagtggagaagctcgccatttggtagattgtgtgaagtagtagttgagacagcccttgaaagagctcaatgagggctattgaacatgggtagagtagtattatccacaattcctccttttctctcgtctttctcaccaatcaaacaacatgttcatttagctttaattcgtatcatgtctaagagcattttcaaaagattctttatttttgactctctatttaacttttatttatcttttaataaagattatactttatataaagcatttcactccaacaggctatctatctatttcagctagtcaggtggctaaccaagtttagttagtcagggagctaatttggagagtcggatagcttggcgagtcggatcgctagtctgttggagagttattttgctgttgattagccaaaatttttcttgataagctatttacctagtctcatggagatgttctgatgcttatataatattttttatttataagttatagctacaacagtctaaatagctgactttaatctgaaatgaataactaaaaaacacaagaacaaacaaaaagcaaaaaatcggagaagtgaaaaagaattcgtccattgtttctatcgcgttttttcatggcaggtcactaaggtcagatggcaggcgtgtttgttccttccctcaccctcccccctgcttttgtgctgttgcgtcctgccggagagagagagaacgctggactgcgctgcgctgcgctgcagactacacctgctctgcgtttgcatgtctttcttggcctcatgcttgttccatgtttgaggacacattgcacgcaggcaggacgcaggcgcacaccatctcctcccttgcccttggaaccgccacccttccacctcgttctcttctcttctcttcccttggctccgcccacctctgcggctctgcctcccttcggcaatggaggcggcgcctccaacttctccaccctccctggtgctactcttgctgctgctgctgctcatcatctctcccccttccagcgctttcctctcccccaagggcgtcaaccctgaaggttccatcctttctcccttacttcatttatttcgtcacataatctgtttctacagtagtaccactggtttccatctctgttccgtttgcctcgaatcgaaccggcggtttttgacggttctttctcctaaggaaatgaaatcaaagtgatttctctggtatatatatgtactataatgctgtgcagtgcaagctctgatgacgatcaagagcatgctcaaggacccccgtggcgtcctcaagaactgggaccaggactccgtggatccctgcagcgggaccgccgtcagctgctcgccagagaatttcgtcaccggactgtaagcgttccacttcctctcccttgcgctgctcccagtcccagatcacatttcgctgcagagttcttcttccccacccccccccctatgtacatccatgtgttcttacccaatgttctgtggactgtggcaattcgaatgtttggcagggaggtcccaggacagaacctctctggcttgctctccccgagcatagggaacctgaccaaccttgagactgtgtgagtattacttcttctcacggatgatggataaccttgtcattgcctggtgcctttttgactggaggttggtcttttgctttcctttccctgttgcagtctcatgcagaacaacaacatcaccggcccaatcccagcagagattggcaagcttacaaagctcaagacacttgatctctccagcaaccacctgtacggtggaagccccgcttctgtaggccaccttgagagcctgcagtacttgtgagcgccaactctacagtagtactagtacatacaagcttctcattaatgctgttcttcaggttttcgcattaaattgttcctgtcctctcgccatgatatgctggattttgttgccatggccaggaggctcaacaacaacaccctttctggtccattcccttcagcatcagctaacttgtcccagctcgttgtcctgtgagtagtttctcactgtttgtgctcatgtttaggtattatttttacttaactttgtgttcgctctatactatgttttcagagacttgtcatataataacctgagtggcccaataccgggttctttggcaagaacattcaagtaaggcttaaactttgtgtctttccctatcccaagtgctaatatatgacagtaggacaggaaatgcaagattaagaactattctgggctattgatgttcttgcagcatagttgggaatcctctcatctgcggcaccaacaccgaggaagattgctacgggactgccccaatgccgatgtcctacaagctcaatagctcgcagggtgctccgccacaggcaaaatccaaaagccacaagtttgttgcagttgcattcggtgcagcaattggttgcatcagcatcctctccctcgctgccggattcctgttctggtggaggcaccgtagaaaccggcagatccttttcgacgtcgacggtaagcggacctccacgtttactttcactccaccggacgcgtgggggcctgagagattaacagtttatgctgaacctgttcttggaacggactggccacacgtagaccaacacatggagaacgttggccttggaaacgtgaagaggttccagttcagggagctccaggccgcgacagacaagttcagcggcaagaacctgctagggaaaggtggctttgggttcgtttacagagggcagctccctgacgggactctcgtggctgtgaagcgactgaaggacggcaatgtcgcgggaggcgaggcgcagttccagactgaggttgagatgatcagcttggcgctgcacagaaaccttctcaggctctatgggttttgcacgaccgccaccgagaggctgctggtctacccatacatgtctaacggaagcgtcgcgtcgcgcctgaaaggcaagcttttttctcaagattccaatgtgctcaataatatcaaacccacttgcggtagtgcagaacaaattctgtcttcttcttcttctttttccatgcctaaaaagaacggtgtcaaattggaagtcgtaacccgacaagccgaacttggaaaacaactcgaattggattctagtactcccttattttttttggttcattggacaaatgctgggacggcacaaaagcaagcatacgattcttgtcaaggcagaccttcactttattccgcaataattatcactgcagggaagccgcctttggactgggcgaccaggaggaggatagctcttggcgcagggagggggctgctgtacctgcacgagcagtgtgaccccaagatcatacacagggacgtcaaagcagccaacgtcctgctagatgactgctgcgaggccatcgttggtgactttgggctcgcgaagcttcctggaccaccggggacttcgccatgtcaccactgcggtgcgagggcacccgtcggtcaccatcgcgcccgagtaccctctccactgggccagtcgtctgacaagaccgacgtcttcgggtttggcatcctgctgctggagctggtcactggtcagaccgcgctggagttcgggaaggcagcaaaccagaagaaggggagccatgcttgattgggtaagaaatctgcaagcgatggtttaattgttgggtgttcttgattgattaggcaacggcaacgtctgtaatgaatcagcaaagcattgttgttgttgttgttggtcaggtgaagaagatgcaccaggagaagaagctggacgttctggtggacaaggggctgaggagcaggtacgacgggatcgagatggaggagatggtgcaggtggcgttgctgtgcacgcagtacctccccggccaccggccgaagatgtcggaggtggtccggatgctggaaggtgacgggctcgcagagcggtggcaggcttcgcagcgcgcggactcgcacaagtccttcaaagtgcccgacttcactttcagccgctgctactccgaccttaccgacgactcgtcattgctggtgcaggccgtcgagctgtccggcccaagatgacaccaaccaccaccaccgtcagtttgcacttgtacagcataaggaccgagaatcatgtgtatattgccatattggagaataaaatgagccatgttagaataactatagtgtgtattagatagatgaactgtacaaaagaagagcgtaaggtttgtacaggtttggatatttacatatttctagcagttgagacagtaataccaagtagacgagctttttactgaaccggaaagcttttgcttgtgttgtcaggttctgttgacccttccctctatatccgtttccttgctgtatatttccagagtgcaaaaggttctgaaatcttataaagtccttagttgatatgagctgcatttcaaagaagggaattgctaaattgtgggaattctgaaatttaattaatttttgtaagatatgagctgcatttcaaagaagggaattgctaaatctcagctgaatgtttcatcagactccaaccgcatagaatcatagtatgcaattgcgtttgccccagacatattttggcaaagcattaccggctttcacatgtccatcagacaactgaaggacccaatagttcttctatttctggaggtgagcatcacaggaattcagcagtgagcatcgaagatgg

SEQ ID NO: 1015 - DNA, 1809 bp, Zea mays
tccttgcgtccgcttctcagtttgctgcttgaatgtgcgaaaaaaacagaccaaactgtcgtttcaattgctcttggcgctttagttcatctgattgaagttggtggtcaccagttcagtgatggtgattgggatacattattaaagagtattagggatgcatcatacacaacacagcctcttgaattgctcaattcattaagatttcagaaatcaaaacaccagcagttactttcaagagaagaaagcaatgcacaaggcaatagttaccttgacagccagggggaaccctccatcagtgacagtaataatggtgagcataatcatccagaggcaggtctgcaaactatcctggagaattcagaagatttaccgtcaccatcagggagaacacaacctgccgttttcccacgtggccaaagctttggacaaagaattatgggcaatatgatggataatattttggtcagaagtcttacgtccaaatcaaaaggtcgaacagatgatattgctccaccctcacctgtgaaggcccctgatgatgaggctgacaaggctgaagaggaagaaagccctatgatggaaactgtcaggagcaaatgtattacacagttactgctgcttggggcaattgacagcatacagaagaagtattggagcaggctaaaagctacacagcagatagcaataatggatatcttgctctcgctcctagaatttgcttcttcgtataactcaccttcaaattttcggacgagaatgcaccatatacctctagaaagacctccactgaatcttctccgtcaagaactagttggaacaacaatttatttagatatcctccataagtcaacagtggagcaggacaaaattgactccattgaggaaacaaatggtttaaatgtggaatctggtgaccaggaaaagatcaagtacctagcagaagggaagctggtttctttttgtgggcagattttgaaagaggcgtctgttctccagcctagcactggggaggctgccagtgcagacatacatcgtgtattagacttacgggcacctgttattgtaaaggttttgaaaggaatgtgcatcatggatgctcagatcttcagaaggcacctgaaagagttctatccattaattaccaaacttatctgttgtgatcagatggatgttcgtggagcccttggtgatctctttagcaaacagcttactccactcatgccctgaagtctggcagtatttcctcccttgcatagatcttgttggaacatattcttcgtcagcatttttgtgcaaacatggagcaccggttgggtgcttgacatccttaacgcgctttctggtgcaacagctactccctaggaacttaagagcttgatcagcgggaacggcaggtccctaggccacatcttttttttttggatgacgcaagggaagtagcttgactgatgcgcacaccgtgtttttcctagcaggcttgtactttggagctatttatctgtgcccggacagggatgatgcttccattatacagtagagtagtgttggtaatatgtacacattgttgagaacgttgtacttgaggcctgttgttattatacggcaatagtagattgtttgcggcaagcctcgttttttgtgcgtctaagaaaaaaaattgcagaattgcggtggcaaatacccattgccctccaagttgtgcgttagcgtatttatccgtagttgacagcaatgaacatattactactgctttctgtattttctattaacgcatgcacatagtttattgggtttccatattttcaa

SEQ ID NO: 1016 - DNA, 3945 bp, Zea mays
ggacgtggtgaccaagttgttggtgattgcttcatggattgcgtcaactgtcttataggttttgcaaattaccagtgcactcctcggattagtttgaaggctatcgctctcctgcgtatatgtgaagatcgtctggcagagggattcattccaggcggcgctattaaacctattgatgttgttccagaggccaattttggtgtgactgagcattactggtttcctatgctagctggtttgtctgatttgactttagactccagaccagaagtcagacactgtgcactggaagtgttgtttgatcggttgaatgaaagaggacataagttctcttctcccttctgggagagtatttttcatcgtgtactatttccaatttttgatcatgtaaggcatgctggaagggatgggctttcttcttctggggatgattggcttcgtgatactagcattcattcgctgcagttaatctgcaaccttttcaatacattctataaggaggtatcctttatgcttccacctcttctcagtttgctgcttgaatgtgcgaaaaaaacagaccaaactgtcgtttcaatttctcttggcgctttagttcatctgattgaagttggtggtcaccagttcagtgatggtgattgggaaacattattaaagagtattagggatgcgtcatacacaactcagcctcttgaactgctcaattcattaggattccataaatcaaacaaccagcagttactttcaagagaagaaagcaatgcacatggcaatagttaccgtggcagccggggggaaccctccatcgttaataatggtgagcatagtcatgcagaggcaggtccacaaactagcctggagaattcggaaggtaccacgagcagaggtttaccgtcaccatcagggagaacacaacctgctgtttccccacgtggccaaagctttggacaaagaattatgggcaatatgatggataatcttttggttagaagtcttacatccaaatcaaaaggtcgagccgatgatattgctccaccctcacctgtgaaggcccctgatgatgatgagactgacaaggctgaaggggaagagagccctatgatggaaactgtccggagcaaatgtatcacacagttgctgctgctcggggcaattgacagcatacagaagaggtattggagcaggttaaaagctacacaacagatagcaataatggatatcttgctctcactgctagaatttgcttcttcgtataactcaccttcaaattttcggacgagaatgcaccatatacctctagaaagacctccactgaatcttctccgtcaagaactagttggaacaacaatttatttagatatccttcataagtcaacagtggagcaggacaaaattgactccattgaggaaacaaatggtttaaatgtggaatctggtgaccaggaaaagatcaagtacctagcagaagggaagctggtttctttttgtgggcagattttgaaagaggcgtctgttctccagcctagcactggggaggctgccagtgcagacatacatcgtgtattagacttacgggcacctgttattgtaaaggttttgaaaggaatgtgcatcatggatgctcagatcttcagaaggcacctgaaagagttctatccattaattaccaaacttatctgttgagatcaggtacatactttctcaagtttagtttctagaattctaagtaccaccaacgaaacatgtgataacgccagagctttaatttgtggttacacttcagatggatgttcgtggagcccttggtgatctctttagcaaacagcttactccactcatgtcctgaagtatggcagtatttcctccgtttgcatatatcttagttggaatatattcgtcatcagcatttttgtgcaaacatggagcaccggtagggtgcttgacatccttaaggcactgtctggtgcaagtgcaacagctattccctaggaagttaagagcttggccagcgggaacggcaactccctaggccgcatatttttgaatgacgcaagggaagtagcttgattgtttcgcaccgtgttttccctagcgacttggatgatacgagggacgacgcttccattatacagtagagtagtgttggtgacatgtacgcattgttcaggacattgtacttgaggcctgttgttattttatggcaatagtagattatttgcggcaagcctctgaaccatcaggtcacaggttcgaagcagcctctacgcatttgctaagggaaggtttgccttggtttatcctttcccaaatcccattcatgtgggagcctccggcacttggtgttcccttatgtttcttatttgaggagttttttttagataatggaggtaatatctggtttcagcaaaaactagggatgaagtgctacttaaaaatgtgggcactaggatttgaaccttggtaggtggtgtcatgcatccacaattttgaactgacacaaactggtttgttcagataaaagaagttattttgtggtgaaataataaatcagaatgcatgactgtttcaactttctatgaattggactagcagagacgtcttataaataatgttcatttttcagtaatgcatgaatacatcaattgttactattattgtgtactcttatggtcaactttctcttggacattccttcaaaaaaacattcccttagataattatgatcttttggaactgttttttttgttttcagctgcagataccttaatgaaggcagtgacggtgacaatgctccagaaacaagcagtgatgtaagcaatgagagtgacaatgacaatgacaatggaaggtctattggaagaacaacccaatgtttagcagaaaatatttgcaccgatcaagaaaggttgtccagtgatgactgtgattccagtaaccaggaacctccccctgttttccaatatatggagcatgatgcaccatatggaagacaaccattagcagatatggtatgtctttttcggttcttgtgcaaccaaatgtagtatttgtaacctagctgacagttatattttattaatacctacagatttcagtatttgcatgtaagtttcctgatctaaatacatacaagagctgtgatcttctcccgtccagttggatctctgtagcctggtacttcccttaactcctttagctattggttcattagttacattgctgtattatccaatgaaagttgattgcaggtatcccatataccggataccaacaggacctacgctacaagatctagatgcttgctttttaacattccattcattgtcaacaacacctgacggtgagcgctcgtgtttcttcttggtggaaaacaatacaaattagcataccctgtcctgttcagagtatgtctaggtgcatattaaaagcagcagtaaacctgaagaatctcatttctgagctatttgctaattgagatgcaatgttgagcaggtacgataagcggttgtcctgagacagataacttccataacagtaaagttgcttctattcctgggaagatcacactgcctctgatcggccaagcatcttacaaattaaatggttccttgtggacgtcaaatcagcaccatgagcagcagttgactacgtcgcttctgaaagctgctgatgactggctttgccagcggcaagtagatcacccagattaccgcttcttcctcacacactaaattggatgtccatccaaactacctacctactgaacatcacagctcgatgcccactattttattcaatgaacttacattatcgctttatatagtccacaatcactgcaggtcgaggagctttattatagtgatgatcgtacacactcaagtgggacatggccactgtcatggagtacaagggcctacccctgcagcaggccgtcgactactatgt

SEQ ID NO: 1017 - DNA, 2564 bp, Zea mays
tgcagcggctgatgacgaggatgaatcaattgttgagagtgcttttgaaaatgtagaacaaggtaaataaggaatttatatagctagctcgtaaagtaccttacccgccttatatcctacaacctatcttgaaattttattggctgactttgtgaatgaaacggtgtcttacagttatcttggaacattttgatcaagtcgttggtgattgcttcatggattgtgtcaactgtcttattggttttgcaaataacaagtgcactcctcggattagtttgaaggctattgctctcctgcgtatatgtgaagatcgtttggcagaggtacagattatctgtaaccatcacctacatatttataagaactggggatgaccttttgtattcactctcatttatctttattgtacagggattcattccaggcggcgctgttaaacctattgatgttgttccagaggcctattttgatgtgtctgagcattactggtttcctatgctagctggtttgtctgatttgactttggactctagaccagaagtcagacattgtgcactggaagtgttgtttgatttgttgaatgaaagaggacataagttctcttctcccttctgggagagtatttttcatcgtgtactatttccaatttttgatcatgtaaggcatgctgggagggatggactttcttcttctggggatgattggcttcgtgatactagcattcattcactgcagttaatctgcaaccttttcaatacattctataaggaggtatcctttatgcttccacctcttctcagtttgctgcttgaatgtgcgaaaaaaacagaccaaactgtcgtttcaattgctcttggcgctttagttcatctgattgaagttggtggtcaccagttcagtgatggtgattgggatacattattaaagagtattagggatgcatcatacacaacacagcctcttgaattgctcaattcattaagatttcagaaatcaaaacaccagcagttactttcaagagaagaaagcaatgcacaaggcaatagttaccttgacagccggggggaaccctccatcagtgacagtaataatggtgagcataatcatccagaggcaggtctgcaaactatcctggagaattcagaagatttaccgtcaccatcagggagaacacaacctgccgttttcccacgtggccaaagctttggacaaagaattatgggcaatatgatggataatattttggtcagaagtcttacgtccaaatcaaaaggtcgaacagatgatattgctccaccctcacctgtgaaggcccctgatgatgaggctgacaaggctgaagaggaagaaagccctatgatggaaactgtcaggagcaaatgtattacacagttactgctgcttggggcaattgagagcatacagaagaagtattggagcaggctaaaagctacacagcagatagcaataatggatatcttgctctcactcctagaatttgcttcttcatataactcaccttcaaatcttcggacgaggatgcaccatatacctccagaaagacctccactgaatcttctccggcaagaactagctggaacaacgatttatttagatatcctccataaatcaacagtggagcaggatgaaaaggactccattgaggaaacaaatggtttaaatgtggaatctgatgaccaggaaaagatcaagtacctagcagaagggaagctggtttctttttgcggacaggttttgaaagaggcgtctgatttacagcctagcactggggaggctgccagtgcagacatacatcgtgtattagacttacgggcacctgttattgttaaggttttgaaaggaatgtgcatcatggatgctcagatcttcaaaaggcacctgaaagagttctatccattaattaccaaacttatctgttgtgatcagatggatgttcgtggagcccttggtgatctctttagcaaacagcttactccactcatgtcctgaagtatggcagtatttcctccgttgcatatatcttgttggaatatattcgtcatcagcatttttgtgcaaacatggagcaccggtggtgcttgacatccttaaggcactgtctggtgcaagtgcaacagctattccgtaggaagttaagagcttggtcagcgggaacggcaactccctaggccgcatatttttggatgacgcaaggaagtagcttgattgtttcgcaccgtgttttccctagcgacttggatgacacaagggatgatgcttccattatacagtagagtagtgttggtgacatgtacgcattgttcaggacattgtacttgaggcctgttgttattttatggcaatagtagattatttgcggcaagcctcgtttttgtgcgtctaataaagtgaggtcctgatgtatagccttgtctgacctgcagaattgcgttggcaaattccctttgtcctccaagttgacgtaatgttgacatgacggtgcatttatctgctggtactagtgtcccccccgtattgggttcatgcattgtttgatattccgt

SEQ ID NO: 1018 - DNA, 3720 bp, Zea mays
atgtaatgtaaaaatgataagtagaatcgattgtggtgagttccaatcggccgtacacttcatctatataagaagagggggtctggacccgttacaatttccgttatataaattgcccaatttactttctttatataaattgcccttctattaaaagcaaaaaattccgttatgtttatctctcaaacattcaatttgaaaacattgttttaatagacgtgatgtttttttattttaatgtgtctactggtcaatcgaatatttcttttgctcgggctgattcgttgacatcacttttcgtgttctctgtaaattttgccttatattgtgccccggcctccaggacgatggctggatgaattccaacctgcaagatcctgttctttcggtcagtaaactgatccaaagtccggatttgatatttgcccagcgggttccccaaaaatgcttcccgatttcacggaaatgaaacgaagccacagggaagcaggcaccgtcatgactcatgagtcttcacgtggtggggtgtgtggtgcccgtatcctgcgtcatcacgaggtgcctgctgcagcgtggtttttttagatgaagcaacaaggaagcacggtaccctcccttcgagaggctttgaccttgacgaataccagcccgatctccatcgggataccttcactgccaagttccccttacgagcgaggtgtggtctgccgcatcacgagaatgcccaccacggcgaaccttacagtacaaaacaatggaccaaccaagctagccagtgaggcagtgattactgtttataagaggagcaacactggcgcagatttcagcgatcgttcactctgctttctccagtttcacttgagagctagctgagactgagagcaaaatggttcttggagcgttggcgagtgcagtcgcctcgatgagcctcctcatcgtctacggtgtcctgggcgctctgctcctgtggaaggccgcccggctgctggaccggctgtggtgggagccgcggcggctggagcgggcgctgcgcgcgcagggcctgcggggcacgtcgtaccgcttcctcacgggcgacctcagggagtaccgccggtcaaaagaggaggccggggccaggcccctgccgctgcggtgccacgacatcgccggccacgtcgagccgttcatccacggcgccgtcctggagcacggcaagacgtgcttcacctggttcggccccgtccccagggtgaccgtcgtcgacccggacctggcgagggatgtgatggccaacaagttcggccacttcgagaagcccaagttcccggcgctcaccaagctgttctccgacggtgtggccaaccacgaaggcgagaagtgggtcaagcacaggaggatcctcaaccctgcgttccacctcgagaagctcaaggtccggtggtaactctattatgtatcatttgttcgcttcggtcgagtttgtgttgtgttgtgactgatcatgtgagtgagtgagtgtgtatacttgtgcagctcatgctgccggcgttctctgcgtgctgtgaagagctcgtcagccgatgggcgcagtcgcttggccccgacggctcgtgcgagctggacgtggacccggagcttcagaccctcaccggcgatgtcatctctcgcaccgcgttcggcagcagctacctcgaaggaagaaagattttccagctgcaggccgagcaagctgagcgcctcatgtccatcattgacaagttcgccgttccgggatacatgtgagttttaaattactggaattgaatacatatcaccttcatttcatatcctctttcgcccattagtattctgaatgggaaacaatcaaacgtacaaatgccacttccaggtccttgccaacgaaaaacaaccgaaggatgcgccaaatcaaaagcgagatcgactggattcttcggggcctgatcggtaaaagaatgcaagctatgaaagaaggtgagagcgacaaagatgacctgctgggcttgctgctggagtcaaacgcgagagagacaggcgatcagagcggccagcccggccaaggattgacgatggaggaagtcatggaggagtgcaagctgttctacttcgcgggaatggagacgacgtcggtgctgctcacgtggacgatggtcctgctaagcatgcacccggagtggcaggaccgtgcgagggaggaagtcctcggactgttcgggaagaagaaccaaccgggatacgacggcctgagtcgcctcaaaacagtgagtcgccaccgccgtcgtactccgggctgattatttccatgtctggtttcttacatactataatgcaggcatacagccaaaccgctcactcttcccgattcattgtgcaggtgaccatgatcctctacgaggtcctccggctgtacccgccggccatcgcgttcagcaggaaaacgtacaaggagatggtggtcggagacgtcacgtaccctgccggcgtgaccctggagctgcccgtgctgttcatccaccacgaccccgacatctggggaagcgatgcgcacgagttcaggccggagaggttcgccgagggggtggccagggcgtccaaggataggctggcgttcttccccttcggctggggcccgcggatatgcatcggccagaacttcgcccttctggaggccaagatggcgctgagcatgatccttcagcgcttccagttcgagctcgcgccgacgtatacccatgcgccgcgccgagttataatgctgcgcccgatgcatggtgcccagatcaagctcagagcgatatgatacgatgctagctcagggattcacatgtggctgttggtccaatgggctttgggctttcaggccaagagttgtgtcgtagcattggacctttttacgtatttttttcttctatccatggatgattagtagtcagtatctttccgtgtcttttcagttatcactagatgtaaacaccctattttacagcccctcacatacactacttggacacccacaaaaacagatcaaattttgcaacttaatattttagtaattaaaaattcttttatttatatggaccaccagatagtggatctgagggactataaaagagattctttgtatgccgtatgcaaagaattttttccgtttgatttaaggagaacatggggttcacaggactgtccttctcacctaaagacttcacaagtcgacttgtcaaatagccttgccgacgacaagtcaccatcggttatgccctgctgcccaggattgttccaggagcttttgcagtaaggtactgatcttgcttcacccttcttgaccttgattaggctctaacaattgcttgtcagagttatctatcactcccatgagccattcgccacattaggtcgttacccagtagctccattgcttcttttttgccctcaacaagtttgtcgtagtgtgcttaatcttttctagtagatatttttgttagtatgtgtcctctacattagccggttaacagtaaccagggtaggattaatcctgatcgtctaaccgcgtccctgatcagaggctatcctaaccgttggttgcagcctctggtcacacgacaccatataaatagattaggggggtccgacgggtttagccaacgctaatcactcgaccacaaaaccctaatcgacactctatgggggccctaatacttccttttgtctgtctgtgtgaat

SEQ ID NO: 1019 - DNA, 1882 bp, Zea mays
cggacgcgtgggcggacgcgtgggcggacgcgtgggcagtttcacttgagagctagctgagactgagagcaaaatggttcttggagcgttggcgagtgcagtcgcctcgatgagcctcctcatcgtctacggtgtcctgggcgctctgctcctgtggaaggccgcccggctgctggaccggctgtggtgggagccgcggcggctggagcgggcgctgcgcgcgcagggcctgcggggcacgtcgtaccgcttcctcacgggcgacctcagggagtaccgccggtcaaaagaggaggccggggccaggcccctgccgctgcggtgccacgacatcgccggccacgtcgagccgttcatccacggcgccgtcctggagcacggcaagacgtgcttcacctggttcggccccgtccccagggtgaccgtcgtcgacccggacctggcgagggatgtgatggccaacaagttcggccacttcgagaagcccaagttcccggcgctcaccaagctgttctccgacggtgtggccaaccacgaaggcgagaagtgggtcaagcacaggaggatcctcaaccctgcgttccacctcgagaagctcaagctcatgctgccggcgttctctgcgtgctgtgaagagctcgtcagccgatgggcgcagtcgcttggccctgacggctcgtgcgagctggacgtggacccggagcttcagaccctcaccggcgatgtcatctctcgcaccgcgttcggcagcagctacctcgaaggaagaaagattttccagctgcaggccgagcaagctgagcgcctcatgtccatcattgacaagttcgccgttccgggatacatgtccttgcctacgaaaaacaaccgaaggatgcgccaaatcaaaagcgagatcgactcgattcttcggggcctgatcggtaaaagaatgcaagctatgaaacaaggtgagagcgacaaagatgacctgctgggcttgctgctggagtcaaacgcgagagagacaggcgatcagagcggccagcccggccaaggattgacgatggaggaagtcatggaggagtgcaagctgttctacttcgcgggaatggagacgacgtcggtgctgctcacgtggacgatggtcctgctaagcatgcacccggagtggcaggaccgtgcgagggaggaagtcctcggactgttcgggaagaagaaccaaccgggatacgacggcctgagtcgcctcaaaacagtgaccatgatcctctacgaggtcctccggctgtacccgccggccatcgcgttcagcaggaaaacgtacaaggagatggtggtcggagacgtcacgtaccctgccggcgtgaccctggagctgcccgtgctgttcatccaccacgaccccgacatctggggaagcgatgcgcacgagttcaggccggagaggttcgccgagggggtggccagggcgtccaaggataggctagcgttcttccccttcggctgggggccgcggatctgcatcggccagaacttcgcccttctggaggccaagatggcgctgagcatgatccttcagcgcttccagttcgagctcgcgccgacgtatacccatgtgccgcgccgagttataatgctgcgcccgatgcatggtgcccagatcaagctcagagcgatatgatacgatgctagctcagggattcacatgtggctgttggtccaatcggctttgggctttcaggcctagagctgtgttgtagcattggacctttttatgtatttttttttctatccatggatcattagtagtcagtatctttttgtgtcttttcagttatcacgtattgcatctaacttgtttaaaaaaaaaaaaaaaaaaaaaaaaaaaaaaaaaaaaaaa

SEQ ID NO: 1020 - DNA, 4371 bp, Zea mays
  misc_feature (3660)..(3660): n is a, c, g, or t
caaaaaactcaccaccaagccatgcccatgtccaccgatgccaccaccaccgccgccccatcaccagcccagccatccaacggccgagcaccgaccggatcggacgtgcccctgaatttccaccgctgccactaccaaatcccgttttttaaaatcaaaatacaaggctcccttcttccagtcccccgtgcctccggctccccttcttcctccgcatgcgcccacctcctgcgccgccccgggtcactgccaggtaggccacaccatgcagccgccgcagtcgctggtgtcccgcgcgcgcaccgcgatccactccgccgccgcccgcgtgctcaccgacatcaaggccgacctccgagatgccgaaggatccggcgggcgtagccgggcgccgtcgccgaggacgtctctggatcgggaggccgccgaagcgagcgccacggggcgggagccggacgtgaagccgccgtcgccgcgtgatgaggtcctagaaataagccccccagagaacgaggattcctcaagcataccaactgaatcaacctgttcaacaaaactgacctttcctccagcttcaatagttaaacaactggtgtctgccattgaaaatgggaaaagtttcaagtcaatgagtgatatgaggtatactggagaacaattgctgaaagataagggaggtttgagcttgtctgttgttaaatcacttgttcgacgtgacaaggaagaaagatcgagctccgatttttttggtgatgaagaaactcaatctttgatgtactccttgttcaaattagaggaacagttttccttcgaagcaagtcaatgtttccctgaattggttcattcaagatctgtgtccaaggatctacatggtgcaccacctggaagttttattcaccatttagcagtggttattggcagcattagttctgtgcacaagatggcatttttttggcagtcagttgttcttgagttgaggaaactatggtctgattggcaacctgtgcctcgtatgccactggaggttgctccagatttgaattcttgtttactacatcaggaaatccaagttgtaaattgctgcattgccaggaaaaaaaagaagaaaagcagctaaggagtcactggattccttgctaaatcaggcaagtattggtaaatcagaacccaggttgtcagaagcgaagtttcctgacagcgagatgtatgcaagagataatactggtgattatgtccttcgacttggtgctgaccagtcatctgagaacttaacattgctggaaactggtgagcctatctattccccgacactgcaggaaggccccatcatgacagcagagcttataaaagaaacagaggagctagtgttacggacaggaagtcttggtgctggatgctctcaacttctatcagatatgcaggctttcaaggcagcaaatcctggttgtgtcctggaagactttgttagatggcactctccacccgattggtctgaggattgtgctgcaaacagtaccacagttggggaaggctcatctagacgtgggcggttaagtgataggatgcaaacaaaagaaggtaacttgtggaaggaactgtgggaggctgcaaaacctatacctgctgttgaacagactcctatatatgatgaagatttagctgtggagagcatctttgatgcgttggaggttattgagccatcaaaactgtttgagcagctacttggcgtcattctttctgtatgctttgtggcagctgaatcagttttagcagcagatagcaatctgtcaaaattattctacgattgcaaggactacataattggcgtttaccacaatgacatgtcaaaagatgagctagatgagatgtacaaggtgtacgagacgatggaagccatagtaacccaccctgaagaagctctccagatcatggagcaacctgatgagaagtctgttgacaataaaaaccgcttcacgctgaagctcaactttatggccaaagatcgcccgccgctctggaagcgcacgacaaaggacgacaagatttctcaaaaggtcgagaagaatacgtcagaggaaaagaacacgaagatattctccaacctttttgacaagaaggtcagcatattttcaaagaagaatgtgagatcgtcggaggtgccaccggcatccacttcatcttcttcgccagggccatttgacgagagtgagtggacgattttgtagttggaactcctgtattgtttcttttgtacaacatgtagaggggggggtgccccggagatgtcgggaataatcttaagctgtacatattcagtctaattcattgaacattttgaaataaattgaaaatataaaaattccatgtggtctgagcatctggggttctcgttcagctaggcacttatacaattctgattgttcaaatatctacattctacatggcatcacatgaagcctaaggtatcgtttggtttacgaaatgtaacgtaaatgataatggtaatgattcacaattgaatatcggcggtaacaaatttaaataacgagatatccatttgtagtgtggtatcgattacagttgaacttaaacaaacatgatttaacattatcggttacacattacgttaccaatatgtgaatcaaacggcacctaagtctgattgtttggatgactcattttaaacctaacaccctttacaggtctggaaaataaaataaggtggccataaaagaactgttttgatgatcagtttgcttagcaaatcaacacctggtttagccactatacattcgatctgggccgatggctgcgaaaccaaacggccacaaatgcgtgcagtcttaacatgcagtcggaggagcgattgcatcttatcctgatcgccgcgggccacggcagagggtgtttggcggagtggtgggacggtcgatgagtatacatccttgcagctcgtgtgagagggcggcgatcagaagaaggtgcgcggcggcgcagcaaccaccgtggaggagctttttagaaggagcgcttggcttggtgtggcgcatacgatacgaggaaaggaacacaggtatagcagcggtagccacccaaattggaattttgctttttatgctaaatgagttgtgctcgtataccattgaagttatatatgttttgttttaatattgccttatgtttgtctatttgaaatccaataccattgaattttgttaccattgaattatgctttttatgctaacaacccgcttccatgtagggaacagacatacctgtttggttcagctttttctgtggagtgaatttagctgtgagaagaatttgaggatcgtagcgattacgtgcggaagaaaatgaagtggtctaaagggttcattatctataaaacgatggattcctactatcatgacgaatagaccgattttgtgttcatgttgattttaaatggtttttatcaaacgatttttatcgaaacgggataaaaaacttggacgtttggcaatccgcaacagctttggtgacgagaagctaaaaaaagctcaaataaaagaatccaggatttggtattgtgccagtcgaatgccatgcgtttggatatccacgaaatcacttaggaaacctatcccaatcccaagagacctgtgcgctcatgtatcntaacccacgtgctcaataccaagctccggccaccggttttggctgaaaacgtccctggtcgtgtggctggtggaatatatggaaaaaaagaaataggagaatttttcaaaattccgagaatgatcaacttgttgtcgcccatcaaatcaaggaggatgtcttacaatacagtgcggccttctctatcttttgatcagagagttctatagcggtggtttttagggggtttttgtttttttttctttctttctctctcttcttctttttttttttgtaatggttgtagttgggactttgttggccagtagtccctgtatttggttagttgtactgattctccttctttaaatatattcggcaatcctcttaccatcctttcgaaaaaacttaccccttcggattagactactctacagtctcctaacaattaaatcctaccgaatagcctactttatcccttatgtcttaagtgttatcggatcttagtacaaaagtttagcaccctaagtttaaactctattctagcatggtcattatagaactataaatataataatttaattgtataaaagtaaatgctcaaaacagaggaaggatcgagaacacacaaatgtttatgtgaaggatctagagctgacactccttactagttcagtcatcgttaaagcagccacgtaaggatgtgtctctctcttgatcctcgtaaggacc

SEQ ID NO: 1021 - DNA, 827 bp, Zea mays
ccgtggggcccggccggccgggaccctgcccacccgaacaataaccaacagcttcaccctcctcctccagtgcaggccgtcggcggctggcggcgtcatttctcctccttcctctggcctgccctgccctgcccgcgcgataaccatctctcgcaactcctcttcgtactcctcgtctccaacgccggcaacaactacagagcttcagcttcccaagcgcgagacatgcgtgcggaaacacagacggcggagtagcgtagcgccacgatgggattgccaagctggtaggtagccaagaagacatgagatgggggcgtccttgggctccgccgccagcaagaaccggcagcaggagcacggcggcgaggctccgcgaccagatccctgcaagaagacgcggctctcgacccctctctgcactatccacggccactcgaggctgatcccggggctcccggatgaggtctctctgcagatcctcgcgaggatgccgcggatggggtacctcaaggccaagatggtctcgcggagctggaaggcggcggtgaccggcgcggagctgtaccggctgaggaaggagctcggcgtggccgaagagtggctgtacatactgacgaaggcggcggcaggtgggcagaagctggtctggcacgctctcgatccggttagcaaccaatggcagaggctgccgctcatgcctgggatcgagtgcaggagtggcggcgtgtacgggctgggcttgcgggacctggtgagcgccggcgtagggtatcttcgacgtcatcagaggctggctcgggcagaaggagctgtcaggcggcgtacca

SEQ ID NO: 1022 - DNA, 4619 bp, Zea mays
  misc_feature (676)..(676): n is a, c, g, or t
gtcatttttaatgaaagttttatactcattaaacagggtgacatatcatcgtatttggtgacatgatattgcaattaagagaaggggtatagagaaagtttcatgtgagatggtagagtttcatggggataaaaccatgtatacacggttacatagtttaaatttgatgcgatagtattagaaacagtacattaaaactcaccactggaaataaccttattgttgaacataaaaacatattttagtgcatctccaagatgagttctcaatgggtatctattttgaaatatatgattctaacaccgaaaagttgctctaacaaaagttctatgcaacaaaaaatatcaaataattataggactcaatctctcgggtcctaaatataggaccccatatgctggagctctattcttgttttatataacatttataatattttattttctaaataatatgattttatttttaataacatgatatagaacttagctgttggagctacaaatgttttttgtggccttaaacactttaaatcagatcctaaattaaatataagacttattattggagatgctcatattatattgtacttttgtattagagcaagacggaagggtggctgtggatccttgcttagtcccaaagtttagcggttgacgtccttgatttcctatgnttgagaataaccagcgttgggtggggagcgtgcttgactttttaaaacccataatatctttagcttgctagtacgtacactgctattgttatggaaactcctttttttcggggaaccatcagcttcaccgtgcgtgaagctagctgagtgtgtaaagaatccgaggagagccgccaacaaattttcttgttctagaatttaggatgtatttacagagactgataagtgggtccactgattaaaggacctataagagaagcttgcagccgcaccattcactcacattcaccctgcccaccccgaacaataaacaacagcttctccctcctcctccagtgcaggccgtcggcggctggcggcgtcatttctcctccttcctctggcctgccctgccctgccctgcccgcgcgataaccatctctcgcaactcctcttcgtactcctcgtctccaacgccggcaacaactacagagcttcagcttcccaagcgcgagacatgcgtgcggaaacacagacggcggagtagcgtagcgccacgatgggattgccaagctggtcagctcttccaaatccaaaagaattgatttttttcttgtcatgacgattggttctttcaatccttataggttaattactctatctattaaatttctggaggtgcaggtaggtagccaagaagacatgagatgggggcgtccttgggctccgccgccagcaaggaccggcagcaggagcacggcggcgaggctccgcgaccagatccctgcaagaagacgcggctctcgtcccctctctgcactatccacggtagccacggccacccgaggctgatcccagggctcccggatgaggtctctctgcagatcctcgcgaggatgccgcggatggggtacctcaaggccaagatggtctcgcggagctggaaggcggcggtgaccggcgcggagctgtaccggctgaggaaggagctcggcgtggccgaagagtggctgtacatactgacgaaggcggcggcaggtgggcagaagctggtctggcacgctctcgatccggttagcaaccaatggcagaggctgccgctcatgcctgggatcgagtgcaggagtggcggcgtgtacgggctgggcttgcgggacctggtgagcgccggcgtaggtatcttcgacgtcatcagaggctggctcgggcagaaggagctgtcaggcggcgtaccaccgttctgtggctgcgccgtcggcgccgctggtggctgcctctatgtcctgggcggcttctccggagcttccgcgtcgaagcgcgtgtggaggtacgacccctccgccaactcatggcgggaggtgagcccgatgcgcgccgggcgcgccttctgcaaggcgagcctgctgaacgacaagctgtacgtcgtgggcggcgtcagcaagggcgagaacgggctaatagctccgctccggtccgccgaggtgttcgacccggcgactggggcctgggccgagctgccggacatgctgttctccaagtcgcaggccatgccgacggccatagctgacctgctcaagcccgtcgccgccggagtgacctcgtatggggggaagctgcacgttccccagagcttctattcctggccattcgccgtcgacgtcggcggagaggtgttcgatccggagacgaactcgtgggagcagatgcctgcgggcatgggcgagggctggcctgcgaggcaggctgggacgaggctgagcgccgttgtggaaggggatctgtatgccctggagccggcgacctcctcttccggcggttgtgagatcaagatgtacgacgcgcaggaggatgcttggaaggtcgctgtgagccaggttcgtgctggggcatttgacgagtcggacagcccttgcttgcttgctgcgtttcttggaaagctccatttggtcgtcaaggatatgggcagcaggatcagtgtcgtgcagatggactctctgatgaagccagtggattcgccagccctttcggctgccacgacatgccgaaccccggatgtctcctcggagcagacacatgtctggaaagccattgcatcgaagaacattgcagctgctgaacttgtcagctgtcaggttctcagcatctgagttcgtaaaatcgagcttctctggaacttctttgtgtaagtctgtgcagtagatgtgtttctgccacacatctgaacatcagagactatttctttctttcagcaatgcacaattgtttgtgcaatctgcgtaattgttatctgtgtatataacatcacatagaactgaataaggttgacgcagctttgtccaatcccaaaggcaacggcgccgactcaatcaatcaccggaccaatctgaaccctgttcattgttccgactgctgtgcattcctgttttcacacacctagtttggttttcttcatagaagtgtgtgcaatgatccccttgaaggcacatgtgtttgctatatccattgatcaacaatgtctttgaaatgtggggtggggtggggggctatttcctatgaaaacaaacttgttcatgtagaaaacttgcagcgtggcttgttctgactgctgcaactataatccgtagagacaaaatactgtactaatcacagccaaattaaagccacagcaagccgaagcgaacaagagtattttcaaatgtggactagtggttcaaaattttaaatgtactaagtatttatactgcattgtttcaaaatcattaacgcatagatgtttccaaactggtgctcaggttttgggagttcgttaaatcagttacacaaagtattgaaaacacaaatataataatactaggaaggactcaatcctcagggatgcaagtagagatggtaatggactccgatccccaattttcccgtgagaaattcctctattagggctagtttgtaaactccattttccaagagatttctattttcccaaaaaatgaactaatttttctttaaaaatctcttgggaaaatagagttctcaaactagctcttaaggaatagggatgagaaaggttctttccccacgtagatgtaaatgggaaaaatagggacgggatgagaaacattctctatccccgttccccgcgggaccgttttacatatgatgatgtttcatttaatatttaatgataaaattaaataattatattgtcaatagatcactcttttacaaatgtgtttagtatatataatgatttcttatatataataatgtatataattgataatgttttatattaataaaaaaatatatatcctcgttataatttaaacggggacaagatcctcaacaaatctctggaaggaacggtgatgaggaaaaaatgctcttcgcaagagtttgtgaaaatctttgtgattttttttgtttcgtcgtgggagtgaacggtgataggaagctaaaacacgaccgaggaattattttgccatccctatgcaatactctactaggtatatgcctgtgcgttgcaacgggggatgtttgtgcatgcataagtctttatttagtgatgctatcaagactcaactcaacaaaattaacaaatgttgaagtctgacatttcgaataaccaaaatttggctcaatatcactattaattgaattaggcaaatcctaaaagttggtaatatatgatatggtgatgtaccatgacctccttagaacaattttgcattgcaaggtgaaaagtataaaaaaaggagatgacgagttgtggctatcaaaactattttagctcacaaatatgaccctcttatctatcaaaattattttagctcacaaacatgaccctcttatcttatatgttgtggcgtgatttctacattacttacatatggacatatattatgataatattcaacccatctaaatataattcctctaaaaacaggtagagcaactaaagttgtgc

SEQ ID NO: 1023 - DNA, 2042 bp, Zea mays
cattgggtacctcgaggccggccgggattcaccctgcccaccccgaacaataaacaacagcttcaccctcctcctccagtgcaggccgtcggcggctggcggcgtcatttctcctccttcctctggcctgccctgccctgccctgcccgcgcgataaccatctctcgcaactcctcttcgtactcctcgtctccaacgccggcaacaactacagagcttcagcttcccaagcgcgagacatgcgtgcggaaacacagacggcggagtagcgtagcgccacgatgggattgccaagctggtaggtagccaagaagacatgagatgggggcgtccttgggctccgccgccagcaaggaccggcagcaggagcacggcggcgaggctccgcgaccagatccctgcaagaagacgcggctctcgtcccctctctgcactatccacggtagccacggccacccgaggctgatcccagggctcccggatgaggtctctctgcagatcctcgcgaggatgccgcggatggggtacctcaaggccaagatggtctcgcggagctggaaggcggcggtgaccggcgcggagctgtaccggctgaggaaggagctcggcgtggccgaagagtggctgtacatactgacgaaggcggcggcaggtgggcagaagctggtctggcacgctctcgatccggttagcaaccaatggcagaggctgccgctcatgcctgggatcgagtgcaggagtggcggcgtgtacgggctgggcttgcgggacctggtgagcgccggcgtaggtatcttcgacgtcatcagaggctggctcgggcagaaggaactgtcaggcggcgtaccaccgttctgtggctgcgccgtcggcgccgctggtggctgcctctatgtcctgggcggcttctccggagcttccgcgtcgaagcgcgtgtggaggtacgacccctccgccaactcatggcgggaggtgagcccgatgcgcgccgggcgcgccttctgcaaggcgagcctgctgaacgacaagctgtacgtcgtgggcggcgtcagcaagggcgagaacgggctaatagctccgctccggtccgccgaggtgttcgacccggcgactggggcctgggccgagctgccggacatgctgttctccaagtcgcaggccatgccgacggccatagctgacctgctcaagcccgtcgccgccggagtgacctcgtacggggggaagctgcacgttccccagagcttctattcctggccattcgccgtcgacgtcggcggagaggtgttcgatccggagacgaactcgtgggagcagatgcctgcgggcatgggcgagggctggcctgcgaggcaggctgggacgaggctgagcgccgttgtggaaggggatctgtatgccctggagccgacgacctcctcttccggcggttgtgagatcaagatgtacgacgcgcaggaggatgcttggaaggtcgctgtgagccaggttcgtgctggggcatttgacgagtcggacagcccttgcttgcttgctgcgtttcttggaaagctccatttggtcgtcaaggatatgggcagcaggatcagtgtcgtgcagatggactctctgatgaagccagtggattcgccagccctttcggctgccacgacatgccgaaccccggatgtctcctcggagcagacacatgtctggaaagccattgcatcgaagaacattgcagctgctgaacttgtcagctgtcaggttctcagcatctgagttcgtaaaatcgagcttctctggaacttctttgtgtaagtctgtgcagtagatgtgtttctgccacacatctgaacatcagagactatttctttctttcagcaatgcacaattgtttgtgcaatctgcgtaattgttatctgtgtatataacatcacatagaactgaatagggttgacgcagctttgtccaatcccaaaggcaacggcgccgactcaatcaatcaccggaccaatctgaaccctgttcattgttctaaaaaaaaaaaaaaaaaagcggcc

SEQ ID NO: 1024 - DNA, 895 bp, Zea mays
tgggacctcgaggccggccgggaccctgcccaccccgaacaataaacaacagcttcaccctcctcctccagtgcaggccgtcggcggctggcggcgtcatttctcctcctgcctctggcctgccctgcccgcgcgataaccatctctcgcaagtcgcaactcctcttcgtactcctcgtctccaacgccggcaacaactacagagcttcccaagcgcgagacatgcgtgcggaaacacagacggcggagtagcgtagcgccacgatgggattgccaagctggtaggtagccaagaagacatgagatgggggcgtccttgggctccgccgccagcaagaaccggcagcaggagcacggcggcgaggctccgcgaccagatccctgcaagaagacgcggctctcgacccctctctgcactatccacggccactcgaggctgatcccggggctcccggatgaggtctctctgcagatcctcgcgaggatgccgcggatggggtacctcaaggccaagatggtctcgcggagctggaaggcggcggtgaccggcgcggagctgtaccggctgaggaaggagctcggcgtggccgaagagtggctgtacatactgacgaaggcggcggcaggtgggcagaagctggtctggcacgctctcgatccggttagcaaccaatggcagaggctgccgctcatgcctgggatcgagtgcaggagtggcggcgtgtacgggctgggcttgcgggacctggtgagcgtcggcgtaggtatcttcgacgtcatcagaggctggctcgggcagaaggaactgtcaggcggcgtaccaccgttctgtggctgcgcccgtcggcgccgctggtggctgcctctatgtcctggggcgcttctccggagcttc

SEQ ID NO: 1025 - DNA, 2484 bp, Zea mays
  misc_feature (737)..(737): n is a, c, g, or t
agtctggctgcatgagccaggactgcgggaatctggctccagggatacgaccaatttgctcgcgtctatagagcctggtctagagtgctttaagtaccgtgcgagtctggtttcactctatacgtaggtaaccaaacatacacctcgcacgcgtagagcctggttaacaacaaccaaacaccagctcattacatcccatcatgtaagcaccagcaaatacatgcagccaaacacatagttaagggttgtttggttctatatctatggtgccaaaacttgccacgcaattttacgccacacttgactaatgtgactaaggttaggcgttcaaattctacgccacaatttgccatgtctaaaagaatcttgccatacttttaccagtcattgacgagtaagatctatgtagcaggaaaaaaatgttgctacaactatggtttcaaaccaaacacatgaccaatttgatcaaatttggctaaatttagatgtgacaaatcgtggcaagttagacagtaaattaaacaatccttagtttgttagatcatgatctaatttgtagacatgaccgtgatttactagagagtttccataaatctacacgaggtagtcaaatagacttttgtggatatttgtatgcatactttttgtagagcgttgctatacatgactttattgatagactcaaatacaagtaaggccgtctagtagtctatgatttattagtttaaaataagganaacaacaacaacggtagattaacgttgttcgtacactcatactccattcgtatggatgagtggtacacgaaggacttctctttttttaagttacatgaacttttccttccaagtaaaaaatcggcagaaaccattgtcgcatccacatccccgtcactcccgcccgccaaatccattgatgacaaagcggccgagtcgcacactccaatgaagggaagctttggttggttgactgctccatccacccaccccctacagttcagttcagttcagttggtctaggccatggccatgtccgcttcctcctcctcgcgcgccctcctccgccggatcggcggcgcgctcctccgccgctccttctcctcctcatccgccgcctccgcagggtaccacgtcgcgggcgggcccagctacatgcgcggcgccgtcttctgggagcccggccgcccgctcacgctcgaggagttccgcatgccgcggcccaaggccggcgagctcctcatcaagaccaaagcctgcggggtctgtcactccgatctccatgtcctcaaaggcgagctccctttctccacgccctgtgtcgtgggccatgagatcactggagaggtggttgaccatggcacgcacactcctgttgagatcatcaacaggttcccagtcggaagtcacgtcgtcggcgccttcataatgccatgtgggaactgcttctactgcgttaagggccaagaagatctgtgtgagtctttcttcgcgtataatcgtgccaaggggacactctatgatggcgagacacggctgtttctaaggggcaatgggaaaccggtgtacatgtatagtatgggagggcttgcagagtattgtgttgtcccagccaatgcgctagcagttctccctgactcactgccatacacagaatcagcaattttaggatgtgcagtgtttaccgcgtatggtgccctgaggcatgctgctgaaatgcggcctggtgattcagtagctgtgatcggagttggaggggttgggtcaagctgtttacagatagcaaaagcctttggagcttcccaagtcattgcagtggatgtccttgatgagaagcttcagaacgctacaacacttggagcaacccacactgtaaatgcagcaaaagatgatgcagttgaaaggataaaggaaattactgatggtaggggtgtagatgtggctatagaggcacttggtaaggcgttaacattttcccagtgcgccaagagcgtgcgtgatggaggcaaagctgttatgatcgggcttgctgcaacgaacgtaatgggagaggttgatataacccgtcttgtccgacgacaggtgaaaatcattggctcatatggcgcaagggctaggcaagaccttcctcagatagtgaagctcgcggagagtggtgccttcaatctccaaaacaccatatcaaggaaatgcaaatttgaggaggcgaatggcgcctatgaggatctcaatcagggcaagatcgtaggacgagctgtggttgagatcatggagtgatgacggacaaggtaatcaatcctgtggttccaagtctgggtcacacaacaataaagttttgcgtgctctttcacagcattgtcaaaatctgtagatgaccaaactgcattgtgtgtgtgtgtgtgtgtgtgtgtgacagtgtgttgttggaattaacatttgcccttaaaaaaaaaaaaaaaacgcccccgtgctcagctttgaaaaacaa

SEQ ID NO: 1026 - DNA, 1370 bp, Zea mays
tttttttttttttttttttcgaaaatcgcaaatgtatttcacttaaaaaatgtgccgctgtgtagtgtcacacatccgctgtcaaattgtactcctgcaactttcctgtaatccaaaaatacaataagacctgaaattggaagctgcaaaagatgatctggcggctcgacgcagaagtcctacactcctagtagactagtactatggaaatggagcaaatttagtgtacggtggccagtacaagtgaatttccagcttgtatatcacccttggccggtccgagtccaccggcgacgaccggacgtacccctccgtgtacagaaaatcgccggtgccgcccaccaccgggtacaccgagggcttggtgttgtgggagcccccaaggacggacacggagcccctgtagccgcggtggcggagcgagatcttggccgccagcaggttgtggagcccgtcgaagctcgtcgtgatggaggtcccctccatcacgccggccacgggggagtcgctgtcgttgtgcagggtcaggtcgtcgcggaagacgtagatgctgccgaagggcctggtggtgtcgctcgagggggcgccttcgtcgccggtgacgacgacgtacccggtctcgttcagcctgtcgtgctggtacacggtgaagatctcgatcttgccggccattgttgtcgcggccgacacaggagagaatcgatgaggctggagctggtaaacgagccatgggaccaggcataccagcaaggttttagtgcttatacccatggcgattgtttggattgacacctgatttttttttcagttcgaaggcgaatgtcctggctgtctcggttcgttcaatgtcaccagattgcaacctgacttttacctgacgtagggtgtttggtggcatcggtagcttgtttcttggtgtgctaagtgtcaacttaattatgttatctccagcagatcgtgtatatgatcatgcaaatcgctgttttttaggtaaatatagtgaaatttaaaatagccgtgacgtagggtgtttgatgctctgattgttttggcatggcaagatcctgcaactgctcctcgagactgggcaccatcacgctaaatagtagctgattccttggatttgagtggcagggcgttttggatctgctgcgtgcgtgggcgatccaatccaacagggctcaggtacgacgacaggtactacgacatgtacgacccttaatgttgtgtcagctcaaaagaattaatgagttttttatcttgatcccgagttcattactaggtacactagcaattcttgtccaatatctgattaactacttttcccctgcttcctcttctagaggagaactgttgttgataaacttaat

SEQ ID NO: 1027 - DNA, 1379 bp, Zea mays
  misc_feature (1378)..(1378): n is a, c, g, or t
aagccccgcaggctgctgggccaaatgtcaaacaacatgctgctgggccaaatggcaaacacaccctaaaagaccgcgggtggctgatcaacggtttccagtagcagcagcacaactgcacgacccctcgccggccatggaggcctccgccaccggcgccgcggatccgcacttcccgatttacatctcctcggacgaggaagacgggcacgcctatttcatcgagtcctatagccccgaggaggtccagattcagcagaccattcttctctccctgtatacctctcgcgcccagacggccgccgcctgctccgcttcctcctcttaccctactggtgcctcctccacccctaaggccggtacctcctccacccctaaggaaactcctatcgatcacaaaagaaagcgcaagcttaaactagaagacgacacgaacgactccaaaatgaagcggtccacgcgcaaccgcttcaactgcgccatctgcttcgagatggttctggctgcggagaagtttgttgtgagtcactgccctcacgcgttctgcaacagttgcatcggaaggtatgtcgccggcaaggtagccgacaacgtagccgtgatcgggtgccctgaccccgcgtgtgagacggggtttattgagatggatctgtgtcgggatatcatcccgcctgaactatttgaccggtggagtgtcgtgctgtgcgaggagctactgggtgatgataagttctactgtccgttcaaggattgctcggcactgttactaaatgatgattcggcgaagatcagggaaacagaatgtccccactgtcacaggctgttctgtgctcgctgccatgtgccatggcacgatgggatcgagtgcaaggaatttaggaagcttggggatgacgagaagggggagaatgatttgatgcttaagaaacttgctgacaaggagaaatggcagaggtgccccaagtgcaggatgtatgtttcgcgaaaatctgggtgcttgttaataaattgcaggtgcaaacagtacttctgttaccattgtgctgcaccaatggatagggaaactcactattgtgagaattgcaagcactagagaagtagattaaggtctttttagataatgagtaggtaaagctcttagttaacaatgcaggctccgtgcgcagtcgtaggtgatacctaagtagaattttatccccttttagtggaagtaagttccacctttctgccatcgtgatattgttgagctatagagttgatgtgctgaagttatccttaaagcatcctgcattcctgcatcatgaactccctccgtcttgtaatataatgctttacaaaatattttaagataacttgagagaataaaaaaaaaaaaaana

SEQ ID NO: 1028 - DNA, 3139 bp, Zea mays
aaacaaatggcaaaaatgagattgcatgactcttcagagggcaaaatgtgctgcaagtatttctaagtccaccaagtaaaaaagaacatagacttgcagcatacgttctgccctacatattctcaatcgcttcagtcagtcagtcggcccggcttactagtagccacccattggcttcattttttagccaagacaaacaggaggagggaggagggatggttctccttcgtctctggcacatcctcttcttcctcacatgcttctctccatcctttgttcatcctatggaaccaggcacctaccgttgctccaatgtttccatcccatatccttttggcgttgctggtaagagcccctccctgtcccgtggatttaaagttgtgtgtggacacagtggtccgttgctgtccatcggaaacagcatgcttgggattcttgacatctcgttgcttgatggtcttgtgagcatattggctagtgctagttctcagcagtgcataggagggacggcgaactctagcgttaaccttgaggggaccgtcttcacattctcagacacaaggaacaagttcacagctctgggttgtaacgtggtggccatgcttttgaatggcagcacggggtatagcggtggctgtgcttccttttgctctagcggaaatagcatcatcgacggctcatgctctggtgtggcttgctgccaagcgcctgttcccaaagggctaaagaagctggacttagagttcagtaatattaatataaccaacagcggcatcgattacgggccatgtggtcaggccttcatcgtggagcagaattcatatgtgttttcacttcctgatctgaactacacagttgacacaaaacctcaataccgacatgttgtgctcgagtggtctgtgaacggcagcagctgtgaagaggcgaaactgtccggatcatacgcctgcgcagagaatgcctactgctacaactcatcaaacggaatcggttaccgctgcaattgccccagtggattcgaggggaacccatacctgcaagggccaaatggatgcacaggtaacaaactcttctatctatcattataatttcgcctcgaatccactagcttttgtttcttgaacagtccatgtctgatatctggtttttttctccttcatgtggctattggcaagatattaatgaatgcatcaccagaaatccgtgcaccaataggtgctcaaacacaataggtggtttccagtgcacgtgcccagcagggatgagcggcgacggcctcaaggaaggaagtggttgcaatggagtaagcacactagtgattgcaataggtaaatgtctaattaataaagccataacttaacaagtgctaataagtgtggttaatcaatcttgaagcatgccgagttgaatcgatgctgcagccaaaattttgtttttttttaaaaaaaaatctgaattttattgcgccctctctctatcgcagttgcaggattagctctgctagtgcttctcctcatccttggcttctggactcactggcttgttaagaagaggaaacttgcaaagacaaggcaaaggtacttcatgcaaaatggtggcctgatgctgaagcagcagatgttttctgaggaggcgccgctgcacatattcacctccagtgcgcgtgacaaggctaccagcaacttcagtgatgacaatattgtcggcagaggagggtttgggactgtgtacagaggcattctgtccaatcaagtggttgtggcgatcaagaaggcgcagcgagttgatcaaacccagacggaacaattcatcaacgagatgatcattctttcacaggcgaaccacaaaaacgtggtccagctattaggctgctgtctcgagactgaggttcccttattggtctatgagttcatcaccaacggggcccttttccaccatcttcacaacacgtcggtccccatgtcatgggagagccgtctaagcatcgcggttgagactgcgtcggcacttgcatacttgcacttagctgcaaagatgccaattattcacagagatgtcaagtcctcgaacatactcctagatgacaacttcactgccaaggtgtccgatttcggtgcctcaaggccaataccgcacgaccagacccatgtgacaacattggtgcaagggacactagggtacatggaccctgagtacttccagacaagccaactgactgagaagagtgatgtgtacagctttggcgtcgtactcatcgagctactgacaagaaagaagcctatcatggatgatatcgcggaagacattagaagcctagcgctgcaatttagtatgctattccatggaaataagctgttggaaatcgttgatcctgtagtagctgaagaagctggagtcagacatgttgaaacggtttcgaagttggcgttacgatgcttaaggttgaaaggggaagaacgcccaaggatgatagatgttgcgattgaacttgaagcactgagaaggctgatgaaacaacacttcatcttgaagaacgagtctttgcttcaggagtcatgttgcaatgaagaaatgagcatcgacgcaccatcaagtttgttccttggcgttgatggcatttctgacgatgaaagcatggagatcattccacttacatgtccatccaaaattctcacatcctatccctaactcgcaactatcacaaataaaaaggattttagctgacttctaccttctcaattgccaattccgtcttagtaatctcttcgtcttatgattagcttccaacgtaactacccggttaatggaatatgactgagttatttggcctatcgtcattcagctatgttctctttttgttcctcttgcagttcaaaaggcgatggtagtttcgctatgttggtatctctactgtatcgactgtcaacaaagaaatcaagacacatatgtaccattctagttctgcattctcatacgttctatcatacagtgctgcgggtttagatttgtttttgactacattacctatcccttaggcaattgaaggattgaatatacgaccagagaagggtgaataggagctcataaaaatttatgtgacgaaacattcttgcattgcttccctaatgctacacctaaa

SEQ ID NO: 1029 - DNA, 2028 bp, Zea mays
caatatttatataatgaagtttaaaatagagatacgacagatgagcttataaagaaggaagccaactaagcaagaagccagcctagtcatacagaaatgaaaaggaaataagaaagagaaactggcccagtagcgcacgtgcggagaaacttgctaggggaaaaatattggcccagtaagtagcgctactgggcacccataaacccgtcatccaaatccatggctgctcagtgcagaccagcccagatctccctttggcgcccgagatcacgcacacggcattattgccggacacacaaccgggagtcccggccactcgccccggccggatgccggagctcagacgactacgtgtataaactccggctacacgtcccggcacggcggcaccacaggctgataagcggcagtgggaaaataccgcaccgcacgcaccaatggagaacgccaacgcctcctcttgccgcaacggcgacggcacccagacgccaccgccgcacgtggcgatgcttgcgacgcccgggatgggccacctgatcccgctggcggagctggcgaagcgcctggcccagcgccacggcgtcacgtccacgctcatcacgttcgcgtccacggcgtccgccacgcagcgcgcgttcctcgcctcgatgccgcccgccgtcgcgtccatggcgctgccgccggtggacatgtccgacctcccgcgcgacgccgccatcgagacgctcatgtccgaagagtgcgtgcgcgccgtgccggcgctcaccgaggcgctcctgagcctcaagcagcggcccaccacgaccggccgtctcgtggcgttcgtcaccgacctcttcggcgcggacgcgttcgacgcggcgcgcgcggcgggggtccagcggaggtacctcttcttcccgaccaatctaaccgcgctcacgctgatgctccacctgccggagctcgacgcctcgatccccggcgagttccgggacctcgccgagccgctccgcctgcccgggtgcgtgccgctgccgggcaccgagaccatgaagccgctgcaggacaagtccaaccccagctacagatggatggtgcaccacggcgccaagttccgcgaggccaccgccatcctcgtcaactccttcgacgccgtcgagccggggcccgccgaggtcctgcgccagccggagcccgggcgaccgccggtgcgcaccatcggcccgctcgtgcgcgccgaggacggtggcggcagcaaggacgacgcgccgtgcccgtgcgtggagtggctggaccggcagccggccaagtcggtcatcttcgtgtccttcggctccggcggcacgctgcccgccgaggagatgcgggagctcgcactagggctggagctcagcgggcagcggttcctgtgggtagtgcggagccccagcgagggcggcgtcggcaacgacaactactacgactcggcgagcaagaaggaccccttctcctacctgccccaagggttcctggagcggaccaaggacgtcggcctcgtggtgccgtcgtgggcgccgcagcccaaggtgctggcgcaccagtccaccggcggcttcctcacgcactgcggctggaactcgacgctggagagcctggtgcacggcgtgcccatgctggcgtggccgctgttcgccgaccagaggcagaacgcggtgctgctgtgcgacggggtaggggccgcgctacgagtgcccggggccaaggggagggaagacatcgccgcggtggtgcgggagctgatgaccgcggagggcaagggcgccgcggtgcgggccaaggtggaggagctgcagaaggccgcggccgagggccttcgcgacggcggcgccaccgcggccgcactggcggaggtggtcaaggagtggacgagtgcagacgacagcgtctactaatcctacactactacgctaaacgcgaatagcctagttaattattcaaagcatttattatgtccattttgctattattgcgggggcagttattataataaagtgctcgtgtcagagt

SEQ ID NO: 1030 - DNA, 2393 bp, Zea mays
ccacgcgtccgcccacgcgtccgcccacgcgtccgcccacgcgtccgcccacgcgtccgctcctctctttccccggcacctgtcacgggaggaggatggacaagagcggcggcgaggcggcggcggcggcagcagcagcagacgacgtcgagcggcgggggggcgactacgagcaagacgagcacgagcggagagggacggtgtggacggcgacggcgcacattgtgacggcggtgatcggctccggcgtgctggcgctggcctggagcgtggcgcagctgggctgggtcgcggggcccctcgcgctcgccggcttcgcgtgcgtcacctactacacctccacgctgctcgccggcgcctaccgcgcgccgcaccccgtcaccggccacaggaaccgcacctacatggacgccgtcagatcgtacctcagtcccagggaggtgttcatgtgcggggtcgcgcagtacgtgaacctgtggggcaccatggtcgggtacaccatcacggcgaccataagcatggccgcgatcaggcaggccgactgcctccgccgggacggcgccggcgccggcgcgcgctgcgacgcgccagggaccgtgctgatgctggcgttcagcgtggtccaggtggtgctgtcccagttcccgggcctggagcacatcacctggctgtccgtcgtcgcggcggccatgtcgttcgcctactccttcgccggcctcggcctctccgtagggcactgggtgtctcgtggcggcggcggcctcgggggcagggttgcaggtgccgccgcggcatcctccaccaggaagctctggaacgtgcttctcgccctggggaacattgccttcgcctacactttcgctgaagtattgatcgagatccaggatacactcaagtcaccaccaccggagaacaggacgatgaagaaggcagcaatgtacgggatcggagccaccaccatcttctacatctccgtcggctgcgctgggtacgccgcgttcggttcgaatgctccgggcaacatcttggcggcaggcgggctgggtcccttgtggctcgtcgacattgccaacatgtgcctcatcctccacctgatcggtgcataccaggtatacgctcagcctgtcttcgcttcggttgagaggtgggccgcctcacggtggccagaagccaagttcatgagcagcgcatacaccgtgtccgtcagcatccccctcttgcagagaggatcggtcaccgtcgcgccgcacaagctcgtcctgaggaccgccatagtcggcgcgacgactgcggtggcgctggcgatacccttcttcaacgccgtgctggggctcctcggcgcgttcagcttctggccgctcacggtctacttccccatcagcatgcacatcgcccagggcaagatcgccagggggaccaagtggtggtgccttctgcaggctctgagcatggtttgcttggtgatctcggtggccgtgggtgtaggctctgtcactgacattgtcgatagcctcaaggcctcttctagccctttcaaaattgtaggctaacaggttactgtagtcatgtacaatgctctgagccgatcgtgcgttgaggtttaaaagaactgtggtgcgcgaattcgcgtcaaatatcgaaacttctcgattgtattttcagagagtatttattgaatttgatcagtaagcatcgttttgcttgtgaggatgtcgccatgtcctgttcctaagatcgtatggatgtcttgccctcatccacaaacaattgctagcatagcaatgcagtaatcacactgatgcacatgctatgcctacagaaactttcggtgtacaaaacgtactaaagcttttacaatatggacagacattgcataggctatacgtccacattatttttaccaccctctttggtccggtagggcacatggacgggcctaaacatctgagaggatgggctgtgtcggccgccgtagcccgctgaagaaaacgtgggctgctatctgttcgtttcttttttttttctcgacgggttggataccataacgttaagccagggctggattacacacagtccacaacgaaatcaaacacctcacaatgacaagcacggcaccagttgcacttgcaccaccagaggcagagtctatcgcgtgctcgcttggttccaatccaattcctttctatgtttatcccctttcctccgtgccgaggagaggagacatgtgagcccccaaccacatgcatgtggtcttcagctcgggggggaaaaaaggccttcccccctttcgcgtttctcctttctaggtcgcgctagctgctatcctatcatcatcaccttcccctcctctcgatcttacgctactggttcctggctcctactgcaggcatgca

SEQ ID NO: 1031 - DNA, 1241 bp, Zea mays
actcttgcttgcttgcccacacttctacctccaatagcacgagaccattacctagaacatcctaatcaaaaaaaccaaaccaccggtgcggtgcggccatggttggccttggcgactccaacacacttgcccaaccatccacacgcgcatggtctgatggtcctgccctttccccttgcttgtatagttagttgccaattgccatcgccaactacctcctctcctcgctcctccaaccaaacaagccaccccccacgaaacccgcaatcccagccgaagccggacgatgaagagggacggatggcagcacggcgccgtccggggcagccgcagcaaggtgctgaggacggccgccggcgacgacaactccgacgccgacgcggtcgtggaaacggcggcggcggcggcgaggaagccgacgaacgcgtcccggagcacgggcaagtgccggcgggcccggtgcgcgggctgccacgcgcacccggtctccaaggcgcgcgacaaggccaagggcgcgcgcaagctgcgcgcctgcgacgtcgcgctcaaccaccgcctcgtgtcctggcgcgtcgtcgaccagggccccgggtacagcggcgcgtccgcctcctccctgctggcgtacctggccggtggaagcagctggcacgaggaggaggaggacgacgacgagggcggagcggcgcccgacggccggctctctgacctctacgacctcttcgtcggccgcgggcaagaggaggacggcgtggatgctgtaggagagattcaggcagttgaagagcaggggctgctggatgccaaggatggcgaggaggaggaggtggaggacgacggcgacgacatggggttctgcatggttggcaccaccatcgcgctggagttctccgacggcgaggaggactggatcgtggtcgaggagatctgattcccatctcgtcgtcctcggtttggcaaattgggaagggttccaatttgcgaataagacatcctgcccatcctctgtcggtgctgtggtgtgtatgtatatactactcctgctatgttctgtgtgcatatggtaatctgatcgtggtcatggattattacatgattcaaaaaaaaacatgaatgaatttctcatctgtgaatgaatgaataataaagttgacaattggattctccaaaaaaaaaaaaaaaaaaaaaaaaaaaaaagtgttaattgttccttccgaagcgttcttgttcccgctctgcag

SEQ ID NO: 1032 - DNA, 2608 bp, Zea mays
  misc_feature (2603)..(2603): n is a, c, g, or t
taaatatttacgtataggagacgtgatttaaaggacgctgttggagagaaagtagatataaaggataaatttttttagagaagatagtaaagaacgtatataaatgatgaatataaattacattgattgagacagcctcacccatcatcaatcaggctcgcgacggtggcttcttcctcccccttcaccgtaccgagacccaaaccaagccgcctcgccagcacccagcagcccgcatcactcgtctccattaaaatcggttttctccttggaaatctgctggcgagtcccaggacccgaatgccccactcttattacctgctaattttgaatttcctaatcgggttgcagctgcttatataagctcactaaccccgcattcgcttttccgactcccacctccagccaaatcgggctatagatcaaacgctgcactgtagggagcgtgaagccagcggcgaatggaatccctagccgccacctccgtgttcgcgccctcccgcgtcgccgtcccggcggcgcgggccctggttagggcggggacggtggtaccaaccaggcggacgagcagccggagcggaaccagcggggtgaaatgctctgctgccgtgacgccgcaggcgagcccagtgattagcaggagcgctgcggcggcgaaggcggcggaggaggacaagaggcggttcttcgaggcggcggcgcgggggagcgggaaggggaacctggtgcccatgtgggagtgcatcgtgtcggaccatctcacccccgtgctcgcctaccgctgcctcgtccccgaggacaacgtcgacgcccccagcttcctcttcgagtccgtcgagcaggggccccagggcaccaccaacgtcggccgctacagcatggtgggagcccacccagtgatggagattgtggccaaagaccacaaggttacgatcatggaccacgagaagagccaagtgacagagcaggtagtggacgacccgatgcagatcccgaggaccatgatggagggatggcacccacagcagatcgacgagctccctgaatccttctccggtggatgggttgggttcttttcctatgatacggttaggtatgttgagaagaagaagctaccgttctccagtgctcctcaggacgataggaaccttcctgatgtgcacttgggactctatgatgatgttctagtcttcgataatgttgagaagaaagtatatgttatccattgggtcaatgtggaccggcatgcatctgttgaggaagcataccaagatggcaggtcccgactaaacatgttgctatctaaagtgcacaattccaatgtccccacactctctcctggatttgtgaagctgcacacacgcaagtttggtacacctttgaacaagtcgaccatgacaagtgatgagtataagaatgctgttctgcaggctaaggaacatattatggctggggatatcttccagattgttttaagccagaggttcgagagacgaacatatgccaacccatttgaggtttatcgagcattacggattgtgaatcctagcccatacatggcgtatgtacaggcaagaggctgtgtattggttgcgtctagtcctgaaattcttacacgagtcagtaaggggaagattattaatcgaccacttgctggaactgttcgaaggggcaagacagagaaggaagatcaaatgcaagagcagcaactgttaagtgatgaaaaacagtgtgccgagcacataatgcttgtggacttgggaaggaatgatgttggcaaggtatccaaaccaggatcagtgaaggtggagaagttgatgaacattgagagatactcccatgttatgcacatcagctcaacggttagtggacagttggatgatcatctccagagttgggatgccttgagagctgccttgcccgttggaacagtcagtggtgcaccaaaggtgaaggccatggagttgattgataagttggaagttacgaggcgaggaccatatagtggtggtctaggaggaatatcgtttgatggtgacatgcaaattgcactttctctccgcaccatcgtattctcaacagcgccgagccacaacacgatgtactcatacaaagacgcagataggcgtcgggagtgggtcgctcatcttcaggctggtgcaggcattgttgccgacagtagcccagatgacgaacaacgtgaatgcgagaataaggctgctgcactagctcgggccatcgatcttgcagagtcagcttttgtagacaaagaatagtgtgctatggttatcgtttagttcttgttcatgtttcttttacccactttccgttaaaaaaagatgtcattagtgggtggagaaaagcaataagactgttctctagagaaccgaagaaatatggaaattgaggttatggcttatgactgtcgtttgttcagtatgaaactagatttccaactgtgccttagaagtttgcaaatgtcttgttatataagggccggctcagtagactagtcatgtcttttaatacaactcatgtggtcctctttgttgcatattatattgcatagttatatgttagtgataaaaaaaaaaaaaaaaaanctcga

SEQ ID NO: 1033 - DNA, 2450 bp, Zea mays
aagatggtgttgttgccttgttggaggccgtctaaaaacagagctcaaagaagcggcagcataggaagattactgatacgaaaagaaaatgaagaaggaagtagaagaggtggagggccacggttatggcgccgccactcccatgacgccgccgccgtcgtcgctcggtcttccttccccctcggtctcgacattgacctccgccgctgccgctagggttttggcgcggccaatgcccgcctcggtcccaagcttgcgggcgccttcccccttcgtgcgggccatgcgcacccgcgttgatccgccgccgccacagccgctcacggcccctcctcttcttcgtcctcgtccggtgctaccgccgccgccgataccagagaagcagcggcgggggcgcccgcgcaactgcgaccgactcctcccgccgccgccgggcttccaccttgctccgtccgcacgggcaccgctgcctgcccgcggccaaccttcatctagggggcatccctttcgcggtcaattcggtgggctccagttgcacgtgctcaaaatacatgtgggagaggatatcgtatcaaagattgtgcaggtctcgaaaataactgggaaggctgtctgtgttctctcagtgtttggggccgttcaggattgctatctgctccactctgctgtcatcttaaatcacaagggtcctttagaaatcattcatgtgtttggatccattttgacatctgatagtcctggatttgggtgcttatctgcgactcttgcttgtggtgattgttctcttgtcggtggcattgcagttggacctctcatagctgcaacaccggtgcaggcaattgttgggagcttccacaatgatgctttccaggcaaacaagaaacctaagctcgttgcatgttaccccagttctcatgttaccgctggcactgggggcatgtgttgcgtcaattctaagattaccattggcagtttgagaaaacatgataccagttcttggtttcccattggcaatggaagcacaactcattccaattctcaagttactgttgatgatggaagcacaaatcaccccaattctcaggttactgttggcagtggaaacacacatcatcctaattcacaggtgaccattgacagtaggagcatgtgttgcctcagttttgaggctggcattggtagttggagtaaagatgatccaagttcttggtttcccattggcactgggagcacagatcactccaattttcaagttactgttggcactgggagcacacaataccccagctcccaggttcccactggcattgggagcgcatatcaatctgattttcatgtcacattgggtgacagaagcgcaagtatccccgattctcaggctactgttcactatgggattaaacatcaacccaattcctgtgtcagtgttggcaacgggagcacaggtagcgtcaattctcaggatattgttggacacggaagcacatataaccctgaatctctgcctgccattggcgacgggagtatgcataacaccaattttgaggtcgtggtaggagttgggagcacagacaagggcaattcacaggacacccttgttgatgggaacctgaatcaccccagttctatggtttctgttgacaacggaagctcctgttaccccaattgtaaggatgctgttggcgatacgtgtgctccatcctctgaaggctctaatccagaatatgcatcctgcactgtagtagtggaacagagtagattgagcagagacagatgtgaatctctcgcaagtgatggcttcttaacgtagcaacactttagatgattgtttatgttttttctctgaagacagtagccaagtacatgtccttggacagcgagggtgactccagcagttcatccaaagtttatccataagcactgttatgcactggagactgcactgttcgcagagtggagtttgaatatagctatgtgtatgggtaagctgttggagatagtgttatgcttttgtggatgaccgccaaagtatccttttgggatggtaggaagttttgaagtccagcagtagttgcgttctttgcagggacatggcagtgttgagaattgtggtgcagtctgttgtagctttagttgctaacagtgttggatttgtgctgaggtctgtcagatgagaaatcctaacatagcagaagggttcgttgagctttcaatatatatgatactgatgagattttatgaggcaagttgtcgggtatatctcgtgcagtaaagcagaatcaaggctccactgcaacagaaactgatcatgtgagtgtatgatagatgtcatggcgttagaccaacgatttgaaattgaaatgttgctaccatgtagaaagatgtgatatgtttagctagatggtctccagcagctcttctattacattatctattctacctcctatttc

SEQ ID NO: 1034 - DNA, 1595 bp, Zea mays
cattgggtacctcgaggccggccggggcttgcttcgcttcacctgccccctgcccacattttccttccttccctcccgtcgccgcctgaaaccgcgacagcaagggtcgtaggagcaaggacgacgacgagaaggctcggttcggctcttcccagtctctccgagggaggaaggagaggatcggagggtgcgatggcgatcgaccacgagtccccgttcaaggagctccgcctcaagaaccgcaggatcatgggcggcggcggccctgaccctgagccggaggaggaggaggaggtcgccacggcggcgtacgcggggcagtggccgcgctggctgcagccgctgctttcggcgcgcttcttcgcgcactgcaggacgcacggcgactcgcaccgcagcggcgagtgcaacatgttctgcctggactgctccgccgcgggcgcgggcgcgggcgcgcgcgccctgtgctcgctgtgcctggcgcaggcccaccgcgaccaccacaccatccagatccggcgctcctcctaccacgacgtcatccgggtgtccgacatccagcgcttcatggacatcgccggggtgcagacctacgtcatcaacagcgcccgcgtcgtcttcctcaacgagcggccccagcagcagaggcctggatgcaaggccgcgtcggcgtccgccaacctcctgcgaggtgtgcgcccgcagcctcctcgacaacttccgcttctgctccctcggatgcaaaggtcgtggggctgctcccccgacgccgccaaggccaggagctggctcctccggcccgccgtcggcggcagcggcgacggcgactccacgtcctcctcgccgctgcgcgacgcccagaagaggcagagcttcaccccgcccacgccgcagccggcgaagcgccgcaagggcatcccgcaccgcgcgccgttcggcagcttcatcgtcgagtactagctccctctctctccgtctccacggcggcggcggcggctgcattggcagtggcactacacagcacacgcgcggtaaagcagggaaaatatatatatactcttgaatgaaccaacggaattgagcagcacagagtgagtcagtgaattcaggtcatgtctgaatcaatccgccattacagggcaatgggactgggacggccaccacttccttttgccgtgacacactctggctggctggctggtggtgcttctcgaggtggatgccattcgctcgctgctggctttgctttccacaaagggaggggaggaaagaaaggttgaggaagaatcaaaacactggcttttcatcactgttgctaggctctctgatatagaaatatatgtacatttttagccttgtcctgtttcaaatcatcatagtggagcattatagctagctagctttttttactagattattcgtctgaagaaaagaaaccatggttcaggagatgaccagctagtgcaaggtacttactttatactagtaataagctatggtggtgggtgatttgtggtgcttaatctgtgtttgtcccattacatatatctgtaaaaatactatgaggaagaaggtcatcatccttggcccttgcc

SEQ ID NO: 1035 - DNA, 1763 bp, Zea mays
  misc_feature (577)..(577): n is a, c, g, or t
gttgggttctggggttaactgaacaggccctaactagactacaaacccaaacctaaatgatcggaaacgggccatgttcagtttgaacttgaactcaaggaatcagacacggagtaaatctgatgtcctaaattgattaacagaaatccagaagcacagaaagaactagcatgcatcatgaattttatcagtttatagctaaccactccgagaggactacttccagtggccaaattaagtaaatactctattttcaatgacgaatcaaacatccaccataatagaaaaaagaggcatctgggttaatatttggattacattagttcccgacttcctgaagcgcatcagaaataaaatggcaaagtagattgagtgaaataaagtgcaggtctcctagattatcatgcaaagcaacttcaccaaaaatcctatattaagattcatccctataactaacaatataggacatagaacaactatatatgtcaccatgtacttctgcatgccaatcatcataaattgctctttgaaacaattcattcttgaattatattgtggctactggctagtctaacanatgcttgaattgcatgcatttcccaaagctgtatgaatcatatcatgtgttatcttattgtggaagcaaatagatattccgttgacctgtagtgtctttgaaccaaattgctagttcaccatggcactaccaccacagcatgcagatacagcgaattgttcccatttctgaaatacggagaacagccttcacagaaaaacacagccaatgctacatacatcggactgcagtgtacaacagaacagccttcacagatttactcttgtttacattttggaagctaacttgattacaaggtgaactgacaaaataacaaaccttacataactttgtgtacctaaaaagttacatgaagaatatctgtacagaagcttatgttacacagccacaccagtataaaaaatagtgggcatgctatctaacagttacaggcttatgttttagacaaaggccgatatgttacaattcttggctaaaacagtgccaactagctacagaaagtatcaatcgaacctaaagacctatacaaatgaagttacataaaggccggtacaaaaaaatttacatggcaatgttgtggacgcttttgtcctaacctaccacaacagacaatgtcgctatgccacatcactaccttacagaacaactcaagagttacattccaaaataaacaagagatcagatcaagcatacttacatctcaaattattgctacaacagaccgcggagatatatatgcagtgaaagccatcacagctacaagcagtaagcagttgatggttgttactgaacaatgcctgggtgcaaagaggtcgctgccctggatcgtcatagcctctacactagatgtagctcagccagctacgctattgagcagtcatccgtctacgtttagaatggtcagcttccctggacctgctgcgtttcccagatgacctccccctgtcccccagtcttcattacgctctgaatcacggtccctgtgcctgtgatgatcaccataacgatctctgtcatccctgtgtctgtccctatctctgtctcggtctctctctctgtcacgatctctttccctgtctctgtcatagttgcgatctctctctcggcccatgtcacgctcattccggtgcctcctctccggctgctcctgttgagggtggcacccacgcgtccgcccacgcttccg

SEQ ID NO: 1036 - DNA, 1801 bp, Zea mays
cccacgcgtccgccaaaatgatttgcatgagctatggtcattgttggagttcatgatgcctgatatatttgctactggggatgttgatctgaagaagctgctgaatgcagaagatcgcgaactaatttcacagataaagtccattttagggccatttattcttagacgtttgaagtcagatgtaatgcagcagcttgttcctaaaatccaacatgttaagtttgttgtcatgggcacagagcagtctgaagcttacaaaaatgccataaatgagtaccgtgctgcttgccaggctcgtagtgccaagtcttcagatggcatttccaataatgttgctggattgattccaaagcgaccaatatcaaactattttacacagtttccgtaagattgcgaatcaccctttgcttataaggtgtatttatggtgacaaagatgttgatcgaatttgacggttgcggtaccctaaaggtgcatttggcttccaatgctccttggtgagagctatacaagagctaaagaactacagtgatttcaatatccaccaactattattgtcatatggtgatgtgggcacaaagggcgctctaaaggatgagcatgtttttgcatcggcaaaatgtcaggccttaggggagcttttaccttctctggcaaatgatggtcacagagtactcatatttagtcagtggaccacaatgcttgacatccttgaatgggcattggaaattataggagttacatatagacgccttgatggagggaccgctgtgacagaaaggcagactatagtggacacgttcaacaacgatctttctatatttgcatgtttactttctacaagagctggaggccagggtctgaaccttgtaggagctgacacagtcattatacatgatatggattttaacccccagatggatcggcaagctgaggaccgttgccatcgcattggacaacagaaacctgtcactatctataggctagtgacaaaggattcagttgatgaaaacatctatgagattgcaaggcggaagctagtactagacgctgcaattcttcattctggagcagagttggacaatagtaccgatgtaccagagaagacaatgggggagattttggcatctcttctcctggtctgaagttctaaccctggagtttcttgaaggtatacaattctacccgtgggatatcttcaacaatgggtttttggccttcatttaagcttaccattcaccctggttaatgtcttgaatcttgaggtcctaagatgtgcatccatgtatcctttttgctcttgaaacctcccatcttttagtctgccttatccatcttttgttctatgaatggcgtgctataaactgctggatttccgaagtgtttatggttctacataatgacataatgtttaaggttactgtaggttgtaatggagtccggttcccaccccccctctgatataggaagaactgaaatctgaagtaatacatctgtaccaaagttttaacttgttttaaatgaaacgcagaatagttccaaagtcgcaacattttcttcagtctgtaccattatttatctttatttttattttatctgcacaagtaggtacggggtacctaagctacacttaacattgtcaggatacgtattagagtgcagtttgaccacatgtacatgtatcttgacatactagtctaactgtcagtttgagattgacacccgctttatcagagaaactatatgggaaactttatatgtgttaaatttaactccccaaaaaaaaaaaaaaaaaaacccc

SEQ ID NO: 1037 - DNA, 558 bp, Zea mays
  misc_feature (525)..(525): n is a, c, g, or t
atggatgataagcactgctaggctatcctggcctatcaggcctacttggcgcgggtgtctctgtctagcggccgagtttaacagttaaaccctagctcaccgtcgtgctcgcctccccgcgcctgctcccttcaggcactgacagttcgccgccgcggcggcgctttcgagcccacgcggaagcgcacctagtgccatggcgaagaagcggaagcacaccgacgcccaggcagagacggccggcgcagagaagccggacgactccgcaccggcgcgcccggagcgcacgctcttcggcttcaaggatccgccccccgacgccgtgcccgcctccgcggcctccagggccgcggtggcgccgttcaggaacagggagaaggtactcatcacctgctcccgccgcatcacgtacaggtatcgtcatctgatgcaggacgtgctgtcgatgctcccgcacgcgaagaaggacagcaaggtcgagtcgaagcagagcaaggggaacgctctcaacgagatgctcgagcncaggagctgctccagttgtctcttcttcgagtg

SEQ ID NO: 1038 - DNA, 1396 bp, Zea mays
ctcgaggccggccgggagcacgagaccatgacctcgaacatcctaaccgaaaaaggccacaagcgcccgagcggcttaaaccctagctcgccgtcgtgctcggctcgccaccccgcgcctgctcctttcaggccctaaccgttcgccgccgcgcattcgagcacacgcggaagcgcacctagtgccatggcgaagaagcggaagcgcaccgacgcgcccgcagaggcggccggcgcagagaagcctgacgactccgcgccggcgcgcccggagcgcacgctcttcggcttcaaggacctggtccccgacgccgagcccgcctccgcgggcgccgaggccgcggtggcgccgttccggaacagggagaaggtactcatcacctgctcccgccgaatcacgtataggtatcggcacctgatgcaggacgtgctgtcgctgctcccgcatgcgaagaaggacagcaaggtcgagtcgaagcagagcaaggggaacgcgctgaacgagctccttgagctcaggagctgctccagctgccttttcttcgagtgcagaaaacagaaggatctttacctttggatggtgaagtctcctggaggaccatcagtaaaatttctagttaatgctgttcacaccatggaggagttgaagcttaccggtaaccatctgaaagggtcacgcccacttcttacattttctacaaattttgatgagcaacctcattggaagcttgtgaaggaaatgataactcagatatttgctactcctaaagatcaccgtaaagcaaaacctttccatgaccatgtgtttgtcttctccattgtggatggccatgtttggtttcgaaactaccagatttcggttccccacaatgagattgataaagttgataaaggtggtctggataaaatgacacttattgaggttggccccaggttctgtttgaatccaatcaaaatatttggtggtagttttggtggtcctacatggtatgagaacccatactacatttcccccaatcagatccgtgcactagagaagaggcagaaggcaggcaaatatgccaagaaggtgaaggccaaggtgaggcggaagatgcacgagatggagaacacgctggagcctgatgagtttgctgagctctggaaaggggagtaactggtctttgatcgaccctgtcaaagtcgtgaagcaccagcaactccttccacttccaccaagcgcaggtcttgtttaccattgtggcagtgccgactgtcgaggttgtggaagttttgtatcacaaagcatacttttatttatataaaatcggattttagtgataagataacttctgcctaaaaaccattcgtctcgtgtttgcttctaaaaaaaaaaagaaaaaaaaaaaaaaagggcg

SEQ ID NO: 1039 - DNA, 1571 bp, Zea mays
actcctatgggcgattgggatcctcgaggatcagccctaccaggcctacttggcgcgtctctctctgtctagcggccgagtttaacagttaaaccctagctcaccgtcgtgctcgcctccccgcgcctgctccggtgctcccttcaggcactgacagttcgccgccgcggcggcgctttcgagcccacgcggaagcgcacctagtgccatggcgaagaagcggaagcacaccgacgcccaggcagagacggccggcgcagagaagccagacgactccgcaccggcgcgcccggagcgcacgctcttcggcttcaaggatccggcccccgacgccgtgcctgactccgcggcctccagggccgcggtggcgccgtttaggaacagggagaaggtactcatcacctgctcccgccgcatcacgtacaggtatcgtcatctgatgcaggacgtgttgtcgatgctcccgcacgcgaagaaggacagcaaggtcgagtcgaagcagagcaaggggaacgctctcaacgagatgctcgagctcaggagctgctccagttgtctcttcttcgagtgccgaaaacagaaggatctttacctttggatggtgaagtctcctggaggaccatcagtgaaatttctagttaatgctgttcacaccatggaggagttgaagcttacgggtaaccatctgaaagggtcacggccacttcttacattttctacaaattttgatgagcaacctcattggaagcttgtgaaggaaattataactcatatatttgctactcctaaagatcaccgtaaagcaaaacctttccatgaccatgtatttgtcttctccattgtggatggccatgtttggtttcgaaactaccagatttctgttccccacaatgagattgataaagttgataaaggtggtatggataaaatgacacttattgaggttggccccaggttctgtttgaatccaatcaaaatatttggtggtagttttggtggtcctacatggtatgagaacccatactacatttcccccaatcagatccgtgcactagagaagaggcagaaggcaggcaaatatgccaagaaggtgaaggccaaggtgaggaggaagatgcacgagatggagaacacgctggagcctgatgagtttgctgagctctggaaaggggagtaggctttgatcgaccctgtcaatgtcgtgaagcacccgcaactcctgtcagcaagcgcagattttgtttacctgtgtggcagtgtctatgttgtggaagttttgtatgacaaggcctacgtttattttacataaaatcggattttagtgataacttatgcccatatgacattctctcttgtttgcttctagtggatgtagtgccaagtgttatatcacttatgtgattggtagctgagaatcatggggaagcgcgatcacagttcaaacctcaagatatcaatgtgatagccatagccgtgttccatatgtatactatgtacttcatttcagcaatggttttgtaaggaaaatagatcaagcttcatttaaagtaaagttttagtgtttgatgagc

SEQ ID NO: 1040 - DNA, 1662 bp, Zea mays
atgcgcgcctctctccctcccaacaaccaggccacaagcgcccgagcggcttaaaccctagctcgccgtcgtgctcggctcgccaccccgcgccagctcctttcaggccctaaccgttcgccgccgcgcattcgagcactcgcggaagcgcacctagtgccatggcgaagaagcggaagcgcaccgacgcccccgcagaggcgaccggcgcagagaagcctgacgactctgcgccggcgcgcccggagcgcacgctcttcggcttcaaggacccggtccccgacgccgagcccgcctccgcgggcgccgaggccgcggtggcgccgttccggaacagggagaaggtactcatcacctgctcccgccgaatcacgtataggtgagtgctccctgttttttccgcttgcagtcttgtgagatgggtgattccgttcacgcgtgcgtgctcggcgtaggtatcggcacctgatgcaggacgtgctgtcgctgctcccgcatgcgaagaaggacagcaaggtcgagtcgaagcagagcaaggggaacgcgctgaacgagctccttgagctcaggagctgctccagctgtcttttcttcgagtgcagaaaacagaaggatctttacctttggatggtgaagtctcctggaggaccatcagtaaaatttctagttaccccggttcccgccttggggccggggaagcttaccggtaaccatctgaaagggtcacgcccacttcttacattttctacaaattttgatgagcaacctcattggaagcttgtgaaggaaatgataactcagatatttgctagtcctaaagatcaccgtaaagcaaaacctttccatgaccatgtgtttgtcttctccattgtggatggccatgtttggtttcgaaactaccagatttcggttccccacaatgagattgataaagttgataaaggtggtctggataaaatgacacttattgaggttggccccaggttctgtttgaatccaatcaagatatttggtggtagttttggtggtcctacatggtatgagaacccatactacatttcccccaatcagatccgtgcactagagaagaggcagaaggcaggcaaatatgccaagaaggtgaaggccaaggtgaggcggaagatgcacgagatggagaacacgctggagcctgatgagtttgctgagctctggaaaggggagtaactggtctttgatcgaccctgtcaaagtcgtgaagcaccagcaactccttccaccaagcgcggattttgtttaccagtgtggcagtgcccactgtcgaggttgtggaagttttgtatcacaaagcatacttttatttatataaaatcggattttagtgataagataacttctgcctatatgacattcttctcgtgtttgcttctagtggatgtggtgccaagtggagtatatctctcttggatccaacggtcattaccgttctccgtgtcagccgcggaattttaaactatttttttataagaaaatgtttaatagtttcattgttctacataggtgaaaatataagagccaatgatgttaagtagttgcttaacaataaaatatctaggtcattcatctcttgacatcgtaaggtaacgatttatatatttctgcatacacggtcattcacatttt

SEQ ID NO: 1041 - DNA, 5170 bp, Zea mays
  misc_feature (4605)..(4605): n is a, c, g, or t
  misc_feature (4996)..(4996): n is a, c, g, or t
cttttaagtttacctgcaggccgacgatgcgatcgcgcagaccatcgacgccgacgtgccgacgccgtttgtcgcgaatccgtcgggcaatctcctcctcctccgaaagttgtgtgcgtctagtctggtttatcgctcccgtctgcttgtattttgtgaaaaaaaaaccaaccactcattatacaaataatgtgttgggtttattgtgcacaatatgattttttacatctgacaatattaataatatgtatagatggtaatgtttgatattaataataaatgacgtatgtcctaattataaattaagctgtgacgaggactctgtcggtaatttatccccgcagaaaatggggatgagaaataaatattccccacaagcatttatgaagaaattcttttgtcgcagaggacggggatagggacatgttcctccgacgaggaatcctccattgtcatccgtagacatgaggagcaaatgattcatttttttttgtaatggtcagatgccctaatttttagttttccctgtattcatcctttgctcaacgtttttccctatgtatgctaacgatgaagatcctaaacagcatactagcattgtagtgccaaagttggccgggttaggtatgttgagaactacgttaccacggatcaccagatccgctctcttccctcccgttagcagtataggcgtaagaagctgtagattactcgtctcccttccataagcacgagaaaagaaatacacgggacacgagatatagggttggatctctgacctatttctcttttctataccatattagagtggtacaggttttatatatatagagacgtgatagctctaggatcatattcgatatttgaccacataacctttcattagggtttctcaacaaattaaacctggcggcgtgcacggaagcgcgcggcccgccccacggcccacgcgcatgtgcgcagccgcgcatgctggttagaaatttgatggtttgttttagcaataaggcctcacagaactcaagcgtgcgcgtgacgtgtggatgaagtgacgacccgctcacccccggcatcggcggtatcgatgcgcacgggcattgatcggcacacgtggttgtggcatttgcaagagagggggatggggttagtaaactaactaaggacttgttccggtttaccccaatccatatggatcgagagggttaatagggtttcaatttctagcaagtcaaaatctctcacaatccgtatcaatacactctaatccatatggattgaaaataaccaaacaagctctaactaagctttatggaacgagcacgcaattctcgaggcagccgatcggctgtgcttcctttcatttcatttgcttggtgggcgccaccggcggcctacgcatgtacgtagtactccgactccgtgcatcctctcgctccggcagttgactatactgcttgaaaaatcaacttgggagccaatttgggcagcccactcagctaaccaacctttttcgaacaggtcaacaagtaaccgaccatctatctaagatttaaaacaacagcggacccgtgcaagtggatcaaaccaggtcaggaagcaaacacatcgatctggtcagcgtttggtttggcgtgcaggtggaacctgagcgatttgacctacgtgcgccgggttatgttttattagagtaaccacgtccacgtcgtctcggaaccaactcgtggctggctgaacaccaacacacgtgtgccgtgcgcccctgcctattagcaccgtgttctggatagagatggagtacacgcgtccctccccagctcgtcctcccctctgtcctgatctccctcccaaatctcaagtcaactccccaacggctttcgcttctctgctggcctggcctgccgacctgcagcacagaccaccgatccgtccgagatcgcgacgatgctgctgctgggtgctggtgctcctctctccacacccaaaagtagggcgtcctctttactcctcgcgtacgtacacgcgccggctccaactccaatcaacccccatccctacctcgcgacgcagcatatgcggcggtggtggatcacagcgaggcgccagccaccggtccggaccacagcgcaggacgccgctcgctggtcgctgctcccttaacaccaacacgaggacgcggcgccacctctctctccactccgccatttaacgctgtctctgagactggaggaaggaaggaaccgtggcctcggatcctgcgggccccccccctcccccagtgcgaatgcgaaagccggaaggcgacaggcccgctaccacgctggtcccgccgcgtcacgtggacgcccgtcacgcggcctctcccggcgcgacaagtgccggccatcttctgggcgcgacacgcggcgctccgccgctggcccgcgcgtcgcgacaccgcgagggaggccgcaaaaaggtagtagagggctagaggcgagggggcccccctccgtttccccgcactcacaaactgcactaatggctccgcgtctttcgctgctagtcgctagtgtaggacggacaccccggctcgctcaccccatacgccgacgctgacaccaggcccagccacgcccgccccccacctctccacaagtggctgagtcgtaacttgaggcaaccgccccccgcccacttccgtcacggcgcggcgcggcgcggcgcggcgccaagcaaccttatccacatctcccctcgcctccgctataaagcccgcgcccctccccccgcccccccacgcgaaccacttcacagaagaagtgctttaccctcacccgccccacgcgcggtagttcgttcgtcacagtcacagtcacagaccagtcgtttctcccttctctcccccgggcccggagaggagaggatggccggccggagcagcctctccatggtcgcgtcgcaccggctgttcacgccggtcaacccagtgggcggcgccgaccacggcgtggagctcgacgaggccgacgtcatctggggcggcggcggcggatacccggcgtcgtcctcaccgtcgtcgtcgtcgccgttcctgtcctccgcggtcgacccgtacgcgcggtcgccgccggtggccgcgccgtccaagcagaagccgcgtggcgtggtggccggcgctccggggccggcgtcggtgcccgtcaacatcccggactggtccaagatcctgggcgccgagtacgccgggagcgggtgggcggcgcacgacgaccgcgcggacgacgacgcggcggccttcggcggcgccgggggccggcgctgggtgccgccccacgaggtgctgcaggggcgggagcgcgcggcggcgtccttctccgtgcgcgagggcgccggccgcacgctcaagggccgcgacctccgccgcgtccgcaacgccatctgggagaagaccggcttccaggactgaccgaccgctactgtcagcgccagccttgcgcggccggcaatgcccgcctaccgtggcctggcctcgtttgatgatcccgttctcgccttgaggaggaggaagtgaggagcttttgcttgattagtggccttttaatccatttggattaggtcgatggttctttttcttctctctctctttttattatgttttggttcttgtcgctctagtcgtgatcgatgaggggagagtagagattaaaagcctctgtttttggcatttttcccccggagaggctcggtcgatgtacgtcccaccactaagattaattcatcttgattactagtatcaatgatttcagcattattctactgcaagtactgcaattatcctgccaatccagtactcctcttctttcgttaagaaaaaatgtaaccggccggaacccatttcgatccaaggtacttatttgagtcatattttaatactagtaagcaatacactctggcactgtagctgccctactgtttcagtagtctaatcatgatattgttagtttgttggtggtgcaattaggttaatttttttttgagggaaacaggagtggagggtccctactcgatttatttaattttttccagagttgcaaagcatgaaaagagattgtgacagtctgctccggacagatttcgtgtgcggggcggaaagaaagaaaaataataataatacagcatctcagcaagaaatagaagggggcggagaaaggcatgggccccatcgctgattggagaggagggcggtgaaatgtcgacacttcgcattaatatagttggttagcacatactagtacaagtaggagtagttaattgcaaagtgagaaaccgagaatatgccggttcccatttgcccccacacgagaaataatgctacgccaacacgcaccatgcacaacgcgacactccctgagctagtccgaaagagcatgacttggtgtgggttgccttgggatggttaggaggttgatcaaccaaactgcttagcggtttgattattggttggcacttgacatgttggtttttagctgcattttttttaataattttgaggttcaaaattgtttggtacgcatttttggcgggcatttcttttttttcacgttatcgttaagcgtagaagcctcntattccgtgcattactagtcacatgcacgtgcattgctacgtttatatatatatatatgataaattttattttaataaaatataaaatatatattttctattgattaggtaggtgtggatatagaaccaaccatcaatgttcaaacactaacttatatataatttcaccttattttttacatactctcctattatagtagtagagaaagattataggagtgcatgttttttctaaagaaatgtaggttttttacgaaataatattgacgcgggacgaaatgtaggattcaacatgatataaagaaatgtaggattcaacatgatataaagaaatgtagatttttttctaaagaaatgtagaattcaacatgatataaaataatattgacgngagacgaccgttgaaaactggtgctttaatatagtagagatttatcttatctagacatatatactccctctgtctatgattaaatcaacttctaaaaaattaggacaaataagtgttatagataatcggagtttctaatcgaagaatatactactacatcaatccaaacccatc

SEQ ID NO: 1042 - DNA, 1047 bp, Zea mays
cccggtcccccgggcggccccgcttcacagaagaagtgctttaccctcacccgccccacgcgcggtagttcgttcgacacagtcacagtcacagaccagtcgtttctcccttctctcccccgggcccggagaggagaggatggccggccggagcagcctctccatggtcgcgtcgcaccggctgttcacgccggtcaaccctgtgggcggcgccgaccacggcgtggagctcgacgaggccgacgtcatctggggcggcgtcggcggcggcggcggctacccggcgtcgtcctcgccgtcgtcgtcgccgttcctgtcctccgcggtcgacccgtacgcgcggtcgccgccggtggccgcgccgtccaagcagaagccgcgtggggtggtggccggcgctccggggccggcgtcggtgcccgtcaacatcccggactggtccaagatcctgggcgccgagtacgccgggagcgggtgggcggcgcacgacgaccgcgcggacgacgacgcggcgggctgcggcggcgccgggggccggcgctgggtgccgccccacgaggtgctgcaggggcgggagcgcgcggcggcgtccttctccgtgcgcgagggcgccggccgcacgctcaagggccgcgacctccgccgcgtccgcaacgccatctgggagaagaccggcttccaggactgaccgaccgctactgtcagcgccagcgccagcgccagccttgcgcttgcgcggccggcaatgcccgcctaccgtggcctggcctcgtttgatcccgttctcgccttgaggaggaggaagtgaggagcttttgcttgattagtggccttttaatccatttggattaggtcgatgagttctttctctctctctctttttttattatgttttggttcttgtcgctctagtcgtgatcgatgaggggagagtagagattaaaagcctctgtttttggcatttttcccccggagaggctcggtcgatgtacgtcccaccactaagattaattcatcttgattactagtatcaaaaaaaaaaaaaaa

SEQ ID NO: 1043 - DNA, 817 bp, Zea mays
gccggccgggccggggtacaggaagcgctagaacaacgcggccgccccccccggttcggccgcgactcgcctggtgatgggcgtcgaactggcgcaaccgaccgccgccgcggctgcggtgaccaccgctgagcaggctcaggatctcatcgacgccgctaggtacgacgacttggaggacgtcgtcgccctgttctccgctggtgtctcgctggactccacagattcgcaaggccgcacagctcttcacatggcttctgccaatggtcaccttgctgtggtggaatacttgattcaaaatggagcgaatgttaacgccaccaacatggagaagaacacaccactccactgggcatgccttaatggacgtatagaggtaatcagggctttgatctcagcgggggctagcgtgagtgctctgaacagccacgagaaaacgccaatggacgaagcggtgaccacaggcaagatgcacgtgatcgacgcgatcggtgcggcagtagctcaagccgagctcaacggcgttactgtctcctaaaaggacctgatgagtacctggagctttgaatgacttgcagccttgttcttatctcccagcggttctgtctgtatcactcgcgaacctgaatccccgacggcccagtatccgggcaatatctatactgacggcaatcgcctgttagtgtcattggcttgaggacatgggaggccgacccgacctgtcgttgtaaaccagatgtgcagatgtcaaagatcaggattttctcctacaaaaaaaaaaaaaaaaaagcggccaaaaaaaaaggcccctagggcc

SEQ ID NO: 1044 - DNA, 1038 bp, Zea mays
aaaaaaaaaaaaaagaaaaaaaaaggccacgctccggcccgggccgggtacaggaagcgctagaacaacccgaccgccgccgccgccgacgacgcctcagctactcgcctggtgatgggcgtcgaactggcgcaaccgaccgccgccgcggctgcggtgaccaccgctgagcaggctcaggatctcatcgacgccgctaggtacgacgacttggaggacgtcgtcgccctgttctccgctggtgtctcgctggactccacagattcgcaaggccgcacagctcttcacatggcttctgccaatggtcaccttgctgtggtggaatacttgattcaaaatggagcgaatgttaatgccaccaacatggagaagaacacaccactccactgggcatgccttaatggacgtatagaggtaatcagggctttgatctcagcgggggctagcgtgagtgctctgaacagccacgagaaaacgccaatggacgaagcggtgaccacaggcaagatggacgtgatcgacgcgatcggtgcggcagtagctcaagccgagctcgacggcgttactgtctcctaaaaggacctgatgagtacctggagctttgaatgacttgcagccttgttcttatctcccagcggttctgtctgtatcactcgcgaacctggatcccccgacgggccagtatccgggcaatatctatactgacggcaatcgcctgttagtgtcattggcacgaggacccgacctgtcgttgtaaaccagatgtgcagatgtcaaagatcaggattttctccttacaaatgttgtagggccgttgcttgttctcccaggcaaccttcgttttcctttgggttcccttggctccaagtagcagcgaaacgggatccgcacctccaccctctgtgtttttttttcttctcgaaattcagcttttgttgcctttaaaattggaatgcaatgtcgtgtccctgtttgagggttgtttttattgatgaaacgctgcaatcaaggattctctccaaaaaaaaaaaaaaaaaa

SEQ ID NO: 1045 - DNA, 1722 bp, Zea mays
tgttgcgtttcaactttagtctactctaatttacttgggactaaaaggttttgttgttgttgtaggattgtggtccaggtcatccccccatccgctggcttcaacagcagtattcttgcttcaacaagtgacctttctacagttttaggtaatttccacagcgatggataaagcaatacctggtttcctgatgctgaaacttttctgtaacaatctgtcattttttcttctcacgatcaagctcaaagattatgatacaagcatgactggttcttgaacactatacaaggctttggagagatgggatgtgctgcttccaggttagaagatgaggaggctgtcaagatgtgccgggacagaagggacttgatcaagcaggcactggagcagcgcaaccgatttgcatcttcccacattgcttacattgagtccctgaagcgtgtttcggtggctctccaacggtttgttgccggagatgatcaccatgagctaatcttcgatacattcatctcccctatcaagcaacagaagccagagatgcttggtctgccttatggttcatatgagaagagaactattcatgtttcaagatacctgaggtcagggcctaacccatcagtgtccattgaggagcacccacgtccggtggaaacagtccgtgtcgagtcaaattaccctatggacaacgacagtggcatggtggatagattcctaccaacaccctcttcaccagtgagatcgtcttcatactacccgccaccttataacaggccaagctacccacctccattggaccaggaaacagttagaaattcttcctattgcatgccttatgacaggccaagctatgcacctccatcaacccaggagacaatgaggacttcttattatgcatcttatgacaggccaagctacccaccaccatcaccccaggagccactgagaaattcatatcacgtgccatatgacacaagctacccacctccgtcaccccaggagcaggaagcatcaccgtgggacttcttctggaacccattctcatcactggacagctttacatatccccgccctcggagtagctatgacaatgtggtcactgatgatgaactcgcgaggttacaacgggtacgagaggaggaaggaatcccagaacttgaagaggaagatgatgagtgtcaagagcatgtacagatggacagaaaagaggaaaaagaagagcacgacaatgcagatgatgatgaagacgatgatgaagacgatggcgaggaatgtgagcattcagatgagtgtatggtttctaatgtgaatttcgatgccaatatgaagcaagaaacaaagggatttgaatccaaaggtattcagtgttctgaagcaccagaaccttgcaagacaggggaacttgagataaaggcgcccaggaaagagttgatgagaaacagagtagcaaatgcagaagaaactcctggtttcacagtatatctgaatcgaaggccagcaagcttggttgaggccatgaaggacatcgactgtcagttctcgcggatatgtgacgctgctcgggaaatctcagtaatgttggaggcaagtagagctcagtactcaacctcaaacgatctttctgcgaagatgctgaacccagttgcacttttgcgttctgcgtcatcccgttcatcattatctcgttttccttttgcttcctctagcttaatagatgatctcttt

SEQ ID NO: 1046 - DNA, 619 bp, Zea mays
gagctatggcgatggctcgtcgcggctctgggaggggccattgttggtcctcatgtactcggtcgtgatgctggttgattcaatgatgagtgcggttttctacttcacttgccggtcatcaaacttggacttcttggacgagcagggtggctcggttgaggagcttgagatgatgagagctggcagtttagatgcatttaggtgatgaagaagattggtttatttctcacgtgtgtatctgttcatagcatcataggagaataagtgagatggccatttgtcaagagccgcacagattgacaagtccgtattggtggttacaagccatggtggcatatgtgtatgcttgggttgattagctgaagttggtgttgaaaggaacattttttgcacccatttggtatgccatgcttagtcaatagcggatttggatgggaaggctagagggagatctgtcatgtggtttgttctggatcagatccatgttttggcagcgattgaagagctggtgatatgtgtagcattctttcaaaacggtgtaactagtatatcaatttaatcgttgtggaaaaaaaaaaaaaaaaaattttgttgcctaatggcattttggttatactgg

SEQ ID NO: 1047 - DNA, 1714 bp, Zea mays
ttgggtacctcgaggccggccgggaggtgacaaatccacgcggagtccgctgaaattttggtcgccccatgcccgttctagacgccatggacgatgcggcggcggcggcggtagataggcacggcggcttctagaccgtctccgttttctgcgcgttggccgtcgggggaagtacacaataaacaaagcaagagcagaggtccaactgggctgctgcgtcctctgcctcttctccttcctgtcgttctgcgctgccccgacccccgagtgcccctggtcttgtcctcctctccctgctgacctcggagcggagcaaagcagccgccaggagggaaggatccatggccgggagatcgcggtacgacaaccccttcgaggagggcggcgccgacgaggtcaaccctttcgcggaccaagctaagagaggaggatcgactgctcagtccggctactctggtggcgcgttctacacgacgcaatcgcaacgccctgctcctcctagcacacgcctttcgcctcttcctcctgaacctgccgacttctacaacgacttcgctaccccagtggatatccccatggacacaaacaaggacatgaagacaagggagaaggagcttctggccaaggaggccgagctgaacaggcgtgagaaggaaataaaaaggcgagaagatgctgcggcacgagctggtatcgtgttggaagagaagaactggcccccgtttttccccatcattcataacgatatcggcaacgagatacctgtccatctgcaaagaacgctgtacgtcgcgttcgcgtcgctcttagggttggtcttgtgcctgttttggaacatatcccccgttcccgctgcctgggcaaaagggtcagaaagaacgtgtgctgttttgttccttggtgcaggtccaaagatatggttcctcgcaatcatatacttcatcctcggatgccccggtgcatactacctttggtaccggccactataccgcgcatgatgaggaacgagagcgctctcaagttcggatggtttttcctcttctacttggttcatatcgccttctgcgcgtacgcagctgtttctccttcaattctcttcgtgggaaaatcgttaaccgggattttgccagcaatcagcttgataggcgacagcgtcattgttgggatcttctacttcattggctttgcattgttctgcctggaggctttgctaagcgtgtgggtcattcagcgcgtctacctgtacttccgagggagcgggaaagaagcggagatgaggcgtgaagcagcacgcggtgcagcgagggcagcgttttgatgaaaaccgtatatagatgatatatataggcacgacttacatactgttcataatagtttgaagtgctttaggtcaagaggcatgtgtgtacagtagggttggcgtcttgtacatctttaaggccggtttggtgaaacatggaaatggaatgaatccataaaggagagatccgttgttattcaaaattaaataacaaggatctcttctccatgggtcccatccatttccctctccaccaaaccagccctgagttcctatcgccacggtgttttgagccctccagattgatcaatcgtggtacatatgacagtgttagtatatggagtaaatacacatggacgggtaaacctaaaaaaaaaaaaaaaaaaaaaaaaaaaaaaaaagaaaattcgaggg

SEQ ID NO: 1048 - DNA, 1435 bp, Zea mays
aggtgacaaatccacgcggagtccgctgaaattttggtcgccccatgcccgttctagacgccatggacgatgcggcggcggcggcggtagataggcacggcggcttctagaccgtctccgttttctgcgcgttggccgtcgggggaagtacacaataaacaaagcaagagcagaggtgcaactgggctgctgcgtcctctgcctcttctccttcctgtcgttctgcgctgccccgacccccgagtgcccctggtcttgtcctcctctccctgctgacctcggagcggagcggagcaaagcagccgccaggagggaaggatccatggccgggagatcgcggtacgacaaccccttcgaggagggcggcgccgacgaggtcaaccctttcgcggaccaagctaagagaggaggatcgactgctcagtccggctactctggtggcgcgttctacacgacgcaatcgcaacgccctgctcctcctagcacacgcctttcgcctcttcctcctgaacctgccgacttctacaacgacttcgctaccccagtggatatccccatggacacaaacaaggacatgaagacaagggagaaggagcttctggccaaggaggccgagctgaacaggcgtgagaaggaaataaaaaggcgagaagatgctgcggcacgagctggtgtcgtgttggaagagaagaactggcccccgtttttccccatcattcataacgatatcggcaacgagatacctgtccatctgcaaagaacgctgtacgtcgcgttcgcgtcgctcttagggttggtcttgtgcctgttttggaacataatctgcgttaccgctgcctgggcaaaagggtcaggtccaaagatatggtttctcgcaatcatatacttcatcctcggatgccccggtgcatactacctttggtaccggccactataccgcgcaatgaggaacgagagcgctctcaagttcggatggtttttcctcttctacttggttcatatcgccttctgcgcgtacgcagctgtttctccttcaattctcttcgtgggaaaatcgttaaccgggattttgccagcaatcaacttgataggcgacagcgtcattgttgggatcttctacttcattggctttgcattgttctgcctggaggctttgctaagcgtgtgggtcattcagcgcgtctacctgtacttccgagggagcgggaaagaagcggagatgaggcgtgaagcagcacgcggtgcagcgagggcagcgttttgatgaaagccgtatatagatgatatattatatatataggcacgacatacatacactgttcataatagtttgaagtgttttaggtcaacaggcatgtgtgtacagtagggttggcgtcctgtattacttctagttaaaagacgcaaggttttgagtcgaaaaaaaaaaaaaaaa

SEQ ID NO: 1049 - DNA, 1676 bp, Zea mays
gcccacgcgtccggcaataaccggggtggcagaaaagaggccgcaactgcaaggcaccgcaggagagaagaagatcaccagcaacaccaagcaactactcgtacgcggaaagagaaacccagaagccggtcttgttggattattccgttcgtcagttccgtccggagcggcggaggctctgttggtggtgcaaaaatgagtgacaacctgatggacaaggttagcgcctttggtgagcgcttgaagatcaccgggacagaagtcagcaaaaagatgactgccggaatgagctccatgagtttcaagatgaaggagttgttccaggggcagactccagctgacaagattgttgagggtgccacctcagaggatctggacgggcctgactggaactcaaacttggagatttgcgacatgatcaacacagagaaggttgacagtgtggaactcatccgtgggatcaagaagaggatcatgctgaaggatgcgagggtccagtacctctccttggtcctgcttgagaccattgtcaagaactgtgacaaggccttctcggaagttgcggccgagcgggttcttgatgagatggtcaggttgattgatgatcctcaaaccgtggttaataacaggaacaaggcccttatgctcattgaagcatggggggagtctggtgatgaactccgttatctgccagtctatgaggaaacatacaagagcttgaaatcaagaggagtgcggtttcctggacgtgacaatgagagcttggctcctatatttactcccgcgcgatcagttgctgaagctgatgttgatgcaagcttgccccagcaggtgttcgaggacgtccatgttcatacatatactgctgaagaaacaaaagaagcatttgatgtagctcgtaacagcgtagaacttctttcaactgttctttcctcttctcctgagcaggatgctttgcaggatgacttgacaaccactcttgtgcaacaatgctaccaatctcagcacactatccagatgattattgagaccgttggagacaatgaagctgtgctctttgaggccttgagcgtgaacgatgagatccagaaagtattatcgaagtacgaggagatgaagcagcccagggcctccgagcatgcagaacatgtaccagttgtcataccgattgctgcggagcatgaagatttgaatgctgttggcaatgaagacgcccttgtcagaaaaccagctgccgcgagagcaacgtcaggtggagatgatgacatccttgatgatctcgacgagatgatatttggcaagaagggaggtagcagctcccaggaaggtccgaaaaagccagatccgaagaaggatgacctgatcagcttttaattacctttccataatcgcagccagtacttgctattgtctggtgctgtacccactcggtagattgaagatttttattcgcatacgattcataccggtttgttcagttaagtcgctacactttgtcaatcttgtttcatggctgggtcccatgaccatgaatgtattgtattggatggtggattatgcgagacggcgggaaagtgtccaatgtgggtgaatctttattcttcgctacagtagccattttttttaaactaaaaaaaaaaaaaaaggctaatccagtagatctcttataatgccgc

SEQ ID NO: 1050 - DNA, 1599 bp, Zea mays
ttttgccggggggttggtctagaagcaataaccgcggtggcccacccggggccgcaactgcaaggcaccgccaggagagaagaagatcaccagcaacaccaagcaactactcgtacgcggaaagagaaacccagaagccggtcttgttggattattccgttcgtcagttccgtccggagcggcggagcaaaaatgagtgacaacctgatggacaaggttagcgcctttggtgagcgcttgaagatcaccgggacagaagtcagcaaaaagatgactgccggaatgagctccatgagtttcaagatgaaggagttgttccaggggcagactccagctgacaagattgttgagggtgccacctcagaggatctggacgggcctgactggaactcaaacttggagatttgcgacatgatcaacacagagaaggttgacagtgtggaactcatccgtgggatcaagaagaggatcatgctgaaggatgcgagggtccagtacctctccttggtcctgcttgagaccattgtcaagaactgtgacaaggccttctcggaagttgcggccgagcgggttcttgatgagatggtcaggttgattgatgatcctcaaaccgtggttaataacaggaacaaggcccttatgctcattgaagcatggggggagtctggtgatgaactccgttatctgccagtctatgaggaaacatacaagagcttgaaatcaagaggagtgcggtttcctggacgtgacaatgagagcttggctcctatatttactcccgcgcgatcagttgctgaagctgatgttgatgcaagcttgccccagcaggtgttcgaggacgtccatgttcatacatatactgctgaagaaacaaaagaagcatttgatgtagctcgtaacagcgtagaacttctttcaactgttctttcctcttctcctgagcaggatgctttgcaggatgacttgacaaccactcttgtgcaacaatgctaccaatctcagcacactatccagatgattattgagaccgttggagacaatgaagctgtgctctttgaggccttgagcgtgaacgatgagatccagaaattattatcgaagtacgaggagatgaagcagcccagggcctccgagcatgcagaacatgtaccagttgtcataccgattgctgcggagcatgaagatttgaatgctgttggcaatgaagacgcccttgtcagaaaaccagctgccgcgagagcaacgtcaggtggagatgatgacatccttgatgatctcgacgagatgatatttggcaagaagggaggtagcagctcccaggatccgaaaaagccaaatccgaagaaggatgacctgatcagcttttaattacctttccataatcgcagccagtacttgctattttcctggtgctgtacccactcggtagattgaagattcttattcgcatacgattcataccggtttgttcagttaagtcgctacactttgtcaatcttgtttcatggctgggtcccatgaccatgaatgtattgtattggatggtggattaaaaaaaaaaagaaaaaaaaaaaaaaaactcgagggggggcccggtac

SEQ ID NO: 1051 - DNA, 1705 bp, Zea mays
cgggggaatgaagagaaatcccggaccacccggcagacaagccgctcttgttgattattccgttcgttagttccgtcgcggagctacgctaagcctacgcccatcggcccctgttttcctaatccgcttctcctgcttccggggaaatttcgtgtccagtatcttgatcttccgccgccgcgcttcacgccagggctccttccaccggcgtcctccttaccgtcgtcctctactggtgctggactgctgcgggggtggagatcggcttagatcaactcttaattttgccgggactctttagagggcgcgtgcgctggtacagcaaaaaatgagtgataacctgatggaaaaggttagcgcctttggtgagcgcctgaagatcaccgggacggaggtcagcaagaagatgacggccggaatgagctccatgagcttcaagatgaaggagttgttccaggggcagactcccgctgataagattgttgaggacgccacctcggagaatctggacgggcctgattggaactcaaacttggagatttgcgacttgatcaacacagagaaagttaacagtgtggaacttatacatgggatcaagaagaggatcatgatgaaggatgcgagagttcagtacctctcattggtcctgcttgagactattgttaagaactgtgagaaggccttctcagaagttgcggccgaacgggttcttgatgagatggtcaggttgattgatgatcctcagaccgtggtgaataacaggaacaaggcccttatgctgattgaagcatggggagagtccggtgatgaactccgctatctgccagtctatgaggaaacgtacaagagcttgaaatcaagagtgcggtttcctggacgtgacaatgagagcttggctcccatatttactcccccacgatcagttgctgaagctgatgttgaaaccagcttgccccagcaggcgttcgaagacgtccatgttcatacatatactgctgaagaaacaaaagaagcgtttgatgtagctcgtaacagcatagaacttctttcgactgttctttcctcttcccctgagcaggatgcttcgcaggatgacttgacggccacactcgtgcaacaatgctaccaatctcagcacactatccagaggattattgagaccgtcggagacaacgaagctgtgctcttcgaggccttgagcgtgaacgacgagatccagaaagtgttgtcaaagtacgaggagatgaagcagcccagggcctcggagcatgcagaacagagagcagttgtcataccggttgccacagaacatgaagatctgactgctgccgtcaatgaagacgcccttgtcagaaaaccagctgccgcgagaacaaggtcaggtggggatgatgatatccttgatgatctggacgagatgatattcggcaagaagggaggtagcagctcccaggaagggccgaagaagccagatccaaagaaggatgacctgataactttttaagcgtacccttctataattgcagcctttgcttgctattttctggtgatgtacccactcggtagattgaagattccttaggatttggatcgattgtctattcgcatacgattcgtatctgccccctttcggtttgttcagtaaagtcgctgcactttctcagtcttgttccaaaaaaaaaaaaaaaaaagcggccctagggcc

SEQ ID NO: 1052 - DNA, 1874 bp, Zea mays
ccactgtgttcgcaccaagcaactactcgtacgcggaaagagaaacccagaagccggtctccggccgggattccgttcgtcagttccgtccggagcggcggaggtacgtctacgcccctcaaccccggctcctaatctgcatctcctgcttccccaaaaattccatgtcctgatcttctctgccgctgcccccaatttccctctcatctcttgctgtctcttccgccgccgccgcacgtcttccttcccatcgctctctactggtgctggactgccgtggggtggagatcggcttggaccaactcatattttaggctctgttggtggtgcaaaaatgagtgacaacctgatggacaaggttagcgcctttggtgagcgcttgaagatcaccgggacagaagtcagcaaaaagatgactgccggaatgagctccatgagtttcaagatgaaggagttgttccaggggcagactccagctgacaagattgttgagggtgccacctcagaggatctggacgggcctgactggaactcaaacttggagatttgcgacatgatcaacacagagaaggttgacagtgtggaactcatccgtgggatcaagaagaggatcatgctgaaggatgcgagggtccagtacctctccttggtcctgcttgagaccattgtcaagaactgtgacaaggccttctcggaagttgcggccgagcgggttcttgatgagatggtcaggttgattgatgatcctcaaaccgtggttaataacaggaacaaggcccttatgctcattgaagcatggggggagtctggtgatgaactccgttatctgccagtctatgaggaaacatacaagagcttgaaatcaagaggagtgcggtttcctggacgtgacaatgagagcttggctcctatatttactcccgcgcgatcagttgctgaagctgatgttgatgcaagcttgccccagcaggtgttcgaggacgtccatgttcatacatatactgctgaagaaacaaaagaagcatttgatgtagctcgtaacagcgtagaacttctttcaactgttctttcctcttctcctgagcaggatgctttgcaggatgacttgacaaccactcttgtgcaacaatgctaccaatctcagcacactatccagatgattattgagaccgttggagacaatgaagctgtgctctttgaggccttgagcgtgaacgatgagatccagaaattattatcgaagtacgaggagatgaagcagcccagggcctccgagcatgcagaacatgtaccagttgtcataccgattgctgcggagcatgaagatttgaatgctgttggcaatgaagacgcccttgtcagaaaaccagctgccgcgagagcaacgtcaggtggagatgatgacatccttgatgatctcgacgagatgatatttggcaagaagggaggtagcagctcccaggatccgaaaaagccagatccgaagaaggatgacctgatcagcttttaattacctttccataatcgcaaccagtacttgctattttcctggtgctgtacccactcggtagattgaagattcttattcgcatacgattcataccggtttgttcagttaagtcgctacactttgtcaatcttgtttcatggctgggtcccatgaccatgaatgtattgtattggatggtggattatgcgcgacaaaaagaaagagaaagtgtccaatgtgggtgaatctttattcttcgctacagtagccattttttttaaactcatatcttatgcttcggctaatcaagtagatctcttataatgccgcaaaaaaaaaaaaaaaaaaaaaaaaaaaaaaaaaaaaaaactggagactctcgtgc

SEQ ID NO: 1053 - DNA, 1487 bp, Zea mays
gctttcaagtaaaaaaagaaacaatttttcatagttattgaacgtaaccagattttttatttcacacatcagttttgagtcaatccagagagcgtttcagtatgatgctgtttatctgtttctaaacgtcgtgcttgtcattcgtgatgcagaggatccctggctggtggatctggttctattacatctgtccagtggcctggaccctgcgaggcatcattacatctcagctgggcgatgtgcaggccaggatagtcggccctggtttcgatgggaccgtgcaggagttccttgaggaaagcctggggttccaacaggggatggctggtgtcacggttgcggtgctcattggcttctcccttttcttcttcgccgtctacgcgacttctatcaaggttctgaatttccagagaagatgaccagctgcctgagctaagtaagcctccgtggtttgcttttgctactgtgtggtgccaacatcaaagtctacttgctagctactcggcggatgccggatggatgaagcacccgttggtcgtaggattgaagttttcacacgtagagaggatggtagataattaaaggttcatgtctgtatatgattactatcgcaaatataatgagcaacagtagtgatgcatttgtgctgtacgtaagatatacagaagagtatgcctcatctgttgccttcacaataggcaaccacgtgactatttatctggtttttctatatatatatatcaacagagaagtaaaatgtcttctaaatcactagccaattactgtttggaaagcatatattttttgtgtcctctctactgcagaaggtaaatccgactcctcgagattccagatagtatcgtgagtcacttggcaaggctcgcggtactggacaagttgcagcggacatgtcagcacctcaacgcccgcgtcgtcgcctgacggtcgtccgacaatagcgacaccagatatcgacaagggcgctggtgagcttcatgatgaaaggcccagtacgaggaacgcgtgcgtcaaaacgctcttgtttggtggtggaagtggaagcggatgctgcacggcacggccgcacggctagcaatctagcatagcatgcgacaggtcaggtcggagagagagagagagagacaggcgatgtcgacgaggcgagtggcacggcgtgcgcgacttggcgacgaccgggccaaacttgtgcccagcgcaggtgactgtggagaccagcggtcccggccgccgtgggagctgctgggggctcgtaatatggccgggtggctgtcggccaaccgtcggcctcggctcgctccgtttcttctagataaaacgcagcgcgggccatgcatgcttagactaatcgcggagcgcatgcatacacaccctgccctgaaggtgtgacacttatcactgtactttgaattttctaagccagattctggccttgcgagatgagacagattctcattactacaaaaggg

SEQ ID NO: 1054 - DNA, 3101 bp, Zea mays
gatatctccaactagtgttaggttatcttatcgattcagattcgtcatagcttcctgccaaatccgttgatctcagcttaatcagccgtccagctgggcactgacacttgtaagttctcctgtggatttttcgctctcctcacgactcacgacaatctggccatgcatgagttgagatgggattcacttccggctactttttttttacagtacgctgtgcctgttgctttaatgtagttctgagcggttctacctcgctccccagctgcaggacttgaggtctcacggtcactcaagtcgtctggtctgagtgagccatggcggaggccaaccgcaggacgacgccccggccccgcgcggtgccgccgctgctcgccgaggtggaggtctccaacctgcccggcttcgacgtcaccccaacgccgagcccgcacggccaggacgccaccacgccgagcccgcgcccgcccacgaagccgtcgtcccgccccggggtgggttccgttttgctctctactcctctgcccgcgcgtccggtcgcgtgtcacggccaacgtggactcatcctgttcttcttgcacgtatatgtatgtatatcccatatgcaggtgccgccgctggaccgcgtgccgtgccgcagcgaggtggtgttcccgccgctggactcgccgttccaggcgccgggctaccgctccgtgcagcccgtctccatcagcctcccggcgtcgcccatcggcttcggcttcggcgtgcccgtcatccccgcgccggccaacgccgccgccgccgactcggacgacgacggcctccggaggcaggccctccaggccaacgccgcggccggcgacccgcagcaggcgccggcgccgacgccgccgcccgcgcgggagaatggaggagggggcgtccggttcatgcaccagccggacaagctggtgttccgctcgcagcccattcccggcggccagccacagcgcgccggcagccgagccgcccgggcctgcagggccatcagccgggacaggcgctatgacacgttcaagaccttctccgggaagctcgagcgccagctcacccacctggccggcgccccggaggtccaagaggtgcgaggagatgacgccgtcgacgccgccacctcccgcaccacgtccatgcccaaagtcgatcgcttcttcgccgcactggaaggccccgaactcgacaagctcaaggtatagtagatcgctttacagtagctagtgcttaagtttgaccgattataattataaatcatctctcctgccttgtgttcagacgtctgaggaactggtgctgccgtcggacaagacgtggccgttcctgctccggttccccgtgtcggcgttcggtatctgcctgggcgtgagcagccaggcgatcctgtggaagacgatcgcgtcgtcgtcgccgaccacgttcctgcacgtatcccacaaggtgaacctggtgctctggtgcatctccgtgctgctcatgtgcgccatcacggccgtctacgcgctcaagctcgccttcttcttcgaggccgtgcggcgcgagtactaccaccccatccgggtcaacttcttcttcgcgccgtggatcgcctgcctcttcctcgccatcggcgtgccgccgtccgtggccactgagcccctgccgcagtggctctggtacgcgctcatggcgcccgtgctcttcatggagctcaagatctacggccagtggatgtccggcggccagaggcgcctgtccaaggtggccaacccgtccaaccacctgtccgtggtgggcaacttcgtgggcgcgctgctgggcgccaacatggggctcagggagggccccgtcttcttcttctccgtggggctggcgcactacagcgtgctgttcgtcacgttgtaccagcggctccccaccaacgagacgctgcctaaggagctccacccggtgttcttcctcttcgtggcggcgcccagcgttgcgagcatggcgtgggccaagatcacgggcgagttcggctacgggcccagggtggcctacttcatcgccatgttcctgtacgcgtcgctggcggtgcggatcaacttcttccgggggttccgcttctcgctggcgtggtgggcgtacacgttcccgatgaccggcgccgccatcgcctccatccgctactccaccgaggtggacaacaccttcaccaaggcgctctgcgtggcgctgtccgtgatcgccgtgctcacggtgacggcgctgttcgtcaccacgctggtgcacgcgttcgtgctccggaagctcttccccaacgacatctgcatcgccatcacggaccacaagatgaagcccatcatggagctgcacgagagccatggcgaggacagcagcaccaacagcaacgacatcgaggccggcgccggtggcaaacagtgagggacgcgacgcctagctaggaagcatgcataagcaatgcacgcgcgcgcacacacccaagtcgccgagcttcacgcacgccaagcgtggggggatgacgcgaccgagttcttgcttggattggattggatctttctataggattgcctacttggttcgatggcgcacgctgaggacctttgatggattgcatctattagttactctatctactactagtcagtagagaactacttgaatgtacagagtgggctacgttgtatgaaacgcggctgcttatttatcgtggaaaacattatgcatgcagagtggctttaaaacttaagcatctcatcagttcctccagccgccagttggaagatgccgtatttgggatactggggaaaacggctcttaactgcgcactggcctctgctacagcctactatcaacaggtaacgcgttgctgcggcagatagaaaccgacgatggtggcggcgacacagaccacaccagggttggatctagcctaattgcatcgcctctttatttgagttagtatttcacatttgctaagaaaaagaaagattaatcactacatcatgatactgttttagtgatcctcattaaacaccaactagcaaattgaccgtacactgctacggatttatacttgaacatagaatataaaacattat

SEQ ID NO: 1055 - DNA, 1357 bp, Zea mays
  misc_feature (1349)..(1353): n is a, c, g, or t
  misc_feature (1355)..(1355): n is a, c, g, or t
tcacctccactccaaacaaacaagggacggtgagcgaggaaccccaccccacgtcgccctccccccacctttctctctagtctctagtttctagtctctacccccaggccccagccccccattcctgcctcttctctctctcgcccacccgccccggccccaatgtcgccgcccctcgagccccacgactacatcggcctctccgccgccgccgcggcgccgccgaccccgacctcctcctcgtcgtcctcgtcctcgccggcgccccgcctcaccctccgcctcggcctgccgggctccgagtcccccgaccgcgaccgcgaccgctgcgaggacgtcgccgccgcgctctccctcggcccgctgcctgctacccccaaggcgcccgctgccgtctccgccaagcgcgccttcccggaccccgcccagcgccccggcgctgccaaggctagcgacgacaggcaggcctcccccgccgcgccgccggccgccaaggcgcaggtggtgggatggccgcccgtgcggaactaccggaagaacaccctcgccgcgagcgcctccaggagcaaggcgccggcgccggcggcggaggacgccgcgtctgcggcccggcccatgtacgtgaaggtgagcatggatggcgcgccctacctcaggaaggtggacatcaagatgtactccagctacgaggacctctccgtggcgctcgagaagatgttcagctgcttcatcgctggtcaaagtgtcctgcataaatcatcgagcaaagacaggctaactaatggctcgaaggtggatgccctcaaagatcaggagtatgtacttacatatgaggataaggatgcagactggatgcttgtcggtgatcttccctgggattattttacctctatctgtcggaagctcaaaatcatgaggggctctgatgctgttggaatagctccaagaaccatagagcagacaggtcagaacaaataagcttggtctttgcctgcacccacgcaagaaatctgagctagctgggaggccatgttgaaggctgaaatagttgctcggaattatcaaaagtcgtcaaatgttagtgtagtttccacgtgttcttgagacgtgtgtatttgtatgtctgtgatgtgatccgtcagatctgttcttgtgcccttcaaaggccaaatcagggagctctctgcttcctgtgtatgcttgcttttccagtattccctgttattctactatgaaatcatccatcgtgccacaaagaactgatggttcctgatgtcaagaaagctgtccgacttgtcttcaatttacgggggaaaaaaaaaaaaaaaaaaaaaaaaaaaaaaaaaaannnnnangg

SEQ ID NO: 1056 - DNA, 1341 bp, Zea mays
gctcccaccccacctcaccatctccactccaaacaaggggaaggcgagcgacagacaaacccaccccatcgcccctcctctgtctcctctcttgcccacgcccgccccaatgtcgccgcccctcgagccccacgactacatcggcctctccgccgcggccgcggccgcgccgccgaccccgacctcctcctcctcttcctcctcctcgccggccccccgcctcacccttcgcctcggcctgccgggctccgagtcccccgaccgcgaccgggactgctgcgaggacttcgccgccacgctctccctcggcccgctgccggcggcagccgccgtctccgccaagcgcgccttcccggaccccgcccagcgccccggcgcttccaaggctagcgacgccaagcagcaggcttcccccgccgcgccgccggccgccaaagcgcaggtggttggatggccgcccgtgcgcaactaccggaagaataccctcgccgccgcgaccgcctccaggagcaaggcgccggcggaggaggccgcgtccggagctgggcccatgtacgtaaaggtgagcatggatggcgcgccctacctcaggaaggtggacatcaagatgtactccagctacgaggacctctccctggcgctcgagaagatgttcagctgcttcatcgctggtcaaagtggtctgcataaatcatcgagcaaagacaggctgaccaatggctcaaaggtggatgccctcaaagatcaggagtatgtccttacatatgaggataaggatgcagactggatgcttgtcggtgatcttccctgggattattttacctctatctgccggaagctcaaaatcatgaggggctctgatgctgttggaatagctccacgaaccgtcgagcagacaggtcagaacaaataagctttggcctttgcctgcatccaaggaagacatctgagctagctgggagactatgttgaaggctgaagcctgaaatagttgccgggaatcgtcaaaacccgtcaagtgtttagtgtagttttcacgtgtccttgagacatgtgcatttgtatgtctgtgacgtgatccgttagatcgtgcaatcgtaggttgctgttcttgtgccctttaaaggccagacagatcagggagctctctgcttccttagtgcacttgctttgcagcattccttgttattctactctgaaatcatacatcatgccacaagaaccgatggttcgtgatgtcaagagagctgccctaattgttccattgtaacctcgtaattgtgttcttccgcaggagaaattggttctgcacaaaacaccaataatcccggagtggagcaa

SEQ ID NO: 1057 - DNA, 1535 bp, Zea mays
accgcgtatcgactcctatgggcgattgggtcccccgaggccggccgggaggcaggcaggcagccaagaggcaagaggcaagaggtccctcagtcgctaggcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacgcgcatccggcgggccgaccgcatcccgctggcgcggccggcgcacgtgccgccggcgttccagcgcgcccggggcaagaagcgcgccgtcctggtcggcatcacgtacgccggcatgcgccaaggctgtggcgacctgaggggccccgtcaacgacgtcaagtgcatgaggaacctcctctgccagcgcttcggcttccccggcgaatgcatcatcatgctcactgacgaccagagggacccgttcaggctgcccacgaaggagaacatccggatggcgatgcactggctggtgcagggctgcagctacggcgactccctggtgttccacttctcgggcatcggcgcgcaggtggcggacgacgacggcgacgaggcggacgggtacgacgaggccatctgcccgctggacgcgttccagagcgggcccatcctggacgacgagatcaacgaggtcatcgtgcgcccgctggtgcacggcgccaggctgcacgccgtggtggacgcctgctacagcgccacggtcctggacctcccctacctgtgccgcatgtccaggaacgggttctggcagtgggaggacgagtgcccgccgtcgggcgcctggaagggcaccagcggaggccacgccgtgctcatcagcggatacagcgagggcaaaggcaacttcgccatgatgcccgacgcccacgcgtcggtcgtcggggccatgacgcacagcttcgtccggacgctggagtgccagccgcgcggggtcacctacggccacctgctcagctccatgagggccatcatgaagaaccgcggcgggggctgcgatctgcagggggccatcggcgcacccatccgcaccgtcgccaacttcagcggcgtgcaggagcctaacctgtcctcttcggagacgtttgacatttaccgcaagcagttcgtcctgtagacaccacgccacaccagtgtttgccccgccggccgcttgtaatgaattgccgtcgtagtatcagaataatcaattatctatcggccatgatatgatatgatatatcaagaaagaaggaactaatacctagagtacttcgttcatctgtattagcagtgaacctctcaatgaaataactaagcatgttcaatgtcctctttttattagagagagacagggagaaaaaaaaaaaaaaaagagacgtgtgcaattgtgcatgcagtttacgtgatcaataaagttacatggaaattattttatccacgtgcgatgcaagtggagccccctagggccaaaaaaaaaaaaaagcggcc

SEQ ID NO: 1058 - DNA, 1420 bp, Zea mays
cgcccgggtcgacgcaagacgctccgctggcaggcagaggcaagaggcccctcaccctcaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccgctggcgcggccggcgcacgtgccgccggcgttccagcgcgcccggggcaagaagcgcgccgtcctggtcggcatcacgtacgccggcgcgcgccggggctgcggcgacctgaggggccccgtcaacgacgtcaagtgcatgaggaacctcctctgccagcgcttcggcttccccggcgagtgcatcatcatgctcactgacgaccagagggacccgttcaggctgcccacgaaggagaacatccggatggcgatgcactggctggtgcagggctgcagctacggcgactccctggtgttccacttctcgggcatcggcgcgcaggtggcggacgacgacggcgacgaggcggacgggtacgacgaggccatctgcccgctggacgcgttccagagcgggcccatcctggacgacgagatcaacgaggtcatcgtgcgcccgctggtgcacggcgccaggctgcacgccgtggtggacgcctgctacagcgccacggtcctggacctcccctaccagtgccgcatgtccaggaacgggttctggcagtgggaggacgagagcccgccgtcgggcgcctggaagggcaccagcggaggccacgccgtgctcatcagcggatacagcgagggcaaaggcaacttcgccatgatgcccgacgcccacgcgtcggtcgtcggggccatgacgcacagcttcgtccggacgctggagtgccagccgcgcggggtcacctacggccacctgctcagctccatgagggccatcatgaagaaccgcggcgggggctgcgatctgcagggggccatcggcgcacccatccgcaccgtcgccaacttcagcggcgtgcaggagcctaacctgtcctcttcggagacgtttgacatttaccgcaagcagttcgtcctgtagacaccaccacaccagggtttgcccctgccggccggccgcttgtaatgaattgccgtcgtatcagaataagaaattatctatcgaccatgatatgatatgatatatcaggaaagaaggaactattacccctcaatgtaataactaagcatgttcaatgtcctctttttattagagagagagacagagagaaaacgcggaatttgagacgtgtgcatgcagtttacgtgatcaataaagttacatagaaattattttatccaaaaaaaaa

SEQ ID NO: 1059 - DNA, 1578 bp, Zea mays
ccacgcgtccgggcaggcagaggcaagaggcccctcaccctcaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccgctggcgcggccggcgcacgtgccgccggcgttccagcgcgcccggggcaagaagcgcgccgtcctggtcggcatcacgtacgccggcgcgcgccggggctgcggcgacctgagaggccccgtcaacgacgtcaagtgcatgaggaacctcctctgccagcgcttcggcttccccggcgagtgcatcatcatgctcactgacgaccagagggacccgttcaggctgcccacgaaggagaacatccggatggcgatgcactggctggtgcagggctgcagctacggcgactccctggtgttccacttctcgggcatcggcgcgcaggtggcggacgacgacggcgacgaggcggacgggtacgacgaggccatctgcccgctggacgcgttccagagcgggcccatcctggacgacgagatcaacgagaccatcgtgcgcccgctggtgcacggcgccaggctgcacgccgtggtggacgcctgctacagcgccacggtcctggacctcccctaccagtgccgcatgtccaggaacgggttctggcagtgggaggacgagagcccgccgtcgggcgcctggaagggcaccagcggaggccacgccgtgctcatcagcggatacagcgagggcaaaggcaacttcgccatggtcagggacatgatacatacatacatactgctgatcgagctctgctgccttgcatctatctatatacctaacatgcatatgctgctgcttggacgacgcgcggcgtgcagatgcccgacgccccacgcgtcggtcgtcggggccatgacgcacagcttcgtccggacgctggagtgccagccgcgcggggtcacctacgggccacctgctcagctccatgagggccatcatgaagaaccgcggcgggggctgcgatctgcagggggccatcggcgcacccatccgcaccgtcgccaacttcagcggcgtgcaggagcctaacctgtcctcttcggagacgtttgacatttaccgcaagcagttcgtcctgtagacaccaccacaccagggtttgcccctgccggccggccgcttgtaatgaattgccgtcgtatcagaataagaaattatctatcgaccatgatatgatatgatatatcaggaaagaaggaactattacccctcaatgtaataactaagcatgttcaatgtcctctttttattagagagagagacagagagaaaacgcggaatttgagacgtgtgcatgcagtttacgtgatcaataaagttacatagaaattattttaaaaaaaaaaaaaaaaaaggggtccggtatagaagattcaagcttatgtatgcgacatgatagctttctatagtgc

SEQ ID NO: 1060 - DNA, 1064 bp, Zea mays
aaaatagaaaaggtggaaatttaggaagcaaacaaaagctccgctgccttgtctgcaatggcgtctggcgcttttcccacgagcgccccctgcccttctcgctctcctccataggcagacgccgcgctcccccaacgccgctccgccgaccccagtcatatctcccgcccccagctgaggcaatggggtcctcgtcctcgccgtcgccgccgccgccgcccatgatcgggcgggccgggaacctcaccgtcttcatcacgccgccgtctcctgctagcacgccgcggggcgctttgcgcacgccgccgcccgagtctccgcgctcggatttctctacacccacccgacagaggatagccccgtcgccctccccttctccctcgccgcagaaacacgagagcccgttcgcggcgcctgcggtggtgttcaccccgcccccgccgtcggctcctgtgaaggtcgcgccgccgccggtgcaggtgccgccgccgcagtacgagaaggcgtccgcgggaggcaagcacgacggatcggcgtttggcttcttctgggacgccgtcgcgcgcgtccaggaagcgcacgccagcctcgacgagtacatggctacctggttcgggttggatcagtccaagtaccagtgggcgctcaacgactactacgaggccacaggcaaggacgtggattgtgtaaagggtagtaagctgaaggagcttactactaaagtgcagaaagtctgaaaaaaaagcaactttgttttgtgttgaagaggtgtagcttgtagcgtatgtctggagaagcatgttccattagttacattttggtgggggccttcttgaaaagtggccatctctgcttcgccaggcagttggacaactggaggccgcggttgaatcaaaggagcggccgttgtttcgttccggtgtttaggatctgctgtaatcctaaggttatgtcaaaacacagaatgggtcttatttgcaatggttctaatctggatgctgtccgttgcttaacaaaaaaaaaaaaaaaaaaaaaagtctccaattcgccctatagtgagtcgt

SEQ ID NO: 1061 - DNA, 3005 bp, Zea mays
tctagtattttttaaatttgttatatttgttgaatgatgtttagcgtatattatagatgtctaatctttatagatacggatgattcctagtatgatccatacttatataggtattagagtatatttatatccacgattgtcttgacggaattatttttttatcttatgtacctatcgccgacgccctcgaagtcgcggtgcacgtaccatccggaccaacgccaaaagtcgcgttattaacttgagggcaaaataaaaaggaagaaatttaggaagcaaacaaaagctctactgccttgtatggaattgcaatggcgtctggggcatttcccacgagcgccccccctgccctgcccatttcgctctcctccctaggcaactaaacgccgcgctcccgcagacggtaccagccgccgcgatggggtcctcgtcctcgccaccgccaccaccgccgctgccactgcccatgattgggcgggccgggaacctcaccatcttcatcacgccgccatcccccgctagcacgccccggggcgctgggcgcacgccgccgctcgagtccccgcgctcggatatctccacacccatcccgcagagggcagccccgtcgccctccctttctccctctccgcggaaccacgagagccgggccgtggcgcctgcggtggtgttcaccccgcccccgccgcctgcttctgtgaatgtcgcgctgccgccggtgcaggtgccgccgccgcagtacgagaaggcgtccgcggggggcaagcatgacgtatcggcgttcggcttcttctgggacgccgtcgcgcgcgtccaggaagcgcacgcgagcctcccagcgagtttgttatatttttgcccagagatttggagttctcatgcttggattctctcgttgttctcgtcgcagcgcacgcgagcctcgacgagtacgtgtctacctggttcgggttggatcagtccaagtaccagtgggcgcttaacgactactacgagaccataggcaaggtcagcaaggtcagtgatcttcgaattcgctcatcgtcaacttggctgaatgaccgtgtaattagggagaatcgcgttcgatccgtgtcgtttcgtctccgctgtcggtactctaatctggatctgtatctgggatgagatacttttttgcgatgatgcctgaaggtgcacggagcattttatctttgtgaggtggtggacggccgttctattagatgacctcgtgaactctacgtgttggtgctaggtttgaagctgtccctacaaccttttgtggtcatgaaaatgctgataagtgtcttctcggtatgtgatagatgctaagagtggcttgtgtgtgttacctgctcccaaaaagtattggggaatatattcaaagggtgtctaagtggtgatggtgccgtctgttaagctcaagtcaatccccatctcgcaatatctgtaaagtttgaaccaaagacagccctcaaacacaagacaagaatagatgcctaatcacccttattttagcaactgcaaggatgatgggacattgtgttgggattgggatagagaatatgcattaggactgccatattgtctggagtagcactttgaggctttcaaaatgttgcgggattagtaaaaaaaatttgtccccctggttttatcgttgggtgtactggctgtttttggtaattttcatctcaacacacagaagtgcattataccatggactcttaacaattccaatcatcaatacggtgggtacaaactataatgctaacaagagtgccgttggtgtttcaaagaacataagcagcaatatgtcaaagtaaactgtgatgcagaaatatgtaatttgagacttaatactggccaaaagctccaagtcttcaatgaaggaatttgagacttggatgcagaaatatgtaaactgagtaggttactcccaaattggaataaacatttgctacaattgatgcgtcttgcagaaattattgtggtccagaaagatataaactggaatagttatgtggtacaattttcagtagacatttttctttcagcagataagtgttgtgaaatgcatatgttgtgttggatttgtggctgagtctggaattatgatataaatgataggttaggggtaacaccaattgaaaaaaaagcttgtctaatatcgagtgagatggtttggacatgtccaatggagaccttcagagacgctagtgcgtaatgggatcctaagacgtgatagcaatgaaaagagaagaagaggtagagcgaagttgacaatggaggtggcagtaaaatgagacttaaaaggatgtgatataccaaagatttaaccttgaataggagtgcatggcatactttttaagacggtaaggcgaccaatcccattttaccttttaattggtaaagcgtaaggcgaggcgacaccttaaatattttttaaaatagaaaatattgatatttgaccaagcgtttaggacaaaaatataaataaagaaaagacacggcgtgggtgacaccttacccggcgtggccatcttcccctctctggcgcgggtggcacgagcactcttcctctcaccttaggtgtcggagtaaggcgagggcgacgccttacctcgctggtctgccttacagcctaggcgacggcttaaaaactatggtgcgtcgaaaacagctatccatatgcccgaaccttaacttgtgagttttattggttttttaactctagtttacttcaacttgcttgggataaaaggatttgttgttgttgctgatcttgtactaagttgagatgaatttgcaaactggaactttgtgctagtgaattcacttaatttacctgaatgttctagttctgtaaactgagtctataacagtgattgaaccagttataaactgggatacaacatgactctattttaacatatatatatataatataaatatataatatatatatatatatatatatatatatatatatatatatatatata

SEQ ID NO: 1062 - DNA, 1160 bp, Zea mays
gggcttttcctttttatctagtataatccgtccgcaaccgttctctgccttctccatcctaaaccctcctagtcctctccatccccatcccctccaatggcggcgactgccacgtccttcgccactctcgccgtcgcgcgctcggcagggcagcggttcctccttgcctccaaggccgccccctcgccgctcctctccctccgcggcgcccgcctcccctcgcagggcgtctccttatctgggggcctcgcggcgtcgccctctcatagccgcgcgcgcttcgccacatcagccagcgccgaacccaaggaagcagaacttcagtctaaaatcacaaacaaggtgtactttgacataagcattgggaaccctgtgggcaagaatgttgggaggatcgtcatcggcttgtacggggatgatgttccacagacaacagagaacttccgtgctctttgcactggagagaaagggtttggatacaagggatccagtttccatcgtgtcatcagcgactttatgattcagggtggagattttgacaagggcaatggtaccggtgggaagagcatatatggacgcaccttcaaagatgagaacttcaaattggttcacactggacctggagtggtcagcatggctaatgctgggccgaacaccaatggcagccagttctttatttgcactgtcaagacaccttggttggacggaaggcatgtcgtgtttggccaggtcctggaagggatggatgtcgtaagtctgatcgagtcgcaggagaccgacagaggtgaccgcccgaagaagaaagtagtcatcagcgagtgtggggagcttccagtggtctaagtgttactcatctgttgtcggtcttacctaacctcggatggatggcgatatttcccccacctgaacttgtcgtgctaccctccccccccccccccccccacccccaccctgctagttatagagaatatttcgaattgaagtaaggtcccaaatctgagggcatactgttgcttctctgctggaataaatgtgctccttgttcatggaacaaaaatattctgttgcattgcatatgcaagagctgttgatcgttctaaccttgtacttatggttcatacttggaatgaaggttcatggaacaaaaatattctgctgcg

SEQ ID NO: 1063 - DNA, 1033 bp, Zea mays
atctgcccgtccggcggcccgcgaccgcaccccattctccagcaacgagacaacaaatctcctcctcttcctctccgtatccgcatcagtccatcaccttcaatggcggcggcggcggctgctgccacctccttcaccaccctcgccgtcgcgcgttcggcggggcagcggtcccttcttgcctccaaggccgcaccttcgccgctcctctccctccgtggcgcccgcatcccctcgcaggccgtctccttctccgggggccttgcggcgtcgccctctcacagccgcgcgcgcttcgctacatccgccagcgccgagcccaaggaagcagatcttcagtctaaaatcaccaataaggtgtattttgacataagcattgggaaccctgtggggaagaatgttgggaggattgtcatcggcttgtatggggatgatgttccacaaacagcagagaactttcgtgctctttgcactggagagaaagggtttggatacaagggatccagtttccaccgtgtcatcagcgactttatgatccagggcggagattttgacaagggcaatggtaccggtgggaaaagcatatatggacgcactttcaaagatgagaacttcaaattggttcacactggacctggagtggtcagcatggctaatgctggaccgaacaccaacggcagccagtttttcatttgcactgtcaagacgccttggttggatggaaggcatgtcgtgtttggccaggtcgtggaagggatggatattgtaaggctgatcgagtcacaggagactgacagaggtgaccgtccgaagaagaaagtagtcatcagcgagtgcggggagcttccagtggtctaagcgttactcatctgttgtccgtttcacttctgacggatgacgatatccccccccccccccccccctatcccatgtgctaattatagagaatatttcgaattcaagtaaggtcccaaatctgaggcatactgttgctgccctgctggaataaatgtgctactttcccctgccttgt

SEQ ID NO: 1064 - DNA, 1724 bp, Zea mays
  misc_feature (211)..(211): n is a, c, g, or t
  misc_feature (452)..(452): n is a, c, g, or t
  misc_feature (752)..(752): n is a, c, g, or t
  misc_feature (762)..(762): n is a, c, g, or t
  misc_feature (1072)..(1072): n is a, c, g, or t
  misc_feature (1082)..(1082): n is a, c, g, or t
  misc_feature (1101)..(1102): n is a, c, g, or t
  misc_feature (1110)..(1111): n is a, c, g, or t
  misc_feature (1122)..(1122): n is a, c, g, or t
  misc_feature (1147)..(1148): n is a, c, g, or t
  misc_feature (1152)..(1153): n is a, c, g, or t
  misc_feature (1251)..(1251): n is a, c, g, or t
  misc_feature (1448)..(1448): n is a, c, g, or t
  misc_feature (1646)..(1646): n is a, c, g, or t
acattctcttgtctcttgcacatcccccgcttccttcttggtcgtttctccccttctgatccgtgctagccagcttgcgttgtggctgcttgtcgccagatctacctatccaccgtaccacagtcgtccacagcgcgcgcttacgatggcggtcgccgccgctcgccttcttcttcgcgtcgtcgtcctcgcgctcctcgcagccgcgcanagggtcgtcgggaagagcgccgtgctgtctctgcgggagttggatggacgacgacggagtgccgcgacgacggatacccggagcagccgctactacgtcgacgcaatgcttgctgaaacgctaggggagcacaagaaagctggggcagcaacaagcgtgctagagctcaagcgccactccctcactgccatccctgaagaccccgtcgcccgcgaccgctacctccgccgtctcctcgcanccgacgagtcgcgcgccaactcattccagccccgccgtaacaaggacagggcatcagcgtccacgcagtccgcctcggcagaggtcccgctgacctcgggcatccggctccagacgctcaactacgtcaccaccatctctctcggcggcagctccggctcgcccgccgcgaacctcaccgtcatcgtggacacggggagcgacctcacctgggtgcagtgcaagccgtgcagcgcgtgctacgcgcagcgcgacccgctcttcgacccagcgggctccgccacctacgctgcggtccggngcaacgcctncgcgtgcgcggactccctcagggccgccaccggcacgccgggatcctgtggttcgacgggggcaggcaacgagaagtgctactacgcgctagcctacggcgacgggtcgttcagccgcggcgtgctggccacggacacggtcgcgctcggcggcgccagcctgggcgggttcgtgttcgggtgcgggctcagcaaccgcggcctgttcggcggcacggcggggctcatggggctcggccgcaccgagctctcgctggtgtcccagaccgcgtcccggttacggcggcgtgttctcctactgccatgccgncggccacctncggcgacgcctcaggctcnntctccctnngcggcggggangacgcggcgtcatcctaccgcaacnngacnnccgtggcgtacacccgcatgatcgccgacccggcgcagccgcccttctacttcctcaacgtcaccggcgcggccgtcggcggcaccgccctcgcggcngcaggggctgggcgcccgcaacgtgctcatcgactccggcacggtgatcacgcgcctggcccccgtccgtgtaccgcgctgtgcgcgccgagttcacgcgccagttcggcgccgcgggctacccggccgccccggggttctcgatcctggacacgtgctacgacctgacggggcacgacgaggtgaaggtgccgctntgacgctgcggctggagggcggggcggacgtgaccgtggacgcggctgggatgctgttcgtcgtgaggaaggacggctcgcaggtgtgcctggccatggcgagtctgtcgtacgaggacgagacgcctatcattggcaactaccagcagaagaacaagagggtggtgtatgacacgctggggtccaggctaggcttcnctgacgaggactgcaactatgtatagagacttgacagggaggaggatgtggaatatcggatttctagttatatgttgc

SEQ ID NO: 1065 - DNA, 3481 bp, Zea mays
gccggcgtcctctcaagtctcaactcccaaggctcggcgacgtcactcgatcggcgtcaacagcaggcaccacggccacgcccacgcagacgcagggcagtaacagaagtacaccatagctatgaatggtccactaccatccgctgtcttcgtcccggtcatgcatgcatgttccgcgtcacggagcaggtgcggacgggacgggcgcccctggggcatcgcccacgctgcgctaccgtcctcgccgcaagcaaacaaggagccaccacctccccggtcgccccctgtgcgtgcccgtgatcgcagatagtccgccgcgccacagcggttacagtgctctcgtggcccctcgtgcatccatccatgctcgtacaggcagcgagtagctactggcaggcagcagcggctcctcgtccgtctatatatccgtgtctctctcacgcgcaccactcacattctcttgtctcttgcacatcccccgcttccttcttggtcgtttctccccttctgatccgtgctagccagcttgcgttgtggctgcttgtcgccagatctacctatccaccgtaccacagtcgtccacagcgcgcgcttacgatggcggtcgccgccgctcgccttcttcttcgcgtcgtcgtcctcgcgctcctcgcagccgcgcagcaggtcgtcgggaagagcgccgtgctgtctctgcgggagttggatggacgacgacggagtgccgcgacgacggatacccggagcagccgctactacgtcgacgcaatgcttgctgaaacgctaggtactgtgcagttcatgacgtacgtacgtgctggtgctaggtttcctcagctccgatccgtgtgacagaaacttttgcatgcatttggaattcgcaatcgatgtgttcatgtttcacaggcacagtatattgcccacgatagtgaagctcacatgcagttgttgtcatatgcatgctcacttccccatgtctgccatcttcttcaggggagcacaagaaagctggggcagcaccaagcgtgctagagctcaagcgccactccctcactgccatccctgaagaccccgtcgcccgcgaccgctacctccgccgtctcctcgcagccgacgagtcgcgcgccaactcattccagccccgccgtaacaaggacagggcatcagcgtccacgcagtccgcctcggcagaggtcccgctgacctcgggcatccggctccagacgctcaactacgtcaccaccatctctctcggcggcagctccggctcgcccgccgcgaacctcaccgtcatcgtggacacggggagcgacctcacctgggtgcagtgcaagccctgcagcgcgtgctacgcgcagcgcgacccgctcttcgacccagcgggctccgccacctacgctgcggtccggtgcaacgcctccgcgtgcgcggactccctcagggccgccaccggcacgccgggatcctgtggttcgacgggggcaggcaacgagaagtgctactacgcgctagcctacggcgacgggtcgttcagccgcggcgtgctggccacggacacggtcgcgctcggcggcgccagcctgggcgggttcgtgttcgggtgcgggctcagcaaccgcggcctgttcggcggcacggcggggctcatggggctcggccgcaccgagctctcgctggtgtcccagaccacgtccaggtacggcggcgtgttctcctactgcctgccggcggccacctccggcgacgcctcaggctcgctctccctcggcggcggggacgacgcggcgtcgtcctaccgcaacacgacgcccgtggcgtacacccgcatgatcgccgacccggcgcagccgcccttctacttcctcaacgtcacgggcgcggccgtcggtggcaccgccctcgcggcgcaggggctgggcgccagcaacgtgctcatcgactccggcacggtgatcacgcgcctggcgccgtccgtgtaccgcgccgtgcgcgccgagttcatgcgccagttcggcgccgcgggctacccggccgccccggggttctcgatcctggacacgtgctacgacctgacggggcacgacgaggtgaaggtgccgctgctgaccctgcggctggagggcggggcggacgtcaccgtggacgcggctgggatgctgttcgtcgtgaggaaggacggctcgcaggtgtgcctggccatggcgagtctgtcgtacgaggacgagacgcctatcattggcaactaccagcagaagaacaagagggtggtgtatgacacgctggggtccaggctaggcttcgctgacgaggactgcaactatgtatagagacttgacagggaagaggatgtggaatatcggatttctagttatatgttgcatgaactatgcccgcctaactactgaatgtagtttgatgatcaaatcccatagttttaatatgactaaaatctttacaatttgatggctccagttagaataggccataatgtagagtagaatatcatgacagctttcttaatataccgaaaaagagcaatagatatagaatgcagaggaagaattatgtattagatgtcacactattttgtgttcacacccactaccggactcgtctttttttgccgagacactcggcaaataccattttacactcggcaaaaaatactcgacaagcattttatcagcaaagagttctttgccgagtaattttttcggacactcggcaaagaaaaaagcacttggtaaattaacaatcgcaaaaaaaacccaaaaaaagcaaaatatttttaaaattatagtaacaactatccaaccactacccatcgccctatcacttttcaccgttattttgaatcaaatttacatgttttgtcaaaagtcaaattttcttttcaatatctttcttttttcagaattctatttttgttcttccacccatgcaatatagagcgaatgagaaaagaggggtttcccttaaaataggctttgaaatagaaatctgctgaatttaaatgtttatttatttatttcttttctatagtataagaaaaatgaattaacagggcgtttggatcccttcattttataggaattagaattcacttaatgaagttacctatttagcttggaatttgatattccatcactttccaaagttctaatataagcttatctcaaattcatggtgtggtggatgggaaatgattttatgtattaatagtatttgtttctattgtataacttataagacactttttaactcactcctctatagtaaaaatataacacataaatatctccgacatcttgctaataataatatactaatatattttgcataaaaccgaattagctcaattgatatatgcctaaattactattattaggatggaattcatttccaattgttgggggccttcgtctttcgaaggtcatcaaaacatgatttaacaatgtttcccgagtggtaatatagaaca

SEQ ID NO: 1066 - DNA, 1799 bp, Zea mays
  misc_feature (1141)..(1141): n is a, c, g, or t
  misc_feature (1382)..(1382): n is a, c, g, or t
  misc_feature (1504)..(1504): n is a, c, g, or t
attgggtacctcgaggccggccggttgggtaccttggggccggccggacattctcttgtctcttgcacatcccccgcttccttcttggttgtttctccccttctgatccgtgctagccagcttgcgttgttgtggctgcttgtcgccagatctacctatccaccgtaccacagtcgtccacagcgcgcgctaacgatggcggtcgccgccgccgctcgccttcttcttcttcgcctcgtcgtcctcgcgctcctcgcagccgcgcagcaggtcgtcgggaagagcgccgtgctgtctctgcgggagttggatggacgacgacggagtgccgcgacgacggatacccggagcagccgctactacgtcgacgcaatgcttgctgaaacgctaggggagcacaagaaagctggggcagcaacaagcgtgctagagctcaagcgccactccctcactgccatccctgaagaccccgtcgcccgcgaccgctacctccgccgtctcctcgcagccgacgagtcgcgcgccaactcattccagccccgccgtaacaaggacagggcatcagcgtccacgcagtccgcctcggcagaggtcccgctgacctcgggcatccggctccagacgctcaactacgtcaccaccatctctctcggcggcagctccggctcgcccgccgcgaacctcaccgtcatcgtggacacggggagcgacctcacctgggtgcagtgcaagccctgcagcgcgtgctacgcgcagcgcgacccgctcttccgacccagcgggctccgccacctacgcctgcggtccggtgcaacgcctccgcgtgcgcggactccctcagggcccaccaccggcacgccgggatcctgtggttcgacgggggcaggcaacgagaagtgctactacgcgctagcctacggcgacgggtcgttcagccgcggcgtgctggccacggacacggtcgcgctcggcggcgccagcctgggcgggttcgtgttcgggtgcgggctcagcaaccgcggcctgttcggcggcacggcggggctcatggggctcggccgcaccgagctctcgctggtgtcccagaccgcgtcccggttacggcggcgtgttctcctactgccatgccggcggccacctncggcgacgcctcaggctcgctctccctcggcggcggggacgacgcggcgtcatcctaccgcaacacgacgcccgtggcgtacacccgcatgatcgccgacccggcgcagccgcccttctacttcctcaacgtcaccggcgcggccgtcggcggcaccgccctcgcggcgcaggggctgggcgcccgcaacgtgctcatcgactccggcacggtgatcacgcgcctggcgccgtccgtgtanccgctgtgcgcgccgagttcacgcgccagttcggcgccgcgggctacccggccgccccggggttctcgatcctggacacgtgctacgacctgacggggcacgacgaggtgaaggtgccgctntgacgctgcggctggagggcggggcggacgtgaccgtggacgcggctgggatgctgttcgtcgtgaggaaggacggctcgcaggtgtgcctggccatggcgagtctgtcgtacgaggacgagacgcctatcattggcaactaccagcagaagaacaagagggtggtgtatgacacgctggggtccaggctaggcttcgctgacgaggactgcaactatgtatagagacttgacagggaggaggatgtggaatatcggatttctagttatatgttgcatgaaaaaaaaaaaaaaaa

SEQ ID NO: 1067 - DNA, 7975 bp, Zea mays
  misc_feature (2443)..(2443): n is a, c, g, or t
  misc_feature (3013)..(3013): n is a, c, g, or t
  misc_feature (5969)..(5969): n is a, c, g, or t
  misc_feature (6054)..(6054): n is a, c, g, or t
atctctttctcttgcacgagaccattacctagaacatcctaatcgaaaagagagttatccaaatactctggtatggcgagatccccctcctcgggttcccactcaactgctgtatcgtagtagtcgactacttccctgcaatccgttggtcagctcacaatagcagatgagtccattggaggagttcgactagtctccaccgctgctgcgagattccgccagattataaaacttctgcccgagcaaagcggccgaccaagttaccacagagcaagtcagcgaggcgaaataggcgaccaagtcccaacaaccgagtaagaaagggagacgaaactgccgaccaagtctctaggcccacaaggttccgcgcataccctgacggcgtgccatgtaccgggtgaagagccagggcgagggcgagatgatgtcgcaggaccagatgcactcgccggtggacaacgatgtcagcagcagccgcaggtcgcctcacaggggcgtcggggcgcccctgaagaaagggccctggacggacgcggaggacgccatcctgatggactacgttaagaagcacggcgtgggcaactggaacgcggtgcggaagaacaccgagctattccgctgcggcaagagctgccgcctcaggtgggcgaaccacctcaggcccaacctcaagaaggaggccttcaccccggaggaggagcgcctcatcatccagctccacgccaagctggggaacaagtggtcgaggatggctattcatttgccagggcgtactgacaacgaaataaaaaactactggaacacacgaaaaaagagatgtgaacgagctagccttcctatctatcctgctggtgtacgtaatcaatcttcaaatgaagaccagcaattgtctggcgatttgaacggtggcgagaacatgtccaatgatcttctatccggaaacagcctttgtctaccagattttaacaatgacagtttccttgcgaaactgcaggctttaccaccacagctgccagctgtttcaataagcaatttgctcggccaaagctttgcatcaaaaggttgtagcttcatggatcaggtagaccaagcagggatgctgaaacaatctggcagtgcgcttcctacattgagcgatgccattgacgatgtgatttcctcggttgatcaattttcaaatgactctgagaagctcatgcagactttaggttttggttatctcaatgaagccaacgctaccagcaagagtattgtgcctttcggggttgcacttactggcagccatgcccctttaaatggtattttctctgcttctaggctcacaaatggtccttcgaagatggagcccccttcagtccaaaatagcaggctcaagtatactgtggatcctgcaatgcagcctactgagttagtagatccttacatgcagtctctatcagcgaccccttcagtgaaatcagagtgtgcatcgccgagaaacagtggtcttttcgaagagctgcttcatgaacctcatgcactaagatctgggaagagccaacaaccatcggtccgaagttcaagttcttctgctggcacaccttatgggactatggttagctcagaatttgatatgggtcaggaatattgggaagaacagcccggttctctcctcagcgaatatgctcacttcagcgggaattatttggctgaatgcgctcctcctgttagcgctgcatcaactgatatctttccgctccccaagatttctcctgcagaaagcccttcaatgggctctggcgagcaggcgttagagcctaaacatgagtcagcagcttcacgtcatcttggaaacttgaggcatgatgcattattctctgggaacacagcccattcatccagtttcaacgataccataacaatgctcatcggcgatgtacctgttcttggtgatggaattgtgctcgattcttcctcatgggacaacatgccacatgcttttcaaattgcggaattcaaatgagttccatataatttctttgtgatgctgaagggcttcttcctgcttgttttggggtcaatatcagggaacgccccactgattgtgacgctgcattcctgacagagatccttgtgatcttcatgcggatagtccttttgtctaattaagtgcatggaagataacctggatattatttttaattttttgctttgtattagagaaccgtttttgtcatccctgacagcatttctgttggaaacgtgtcatgacttttgtttgaacaatttaaatgtcggttatagataatgtgatgtgtgccatcaaaaaaaaaaaaaaaatgtggtagcaaattgttgaagtatacgctgtcattgctgctgtgctggcacatcgtttgtgcagtacgatggtttttgagatgttcattgaactgcaatatggcgttgagaaattatatgcctntatcatgtataggctccaaaccctcggtggttggttcctcctcggcagtagttgtactgtaggctgtctgttgagcagttgaaatgtcttagtttgatactcccctgtggcttcttgatgctgtaatagactttcagatctagctttctggaatcttttctgtgatctttggccaggtgttgtgcgagatctaagatatgtagtgtctgtttggaaacatagtattttattagttcccagaccatggtatttaagtatatcgtggtattttactaaaaaacgtttgggaacatacaaaccctatgttttaaaccatggttttgtcaatacaacagtatttttgggtaaaaaaaaactttggtctaaattaaaggtttttttttttgcatacagctacggtcttctcttgttttatattacaactaaaatactttgccttcaacaaacaggtattggatttgactggtgtaaaatatactatagttatgttatgtcatataataaactgtggttttgaaaaacaaagttcgcaagcaggaccgtaatctgtaaagtgtcgtgacaatcttntttcctattttctaataaaataggggatacctcttcctgttaaaaaaaaatcatgtttagactcccgattgagtgaaagcgacaatcttgcgccaccagttctagctttccttgccttttgcaaatctgatagctttagttggtggctgaaagaaaaaaaaaagcaaggataagatgtcaagtgattaaggttgcaacgttgtggcttcagagtcggagcctaaaagacgttgtatcatctacgactacgacactaaaaagtctcgacactgcacggtcgcaaactgcgtgtacctaatttctctggtatcggttatttcgttggtatcaacttattttatttgttcgtcctgtatcctttttattacgtttttcgttcattgagcctccaaggtgcaagccatgtctacaaggtttctttcaccttttggattccattttgaatctaggactctcggtagttgtcaatactacgaccctagcggaatttagaattgtcctccctccatccaaaaaatagtattacctccgtttttaaatatatagcatcgttgattttttttaaaaaaaaatttaaccactcgtctaaagtccagcagttcaaagcatcattagcttaggctctaacccgagtagcattgggcacgtgagaatcgtgtgaatcagcaaggaccatcttgcaagactaaatactcgtgactgttgaagaacgagccggaagactcatatgcagtagtggcttggttcggtttcaattcgtgctctcgggcgtagttttgttcgtacaatgatagtgtctggtccggtttcaattccaaacagcctatctgttttcagcatccgccgttatgaagatctcagcccaatccatatatagatggtccaggatcggggtgggcttcggcccatggagaagcagagaagatgaatgtgagagagaaaaaaaaatctacgaacatctgggaaagagagacaacatggaaaaaggaaaatcccctatctgcctaacctcgctacagtatcctttactgtacaccacaaacatcctaatcgaaaagttctagccagaggagaggaaaaaaaacctacagcggctccacatcagcagccagcagctgcagatcgagaatgcctttcgatcgagtcgctcacaagactatggtgtacttcccactccagctagttttgtatcgggttggacctgctcggcgtctgcttcttcaggttctcggacaccgcggcgccgccgggacccatggctgccggcttggccgctgcccggaccacctctggtcgcgccttctccgagtctgagctgacgcgtgctactacgacgaggctctgcaagagctttctcgactgcgtcctctccttggagaccacagcggcagaaggtgccaggaggaggcagtagtgcagaagcagcagggcggagaggaggctgagagcgcagacgctggtagtggtagctcctcccagtccccccatgccctggtaagctgtgggaaatgaggactgggagctccaatctgctcaggaaataagaactcccgttccatgtgagtacagtcagcgccgagagatccgtgcttcagccttcaggagctctcatgattgttgtgtttgatttggcatgtgtgagtgtggtccttcggcgattgtgggcagcacatgcggccacagattccatccactttttttctgtttctctccacgtattttttacattcgtttttgtcaataataaagaaaattgttttttctttctttctcgggagaagctttgtactttatagagcataagcatgagcatggattttgtgtcatggatttctactagtatttattgtcggtttagatgaacgtttggtgcaatcttttagtctccagttcgtttcaacttgcagtagcaattcattcaaacttttgctgctctttgtccgtggtccttggtagctactgccactaaagagtagctttacgagtgagtggctctagatccagatatcagcagcggggtcatgagaaaatcagccaccgaggaacaagtaaatatggctggatcggcgtaggccgggcgacccaaacggacaagagccggcggcgaaattcctgccacctcccgactcccgaataaaagtaggccgtctcccaagtcccaactcccaaccgcgcatttggcagcgcctgcctcctcgaggaatgtgccaaatacttgcggctggattcagtgtagattgattgtccatctggccatgctacgctgcgtcgcagctaagctaagtctatttacaatgatagtttcatgtatgtttaatagtgtgttatatcactattttaaatgacatgtcgtattatttatgataaatgagttttatgaggtaaaattggtttcatggagatgaaactatgtcaacccgtttctaaggttttagaaatcgtacgaaacatctattaaaagtgatatgtttcatcttcacatattttactgatttctattggttgtttagttgcagtatttaattgttatgttagtctataaaatagtgaagcgaaattttgtgttcaaagacattgtttcattctaagtttaatgacactcttgatgatgtgttagtgttggaaagagtgttataaaataaccattgtgattagctaaaaaaaaccgggcagccttcccaggcacgatcttttcaaacataaaaaagaaaggataaaaaaccttccaaaaggcaggcttccctgaaagttgctttggtcgctacagtacaggtggatggcgaggaccgtaggcaggtggtggcgtcgtgaagtagacgaatccgcagcaacccactcccgtgtgcctgcgttcttcagcagcctgtgactgaggccctgtttggattcggtactactaaagtttagttggactaaactttagtgactaaattttagtcactaaaatctaccgttnggttccggtgactaaaactttgcacacagctattattactggacataaagactgaattgcccctgttcaatgcccaaaatctcantacagtctagctgccatccgaacactgtttaacagcactgtttgaagcacagttttaaaaaaacattctggaaaaacagtctgaaacgagcacacaattcatataaaatgagtagtaatcctcatgcagtacaatactattttattacaaattcatataaaattcaatctctaaactgattcatattttgatctcatgcagtacaatactattttattacaattcatataaaatgagtagtaatctatgctctactaaacaaaccatcggcgatccaatctctaaactggttcatattttgatcttcatccccatcacgtggattatctctatttccttgagaagatgatgctcccgacaatggaatgtagttttcatcatggtcacacatatcgaagtcctcatccatcatagcactctctctaataaagttatgaagtgccatgcaagcgataattatttggctttgctttgctatcggataacttggtaattgtagcaaaatcctccacttcattttgagaactccaaaagatctctcgatgacatttctaagtgaagagtgggcataattgaagagttctttcttacctctaggcattggtccttgtctatactccggaagatgatattttgttcctttataaggtgcaaggtaacccggtcggtttggatatcctgagtccacaagatagaacttgccttcacattaaaataaatttgtcagttaaccggaaacatttaaagctatgtgaaataagagaaaataacattatggtaccttgaggtggatgtggaaacttgtcgccatacttgtcaagtgcatccttaaacaccctcatatcatgaactgagccaggccatcccgccacgacaaaagtaaatctcatattaaagtcacatacgaccaacacattctgactcgtgtatccatgtcttcccgtatgttgtactacagctgttgttggcactatgacaggtacatgtgtcccatctattgctccaatgcaattatcaaaatacggagaaaactaaggagattgtagcctatgatgcactgtcctaaattgagggtctactggcctaataatatcagctgcaagcttactaacactacacaatactttaccaaacttcctactacatgtgttggtggacctagtaaatcgattttcagcttgtctcatgctttgaggagcaccacagatccataaaaattgacctaaagcctctactgatgacatcttcttagtggacttcaagccatatgactctacaagcacattatgtaacttatagaacacatccctattcatcctaaacatgttgaagcaagatgtcctattttctagtgttttcattacccattcataaccagattctgttggtactctatattctgatttgttcatgtatgtgtcaaagtggtacataccaagtatgccaccaacaatagcgtagttgctattcatttgttgacaggtccacagataatgcatctcctcctcagcaccatcttcctgtgtacacagatatgatacacattaaaatatgacacacaataaaatataagtagcacaaacttgttcttcttgcagcacaaatataaacactacagcacaaccacaaacagcaaggttgacacataaacgttgcagacaaacagcaaggttcacacataaacgttgcagacaaacaacaaggttcacacataagcgcttgagtataacagccacagataagaaggttcacacaaatctaaacatatggtattgtttatatttgagttgctattcagatttcagtttgttcagatttgagattttagctgctccaacaatcctagagcaaattgtgatttcagtttgtttagatttcagtttgtttgctgttcagatttcagtttgtttagattcagttt

SEQ ID NO: 1068 - DNA, 2299 bp, Zea mays
ctctatctctctctcagtctctctcttccgcacgagaccattacctagaacatcctaatcgaaaacacatactctgctgctgctaagtggtggcatctcgtttaggcgagatccccctcctcccccgctttccactcctctcctccaccctagtcgactccttccctgcaatccgctggccggctcacagtaccagaggagtccaccggaggagctcagctagactccaccctggtggctcgatcggcaccggccgctgcctgcgagactccgccagcgcgcgatgtaccgggtgaagagcgagggcgagggcgagggcgagggcgactgcgaaatgatgctgcaggaacagatggactcgctggtggccgacgacgtcagcagcggaggagggtcgcctcacaggggcgtcggcacgcccctgaagaaggggccatggacgtccgcggaggacgccatcctggtggactacgttaagaagaacggcgaaggcaactggaacgcggtgcagaagaacaccgggctgttccgctgcggcaagagctgccgcctccggtgggcgaaccacctcaggcccaacctcaagaagggggccttcacccccgaggaggagcgcctcatcatccagctccacgccaagatggggaacaagtgggcgaggatggctggtcacttgccagggcgtactgacaatgagatcaagaactactggaacactcgaataaagagatgtcaacgagctagccttcctatttatcctgctagtgtatgcaatcaatctacaaatgaagatcagcaactgtctggtaattttaacggtggcgagaatatatccaatgatcttctatctgggaacagcctttatctgccagattttaccagtgacaatttcattgcgaacccagaggctttatcctatgcaccacagttgtcagctgtttcaataagcaatttgctcggccaaagctttgcatcaaaaagttgtagcttcatggatcaggttgaccaagcggggatgctgaaacaatctggctgtgtgcttcctgcattgagcgatgccattgacagtgtgctttcctcagctgatcatttttcaaatgactctgagaagctcaggcaggctttaggttttgattatctgaatgaagccaatgctagcagcaagagtattgcacctttcggggttgcacttactggcagccatgcctttttaaatggcaatttctctgcttctaggcccacaaatggtcctttgaagatggagctcccttcactccaagatactgaatctgatccaaatagctggctcaagtatactgtggctcctgcaatgcagcctactgaattagtagatccttacctgcagtctccatcagcgaccccttcagtgaaatctgagtgtgcatcgccgaggaacagtggtcttttggaagagctgcttcatgaagctcaggcactaagatctgggaagaaccaacaatcatcggtccgaagttcaagttcttctgctggcacaccttatgagactaccacggtggttagcccagagtttgatatgggtcaggaatattgggaagaacagcccagttctttcctcagtgaatatgctcattttagtggaaattctttcactgaatccactcctcctgttagtgctgcgtcacctgatatcttccagctctccaagatttctcctgcacaaagcccttcaatgggctctggcgagcaggcgttagagcctaaacatgagtcggcagcttcacctcgtcctgaaaacttgaggcctgatgcattattctctgggaacacagccgatccatccattttcaataatgccatagccatgctcctgggcaatggcattgatgccgagtacaaacctgttcttggtgatggaattgtgctcgattcttcgtcatggaacaacatgcaacatgcttttcagatggcgggattcaaatgagttccatgcacttgtttgtgatgctgaagggcttcttgttgcttgttttggggtcagtatcagcgaaggccgcattgattgtgacgctgcattcctgacagagggcgtgcaggtgcagcagctaccatatgtgatcttcatgctaatagtccttttgtctaataaagtgcatgaagataaaccggatattttttttttgctttgtattagagaaccgtttttgtcaaccctgtcaggattctgttggaaatgtgtcatgatttttgtttgaacaatttaatatctgtcattgataaaaaaaaaaaaaacaaaaaaaaacaaaactcgagggggggc

SEQ ID NO: 1069 - DNA, 962 bp, Zea mays
ccccgccgccgcccgggaaaccaaagccccggccatctctctactcactcttcctgtctcctcgtcttgctggagccagtattaacagatccgggttcgagcgtccagtctcgccggacctccgactggcggtcgctgctatctctctggtaccgcggtctcttgcgcgcttctctccattcgctcccactcaccggcttgggggaatgaaggatgtggtagggagcccggggacctggagtggcatggcgctgcggttgtcgcaatgcgtgtccgctggcgcatccatgggcgctatggccacagcgtacggcttctccaactacactgctttctgctacttgattgcttcaatgggcctacaacttctttggagttttggccttgcttgtcttgatgtctactctttgaagactaaaagagatcttcacaaccctgtgcttgtaagcctttttgttgttggggactgggtcactgcaattctgtcgtttgctgccgcgtcggcgtccgcgggcgtgaccatcctgttcgagagggacgtccacttctgcaggatgtacccgcagttgtcgtgcggccggtacgcgctctcggtggtgctggcgttcatcacctggtccttcatcgcaacttctgctgtctccatgttctggttgctgccgtcgctctgatgtggcacggaaggagcctgccgtgtcgtcctgtttagatccgtttgcttcagcagctggttgatgccctgggtcgctctgggttgtgtgcttaagtaactatcaggatcctgatcttaaccggatgtactctgctggagacgagaaattatctagtgtatttgttaaaacaatgaggtggtttatcttcttatttctttttttaccatcgatgttgattgtggtccatcatctttctctatctctaccccttaaacccaagtttttgtgtgtcgagcgtcgttgtcgtgt

SEQ ID NO: 1070 - DNA, 1211 bp, Zea mays
acatcaattctttgccttttcaaccatactcaaatttgaaatctggtttactaaatgtctctgcattgcttcctggtgacgtcttaaagcttggcatgggcccaaaatcatatatagcttatggctatgcagaggaactcattagaggagattctgttacaaagcttcattgtgatttgtctgatgcagttaatgttttaatgcatactgccaaagttgtgccttctgaagaacaaaaagaggggataagagatttgaaaataaggcatgcagaacaagataaaaaggaatgcttggggaattcatcaatagatggaaataaaacaagcatggagcatgctcatatatcatcagtttcctgcgaggatggtggaggtgcactatgggatatttttaggagggaggatgttggaaagctgaaagagtacctcacaaaacattccaaagaatttcgccatatgtactgttgtccagttgaaaagatatttaaccctgtacatgatcccacgcgtccgcggacccgcgggcacaagagaaagctcaaggaggagtatggaatcgagccatggacctttgtgcaaagacttggagatgcggttttcatacctgctgggtgtcctcatcaagtacggaatctaaagtcttgcaccaagatagctctggattttgtatcaccagagaacattcagcaatgtctcagcttaaccgaggatttccggagacttccagtgggccacagggcaaaagaagataaactagaggtgaagaagatgatcgtctatgccgttgagcatgctttggcgattctgaaagagccttgcacaccccgcgagtccgcctgaacaagctggcatcatatctgggtttctgctagtcaacgagggaaactagagaacatgatgcgatgttgtgcgacagtagacgtggggtagcgctagttgctttgcttgtcggcacaaataataatcttggaaatattactaataagggctcggttaggaagggattggaggagattaatttttttttattttaactgaatagaaagagatttgatgagatccctatacaatcgaaaaaggcctaaaatggtagattttgctgatggtgtgcatcactgaagagctgggcatgctgaaaaaaatagatgtcatactgtaaatctacaaaatgtggcttcgtttccaaaaggccttgcccctgttttctat

SEQ ID NO: 1071 - DNA, 1457 bp, Zea mays
ccggccgggccggggagtgccccagtctcccacccccagctccaccaagtcaccgcaccgccgcatctaggtcaccgcctcgccggcgtttcgccatggccggggactggcaggacctgggccaagcggcggccataggcctcctcttcgccttcctgctcgccaagctcatctccaccgtgatcgccttcaaggaggacaacctccgcatcacgcgctcccctccgtcctcccccacagccgccgccccagctcccgcgacgtctcccctcccctcccaacacgccgccgcaatcggaagcggcagtgacagcgattgggagggcgtggagaccaccgagctggacgaggagttcagcgccgcctccgccttcgtcgcggcctccgccgcctccggcaccagcgtccccgaggaggcgcagctgcgcctctacggcctctacaagatcgccaccgagggaccatgcaccgggccgcagccgtccgcgctcaagctcaaggcccgtgccaaatggaatgcttggcataagctgggtgctatgcctacggaagaagctatgcaagaatacatcacaattgttcaggagctattccctaactgggatgcaggtacaagtgcgaaaaggaaagatgaagaaagcattacttctgcatcagcttcgaaggggcccatgggacctgtgtttagcagtttgatgtatgaggaagacgaagggaatgattcagaacttgctgacatccatgttttagcgagggaaggagcaactgaggatatagtgaagtttctggcagcgggtgtggaagtcaacatgagagatactgaaggtagaactccgctgcactgggctgttgaccgtggccatcttagtgctgttgaggttcttgcaaaagcaaatgcggacctgaatgccaaggacaacgaagggcaaacggcactccactacgctgctgtttgtgaaagagaagacatcgcagaattgctcgtgaagcatcatgccgaccttcagatcaaggatgaggatgggaacacggcacaggacctgtgccctccgagctggtcttttatgaaccgggcgaactgacaaccaacatgctaccttacattagctgtactctaagctggtaccgcacttggtcatgtgctttttctttatgggggacatatggtgtacctggtgtgccctgtgtgaagtgccgtgcgtggcgcccgctatgacgattgggaaatcagatgagctgttttattttatccacctcatctaactagttgtcaaaactcaaaagtcgagtggttgaagtgttagtgctgggagatacatgtgttgccttacaccaatggtctgttactgttagtgaaaaggaactacagtcatacatgtaccttgtttcctttgtatttattggaccgccgtttgtgtgttccaaatgttagatggggttggaggcgacagagttcc

SEQ ID NO: 1072 - DNA, 3031 bp, Zea mays
caaagcatgccagccttatacaattgaatgtcaaattttagaaggcatgcgtattgaacgttatacatcagaatctatctcgctactatgaaagaaagaagcctgtttgggcctatgtaaccagaagatagaggcccggctcacaatcgcagactcacagtgactcagtgacagtagtgttcgggcccgatcgactgctcctagaagcctcggccgcgcctctatctcatctccttcctcctgttgagcccgccggcctcccacagcttactacgaaaaccctaaccccttcccttatcctctgctccctctccacggttccacgaacgttggcgcgcaagctcgtggtgtgagcggtcactgtctcccatcccatggctccggcgctgagcgggactctgggcgcgtcgtcggtggcggcgctgcggccctgcgcggggaggagggcgccgtccgccgcgagctcggttgcgccgcgcgggagcggggtggtgaggtgctccagagggctcaggtgggacgcccacagaagcagggggaggttgctcagggtgaggtgcgatgcggccgtcgcggagaagcccgccgaggaggaggcggctggggagaagttcgagtaccaggcggaggtgagccgcttaatggacttgatcgtccatagtctgtacagtcataaggaggtatttctccgggagcttgttagcaatgcgagtgatgcgctggataagctgaggttcctcggcgtcactgattcttctttgcttgctgatggcggcgagctagaaataagaattaagcctgaccttgatgctggaacgattactatcactgacactggtgttggtatgactaaagatgagctcaaggactgccttggtaccattgctcagagtggcacctcaaaatttctgaaggccctcaaggaaaacaaagaccttggggcggacaatggtctaattggtcagtttggtgttggattttactcagcttttcttgttgcagagaaggttgtggtgtccaccaagagcccaaaatcagataaacagtatgtgtgggaagctgtggctgacagtagctcttatgtcataaaggaagagactgatcctgagaaaatgcttactcgtggaactcagattaccctgtttctaagacctgatgataagtacgagtttgcggacccttcaaggattcaaggcttagtaaaaaattactctcagtttgtgtctttccccatatacacatggcaggagaaatcaagaactgttgaggttgaagaggatgaagagccgaaagaagttgaagaggcaacgaagggtgagaaaaagaagaagactattacagagaaatattgggattgggaactagccaatgagacaaaacccatatggatgagaaatccaaaggaaattgagaacaccgaatacaatgagttctataagaagacattcaatgagtttttggaccctcttgcccacactcacttcacaactgagggtgaggtggaattcaggagtgttctttatgttccaggcatggcgcctcttagtaatgaggagataatgaaccccaagaccaaaaatatccggctatatgttaaaagagtcttcatctctgatgactttgatggtgaactgtttccaagatacttgagctttgtgaaaggtgtggtggattcaaatgaccttcccctcaatgtttctcgggagattcttcaagaaagtcgaattgtaagaattatgcgcaagcgacttgtcagaaagacctttgatatgattgaagagattgcggaaaaggaagataaggaggactataagaagttttgggagagctttggcaagtttgtcaagcttggttgcatcgaggacacagggaatcacaagcgccttgctccattgttgcgcttccactcttctaaaaacgagggagatttgataagtcttgatcaatatgtagagagcatgcctgaaagtcaaaaggcaatctactacatcgctacagatagtctccagagtgcaaagactgctcctttcctggaaaagctggtccagaaagatattgaagttctctaccttattgagccgatagatgaggttgccattcagaacttgcagacctacaaagagaagaaatttgtggatatcagcaaagaggatctggaattgggtgatgaagaagaagagactaaagaaaccaaacaggagttcactctcctatgtgattgggttaaacaacagcttggcgacaaggttgcgaaggtccaaatatcaaagcgtttaagttcatctccatgtgttctcgtatctggcaagttcggttggtccgccaatatggaaaggctcatgaaggctcaaacacttggtgacacatcaagtttggaattcatgaggggaagaaggatctttgaaatcaaccctgaccacccaattatcaaggatttgagcgctgcttgcaaaaatgagcccgaaagcacagaagccaggagggctgttgagctcctatacgaggctgctttaatctcgagtggatatactccggagagtccagcggagttgggtggcaagatctatgagatgatggcgattgccctcggcgggagatggggaaggtccgacatggaggaggccgaagcgtcgacgggtgaggccagcgcagaggcagactcatctgaagtcaccgtagcagaggtgattgagccctcggaagttagacccgagagcgatccgtggagggaccagtgagttctcccacgggcatccttaactccatatttagcagtgccggggataaaaactaagccatgggcaagaacatattgccgtggcaatttttttgtaggcttagactttgccggccaccagaatcttattgaggaggtagtggccttagaaaagaataataaagcatgaagactgatgattacatagcgaaattgtgctgtccctctcaataatatttataatgaaaagaacttatttctgcaacttaattcaacagtgtttttgattccaaaataatagcccccccccacccc

SEQ ID NO: 1073 - DNA, 1434 bp, Zea mays
ccccccccccccccccccgactttgatggtgaactgtttccaagatacttgagctttgtgaaaggtgtggtggattcaaatgaccttcccctcaatgtttctcgggagattcttcaagaaagtcgaattgtaagaattatgcgcaagcgacttgtcagaaagacctttgatatgattgaagagattgcggaaaaggaagataaggaggactataagaagttttgggagagctttggcaagtttgtcaagcttggttgcatcgaggacacagggaatcacaagcgccttgctccattgttgcgcttccactcttctaaaaacgagggagatttgataagtcttgatcaatatgtagagagcatgcctgaaagtcaaaaggcaatctactacatcgctacagatagtctccagagtgcaaagactgctcctttcctggaaaagctggtccagaaagatattgaagttctctaccttattgagccgatagatgaggttgccattcagaacttgcagacctacaaagagaagaaatttgtggatatcagcaaagaggatctggaattgggtgatgaagaagaagagactaaagaaaccaaacaggagttcactctcctatgtgattgggttaaacaacagcttggcgacaaggttgcgaaggtccaaatatcaaagcgtttaagttcatctccatgtgttctcgtatctggcaagttcggttggtccgccaatatggaaaggctcatgaaggctcaaacacttggtgacacatcaagtttggaattcatgaggggaagaaggatcttcgaaatcaaccctgaccacccaattatcaaggatttgagcgctgcttgcaaaaatgagcccgaaagcacagaagccaggagggctgttgagctcctatacgaggctgctttaatctcgagtggatatactccggagagtccagcggagttgggtggcaagatctatgagatgatggcgattgccctcggcgggagatggggaaggtccgacatggaggaggccgaagcgtcgacgggtgaggccagcgcagaggcagactcatctgaaggcaccgtagcagaggtgattgagccctcggaagttagacccgagagcgatccgtggagggaccagtgagttctcccacgggcatcctttgttagaactccatatttagcagtgccggggaaaaaaactaagccatgggcaagaacatatttggtcacagttgcttctatatgggttcttgccgtggcaattttttgtaggcttagactttgccggccactaaaatcttattgaggaggtagtggccttagaaaagaataataaagcatgaagactgatgattacatagcaaaattgtgctgtccctctcaataatatttataatgaaaagaacttatttctgcaaaaaaaaaaaaaaaaaaa

SEQ ID NO: 1074 - DNA, 1132 bp, Zea mays
gggaccctcgaggccggccggggcaaccagtcaaccaccctatacattgggtgcctccaggccggccgggacctcttcaatcccagtcccacacaaagtttctcctcgatcctcatctcctccctctctcgagtcaagagcagagcagctaccaaacaagctctcctttcgcttccgatccatggagctcgacgccgacaacctgagcgccaccgagctccgcctcggcctgcctgggaccagcagcagcagcagcgacgactggcagaagaagccgtcgccctccgtcggggccaagcgcgctctggacgacggcaccaagagcgaggcctcggggaccagcccggccgccagagacctcgacttcgaccacgaccacgacaccgccgcgcctcccaaggcgcaagtggtcgggtggccgccggtgagggcgtacaggaagaacaccttccaggcggcggcggcggccaagaaggtcgagcagaagcagaagcagcagcagcagggaggcctgtacgtgaaggtgagcatggacggcgcgccgtacctcaggaaggtggacctccggatgtacaaggggtacagggagctcagggaggctctggacgcgctcttcaccaactccttctccgcggcggcagagggcggcggcgaccaccaccagcacgccatcgcctacgaagacaaggacggcgacctcatgctcgccggagacgtgccctgggatatgttcatctcttcgtgcaagaagctcaggataatgaagggctctgcctctgaggccaggtgatcgctgatccatacataaacagaggctacagacacgccacctgggaacgcggatccaagagcacacacggatcgtacttgacgaggaaggagggaggagcagtgtggcttgagctctccagtgttgtacaaagacatgtttctttctgaacccaaaagggagaaagatgtatgaagcgtgtatataagatcttagctagcagtttgttttcatttgtatgagcgatcgaaggctgtaaaaaatgaaaaagaaaaaagaaaagggaatgagaaattgactaaagctggtcatttttccaaaaaaaaaaaaaaaaaaacaaaaaagaaaaaaacttgattgtgt

SEQ ID NO: 1075 - DNA, 1561 bp, Zea mays
attcgggttgatgatgagtgactccgggcccctcgccaaacgccctccgtgccgtgcccactcctctccccgcagcttcgggcccctgccatgccgtcctcgtcgtcgctgatccatggcatctccatctccgtctccgacgacgacgaggccaccggcaaggtgcgcgtccgcgtccgccgcaagcgctcccgcggccccgcatccgcttcggcgcgccgccgccgcatcctcttccgcgccgcgcggctgggcgtgccgctcctcctcgccgccctcgccgtgtgcctcctcctctacgagtcctaccgcctcacgccttcccgctcctccacactgcctccgccgtccttcgcggacatcagccgcctctcccgcaacgcccgcgccgccgatggcgccaggaagtcatgcctgaagtttcttgatcctgagaagcttcaaaatttggaacttccagaaattcctgaaacaaatttgtcgatcaaggaagttctgtacagatcaagtctgccccatatcgtcaatgatacaccaccacatacagagaattcccggttcaacttgttcacaggataccagacactcactgaacgagaagaaagcttcaagatgaagaaaagtgtgacagtgcactgtggcttttataatgaaaatggagggttcagagtttctgatgttgacagagaatatatgagatcctgtgaagtagttgttgcaacttgtgcatttggtggaggtgacgaccttcatcagcctatagggatgaccgaaaattccatcagaaaggtttgctatgtagctttctgggatgaagtcacccgtgcagctcaagaggaggaaggacacacgatcagtgaagacctcgtgattggcctatggcggatcattcttgttagcgatcttcctttctcagatcaacggttgaatgggaaaattcctaagctgataggccatcgcctcttccccatggcgcggtactcaatttgggtggattcaaaatctcagttccggagagacccattgggagtccttgaagcccttttgtggcgctcaaactcttctctagcgttatcggaacacggagctcggagtagcctgtacgatgaggcgaaagcaattgttaagaaacacaaagcaactccagtggaagttgaagtgcagttggatcagtaccgacgagatggcatccctgatgagaaaagattcaatggaaagaaaggtccatttctagcctcaacatgttgtttgcatcccacacttttgttatgtctccttttagttcatatattttggtatgtgttatgtttcttgacttgtttacatgtcgacattacttcttgtttggtttcttgtgaaccatcactcgaacctgatgtcatcagtttttttcgctttaagtagtccctctaagagccatggtagcattaacagtttactcctgtgggcaggaacttgggatgctgaatctcaaaagcactttagtaataaagagaataacatccaacactttgtgcaaccatgtttggtcttcatgagaaaaaaaaaacgtgtggtacag

SEQ ID NO: 1076 - DNA, 1598 bp, Zea mays
aaaaatacacggagcctgcacgcgtgtttctccacatgccctctccttctcggatcctctaccgtaatctcccggcgacgccgccgccatgtcttcccagtcttctgcaggaggtccggcgatccatcatccccactccaactaccacccgtacatctttcagcatgaccctccgctccactctaattcccgccgtcgccgccgtaaccatgatgacccatatcaaccctatctgcctctaccccacgctcactcccacggagccactgccgtcgttaccggcaccgttcgttgccatgtcccccgggatccacttgtgctctcacacctccaggagcgcctctttccgactctccctcaacatcacccgatcgcgggtccacccccgacgaagcgggcccgccgcgcgccagatactccgtgggatccgccgccgccaacgctgcagccggcacttgtcccggtggcgctagagaggcctccggatgtaggacattctgccggggcgttgctttcgcgtgacgagatcgagaggcggtctccatcaagaagggacgggatcgattccgcgcttgaggccaggctgcgtgcgtcctactgcgcctacctgcattgcctcggcaaccggctcgggttgccgcagacaacaattgcgacggctgtggtgttctgccatcggttcttcttccacagatctcatgcctgccatgatagatttttggttgcgactgcagccttgttcctggcagcaaaggcagaagaaacaacatgccttttgaatactgttcttagggcttcatgtgaggtttctcaaaatcaggaattcaatcttcttccttacatgctatgtggtcaggactggtttgaacagtacagagagagtgtaatacaagcggagcaaatgatacttacaacacttgattttgaactcgaagtagcccacccatatgcttccctatcctctgctttgggcaaactaggactcacacatactgttctgtttaatgtggcttggaatctgatcaatgaagggctacgaagttcactttggcttcagttcaagccccatcatattgctgctggagctgcattccttgctgcaaagttcctccactatgacatcacattccatccaaatttctggcatgaattcaagacaagtccatatattgttcaagatgttgtccagcagttgaaggagctactttaggatacaacattcaatgtatttacataatactcagagatcctcttggtttatacgctgtagtgagtagtgatcactgccaaaagtacgtacacattagcatgtggtcactttcatcaattactgaacatctttcatgtaggtttttacaaccacagtgctatgtacaaaaggggaagatgttattcaaaagttgcccttttagttttggggaggtaaaagcaaacaatctttagaagagatgtgacgaacaacaagagataaaaaaaggcaaaaaggtgtaagagatgtaaaaagttgatgaaatgttggatcccttaattggttgtccggttgtgattatctgatatatatagaggatggtttatcccgaaaaaaaaagaaaaaaaaa

SEQ ID NO: 1077 - DNA, 1684 bp, Zea mays
actggggagatccctccgcgctccctccggcccccccggccattttccaacacacgctatattataaaactacccaaagagatcgtcgcctcgatttctcttcgagtgccaagcagtactgctagttctacttctgtacttcagcagtaggaggccgctgtttgctacgattttgactgactgagatgggaatcctctgcctcggtgcttcctccacactgctctgcggggaggacaggaacaacgtactcggcctcggctgcggcaacgagctggtggaggtggggagcggccatgacggcttggactccgtcgtcggcgccgtgttccccgtggacacagatgaggccgtgcgggcgttgttggagaaggagacggaccacaagcctcaagacggctatgcggagaggctggagcgcggcggattggagtactcctggaggagagacgccatggattggatttgcaaggtccattcgtactacaggtttggaccactcagtctttaccttgctgtgaattacctggatagattcctctcctcatatgatctcccacacgataagccttggatgcgacagttgttgtcagttgcttgcctagctctcgctgtcaagatggaggagaccgtgctccctcttcctgtggaccttcaggtctgcgatgtgaaatttgagtttgaagcaaggactattgggaggatggagcttcttgtgctggccaccctgaaatggagaatgcaggctgtgacccccttcactttcatcagctacttcctcgacaagttcaatggtgggaagccgccgagtatggcactagcgtcacggtgcaccgagatcataattggcacactcaaaggctctacattcttgtcattcagaccatctgagattgccgcggcctcagctctagcagcagtttctgagaatcaggttgttggctcctcgagtgctctttcagcatctgaagtccctataaataaggagatgattgctagatgctatgagctgttgcaagagcaagcgctggtgaggaagacagggcacatcaatggaagcccttcagtgccgcaaagcccgattggcgtgctggatgcaacatgcttcagctttaggagtgaagatgtaagactaggatcatcgcaatcaaacaacatcagtagtagtagtaacgacaatcaagtttctaagaggagaaggctaagcatatcaccaatctgagtagatcaaaactctgttggcagtgtcgcattgtgcgcttggttatgcattgatcatcttaacctcagagcttgtcagagcaacaagtagtggtacaaaaggacccagtgaagcattgtaacaagcagaggatggtgacagtaataagttagaagcagcttcttgatctctgcgacgaaataggtgacgaggaacgtttcttcctctagtaactttgaatccccttcctccccggtccctttgttttattccttttcctttttatcggtatctcaaggcatttgtggggactggggagatatatgtggatatgagattggagacgtgaggattaaagagagagagagggagggagggagataaaaaaaaaacaggtttgttcctttgttctctgccaatatacaaaaaaactgtcgcgcgaaaaaaaaaaaaaaaaaaaaaaaaaaaaaaaaaagggcggccgc

SEQ ID NO: 1078 - DNA, 1778 bp, Zea mays
ccggccgggaactcactgcatatctgacatctcagttgctgaacgcctgaaccgcaagtcatccatgacctcttctattccgaagctgcttctcctcctcttctttctcagccatcgctctcccattgctcgcgcaggcgatgatggcagctacaaggttctgtccatgggctctccgagaactgactccgtctgttcccagtccaaagcggttccttcgtcgtccgccggtgccgccacggtgcccttgcatcaccgtcacggcccatgctcgccgttgccgaccaagaagatgccgacgttggaggagacgctccaccgcgatcagctccgagctgcctacatccagcggaagttctcaggcggcggtggcgctggtggtgacgtccagcgatcggacgccaccgtgccgacggccctgggcacctccctgaacacgctggagtacctgatcaccgtaggcctgggctcgccggccacgtcccagaccatgctcatcgacaccggcagcgacgtgtcgtgggtgcagtgcaagccgtgctcgcagtgccactcccaggcggacccactcttcgaccccagctcgtcgagcacgtactccccgttctcctgcggctccgccgactgcgcgcagctcggccaggaaggcaacggctgctcctccagctcccagtgccagtacattgtcacgtacggcgacggctccagcaccacggggacctacagctccgacacgctcgcgctgggctccagcgccgtcaagagcttccagttcgggtgcagcaacgtggagtcgggcttcaacgaccagaccgacgggctcatggggctcggcggcggcgcgcagtcgctggtgtcacagacggcggggacgctcggcagggccttctcgtactgcctcccgccgacgccgagctcctccgggttcctcacgctcggcgctgctggcggtagcggaacctcgggcttcgtcaagacgccgatgctcaggagcagccaggtccccacgttctacggcgtgcgcctccaggccatccgggtgggcgggaggcagctcagcatacccgcctcggtcttctccgctgggacggtcatggactcgggcacggtcatcacgcggctgccgccgaccgcctactcggcgctgtcgtcggcgttcaaggccgggatgaagcagtacccgccggcgcagccgagcggcatcctcgacacctgctttgacttcagcggccagtccagcgtcagcataccgtccgtcgcgctagtcttctccgggggcgccgttgtcagcctcgacgccagcggcatcatcctcagcaactgcctcgccttcgcggccaacagcgacgacagctccttgggcatcatcggcaacgtgcagcagcggacgttcgaggtgctgtacgacgttggccggggcgtcgtggggttcagggctggggcgtgctgatcgatcgtgatcggcgcaaggacattgacaataccggccgggagtacgtactgtgctcgtttgggttgcgagtgcaacgtaaatggaagaagtgcaaaacatatacatactacttcgattttaattatctttgcgatagcatgcaataacgtcatgcatgcaagtgtgcaaactactaaaagctaaaagataatcttaatgtcacctgattgatgactataaaagattaatgatatattattgtattgcgcttggtgcgatgattaattatggtgtatacagccttttgggcgagctaatgttccttatatattactcactccgtctc

SEQ ID NO: 1079 - DNA, 2150 bp, Zea mays
gagggcaccggtggccggttgcccgttgacgccgcggcacgcgattccgatcctgccagccagcgcaagcctgtggctgccacggtgccaccatgtcccgcggcagtgccgcctccgtattcctcggcgtcgacgttggtactggcagcgctcgtgcaggactcttcgatgaaaacggcaaattgctggggtcagcaagcagccctatacagatatggaaagagaaagactgtatcgagcaatcatcaaccgatatctggcatgcggtctgtgctgcggtgaaatctgcgtgctcactggcaaatgttgctcctgaggacgttgctggccttggctttgccgccacttgctcccttgttgctgtcgatgctgatggttcccctgtttcggtttctttgagtggtgatacaaggaggaatatcattgtgtggatggaccatagagctgtgaatcaggcagagcgaatcaatgctaccaattcgccagtactgcaatactgcggtgggggtgtttccccagaaatgcaggctccaaagctcctatggatgaaggaaaatcttctagattcgtggtctatggtatgtaggtggatggacctaagtgactggttagcatatagagcaacaggtgacgacactcgcagcttatgcacaactgtctgcaaatggacatatcttggacatgcacacatgaaacagtggaaggaatctgattcacgtgatatggaggcatgcggatgggacaatgttttttgggaagaaatagggttgggagacctcctcgaaggaaattgtgcaaaaataggacgcagtgtcgcttttcctggtcatgctcttggttctggtttgacgcctactgctgcaaaggagttaggcttacttcctggtactcccgtcggaacctcacttattgatgctcatgctggtggagttggagtcatggaaagcattcctgatgcaggatctaaagctggttgtcagtgatgagtatgtctgatgaacatgcaatatgtcaccgtatggtattggtatgtgggacatcaacctgccacatggctgtttcaaaggacagattgtttatacctggtgtctgggggccgttttggtctgcgatgatccctgagttttggctcacagaaggtggccaaagtgcaactggcgctctgctcgattacattattgaaaaccatgttgcttctcctcttctttctaaccatgctgcttctcaaagtatatccatatttgagctactgaacaagatgttgctttctatgtcacaagagcagaatagtccgtttctttctgcattaactcaagacacccatgtgcttccggattttcatggaaatcggtctcctgttcctgatccaaaatccaaaggagtgatttatggcttgacacttgatacaagtgagaagcatttagctcttctatacctagcaacaattcagggtattgcttatggtactcgtcatattgtggagcattgtaatgctcatggccacaagatagacacacttcttgcttgtgggggacttgcaaagaattctctgtatatccaagagcatgcagatattacaggatgtcctataatacttcctagagagagcgagtcagtgcttttgggtgccgctgttcttggcgctgttgctggcaagaagttcccgggtgttcgtgatgcaatgaaggctcttaatgcagcggggaaggtcgtaaatccgtcttcagaccctaaggtgaagaaataccacgatgcgaaatatcagatattcagatccctgtatgagcaacaactctctcatcgcgcaaccatggcacaggcattgcagtagggctctatggccactttggctcttcactcttggttattgatacccttggtttcattgccatgttttattggcttatttacatgtaatcaatatcgccttgagtgatttgatagaatagaaaccatgataagatgcatgtatacacatataagaaaactggtaagatgatctttctcacagggacgtgaaatccccaaagcctgtgcaatgttaataaaagaaaaggaggttcttaagggctcaaaaaaaaaaaaaaaaaaagtcccaatcattataaatgcatctcatggttataacgcaaaaaaaaaaaaaaaaaact

SEQ ID NO: 1080 - DNA, 1388 bp, Zea mays
gcacgagaccattacctagaacatcctaatcgaaaaatcctgtctgctgtctctcccgagtgacctcaaagtcagcgagcgccacatccgactccgagggccaccggtggccggttgcccgttgacgccgcggcacgcgattccgatcctgggttttacctaagaaataaacaactctgaatttcccaagacctgaagaccagccagcgcaagcctgtggctgccacggtgccaccatgtcccgcggcagtgccgcctccgtattcctcggcgtcgacgttggtactggcagcgctcgtgcaggactcttcgatgaaaacggcaaattgctggggtcagcaagcagccctatacagatatggaaagagaaagactgtatcgagcaatcatcaaccgatatctggcatgcggtctgtgctgcggtgaaatctgcgtgctcactggcaaatgttgctcctgaggacgttgctggccttggctttgccgccacttgctcccttgttgctgtcgatgctgatggttcccctgtttcggtttctttgagtggtgatacaaggaggaatatcattgtgtggatggaccatagagctgtgaatcaggcagagcgaatcaatgctaccaattcgccagtactgcaatactgcggtgggggtgtttccccagaaatgcaggctccaaagctcctatggatgaaggaaaatcttctagattcgtggtctatggtatgtaggtggatggacctaagtgactggttagcatatagagcaacaggtgacgacactcgcagcttatgcacaactgtctgcaaatggacatatcttggacatgcacacatgaaacagtggaaggaatctgattcacgtgatatggaggcatgcggatgggacaatgttttttgggaagaaatagggttgggagacctcctcgaaggaaattgtgcaaaaataggacgcagtgtcgcttttcctggtcatgctcttggttctggtttgacgcctactgctgcaaaggagttaggcttacttcctggtactcctgttggaacctcacttattgatgctcatgctggtggagttggagtcatggaaagcattcctgatgcaggatctaaagctggttgtcagtgatgagtaattttgtgttttgctagagaaattgttttcaaaacattgtgtatgttgtatatattctaatatgtttttaacagtgtctgatgaacatgcaatatgtcaccgtatggtattggtatgtgggacatcaacctgccacatggctgtttcaaaggacagattgtttatacctggtgtctgggggccgttttggtctggtacagctgccttctcaaatatatattttaatttcccttaaaaagaaaaaaaaaaaaaaaa

SEQ ID NO: 1081 - DNA, 866 bp, Zea mays
  misc_feature (531)..(531): n is a, c, g, or t
  misc_feature (799)..(799): n is a, c, g, or t
  misc_feature (840)..(840): n is a, c, g, or t
aaagtcagcgagcgccacatccgactccgagggccaccggtggccggttgcccgttgacgccgcggcacgcgattccgatcctgggttttacctaagaaataaacaactctgaatttcccaagacctgaagaccagccagcgcaagcctgtggctgccacggtgccaccatgtcccgcggcagtgccgcctccgtattcctcggcgtcgacgttggtactggcagcgctcgtgcaggactcttcgatgaaaacggcaaattgctggggtcagcaagcagccctatacagatatggaaagagaaagtctgtatcgagcaatcatcaaccgatatctggcatgcggtctgtgctgcggtgaaatctgcgtgctcactggcaaatgttgctcctgaggacgttgctggccttggctttgcccgccacttgctcccttgttgctgtcgatgctgatggttcccctgtttcggtttctttgagtggtgatacaaggaggaatatcatttgtgtggatggaccatagagctgtgaantcaggcagagcgaatcaatgctaccaattcgccagtactgcaatactgcggtgggggtgtttccccagaaatgcaggctccaaagctcctatggatgaaggaaaatcttctagattcgtggtctatggtatgtaggtggatggacctaagtgactggttagcatatagagcaacaggtgacgacactcgcagcttatgcacaactgtctgcaaatggacattggacctatatttatatatagctgtaagcataagaggacaaaaaacncaacatcttcgctttaatctttaatctgtaccggttgcttntaaaaaaaacaaaaaaaaaaaaaaaa

SEQ ID NO: 1082 - DNA, 1948 bp, Zea mays
ccccctcccgccccccccccgtcccctcctctaccggtgacgcacgcaccccatctctgatctgatctgatctctccccctggatctcgacctccgcctggctgctccgctctgcgtcgctcgccatggcgtcctcgacggggagcttggagcacggcgggttcacgttcacgccgccgcccttcatcacctccttcacggagctgctctctggggcagcagcggacatggtaggagccgcgggcgccgatcatcaggagcggtcgccgagggggctgttccaccgcggcgccaccaggggcggcggcgtaggcgtgcccaagttcaagtccgcgcagccgcccagcctgcccatctcgccgccgccgatgtcgccctcctcctacttctccatcccgcccgggctcagccccgccgagctgctggactcgcccgtcctgctccactcttcctcgaacttcttcgcgtcgcccaccaccggcgccatcccggcgcagaggttcgactggaagcaggccgccgacctgatcgcgtctcaatctcagcaagacgacagccgggctgcggtcggcagcgccttcaacgacttctccttccacgcgcccaccatgcccgcgcagaccacgtccttcccttccttcaaggagcagcagcaacagcaagtcgaagcggcgactaagagcgccgtcccgtcgagcaacaaggccagcggcggaagcggcggcagcaccaagcttgaggacgggtacaactggcgcaagtacgggcagaagcaggtgaaggggagcgagaacccgcgcagctactacaagtgcacgtaccacagctgctccatgaagaagaaggtggagcggtccctggccgacgggcgcgtcacgcagatcgtgtacaagggcgcgcacaaccaccccaagccgctgtccacgcgccgcaactcctccggcggcgtggcggcggcggaggagcaggccgccaacaacagcagcctctctggctgcggcggcccggagcactccggcggcgccaccgccgagaactcgtccgtcacgttcggcgacgacgaggcggagaacgggtcgcagcggagcggcggtgacgagcccgacgccaagcgctggaaggcggaggacggtgagaacgaaggcagctcaggcgccggcggcggcaagccggtgcgcgagccgcggctggtggtacagacgctgagcgacatcgacatcctggacgacgggttccggtggcgcaagtacgggcagaaggtggtgaaggggaacccgaacccgcggagctactacaagtgcaccacggcggggtgccccgtgcggaagcacgtggagcgcgcgtgccacgacgcgcgcgccgtgatcaccacgtacgagggcaagcacaaccacgacgtgcccgtgggccgcggcgccgccagccgcgcggcggccgccgcgccactgctgggctccggcggcggccagatggatcatcgtcatcagcagccctacaccctggagatgctgagcggcggaggaggagggtacggcggcggctacgcggccaaggacgagccgcgggacgacctgttcgtcgactcgctcctctgctagagctggcgagggggatgcggagccggtccaccaatctcggtgcggcggcggtgtctgtagcctgttgtacgtgtacggcgggggtatacgtagcgtgcacgctcgccttcgcattcagaattcagatacgtccagtatacacacacacgcacacacaacacgctgtgtgcaccggatctaggttagctaggaatgggaatttgttgattcgttggaggccttcctgccacgcgcgcacggcacggtactcgtacagacaggccgctgccgctgccgcctgtgtggaaaggccctataccgtatatatagtgtgacaaagtcaataaagctgaaaagatcgcgttatttcc

SEQ ID NO: 1083 - DNA, 3643 bp, Zea mays
  misc_feature (937)..(937): n is a, c, g, or t
  misc_feature (940)..(940): n is a, c, g, or t
gcatgcctgcaggccggcacagcagcctctcggccgtagcggcggccggctgtactggaccggagcactccggcgccaccgccgagaactcgtctgtcaccttcggcgacgacgaggcagagaacgggtcgcagcggagcgacggcgacgagcccgacgccaagcgctggtacgtacgtgatcccgactcccgagcgagcgagattcattattcgctacccgcggttcacaagttgagcgtgtattactactgtttcctcgtgttcctgcaactcatgtatatatgtctgcttgatcaggaagcaggaggacggcgagaacgagggcagctctgcaggcggcggcggcaagccggtccgcgacccccggctggtggtccagacgatgagcgacatcgacatcctggacgacgggttccggtggcgcaagtacgggcagaaggtggtgaaggggaacccgaacccgcggagctactacaagtgcaccacggcggggtgcccggtgcggaagcacgtggagcgcgcgtcccacgacaagcgcgccgtgatcaccacgtacgagggcaagcacaaccacgacgtgcccgtgggccgcggcgccgccagccgagctgctgctgctgctgcggcggcgggttccggggccttgatggccaccggcggcggccagctcggctatcatcatcagcagcagcagcagccatacaccctggagatgctgagcagcggatcgtacggcggcggcggcggctacgcggccgccaaggacgagccgcgggacgacctgttcgtcgactcgctcctctgctagcgtcggggacgcggagtcggtcggtccacccaatctcgctgcggcgggcgtctgtagagcctgcgttacgtgtacggcgcgtgtacgtatacgcccgtagcgtacatgctcccctttgcactcagangcncaatataacacacagtcacacacacacacacacacacacgacacacgctgtatacactggatcctaggtgtttttttagcttagctaggaatgcaaatttcttgattcgttggagggttttttttctagcacgcggcgcggccggtgcccatctgtctcgcaccgtcgcacgcctcttcatacactctctcctgtactcggctactagtgctactgcatgtagacatgtagtgaatgtgaagtacaaagaatacaatacaacggagtatagtagtgtagtcttgtatgcatatgtaaactactatactctgttttacgaaatgggaaaaacgtagattgtttgggtttcttcgtggcaggtgtttgggttgtacgtaccatgcatttgaattttatatattgaacttgagaggtgacatgccgccgctcttggtccggccgctacggaggctacctcagctgctcatccttatcgcaatgaggcagcgccatagtctaatccgatctcgcgtcgcatcgggcacattcactgaacccagccaccagaccacccaggtggcacgtgcctcaacttgtgtatcaacaaggcgacgtgcgcgtcgcgtctcctctcaccatttcggaccggaggcgagctgacgtggatgcaatataaaaccagatattggacttattatccgttatccatacccactaaaatttgtgaaaaataatacgagtactcatatctgtttttaatatcgatatcaaatggatatatattattcgattccgagtttttcttaatatcttcgtatcccgtttctgatccgcattcgataatatcatactggctttaccaatgttcataaagaaaacaagggtcataaagatctatttaaaagttctctatcaacaaattattattttttattattactaattatatactgtaaccgtccgtttaatagtatatcaataaataacctttagtataactaatatcacgtaaagattaaatgtttttttgggttcatttaaacctagtatattagtggttgtaaattactaaaacaatttagtttattttttgattgatataatataagctacaattctgtaataaaatttatatagatatagtattgattgatttcatagatacatttaattattgatgaactgtattagagtctgtttggttgggctgtggctgtggaaaaaactgctgtgggctgtgagctgtccaaaaagctgctgtgagccgtgagttgttaaaaagctaaaaaccgtttggtggaaaccactaaaagctgttaaaagttcttcgatatatattttcacagttctatccaaaagctactaaaagcatgtctagatgtgatttcaattttgtaatacgagaaagtcagcttttagaaaaaaaatgcttactaaatccagtcctttggtttagcttttgacttttaaagggcaaaattcaaagctaaaagctaaaccaaacacactcttatttttatgagttgttattgtctatgtcatatatacaaatactttaatcttcgcttctgcaactcttcggttgacctaatatttccttaaatattatccattacaatttagcttgcttcgatatcgaagactagtagaagtgtacttttatttagttcaatctgttttactaatgtacactaagtttaacaatagacactttgagttggataaactaaatatctaaatagatactcgaatccaaaatatttaaattttattccaaaatatttatatctccatttgaattaaattaaatacgataaaagacatacttggtgatgaatccatcacgctaatcaatgcggtcgtgctcccaaaagtgaacacagttcgcgggctgattatattggatgattgcgttgccgccaaaccgatgacctccttttgtatttgtctacggatgtggggtctgctactagtaagtagtagtgattagtctcaagtggtggaggcacgatctcctaacttgcgtacgatgatcgggctggcctaacggaattggccgacctcccgctgactcagctcgatcggtagcatcttcttattagctggaagatgcaagaaccgacaaaccatcgcgttcaaacacagcatcgcttggtttttttatgtccaaaataagtacgccagccgctgagaagttttggctggggcaaaaattactctgcttcggagtagcgacgaaatcgaattagatacggaagaataatattcgtttcatatttgttttttttatattttgtcttttgatacggatcacatatagatttatcaagttatgtcgaataagatttaaatgaatattgatatcttaaatatccaactttgagtatacggatatagatcatacatggatcggatattgaatactcgaactcggtatcaacccacttagacagatcaaattcgaatacaaacggataatatcagtaccatttacatccatacttcggtgacagctagaaagtacgtgccacacgcgagggctcatcatcggtcgctaagtcatcgccaattgtggcatatgaggctcccgcatccaaaatgtaaaaggacaaaaagtcttcatatgcatgcacaagagataccgggagggataaggaacttaaaagttgtttacttgaaacaattcatgagtctactcaaattttatagaataatcttcattcc

SEQ ID NO: 1084 - DNA, 1043 bp, Zea mays
gcgtggtcgcggccgaggtacacggccgacttcaccagcggcatctccgccagcgccttcatagtcacctcgccaccgtgcgcgcgcacacgacgacgacgtccctaccttccttcgaggagcagcagcagcagcagtcgcccaagcccccgtcccgtcgagcaacagggcgagcggcggcgggaacggcaacactaagctggaggacgggtacaactggcgcaagtacgggcagaagcaggtgaaggggagcgagaacccgcgcagctactacaagtgcacgtaccacagctgctccatgaagaagaaggtggagagggccctggccgacggccgcatcacgcagatcgtgtacaagggcgcgcacaaccaccccaagccgctgtccacgcgccgcaactcatccggcggcggtgcggcggaggagctgcaggccggcaacagcagcctctcggccgtagcggcggccggctgtactggaccggagcactccggcgccaccgccgagaactcgtctgtcaccttcggcgacgacgaggcagagaacgggtcgcagcggagcgacggcgacgagcccgacgccaagcgctgcaggaggacggcgagaacgagggcagctctgcaggcggcggcggcaagccggtccgcgagccccggctggtggtccagacgatgagcgacatcgacatcctggacgacgggttccggtggcgcaagtacgggcagaaggtggtgaaggggaacccgaacccgcggagctactacaagtgcaccacggcggggtgcccggtgcggaagcacgtggagcgcgcgtcccacgacaagcgcgccgtgatcaccacgtacgagggcaagcacaaccacgacgtgcccgtgggccgcggcgccgccagccgagctgctgctgctgcgcggcggcgggttccggggccttgatggccaccggcggcggccagctcggctatcagcagcagcagcagcagcagccatacaccctggagatgctgagcagcggatcgtacggcggcggcggcggcggctac

SEQ ID NO: 1085 - DNA, 2561 bp, Zea mays
cttaccgggcttgggaccggctatgttgaaacgactcaaggaagtcttccaatcaacataggcggagttatgattattaaattatgattattaaaaatggaatttaattcaaggattcaaacggggcaaagagaagcacatttttgtcccactacagcagcgtgccagcgtgcggagtgcccagtggcccactgggtttccagtgtcccgctcgtccgactcgtgcgcctaccttgcctacccgtgcggacacgccacggcccacgagcgagagcggagaagggaagggacccacatcccagaaggcctctccttcccggaacttggacgtcgccgcctcggctgaccggtcaaaccgcacgagctttgacgcacacataccatcggcgtcaaactctgccttccaagaagcatcccgtttccagcacgttcacgttccgcctcagagccccactgacattgtggtcccatctgatgtggtccccgtcagtaagtgacgccattgcttgagaagcgcccccaccctagacgctgctggcactaccggccgctacttaaatggcagcccagccgccgagccaccccgcccgtccgcttctcccctctcctcgactcctcctcacgtcacgcaccccatctcttctctccccctctcgtctcgtccagtcgtcccccactctacccagctgccctgctctgcgtcgctcgccatggcgtcctccacggggagcttggagcacggggggttcacgttcacgccgccgcccttcatcacctccttcaccgagctgctctccagcgcaggggacatgctaggagccggcgccgatcaggagcggtcgtcgccgagggggctgttccaccgcggcgccaggggcgtgcccaagttcaagtcggcgcagcctcccagcctgcccatctcgccgccgcccatgtcgccttcctcctacttcgccatcccgccggggctcagccccgccgagctgctcgactcgcccgtcctgctccactcgtcctccaacatcctggcgtctcccaccaccggcgccatcccggcgcagaggttcgactggaagaaggccgccgacctgatcgcgtctcagtctcagcaagacggcgacagccgggctgccgccggcggcttcgacgacttctccttccacacggctacctccaacgccgtgcgcgcgcacacgacgacgacgtccttaccttccttcgaggaggagcagcagcagcaagtcgaaaaagccgccgtcccgtcgagcaacagggcgagcggcggcgggaacggcaacactaagctggaggacgggtacaactggcgcaagtacgggcagaagcaggtgaaggggagcgagaacccgcgcagctactacaagtgcacgtaccacagcggctccatgaagaagaaggtggagagggccctggccgacggccgcatcacgcagatcgtgtacaagggcgcgcacaaccaccccaagccgctgtccacgcgccgcaactcatccggaggtggtgcggcggcggaggagctgcaggccggcaacagcagcctctcggccgcagcggcggccggctgtactggaccggagcactccggcgccaccgccgagaactcgtctgtcaccttcggcgacgacgaggcagagaacgggtcgcagcggagcgacggcgacgagcccgacgccaagcgctggtacgtacgtgatcccgcccgagcgagcgagcgagattcattattcgctacccgcgggccgcggttcacaagttgagcgtgtattactactgtttcctcgtgttcctgcaactcatgtatatatgtctgcttgatcaggaagcaggaggacggcgagaacgagggcagctctgcaggcgccggcggcaagccggtccgcgagccccggctggtggtccagacgctgagcgacatcgacatcctggacgacgggttccggtggcgcaagtacgggccggtcggggtgaaggggaacccgaacccgcggagctactacaagtgcaccacggcggggtgcccggtgcggaagcacgtggagcgcgcgtcccacgacacgcgcgccgtgatcaccacgtacgagggcaagcacaaccacgacgtgcccgtgggccgcggcgccgccagccgagctgctgctgctgcgcggcggcgggttccggggccttgatggccaccggcggcggccagctcggctatcagcagcagcagcagcagcagccatacaccctggagatgctgagcagcggatcgtacggcggcggcggcggcggcgccgccgccaaggacgagccgcgggacgacctgttcgtcgactcgctcctctgctagcgtcgatggtcggtccacccaatctcgctgcggcgggcgtctgtagtgtagagcctgcgttacgtgtacggcgcgtgtacgtatacggccgtagcgtacatgctcgccttcgcactcagatgcacaatataacacacacacacacgctgtatacactggatcctaggtgttttttttagcttagctaggaatgcaaatttcttgattcgttgaa

SEQ ID NO: 1086 - DNA, 462 bp, Zea mays
catgctccggccgcgcgtggtcgcggccgaggacgagccgcgggacgacctgttcgtcgactcgctcctctgctagagctggcgagggggatgcggagccggtccaccaatctcggtgcggcggcggtgtctgtactgtagcctgctgtacgtgtacggcgggggtatacgtagcgtgcacgctcgccttcgcattcagaattcagatacgtccagtatacacacacacgcacacacaacacgctgtgtgcaccggatctaggttagctaggaatgggaatttgttgattcgttggaggccttcctgccacgcgcgcacggcacggtactcgtacagacagtcatacggttgtgtcgttttgtagttgtagcaacggtgccgctgccgcctgtgtggaaaggccctataccgtatatatagtttggcaaagtcaataaagctgaaaagatcgcgttatttcc

SEQ ID NO: 1087 - DNA, 4051 bp, Zea mays
atggaggaacctctgttggaccatgaatcttcttccttatctgaagcaacaggtcgtagatcacttttctcagatgctggattgtttagtaatatcaccttttcttggatgggtcctttacttgatcttggcaagaggaaaacactagaccttcatgatgtgccattcttggatgacagtgacagtgtccacggaatcacccctaagtttaaatcaaagattgcctcgatttctgccacagggcaatacactgatgttacaacagttaagttagtcaaatctcttgtgctcacaacatggaagctaatcattatcactgcagtttatgccctaatccgtaccgttacttcatatgttggtccctatctcatcgagcacttcgttgactacttaaatcaaagcacacgatccactaaaagaggataccttttggtgttggcatttgttgctgcacagctgatggaaggtctctcatcaaggcatttgctctttagatctcaacaattaggcttgcgcgtgcattctgctcttattgcaattatttaccaaaagggtcttgccctctccagccaatccaagcaaggtagttcaagcggggagctgatcaatgttgtgaacattgatgctgagcgagtaggagatttcaattggtctctgcatgaactttggctgctcccagtgcaaattagtctcgcaatgattatcttatactctactcttggcttggcatcattcgctgcccttgctgcctgtgttttgacaatgttggctaacatacctttggggcggattgagcaaaattaccaggagaaaactatgaatgccaaggatgctagaatgagtgctatgtctgagatattacagaacatgcatattctcaagcttcatggttgggaattggttttcttgtcaaagattaaagagataaggaaggttgagatgaactgggtaaagaaatatgtctacacctcatcaatgcttatatctgtatttttttgtgcccctgcatttgttgctatgatcacttttggaacttgtataattatcggcatcccattagaaacagggaaagtattatctgctctagcaacatttaggcagttgcaaggtccgattcacagtctgccagacgcgatctcatcaatcattcagacaaaagtatcacttgacaggatatgttcatttctctgccttgaggaattagcaagtgatgcagtaactaagcttccgagtggtagcaccgatatatccattaaggtgagaaatggtagcttctcctggcaaaaattctctcaggtgcctactctccaagatctggacttgtgtgtgcaacaaggaactagagttgctatctgtggaactgttggatcgggtaagtcaagcttattgtcttgcatacttggtgagataccgaagttatctggagaggttcaaacttgtggtacaattgcttgtgttagccaatcaccatggatacaaagtgggacaattgaagaaaacatacgttttggtacacaaatgaacagggaaaggtacaaaaatgtccttgaggcatgctgtttaaataacgatttggatatattacctttgggtgaccaaacaattataggagaaagaggaatcaacttaagtggtggacaaaaacagaggatacagattgcccgtgctttgtatcaagatgctgatatcttcctatttgatgatccatttagtgcagttgatgctcgcactggactgcacttgttcaaggagtgcttgctagaatttttagcttcaaaaactgttatatatgttacccatcatgttgaatttttaccttcagctgatcttatcctggtcatgagagatggaaaaataacacagtcaggggattacactgaaattctgaaatctggagaagatctcttggaattagttgcatcccataaagatgccttatcaactttagacatgctggagcgccctattgaaaattttgagagtacatatcatcctggtggcaatgaaagtaacctgtttatagcgggggataagaaagaccagaacgaggaaggagatattcaaaatggtcagctagtacaagaagaagagagggagaaaggccgggttggatttattgtctactggaagtatattatgatggcatataatggagcacttgtgccacttattttgctagctcagataattttccaagttcttcaaattggatgcaatttctggatggcttgggcagcaccaatatctgaaaatgtgaatcctccaatcagtagtttgcagatggtaaatgtgtactttgcattagcaattggtagctcattgtgctttttcattcgatcacatcttcttggcatgaccggatgtaagactgcttatattctatttgagaacatgcacaactgcattttccgagcaccaatgtctttctttgactccacacctagtgggcgaatcttgaacagagcttccacagatcaaagcacagtggatacaagaatttttgacctgatgggctatcttctatttcctgctattgagattctaggaacaggtattctgatgtcacatgttgcatggcaagtcttcatagtttttgtccccattattactgcatcgctgtggtatcagctgcaggaattcggcacgagcacacactccaacttttagcaatactacatagatgcagctagagagttgcaaaggttggttggagtttgcaggtcccccgtgcttcaacatttttctgaatcaatggctggctcaaatataattagatgctttcaaaaggaaagacaatttatccgttatattggatatttggtggataatttatctcgaccaagtttgtataatgcagccgcaatggaatggttgtgctttcgtttggatatgctttcatcctttgttttttccttcacattgatacttctggtctcttcaccatctgctttaattgacccaaagactgctggtcttgcggtcacttatggactaagcctcaatatgctacaagggtgggctattgctgtcctctgcagtttggaaaatagaatgatatcagtggaaagaatgttgcagtatacgactattccttcagaaccaccacttacaatatcagaacgccaaccaaatagacagtggccaacaaagggcgaaattaagtttcttaacctccatgttcgatatgcaccgcagctgccttttgttctaaaaggcctgacgtgcaccttactcggaggaaagaagacaggtattgttggtagaacaggtggtggcaaatcaaccttgattcaggcactatttcgcattgtggacccatgtattggccaagtgtttatagatggcactgacatctgcaccattggactacatgacctccggacaagattgagcatcattccacaagatcctgttatgtttgaggggaccttgcgaaccaatattgacccccttggggagtacagtgacgagaaaatctgggaggcattggattcatgtcatcttggggatgaagttagaaagaacgagcttaagcttgactctacagtgacagaaaagggcaaaaactggagcacaggtcagcgtcaacttgtgtgtctgggaagggtgattctgaaacggaggaagatcttggttttggatgaggcaacttcatccgtggatccaattacagacagcttgattcaaaaaaccttaaaacaacaatttctcaaatgcacaatgattacaatagctcaccgtatcacatcagttcttgatagcgacaaagtcttgcttctggataatggtgaaattgcagagcatgacgccccagcaaaactgctagaggacagttcatccctattctccaaacttgtatctgagtataccatgggatctgataagtggcgaatgcaagaaagcagctaaatcaatactctacagataatacaggacaaacgccctaggaagtgtgagtatctacgtgtcaccaattttatagcttaataaagcaattttttaaaaaacaaaaaaaaaaaaaaaggcgccgtcttcgcgacaagttacgacg

SEQ ID NO: 1088 - DNA, 1745 bp, Zea mays
ataccataccacgccacagcagcatatatgccactgcccaggcagccagccatgccgccaccaccccgatcccggcacagaactcagtgccagacgcggacagcgagcgcgaccacatctatctaggacccgtatctctctctctcctcccgaccagcacgtcacgtgccacggacaggggtcaagcgcggtcgccgatgtcggcggcgggcggcagcggcagccgcgcccgcgccacctcgcggcccgcggcggcagcatggctgctgctggcgctggccacagcagcagcagcgtcggcgctggcgctgccagcggccgcgggcggcttcagctgccgtcctgggtcccggccggtgctcttcaacttcggggactccaactccgacacgggcggcatggcggcggccaaggggtggcacctcacgcgcccggagggccgcgccttcttcccacgccccaccggccggttctgcgacggccgcctcgccatcgacttcctctgctaacatttagttgggccccaaattgcatccaggcgaaagcttgaacatcagctatttgagcccatttctgaaggcgttaggctccaattacagcaacggtgcaaatttcgccattgctggcgcagcaacgcaaccgcgagatgttccatttgcgttgcacatacaagtgcaggagttcttgtacttcagagatagatccttggaactcatcgatcaaggtctaagtggtccaattgatgcacaaggattccaaaacgctctatatatgatagacatagggcagaacgatgtaaacgctcttctgtcaaacttgccctatgatcaagttattgccaaattcccaccaattcttgctgagattaaggacgctgtccagactctatatagcaacggtagccgaaacttctggatacatgggacgggggctctgggttgcctgccgcagaagcttgccataccaaggaaaaacgacagcgatcttgatcagtatggctgtctcaagacctataacagagctgcagttgcgttcaacgcagcgctgggcagcctctgcgacgagctgagtgcgcagatgaaagacgcgacgcttgtgtacacggacctgttccccatcaagtatggtcttgtcgccaaccacactaaatatggttttgacaagccgctgatgacatgctgtgggtacggagggcctccctacaactacgacttcagcaagggttgccagtctaaggatgtggcggcctgcgatgacggctcgaagttcgtcagctgggatggcgtgcacctgacggaggcggccaatgcggttgtggccagagcgatactgagctcacagtactccaagcccagtctcaagtttgatcagttctgcagagcctgatacttgttagtacctcataccgtgcctttttagtttaggcaaatttactgaacacaacttggcacttcaaagtcaaaatggatggatccgcttctgataatttgattgccttatttacccgtcagggatgtgacccatcattgatctgtcagccatagcccataggccataactttggataggtgaaacttccaaatattgtgggccacatgtaccttcaaactacatgtcctatctgatatgttttcatcaaagagagaaatacaccatgggttatcaaaaaaaaaaaaaaaaaaaaaaaaaaaaaaaaaaaaaaaaaaaaaaaaaaaaagggcggcagctcgcgatctagaactagt

SEQ ID NO: 1089 - DNA, 3544 bp, Zea mays
  misc_feature (3014)..(3014): n is a, c, g, or t
gacgttgggaaggacgcatacgaagaggtagatttagtcaccaagggtggaaactacggatggcgtgtatacgaggggccatacatctttcacccgcaaaagtcgcctggagggaatacttcgcctgagtccataaacgcaatcttccccgtcatgggctacgaccattctgctgtgaacaaggaaatcgggtcagcatcgatcacaggcggatatgtgtaccgaggttccgctgacccctgcttgtacggaaggcacgcctgcagctagtgcccagcaaagcacctgcatacatatatttcttaattttttccccatatatattctctgccaggtacctctacaccgacctgtactcatcgctgatgtggacgggcacggaggccccagaggggagcgggaactacacgtcggccgtgaagccggtgagctgctccaaggcctccccgatcggctgcgagtccgtcgccgggagcacggacccgctgctcgggtacgtcttctcgttcggggaggacagccgcaaggacgtcttcgtcctggcgagcaagggcgtgtaccgcgtcgtcaggcccagcctctgcggctacacctgccccgcggagagaccggcgaccgacaacggcaccgcgccaggtccaggcgggccgtcgtcgggcgctcccgccgcgacacggctagggaggtcggtggcggcggtagcggtagctctggcgttgatcccgtgtgtgctgttactgtgaccttcagatgtgtgtctcgtgcgatgtagtaggatcagtcgtagctgaagctactgggagctggaagagtacatacgtatagcgtgagtaacgaacactcaaaaacagttgtgctatgtggatgcctctggacaagacaaagagcaatgggtagttttggcgcggcgctggaacgttcggttcaggaaagggttgttggaaggcgcggaggaatcagctcttgtccccaacgcagcagcggctcctcggttctggccacggggaacgtcgctctcgtctggcggctgcgcgtcctcgtgctgggacggaatgccgtcgcgccggccccgtcgtgtcgtgcggaggcgtggccgcccaaacggggaaacaggagcaatatgtgctctgtttaacaattcgacagcagacggatcacaacgcaacaaaaatccaatgatgcgatcctcgctgtcaacgttcgtcggttgtgttccaactcgcgggcctggccggactgtataatgggtacacaatgggatggtgcggtaggtgtaggcactgcacgcacgtacgcggctcccgtgactgcgccaggtacgtttgtacgtgtagggcttagaaccttgtggcggcagagcaaagattcgggctcgatttcgcctcgcacaccgccgctggcgtgactgcgttgggaatgtttctgtttccggaatggggagcgtcctcgatctgcttgcttgcttgctacggtcgtgtcgtgtgcgccaccacgttggggcccagccggccatcccaactgctcgagtctctgaacgacctgttggtacggccggccaggcctgccttccggacggtaccacgcatttgctgatttgcccattgcacttgcacgcacgtcgagtcgagccatcgcgccattagtagggccggccggcaggcggcagctcaatccatatcgtgtctcgtctcgtgccgtgcctccttctcacacagcgccacgacttacgtgattacgtcacggttccgatgccaatgccatgctggcacgacacgacgaaaccataaagagcgcgacccagccttgccggcttctccactctccagtgccctgccaatcccccgctctcccgcctaccgccaggcccaggcgccagcctccaaagtccaaacccagctagagcttagagctagcatggagtccgccgccccgtgcccgcgcgcgcacgcgcaccccgtggacctccgctggctgctctccgtcgccgccggcggcctcttcgcgctgctgctggtgctgctggccacctccccgtcgttccggctcgcctccacctcgccctcaccccgcctcttcctcggccccgcgtccggctcctcccgggcgcgcccaccactcttcgtcgagcccgccctgtcccgcccggcggcgccgtccccgcccgcgtccgcctcgctcccgcgcttcgcgtacctcatctccggctcggccggggacgccggcatgatgcgccgctgcctgctggcgctctaccaccccaggaaccgctacgtgctccacctagacgcggaggcgcccgacgccgaccgggccggggctggccgccttcgtcgccgcgcacccggtgctcgcggcggcgcggaacgtgagggtggtcgagaaggccaacctcgtcacctacaggggccccaccatggtgaccaccacgctgcacgccgccgccgcgctcctgtggggcgagggcaggggccgcggcgccgactgggactggttcatcaacctctccgcctccgactacccgctcgtcacgcaggatggtaagccactggtttccccttcccttgcctctctgctccgatggcgcgcgccatgaccggtgatggtcggggttgttgtcctgctgaacctgtgtgacgacgagtgacgacgcttctgcctgctgcagatttgcatgcatgtgttctccaagctgccgcgcgatctcaacttcatcgaccacacgagtaacatctcctggaaagcgtacgtgctctgctctcgctcgcattggttgcagacttgcagctcctatacgtgcgcgtgcgctctcaacggatctttgttcttggcgctactgagattatgtatgatatcgtcaggtttgcgagggcgatgccggtgatcatagacccggcgctgtacatgaagaaaaagggcgatctgttctgggtgccggagaggcggagcttgccgacggcattcaagctgttcactggtgcgtctactgctctctctctctctctctctctctctcnctctctctctccacccgtgattgttaacctgacattgacagagcacactcattcattcagtgctagcacccaactactaccccatcgcacggtcgcagtgcctatatttgtgtcatctttctctgtatacagtagttgattggtccacaggagaactagtcacagcatgcagctagattgttttgagttgtcgccattgtaagaaactgaactgtctgaatgatgaagcgattagcactgcctgagttggttgagcagcaggaagttgcaaagccctagcgtgctttgaatgcttttgatttcgctctcggtggcaactcgctagagagtctgttccttgtggacaagagcctggacccttccctctgttattttggataagagaagaatcgaaataaagatgaaatgcatgctaaggagtcagggctagcttgggaatacaattttccaaagggatttctattttgccaaaagaaaataaattaattttcttttaaaacatgaaaatcctttgaaagacctgccgaacg

SEQ ID NO: 1090 - DNA, 920 bp, Zea mays
  misc_feature (50)..(50): n is a, c, g, or t
  misc_feature (93)..(94): n is a, c, g, or t
  misc_feature (900)..(900): n is a, c, g, or t
  misc_feature (918)..(919): n is a, c, g, or t
ttttttttttttttttgagcctaaatttatcgagcctcatgttttgaccntgaagttttctgcactctttctgaaaacgctggctgatctttnngctttgccttggacttgtaccttacactgttacacatgagcaggacgcatacgaagaggtagatttagtcaccaagggggtggaaacttacggatggcgtgttatacgaggggccatacatctttcacccgcaaaagtcgcctggagggaatacttcgcctgagtccataaacgcaatcttccccgtcatgggctacgaccattctgctgtactcatcgctgatgtggacgggcacggaggccccagaggggagcgggaactacacgtcggccgtgaagccggtgagctgctccaaggcctccccgatcggctgcgagtccgtcgccgggagcacggacccgctgctcgggtacgtcttctcgttcggggaggacagccgcaaggacgtcttcgtcctggcgagcaagggcgtgtaccgcgtcgtcaggcccagcctctgcggctacacctgccccgcggagagaccggcgaccgacaacggcaccgcgccaggtccaggcgggccgtcgtcgggcgctcccgccgcgacacggctagggaggtcggtggcggcggtagcggtagctctggcgttgatcccgtgtgtgctgttactgtgaccttcaaatgtgtgtctcgtgcgatgtagtaggatcagtcgtagctgaagctactgggagctggaagagtacatacgtatagcgtgagtaacgaacactcaaaaacagttgtgctatgtggatgcctctggacaagacaaaaaccaatgggtagttttggcccggccctggaccgttcggttcccccaccaaaaaaaaaaaaaaanaaaaaaaattattaaagnng

SEQ ID NO: 1091 - DNA, 4130 bp, Zea mays
  misc_feature (1)..(1): n is a, c, g, or t
ngtttccagccactttgcccaccctccgctgtccgtccgggctacccatttcgtcgcagtagtcggcagtcgaaaccctagtcccctcgctttccttccactcgccgtcgcggcgccgatagagccagagctgaaaggcgtaggaaaagctggtggaggaggggatggaccggatcgtaggcagcaagtacaagctgggtcgcaagatcggaagcggttccttcggggagatctacctcgcgacgcacgtcgacacctacgagatcgtcgccgtcaagattgaaagcagcaaaaccaatcatccacagttgctatatgaggccaaactgtacaatgctcttcaaggagggactggtatcgcaaacataaaatggtgcggcattgacggcgatgaaaacattcttgttattgatttactcggaccaagccttgaagatctgtttgtttattgtggccggagattctcactgaagacggtcttgatgctagcggaccagatgataacaagaatagaatttatgcattctaaaggctatctgcacagagacatcaagcctgataacttcctcatgggccttggtcgaaaagctaaccaggtttatgtaattgacttcgggcttgcaaagagatatcgtgattcagccaccaaccgccatataccttatagagaaaataaaaacttgactggcacagctcgctatgctagccgtaatactcatcttgggattgagcaaagccgcagagatgatttggaatcgatcggatacgttcttctgtatttccttaggggaagtcttccttggcagggcttgaaagcagccacaaagaaacagaagtatgacaaaataagtgagaagaagctttcgactcctattgaggctctatgtaaatcccatcctgtggaatttgcttcctatttccactactgccattctctgacatttgatcagcgtcccgattatagtttcttgaggcatgtctttcgagaattgtttgagcgcgaaggctatcaatttgattatgtgtatgactggactttgttgaagtgtaagcaatcccagaaggctaaggttcagcaaggatgctctcatgatgcaggcgtaagcagccgtccagttgcaacaaacgtggacaagcaccaagttggtgttgcacgcccaattaatgcttcaggtctgcttgaagcagaacaacgcccggcaatcagaatgcaattaaacagccgttccaataatctgcatcctgagagattgggagtgtctgctagtcataataatgtactgctgcaatccacgtcacttgacaatgctgatgctccaatggaccacgcgacacattcaaaagcacaggggtccattgatccacacactcgtggaagttatagtccagggccctctaaccgcacttaaccttttgcattgttcgtaaaagcttgcgggtccatgcagtaaacaattggatcctttacaaacctaataatggtgacacattctatgcataatgaaaatttggggtttcacctggatagctttcattttaattacgggctgcagcagtgcgacaatgtgcattctacttggattgagttacaactttttaacttgtataagcttccattgtgttgaacacaaaattacaccccgctcgaccccgcgttgtgccatcggggaagtttatgattggttagcatgcacattcaatgacatatgcatgcatcagttaggacaacgcctcttcgctaaaagtgaatatccgaccagtattgacctgcagtttccagtgtcttgacaccaaatcgccatacaaaaactacagagtggtggtatatgggaagttcatggttggttagcatacaccctctttgctgaaaggctgtcatattctacttggattggccgcagcttgcaatgtatgacaccaaatagcaccatacaaagactatgaagaggtctgggaagcttatgattgggtagcatccatgtatctataactgtgaccgcaactttgaagaaacacatgctgtggctcatggcctcgagataaaaaaaggttaaattgcaatcgacaacaatctggttgggcagaggtaaatatcatgccgtgctcctgtcatagacatggttgcctgtattttatttgaatgagggttgaatagcttataacattgtgaggaagtcctaccacatattgatttttcatgttggtgttttttttgttggcattctctctccagttgtcataaaaacaatgaactgtacataatttcttagaagggctgttcttaagtgttgaggtggaatgagatgatttacttgataaaagtgtacatatttaggtatccctcatttttctgattgcatcaatatctttcaatgatataacgctggttccgaagtgaatgtttttttagttataaaaaggatgaactgtatctaggagtggagccatctttatactttgtcgagtctgaacagcacttcgccagaattcaaaactgcccaatttattcatgcatttgttgtgcgacaacatgaaacagagcagaatgttaaagtccagctttagtcatcgcgcttataacattcctggtttaactatatagtcgagttcttgaatttggcaattttcacagctggagccgccttagtctaacgcttgttcttgttttcgagacagaatcctgttcgcagagtgtttgagctcatttgttccttggcaaagtcgatgtcgttgacgaacacctgcattacgaattacgatatatgaacaccgtaggaagtttgtcgaaaagcgaagggaatcatccttctctatagtccaaaaacgtcggtgcattggatagtaccgatttcactcatcagggtccaggatggatgtgacatgcattggtgtggattgatccctggcaagggcaatggctcacaactcagcatcatgttgtgtccagagaagcatctcagctgcagggacctagcgcgaagaaaaccagattgcacacctgggcatatgcaattccccttgtcatactcggtgtcggtgacaccatagttgtaggtatgctccagcgttcagggctccagcgttccaggcctctcaaacttgtagccgtcacccgtcagggcccacaccacgaaggcgatgacgctcttgctgccctctttatgagatctcaattgtaaccgatcgacggggaagttctaggtttgccaacagcactgctcgacgacgaaatgcgattccgcgggcccgtattcgaggaacgcgtcggtttacttctcctcagcctcaggtatatatgcccatcttgctgagcagcttcatcccccaggcacccggtttagaacatgcgttaatttgtataatctgtttcagctcagacttcagagcggactgtgacttgtattgttttgtggtaacgcatacgtacctgattgtctttgtcgacgccgccgacccggtagatgacatgtcctttctttgcccacgagaaggcctcggatcttttgccgccgcgccggccacgttactggtctcgtcctggccacctgagctgtaagctgcgctgcagcggtggagaggaacaacgacctccgggcccgcccggggcacgggcgtggcgcctgcagtaacgtgcatgaacgtacctcatccttgacgtgtggggccgaccggtgcctggccccatacgtcaaaaggatgttactgtagaggatttgattccgacgtggctgtgcacgcgacagcccccgcggccagtcctcgtcgcagtgtctgctggtcgaatcggtttgcctggcgcccctttctcgtgccatccttaattcctggccgcttcggagtggtatcctgcatagtatttggtgcggacggttgtgtacgctgccaagtgctagaggccgactgaacccggtaccgaatagtttggttttatatgagaccaagtataataagatatataggctggatgtaaggcatagagtaccacattagatttacggtgacgtgaaagagagaataaaagtgggtgcttattaatagccagctaacatcaggctgcttatggactccaacacaattacacaatatgtgagaggaagaaatagaccaaccattaaatgcaggggtcgacc

SEQ ID NO: 1092 - DNA, 802 bp, Zea mays
ggggatggactagttttgtgttgtatataggcagaaaaccatgggcacagattagtcggacccaagtgcggattttttttttttttttggcaaacccaaatattgaccagacatttcaattactgatgaatccaatattgttggctgcttatgtaaccgtaacccgtatacgtcattggcctccccaaaataaagtcaccgaataaaggaatcaatgtatgcatataatcagcaaaagacaacttggatgccaatttatgcagtctcctcaccacatccccacgggacgaatgcatggagatcaaagctctctctagcacatataggtccaccgctttgtcctcgccctcgggaattatttatataaaactcagaccgaaatcaataagaaccaccaattaattgttacagttctaaatcaccatgaacaaggcctccatcatgtagtttgccgacgacgtttcctatctgtgtgatactaatatcatccaggcgttcctcgttaaccccatctgaaccaaaaccaagaagtatatccttgacagacaagccatccacatactgtcaaagtatgcagaagtggatccacagcataaagtacaggagtaggaacaccaagccttcttgcttttgtgatgcacgagcttccttcaggaggcgctatcgaggtaaggcacgaaactgatcttcaggagtcctgactcctgagagatacgcgaggtcaggcctgctgcggcaggtcgcgctcgcgcctcggcatctcaccgggcggcggggacgggtatggtatggaggcgctgtt

SEQ ID NO: 1093 - DNA, 4255 bp, Zea mays
  misc_feature (126)..(126): n is a, c, g, or t
tgaggggaactatcttgcttgggggggtggtgccaggcatcacaagatgtaattttcaacctgaccgaaaaaaagagtccttgtctaaggaataccagtccttgagtgagaagtacaattccttgngaagatgagaatgatactgttcttgaagaatgcatgatgctcgagaaccggtgcctgttcgttaggggacataataatgagattgcatctgcattggcttctcttaccaatgagatggctttgttgagtttggctaagagcgatcttgatcttcaagttgatgagctgagcagaaggtcagtggcgcatgaatcagaaaatagtcacttaaaggagtacatcatatacttggtagagattctcagaactcgattagtcctttcagagtttgatttggacaccaatcaaagtgtctgccaggagttggttgttaaacttgagaattgcatgacacagctggcgcagaaggatggtgagctaatggaagcagaggaggaagttcaactattgcaagaaaagaaccaggaactctgtggagttgttagatctctacaggttgcaactgaaggtgctaaagtggtggaaggagaactggagaagaaaatcacaagactgattgaacagtgttcttgcaaggatgtcgaaattttacttcttcaccaagacaatgaggcattgcaatcagaagttgagcaatgtgagagggaatttgttgttctgatggatgatgcaattacctcttcagtgaattctgcggtgtatgaagaaacagcattcaagcttatgatgaatggtaaagctacagagaatagagcaatatccctaaaggagttgctaatgaaggaggtctcttcccgagatgctcacattgaggagttgcagaaaaagttggctggcattcaggacgaacatgcagaactaaaagctgagttgaacacacatctagctctcgtagcatcattggctgatcatgtcagtgtgttggaagaagattgccgttctctgtcaaaaccctgtagtacagaagacaaagaggaaaccgcatgtgtacatcatgttcaagagggcaatgatgggctggaatctcattgcttacccaaaggaactccagagttacaagggttgattgcaagaatagaagcacttcaagtagttgtatcaaatgctaaagatcgtcaagatcaggagtcagctgagtctgcagctaaattggcggcagtaagtgcagaaattcaagaccttaaagcaagaggtggctcacgcatggagggaaaagaaatatattctgatcatgagaaacaagatgttgagatctccaaagggaagcaagtccagatcatgaaggatattgagctggaccaaatatccacttgtccaccatatggtgctcgagctgccctctatccgcttggaactggtgcaaatgccgaactcgatgacgatatgcttcagctgtgggaggctgcagagaggagctgcaagaaccaaacggccaagtcctcgtcatctgagcacgacatacaagccgtcgaggatctgaagagtgagcacccttcgtctgagctagcaaggggaagagaccttggaatcaataagctagaagcgtcgaagggagctgcagagcctcatgaggcgtggagcaagaacgtacttgagaggctcacttctgatgctcagaggctgttgagcatccaagcgagcattgaagagctgaagcagaaaatggaggggcagtcaaagggaaaatcccctatgaactctgagtacagcagtgtgagcgctcaggtgcatgagacagagggccatgtcttggaacagatcaatctgaacaacaaattgactaggacggctgagaactaccccacactgtcagataatatgagcaccgagcgagaagggtattccagcaggaggaagatctccgagcaggtgcagaaagggtcggagaatgtggcaaggttggaactggagcttcagaagattcagtatgtcttgctgaagcttgaggaagagcacgagtacagaaggctcaaagtctctgataagcgcactcgcgtgcttttgagggactatctgtatgggaggaaggaccgcggtggcgggcagaagaaaaagaagagggtcccgttctgtggttgtgttcgtccgaaatcaagaacagagccgtagcctttctttttgttcgacctgcacctccaagtggtagccgtagtccgaaatcaagaaataaaacaaaatcgacctgcacctccaagtggttggctaagtgtcgcctgtgcattggaagaggaggtggtgttcctaggatccctttgtaattgagttagcattttagtatcttttttcttttatttttgaaactagcattatagtatcctgatgaagaagcttatgtactaaattttttgttttcctgtctaaatgaggccattctggctagtttaatgcgttaatactgtcgtatatcaaggcgttctctttccatctataatagaaaaaacgcaacagccctgcgtgtcattatattaagaagaaaaaaagaacataggagagacaagacttgtcaacccctaattacaaaggcccctaggccgagacccctccggcaataacacaacgcaccacacacacaaggtaacaacccgaccaataacgactaccagcaggaaaactgctaaggtcccctagggagctggcgcagcaggaggtcctgcagagctgatgcaccagccaaacaccagacgttgccctcctcaatcacagcactctgaactcgctgggtgcagggcacaaccccctcaaaaacacaagcattacgatgcttccaaatctcccaagcaaccaaaatgatcaaggaattaagaccttttcttagactcttctccactttcttgatactttggcaccaccaatttgagaaacgagtgcatccatgctgaggcacaatggcaaggaggcctaaattgtgtagcatggacgtccatatctgccgagcgaacacgcaggagacaagagtatgctggatggtttcctcggcctgatcacacagagggcaagcaactggatggggcagacctctttttgcaagtcgatcagctgtccaaaccctgtttttgattgccaaccatacaaagaatttgcatcgtaagggggcccaggtcttccagacacgtcgccaagggccaaaagggatagagccaacaaagagagcatcataggccgatttgctacaataagtaccatgagcagagaggcgccagatgtgttggtctgcgatgtcaggttgcagaactaccccatcaaccaagttccatagctgcagatactctactaggaccgttacagacaatcctccccgaatatctgacacccattgacgatttgtgagcccctcagctactgttcttcgctttaaagcccttctagaaatcacttggataagggttggacagtgttcagccacagttttaccaaggagccaacaatcagaccagaacttcacagattcaccactgcctaccactgaggtaatagccacatcaacgagggcctttgcattacggtgcactcggatagggagaccagcccatggccttgacgcgtcagtcttttgtaaccaaagccacctggcacgtagggcccatccaaacatctccaggttgagaatacccagaccaccatacttgagaggccgctggacagcttcccaggacacgagacagttacctccatttgcatcaccttgccccttccaaagaaagcctcgtctcctcttatcgattgccttaaaaacccatttagggagttctaaagcaagcataagatagatagggacagaagacaacactgtcttaaccatgacaagacgaccagcccggctgagaagattagctttccatcctggaagtttatcagcaactttatcaacaagcggcaggagatcagagttagcaagcctatggattgatagaggaatccccaagtaagtgcagggaaaattttttgtagcacatggtaataaggcagaaatggtggtcagctcattcgctccacattgaatgggtgtaacagaacttttggagatgttcgtttttaacccagtagcatgaccaaagatgtctaaaatgctgataattgctgagatatcctgatgagagggccgcatgaacaaaacaacatcgtcagcatagaaggagatacaatgtttggcatgttgatttgcaatcggctgcaggtcgtctgtagagga

SEQ ID NO: 1094 - DNA, 1418 bp, Zea mays
tccaccgccctctttttttttttttttttatttttaaaacttctcccacttccggatgaaacggcactctgcttctgagttctgaccaaatggtgcagccatgcaacatagttccagatttcacaaacgttacagcagccaaagccactcaccgctaaaaaaaatacagcaatggtggtacatcactctcgttttagacgacggtctttctaataacatacatccattgcatgccacatatttttcttcttctccattcatccgaccatggtgcgcttcctgccccgttgcctcacttgagccagcttgttctgggtggagcaccattgcttcgaagcctttctgtacgcagccaggattttctccatcacatccccacaggacgaatgcatggaaatcaaagctctctctagcacatataggtccaccgctttgtcctcgggaattgtcgaagtgaaactcagcccaaaatcaataagaaccaattgattgttactgttcttaattatcatgtttgacgtggtcaaatcaccatgaacaaggcctccatcatgtagtttgccaatggcatttcctatttgtgtggcaatatcattcaggcgttcctcattgaccccatctgaaccaaacctaagaagtatatccttgacagacaagccatccacatgctcaaaggtcaaagtatgcagaactggatccacagcataaagtactggggtaggaacaccaagccttcttgcttttgtcatgcaccgagcttcagcatttaagcgctttagagtcaacttcgagtccaacaatgggtgtcggtacttttttgaaaaacgctctttgattacacactttcgtcccacaaatgtcgaagcaaataccctcccttctgcaccttgcttcagcagtacgccaaaatcctgttcttgctcttgagacatatccatgaagcctaataaccccgcgtttctatgcttcgggaggccgctgctactgggaggtgtgccaggcctccgggcagcgaggacggggagatggacgttgcggttgcgacagggttgagcgatgaacctcaacaagattgaggagttgcagaaaaagttggctggcattcaggacgaacatgcagaactaaacgctgagttgaacacatatctagctctcgtagcatcattggctgatcatgtcagtgtgttggaagaagattgccgttatctgtcaaaaccctcagtacctcacgacggcagacgggctggctgacggcgcgacctcagagctggcggcggcggacgcggccacggatcggcgacggctggcggcgcgcagggaagcgcggctgagcgggtctccaagcggtgacgggctggcggcgcgcaggtttccaaggatctccaatcggtgacgggctgacggctggcggcgcgcag

SEQ ID NO: 1095 - DNA, 855 bp, Zea mays
  misc_feature (47)..(47): n is a, c, g, or t
gatgttactgtctaattatcatgttgacgtggtcaaatcaccatgancaaggcctccatcatgtagtttgccaatggcatttcctatttgtgtggcaatatcattcaggcgttcctcattgaccccatctgaaccaaacctaagaagtatatccttgacagacaagccatccacatgctcaaaggtcaaagtatgcagaactggatccacagcataaagtactggggtaggaacaccaagccttcttgcttttgtcatgcaccgagcttcagcatttaagcgctttagagtcaacttcgagtccaacaatgggtgtcggtacttttttgaaaaacgctctttgattacacactttcgtcccacaaatgtcgaagcaaataccctcccttctgcaccttgcttcagcagtacgccaaaatcctgttcttgctcttgagacatatccatgaagcctaataaccacttgaaacaatgcttcgggaggccgctgctactgggaggtgtgccaggcctccgggcagcgaggacggggagatggacgttgcggttgcgacggggttgagcgatgaacctcaacaagctcagtacctcacgacggcagacgggctggctgacggcgcgacctcagagctggcggcggcggacgcggccacggatcggcgacggctggcggcgcgcagggaagcgcggctgagcgggtctccaagcggtgacgggctggcggcgcgcaggtttccaaggatctccaatcggtgacgggctgacggctggcggcgcgcaggagccaggagaagccggactggcggcgcgcaggagatggtgcgcgtgcgcccgtgcaccgtggggagaagcagt

SEQ ID NO: 1096 - DNA, 1951 bp, Zea mays
  misc_feature (1543)..(1551): n is a, c, g, or t
  misc_feature (1622)..(1626): n is a, c, g, or t
  misc_feature (1662)..(1683): n is a, c, g, or t
  misc_feature (1778)..(1800): n is a, c, g, or t
  misc_feature (1802)..(1804): n is a, c, g, or t
  misc_feature (1910)..(1925): n is a, c, g, or t
gtctcttcaggttgcaatcgaaggtgctaaagtggtgaaaggagaactggagaaaaaaatgacaatgctgattgaacagtgttctagcaaggacgacaaaattttacttcttcaccaagaaaatgaggcattgcaatccctcgtggcccgccggggggggggttctgttgatctgatggatgatgccattactttttcagtgaattctgctgtctatgaagaaaaagcattcgagcttatgatgaatggtaaagctacagagaatagagcaatatcccaaaaggagttgctaatgaaggagatctcttctcgagatgctaatattgaggagttgcagaaaaggctggctggtattcaggatgaacatgcagaactaaaagctgagttgaacacacatctagctctcatagcatcattggttgatcatgtcagtgtgctggaagaagatgttcgttctctgtcaaaaccatgtagtacagaaggcaaagaggaaactgcaagggtacatcatgtgcaagagggcgacgatgggctggaatctcattgcttactcaatggaactccaaagttacaagggttgattgcaagaatagaagcacttcaagtggttgtattaaatgctaaagatcgtcaagatcgtgaatcagccgagtctgcagctaaactggcggcagcaagcgcagaaattcaagagcttaaaacaagaggcggctcacgcatggaggcaaaagaaatatgttctgacaatgagaaacaagatgttgaggtctccaaagggaagcaagtccagatcatgaaggatattgagctggaccaaatatctacttgccctccatatggcgctggaggtgccctctacccccatggaactggtgcaaatgctgaactcgatgacgaaatgcttcagctgtgggaggctgcggagaggagctgcaagaaccaaacggccaagtcctcgtcatctgagcacgacatacaggcggtcgaggatctggagagcgagtgcccttcgtctgagctagcgaggggaagagaccttggaaccaataagctagaagtgccaaagggagctgtagagcctcacgaggcgtggagcaagaacgtgcttgagaggctcacttctgatgcccagaggctgttgagcatccaagcgagcatcgaggaactgaagaagaaaatggaggggtcctcgaagggtacgaattctgagtacggcagtgtgagcgctcaggtgcatgagacggagggtcatgtcttggaacagatcaattccaacaacaagttgactaggacggctgagaactaccccgcactgtcagataatatgagcaccgagcgagaagggtattccagcaggaggaagatctccgagcaggtgcagaaagggtcggagaatgtggcaaggttggaactggagcttcagaagattcagtatgtcttgctgaagcttgaggaagagcacgagtacagaaggctcaaagtctctgataagcgcactcgcgtgcttttgagggactatctgtatgggaggaaggaccgcggnnnnnnnnntggctcaaagaagagggtcccgttctgtggttgtgttcgtccgaaatcaagaacagagccgtagcctttcnnnnngttcgacctgcacctccaagtggtagccgtagtcgnnnnnnnnnnnnnnnnnnnnnntcgacctgcacctccaagtggttggctaagtgtcgcctgtgcattggaagaggaggtggtgttcctaggatcccctttgtaattgagttagcgcnnnnnnnnnnnnnnnnnnnnnnngnnncctaacattatagtatcctgttgaaatgaagcttatgtactaaatttaatggtttcctgtctaaatgaggccattctggctagtttaatgcgttaatactgtcgtnnnnnnnnnnnnnnnncttctagaacaaaccgcgggccctcg

SEQ ID NO: 1097 - DNA, 2197 bp, Zea mays
aaagctttggtggttttgctgctgatgttgtggctgcaatagatcaggcagctgaagataatgttgacattatcagcttgtccattactcctaatcggaggcctcctggactcgcaacattcttcaatccaatagacatggcactcttgtcagctgtaaaagctggcatatttgtggtgcaagctgcaggaaatactggtccttcccctaaaagcatgtcttcctacagtccctggatatttactgttggagcttctgcccatgacagggtatacagtaactatgttgtgcttggcaacaatttgaccattcaaggagttggccttgctcctggaacggatggtgatcgcatgtataatttagttgctgcaccacatgcactgaagaacaatacagccagttgtaatgaaatgtcccttggggagtgccaagattcgagtcacctagatgcagatttgataagaggaaagatactagtgtgcagctattctataagatttgtgcttggcctttcttctgggaaacaagctctagatacagccaatgatgtcagcgccgcaggagttataggcttttcccacgcgtcggttcttgggtttcaactgaacccaactccaatgcacatgcctgggcttataataccatcatctgatgactcaaaggtatttctcacttactacaatgactccctagtgagagatgggacatcaggtcaagttgttagctttgccggagttgctaaaatattagggggtctaaatccaaattatggaaattctgctccgaaagtaatgttctattctgctaggggtcctgaccctgaggacaatacactgtcaaatgctgatatcttgaaaccaaatctagtagcaccgggaagttccatttggggtgcttggagttcagttggattggattctgctgaatttgctggtgaaagtttcgcaatgctctctggcacaagtatggctgcgccccatgtcgctggcctcgccgctctaatcaagcagaagtttccttcttttagcccagcagctatagcttctgcactgtccacaaccacaactcttagtgacaggcaagggaaaccaatcatggcacagcgaacatacagcaacccagacttgacgcagtctccagcgacatcttttgatatggggaatggctttgtcaacgctaccgctgctttagacccggggctcataattgattgcagctatgatgatctcttctcctttctttgcggcataaatgggtctagcccagtcgtgaaaaactacactggcaacagctgcgtggcctccaccatgacaggagcagatctaaacctaccatcaatcaccatagccgtgctcaaccaaacaagaaccataacgagaacggtgatcaacgtggcggctgacgagagctactctgtcaattacagtgcccctaatggaactgcagtttccgtggtgccgacgcaatttttcattccaagcggacagaagcagctcgtgacctttgttgtgaacgccaccataaacagctccactgcgagcttcgggaacgttgggttccagggtaacaaaggccaccgggcgataatgccattctcggtgatctccaaggttgtatacagttcctgatgactgatgagccgagctgatgcagtggatgcaatgcaaatgcaaaccaaggcctgactgatccagcgtatgcagtgatgacttgactgcatggaggtggagcttgcctttgactagagaaattttttgttggttgtggcgtgtacattctgaagcatgttgatgtaagtagctgagtgattaaccagtaactgtaaagagaatgtactgccagatatccagaatgggaaatccttgtgcaaccagaatgttaaatagcactttgttggggtttgatttaccgatatgatgttcgtgcgatagcatcgtgcttgatagttgatgcttggtatactcaaaagtatctcggtatagaagtaggccatgctgaattgctgactatcaaacatgatcaggctaggtgctaccatggcaaagtccgctagatcggctatcaactctagtcagcccgggtcctcaaagttggagttggtcatgtcaaaattagtggatctttgctgtgtcgacttaatcagccgagagcactagatagatataaatggatctacatgtgttactgctacacatga

SEQ ID NO: 1098 - DNA, 2306 bp, Zea mays
gatgagacatcaggccaagttgttagctttggcggagttgctaaaatattaggggggctaaatccagattatggaaattctgcaccaaaagtaatgttctattctgctaggggtcctgaccctgaggacaatacactgtcaaatgctgatatcttgaaacccaatctagtagcacccggaaattcgatttggggtgcttggagttcacttggattggattctgctgaattttctggtaattgcttctgttctcgaaatgttttatgaaacttttgtaaatggccttgtgaattgtaccaacatgtaaagttttgatcattctgtgttcttaaccttgttaaaatggcacaccttttgcagatgaagaatcacaaactgtaatgttgaaacaaattgttacattacatgtattgactgattaattcttcaaacatttaaaaatgattagagcgccattgctgttggactacccagccgcccaaaacaagattttgcaatattcagttttctcaaacaaaattgtctttgcattagagtccagcactacagattttcctttcactgatagaatctgtgaaaactcccttgtaggtgaaagtttcgcgatgctctctggcacaagtatggctgcaccccatgttgctggcctggctgctctaatcaagcagaagtttccttcttttagcccagcagctatagcttctgcattgtctacaaccacaactcttagtgacaggcaagggaaaccaatcatggcgcagcgaacatacagcaacccagactcgacgcaatctccagcgacagcttttgatatggggaatggttttgtaaacgctaccgctgctttagacccggggctcgtatttgattgcagtaagttctgcagtcacctccattttgatcattttaaaaagcaaaaatatttatctgtacaaaatggacgtttctatatctatacagctaatttgtaaattattcttacaggttatgatgatttcttctcctttctttgcggcataaacgggtctagcccagtcgtgacaaactacactggcaacagctgcgtggcctccgccatgacaggaggatctaaacctaccatcaatcaccatagccgtgctcaaccagacaagaagcataacacgaacggtgaccaacgtggcggccgacgagagctacaccgtcagttacagcgctccctatggaactgcaatctccgtggcaccgatgcatttttttattccaagcgggcagaagcagcttgtgaccttcgtcgtgaacgccaccatgaacagctccagcgcaagctttgggaacgtcggtttctatggtgacaagggccacagggcgatcatcccattctctgtgatctccaaggctgtgtacagttcctgacgactgatgagccgagctgatgcagtggatgcaaatgcaatgcagaccagggcctgactgatccagccagcgtatgcagtggtgacttaactgcatggagccatggaggtggagcttacctttgactaggatttttttgttgttggttgtggtgtgtacactctgaagcatgttgatgtaagtagctgagtgattaaccagtaactgtaaaaagaatgtactaccagaatgttgccatgaatgggaaaaccttctgccaccagaatgttaaacagcactctgcttgatttaccgatgtgaatgtgatgtttgtgtgatagcatcgtgcttgacactgtatcccctttcatcgtccgacccagacggtccacagcccgcgactagattgactcgggcgattattcttatctcgtgcgtggttatccatctaatcatgtgaggtctgttggctatgatatatgaacgggatgaaagggatacaaccgattgaaaacccacgaacacgttacaatcgaaccaatctactttatttacctttcctgtcctacgagtagatgtagcgtattttttactgtagcttttcgcatatccacttccaacctattcgactccacgtgtctcggatggcctgtcgatcctaagacgaccctaagatcttatccggttatccgcgggggtaagattcacttcactcaatatctcttcctcgacttgatttcttaattcctaagcgactttatgtcgactagagacgtcccgggtggcctggacttagagcaccctaaggtctctcctgagggagggagatctaggttctagcgaggaggaagacgatattgcgacgtcgtgatgcgttcggcccacgaccacggacatccgcgccgctgcagagggcaccgtcagacggtaca

SEQ ID NO: 1099 - DNA, 1121 bp, Zea mays
  misc_feature (1095)..(1095): n is a, c, g, or t
cgtgtgtgtccccaatttttactttcttttttaagaaagccgattttactttttacatggttctctgagctggtgtgatttgtgaattcttctcgccaacagcccaacacacacaaagagagctgtagaagcagacgcccaaaacaatggccgcagaccgcagtacaagtacacaacacaacactggccgcaaactgcagtgcgagcagccgagctgagtgaagaggggtttggacgtttggtaggtagacacgggagggttttgctgggggaggagcattgcaagtaggactgtaggagtatttctccgctctcttcctgcttgatccatccctttctcctctagcctcgcaaagtcgcactctactgggcgctctcgcttcctccttgagcggcgcagccgcgggcgcgtagtgcacatctctctctctcccccctctccccctcgccattaatttgctgcctgccatcccggtagcgcttcgctgcgcagcctgcgcctgaaggttcgatctttcactcccatgggcggtggacgcaactagtctttctttcttggtgtttcttggcgcctcgtgggaggtgagcgccgaggagcttcgagggaatgagggtgacgcggaggcatgagcaccgggccgccgccgccgcgttcctgtacgcggtgacggttcttggggtgttggcgggcagcgccggcgtccgcgctttcgatgatggcacagcggtgtacattgtcaccatgaagcaggcgccggttttccacaggcgccttaacttggagaagttcgggagcagcagggttgctaatgctgccggccgcggcggcggcgggggaggaggaggagcaggagacaccccgaccaccagcgtcctcaggaagccgagacagggttcacccagacctatgaattatggctcttatattgtccacctccaaaattcattattgaagaggactctaaggggagagcgttatataaagctgtacagctaccgctacttgattaatgggtttgctgttggcatcactcctctgcaggcagataagctatctaggagaaaagaagtagcaaatgtgatgctggattactnagttaggacagcaccaactcatacac

SEQ ID NO: 1100 - DNA, 1707 bp, Zea mays
ttgggtccctcgaggccggccgggccggattcgatgatgaaaagctctgggcccgtcgggctcgggcactagagccaagagctccatccatttcatttcctccactctctaaaaagtagaccagccaggggagagaagtgaggcatcgaaggaagcccccaccatggcggccaacggcaagagcagcttggcgaacggcgcctccaccgggggaaagcccatcaaatgcaaagcggcggtggcgtgggggcccggcgagccgcttgtgatggaggaggtggaggtggcgccgccggggcgcctggaggtgcgcgtgaagctgctcttcacctccatctgccacaccgatctcagtttcttgaagggagagaacgagctgcaccgcaagttcccccgcatcctgggccatgaggcagccggagtggtggagagcgtgggggacggggtggaggatctggccgccggcgaccatgtgatccccatcttcaacggcgagtgcggggcgtgcgcctactgcgagtccgatcggacaaacctgtgcgggacctaccgcgtggacgcttccaagagcaccatggtctctgacggcggcaccaggttctccgtagcggaccgcgtgtccggccgcaccgtgccggtctaccacttcctcaacacctccaccttcgccgagtacaccgtgctggacgcggcctgcgccgtcaaggtcaaccccgaggcaccactgcaaaagatgtgcctcctcagctgtggcatctccacaggagttggggctgtatggaacacagccaacgtttccgcgggctccaccgttgcgattttcggccttggcgctgtcgggctcgcggttgctgagggtgccaggctacgaggggcagctcggatcatcggtgttgacataaaccctgaaaagttcaccaaagggagagagatgggcgtcactgactttgtcgactccagggcctctgacaaaccggtgcacgaggtgatcagggagatgacccatggaggtgtcgactacagctttgagtgtaccgggatcaacggcgtgctgcgagaggccttcgtgtccacgcatgacggttggggcctgacggtggtgctggggatccatgcgacgcccaagatgctgccgctgcacccgatggagctcttcgacggccgtcggatcaccgcctgcgtcttcggtgacgtcaaggggaagtcccagctgccggccatcgtcgacaagtgcgtcaacggggacctggatataaaccttgacgggttcataacacacaggatgcccttctcggacatcaacaaagccatccagttgctggaggaaggcaagtcccttagatgcgtgctcaacctctgatggacatggaccgaccaccacacatgcatgcgtgggagattattgtccttggttagtttggttactacagaaataatcaaataaatatagaatccgcagtgtgtgtcgagttgtacaattcacgtgtgcaccagtgctactttattgtaaaggagggtgtgattgaagccaactagtagcagcagggccacaagtgttgtttctatcgtacatgtgctgtgatgtctcaaagttatctcggttctcacaacacaacttattgtcataaaatatgctgatctttgattttacataacaaactgtttcgctagtttctcgtgcgatctttattttaaaaaaaaaaaaaa

SEQ ID NO: 1101 - DNA, 2698 bp, Zea mays
acccaccctcaactcgctcgtgatgcagcagtagtgtgatgcagtgttcagcttcatacaaatagtcccacctcgcccaaccaaacagaggcacaaactcttctatataagaacatgccctggcaaatgttgaatgccgaaggctcgagctggacggaagattgggagcttgggtcggattggggagtgagccttaggccgtctagtttgttttttattttcgaaaaaattagacttaaattcagtaaattttgattaaaatcgctaaccgaaggaaatagtcggtagaataatatcgtcgtcggtgaatctaatcgggaaaaaaatcaaaaatggtttctgtaaatcgaaaaattccgaaaataatgatgctcttgacaccaaatgctaactattacttagttgtgataagcatgttgtgaattgatatttggattaccatgctctatttgttgggcgctcttaaaaaacatatgtattgaactacttaactaattttagagcttcttattagatggcatttcttcctagaatccttgttaaaatttgattggccttatatttattttgatttttaggtaccacatcatatagataacaagctaattgaagtgctcctgggtactaatgtttagttatttttagactccctaaagatgaaatatttaagttcaaacttaatcattatgatgtaaaactaaatggttgtgagttagtccaaatcgtagtttggtacaatatgatagatgtgggcttacttatacatgaatgatcaatgcttgtttatatgattggtgtatatcttgtgatttgtggtgcatgttaacacagtgatgattctgcacaaattaatttgtgatgttcttttcgtcactatggcacaaatgccaatatatgacggctcacttaggtctaactaatatatgttagattcatttttttatataactagagaaatttgacttcaggatgaaatcatggagtgacagattttattaattttcgtatagtgccgttgtttacatttctgagctacagtatactgcgtctttaatttgagcacactgacgtcagacctgagattagctcttcaactagtcgcgctgtcacggtgccgaacagcgtgtcatcgccttcccctccccacaagccaaacgcgaataccacccccgtgacttcccgatctccggcgatggccgcgcggcgcctcggatcccccgcatctaggtggctgcgcccgtccgcgctgctcctcctggtcgcctctgctctcctctcggccccgtcgccggcccgggccctccggttcgacctcgagtccggccacaccaagtgcgtctccgacgagatcaaggtcaacgccatggccgtcggaaagtaccacatcgtcgggcccgaccccaactcacccgacgcccagctccccgagtcgcaccgcatctccctcagggtgacgtcgccgtacgggaacagcatgcactacgcggagaacgtgcagtcgggccacttcgccttcacggcatggccgatgtgcgtgtcatgaatgggggcgctttccttcgatttatgtgcaggtgacgtcgccgtacgggaacagcatgcactacgcggagaacgtgcagtcgggccacttcgccttcacggcggcggaggccggcgactacctggcctgcttctgggctcccgaccacaagcctccggtcaccatcgggttcgagttcgactggaggagcggcgtctccgccaaggactatcccagcgtcgccaagaagggcaaggtcgatgtgagtattttcgcttcgccctccctccagattccttcctttgttttggtcaaattcaccaccaatctggtgacgtcgatatggactgacttgtgcggttgtgggactagtatgtttagtcaggaataattttctgattgtgcatgctgacggtttgttgatcaattctgtttaacgttgatattgaagagcatttgattttacaactttctgcttgctagtgattttggtgtgtttgcatgttggactgctagatttttactggttagagcttttcacttttatgaaataagttaggttcaatttggatatggattgtgtatgcttttgtagcctgttttatacgcttcataatgagttctttttagttttgctatgtcgaggagtatatttgcaagtggtatattgatatttctagccatggtgctgggttcaagtatggactacagatgtggggctggattctttggaagaaaatatatgttagtggggttttgtaatttgaatgaggaagctcgttttttaaaagtatattgatattagtaagttgttgctacagttcaatcaatgttcttcaacgcggatatagaaaggtcataagcttagtaaccaacaggttgctcggtacttttttttttgtggtgtttttttcttggttttcattgcaatgtgtacttagtttcgtacaggttgtgcacaatgtacactattcttgaatgaataataggtacacaattgacatctgtaatattttaatctctcacttggtgctttttatatcttgttttaattatgcatgacttaatggtaagcataatgtgtgatttagagtctgattcttattgaacatatgctaaacaactttggtctcttggaataacattctagagaggtggacagagagatgatatgtg

SEQ ID NO: 1102 - DNA, 1299 bp, Zea mays
tgaaagaaaaaggaattggagaaaagaagacttatcctttagctgacttcttaggacttgaaactgggcattttggtggctgtgtgtagctgatctgcttttcacctcgtatttgtaaattgccctgttgcaatttaatcttttagtgctatctaggaattgaacttaactgatcctgctaataatgtgtccctgtcccataaagtttttgctcctctagttatttcttatttattggtcgtgtactggtgttgacactctgctcattcctgagacggagcaagtcgtattgtttctgtgaaaatagtattacttttagccatgctgttgcttatggctagtgcctatgttcatgcacgtgcattgctcatatgttgcagatgatggaattggagctgaagaagctagaggaaactataaaaaatatacatgaagagatgctttatctgcgtgaaaggtagtagtctacaaagtcagcgagaaaatgggtcctgtggaaaactaaaaagtaaaaaacaattctgatacgacgtgtccatgtcttgtgtccagggaagaggaaatgcaggacgtgaacaggcgaacgaactcaaggatggcttggctagggttcctctcccttggcggctgcttatcagtggcaggtttgcagctgtggcacctgaagaccttctttgaaaggaagaagttgttgtagactgtagttggcccatggttcacggtagacctcagcgcaggtgtaacctatttttgggtgaactgccgatctgttacggagcttggaatcccatgtaacaaacggtatgtcgtacttgagaaatatgctttagcctgtccagttgaaattctaagaaacttgaaaaaaaaaaaaaaaagtcttccattcaatagttcgtgttgcaatttggacttctggagcaccgtgttgactcttcttcaagtgatggttgtgaatctggagcgcctttttttttaacctcctagctattgtgaagctagagcgaaaagcacgacgttcctagactcaaacgccagttccacatgtaatcgtctcatcgcctaaagcatgaaaggtgtgggcgtgggcattccgttttcggcggttattttagagatttggttcctagaaaacgaccaactgagcattttggtttcagttattttagttcattttcgattctaactgaactaaccagatgtcaagaaattttaggaacgaaacatttcggctcgttctggaaccgaatgtgttcagcctgtttaggcagcaacaaaaatgcacgttttaaataagtaatt

SEQ ID NO: 1103 - DNA, 1103 bp, Zea mays
ttgggacccgcgttggcggcccggagattagctcttcaactagtcgcgctgtcacggggccgaacagcgtgtcatcgccttcccctccccacaagccaaacgcgaataccacccccgtgacttcccgatctccggcgatggccgcgcggcgcctcggatcccccgcatctaggtggctgcgcccgtccgcgctgctcctcctggtcgcctctgctctcctctcggccccgtcgccggcccgggccctccggttcgacctcgagtccggccacaccaagtgcgtctccgacgagatcaaggtcaacgccatggccgtcggaaagtaccacatcgtcgggcccgaccccaactcacccgacgcccagctccccgagtcgcaccgcatctccctcagggtgacgtcgccgtacgggaacagcatgcactacgcggagaacgtgcagtcgggccacttcgccttcacggcggcggaggccggcgactacctggcctgcttctgggctcccgaccacaagccgccggtcaccatcgggttcgagttcgactggaggagcggcgtctccgccaaggactatcccagcgtcgccaagaagggcaaggtcgatatgatggaattggagctgaagaagctagaggaaactataaaaaatatacatgaagagatgctttatctgcgtgaaagggaagaggaaatgcaggacgtgaacaggcgaacgaactcaaggatggcttggctagggttcctctcccttggcgtctgcttatcagtggcaggtttgcagctgtggcacctgaagaccttctttgaaaggaagaagttgttgtagactgtagttggcccatggttcacggtagacctcagcgcaggtgtaacctatttttgggtgaactgccgatctgttacggagcttgaaatcccatgtaacaaacggtatgtcgtacttgagaaaatatgctttagcctgtccagttgaaattctaagaaacttgaaatagatactaaattgtcttccattcaatagttcgtgttgcaatttggacttctgcagcaccgtgttgactcttcttcacgtgatggttgtgaatatggagcgccttttttt

SEQ ID NO: 1104 - DNA, 1242 bp, Zea mays
ataagatttaaggttcaaatcagattagaaatagaccctttttctatccacttttaactaaaatttattttagtgttctaccattttataaataaccatttgatcgcgatccattaccagctagcaccggtcccgcacgacggcacgagtcatcgtcgccttcccctccctccacacgccaaacgcgaactcccgtgccgtgacctcccgatctcaggcgatggtcgcgcggcgcctcggatcccccgcctgtaggtggctgcggccgtccgcgctgctcctcctggtcgcttccgctctcctctcggccccgtcgccggcccgcgcgctgcggttcgacctcgagtccggccacaccaagtgcatctccgacgagatcaaggttaacgccatggccgtcggcaagtaccacatcgtcagccccgaccccaacttccccgatgcccagctccccgaatcgcaccgcatctccctcagggtgacgtcgccgtacgggaacagcatgcactacgcggagaacgtgcagtcgggccacttcgccttcacggcggcggaggccggcgactacctggcctgcttctgggcgcccgaccataagccaccggtcaccatcgggttcgagttcgactggaggagcggcgtctccgccaaggactatcccagcgtcgccaagaagggcaaggtcgatatgatggaattggagctgaagaagctagaggaaactataaaaaatatacatgaagagatgttttatctgcgtgaaagggaagaggaaatgcaggacctgaacaggcgaacaaactcaaggatggcttggttagggttcctctcccttggcgtctgcttatcggtggcaggtttgcagctgtggcacctgaagaccttctttgagaggaagaagttgctgtagttgccccacggtatatttttgggtgaactgtcagatgtgttacagagcttggaatcccatgtagcaaacgctatgccagatactagagaaatatgcttcacaatgcttggaatcccatgtagcaaacgctatgccagatactagagaaatatacttcactatgcttggaaaacaaaagaaaaaaaaaatactagagaaatatacttcactatgcttggaatcccatgtagcaaacgctatgccagatactagagaaatatgcttcactatgctttagcctgtccagtgaacctctaaggaacttcaaagagaaactaaattgtcttcatttt

SEQ ID NO: 1105 - DNA, 1185 bp, Zea mays
cgtatcactcctatgggcgattgggtccctcgaggccggccgggacgagtcatcgtcgccttcccctccctcgacacgccaaacgcgaactcccgtgccgtgacctcccgatctcaggcgatggccgcgcggcgcctcggatcccccgcctctaggtggctgcgcccgtccgcgctgctcctcctggtcgcttccgctctcctctcggccccgtcgccggcccgcgcgctgcggtggcgacctcgaggccggccgggcaccaagtgcatctccgacgagatcaaggttaacgccatggccgtcggcaagtaccacatcgtcagccccgaccccaacttccccgatgcccagctccccgaatcgcaccgcatctccctcagggtgacgtcgccgtacgggaacagcatgcactacgcggagaacgtgcagtcgggccacttcgccttcacggcggcggaggccggcgactacctggcctgcttctgggcgcccgaccataagccaccggtcaccatcgggttcgagttcgactggaggagcggcgtctccgccaaggactatcccagcgtcgccaagaagggcaaggtcgatatgatggaattggagctgaagaagctagaggaaactataaaaaatatacatgaagagatgttttatctgcgtgaaagggaagaggaaatgcaggacctgaacaggcgaacaaactcaaggatggcttggttagggttcctctcccttggcgtctgcttatcggtggcaggtttgcagctgtggcacctgaagaccttctttgagaggaagaagttgctgtagttgccccacggtatatttttgggtgaactgtcagatgtgttacagagcttggaatcccatgtagcaaacgctatgccagatactagagaaatatgcttcacaatgcttggaatcccatgtagcaaacgctatgccagatactagagaaatatacttcactatgcttggaatcccatgtagcaaacgctatgccagatactagagaaatatgcttcactatgctttagcctgtccagtgaacctctaaggaacttcaaagagaaactaaattgtcttcattttagctcgtgttgtaatttggacatctggattctggagcagtgttgactttttttaaaaaaaaaaaaaaaaaaaaaaaaaactcgagggggg

SEQ ID NO: 1106 - DNA, 1609 bp, Zea mays
  misc_feature (26)..(26): n is a, c, g, or t
cattgggtacctcgaggccggccggngaaaaaatacaaaaaaaaaaaaaaaggaaaaaaaaaaaaaaaaaaaaaaaaaaaaacattggatacctcgaggccggccgggatcgccccctttcccatttctcccctcgattctccgggctgatccggtcgctgtccgggcctgttcgattggaggagaatcgcctggtttgaaggaaaggcttgggaagaaaggtaattatcactgtatctgacatggatgagcacatgggaagacgaacagtcggcggcctcctcttcaccaagggaggatccatccttctcttcagagaagacggctcgcgccccaaggccaagaactgctgcacgcgccatggctgtagcggtcagcatcctgctgacagagccaagggcaaggaggtgcacagggcagcagcggtgggcagtgaatcgacaccggctacccctcggagatcacaagcttttaggaagcccaacagaaggcctccacatgaaggcagtgcctcaggcagcatcgtcagggatgtaggaggcccttgtagcgaaaccggcagcgggtcaagagatgctcctgggcgtgatctgcttgctcggcttaaggagagggtcaacacatcaaggaaacgatcgttgaacagggagaacagcccgcagtcgccgagtggactcagtgtctgtgccagttccccgagcaacagtcggtcagtctcaaggccgtcgcaccggacagcttcgaggataagagaagctgacgaaggcgcgaatgcaggagctgacagtgtagtgcgcagaaatgctgctaggaggggttcagagaggagtgacgatgacttgctgctggtcgagcaggtaacaagaaaccaagcgccttctgaagggtttctctctggattcatggctagatacagaagcgatcttcagggagagctttcgtccctggacgacagcatggaggatccaaatggatacttgcgctttgatgtgggcgggattgaagagctcgagaactatttcatattcaatgatcggcatagaggaatgaggatggatatcgacggcatgtcctacgaagagttgcttgctttgggggagcgaattggtaccgtaaacacaggtctttcagacgacgcgttatccgcgtgcctgaacaggaggctctacatgcccacagcttcaggttctcatgaagattgtgaaagaaaatgcagcgtatgccaggaggagtatttagcaggcgaggaggtgggcgagatggcatgtaaacactactaccacctttcctgcatagatcactggcttcggcagaagaactggtgtcctatctgcaaatctgtcgccctgaaaatcaactagcaacgtgtttcatgtttcttcataaatgaagtgtatagattcttcatctcctgtattccttccccaccccactccttttcccttttggaattttttttctttctttctttttcttttactcaaagcactcattttttattatcaatttaaatcagaaaagaaaatcttgtgttgggttagggcttgctgcgagccttactcgtgttggcccatggcccagtaaaaaaaaaaaaaaaaaaaaagcggcc

SEQ ID NO: 1107 - DNA, 1922 bp, Zea mays
tgggaccctcgaggccggccgggatcgctctctcccaattcctcccctcgattctccgggtcgatccggtcgctgtccggcccggttccagtggaggagaatcgcccggtttgaaggaaaggcttggaaaggaaggcagttatctgacatggacgagcacatgggaagacgaacagtcggcggcctcctcttcaccaagggaggatcaattcttctcttcagagaggacggttcgcgccccagggccaagaactgctgctcgcgccatggctgcagtggtcatcattctgttggcaaagccaaaggcaaggaggtgcacagggcagcggtgcccaatgaatcaacaccggctaccccacggagaccaaagatttgtaggaatcccgacagaatgccaccacatggaaccagtgctccaggcagcatcagcaaggatgcaggaggctcttgtagcgaaaccggcaacaggtcaagagacactcccggtcccgggcgtgatctactggctcggctcaaggagagggtcaacacatcaaggaaacggtcattgaacagggagaacagcccacagtcaccgagtggattcactgctagttccccgagcaacagtcgatcagtctcgctctcaaggccgtcgcaccgggcagcttcgagggtaagaagagctgatgaaggtgcaaatgcaggagctgacagtgtgcacagaaatggtgctgggggtgctaggaggagttcacagaggggtgacgcaggcttgctgctagttgagcagcaggtagcaagaaaccatgtgccttctgaagggtttctttctgggttcatggcgagatacagaagcgggcttcaggaagggctttcgtccctggacgacagcgtggaggattcaaatgggtacttgcgctttgatacgggtggaattgaagaggtaagacattctatttctgtcactgcacaatagtcgtgctaagtccagcagagctatgaagagaatgcaaatcgtatgattacattgtgcactgcagctccagaactatttaatattcagcgatcggcacagaggaatgaggatggatatcgacggcatgtcctacgaagtatgtctgacggacgccattttcccatttccttctcgcttcatcctattctctgtcttgtcttcagtcagtaagcagtttctgtttgtcatgttttgtatctccaaagtagtcatatgatttgtgacactctgctttgaaggagttgcttgctttgggagagcggattggtactgtaaaaacaggtctttcagacgatgcattgtccacgtgcctaaataggagcctctacatgcccacagctccagggtctcatgaagattgtgaaacaaaatgcagcatatgccaggcaagttcatttgtactatatcagattgttctgtatcaggatattagttgcaacctctaaattttttttttctgttgcgtgagatgtttctcaggaggagtatttatcgggtgaggatgtgggcaagatggcgtgtaaacactactaccacctttcctgcatagagcactggcttcggcagaagaaccggtgtcctatatgcaaatctgttgccctgaaaaccaagtagcaacgtgtttcatgtttctttatagattcttcatatcctttatcccctccgcacctctcacattttccctttgggaattcttttccttcctttttcttactcaaagcactcatttttgtatcaatttaaatcagaaaaggaaatcttgtgttgtgttagcaacttgctgcgagcctggaccctgttggcccaaggcctagtaagaacaacccaatttattacgggagaagtccactgtctgctcaactgttgaaagtacagaaatggatatcgtgcactccaacaaatcacaatcctaaggccttgttcg

SEQ ID NO: 1108 - DNA, 2000 bp, Zea mays
gtttttatatcactaatgtagcgttcagctacaggtcttgaggttttatcccaatgacttaagagggatcgaggacaagtgtttaacagtatgtcggatcagactcacttcacttgaagagctcacttcgcttgaaaaccacacttcacttgctttaagtagggcgggcgagcagatgacaagccaggacccgacccggcaagcgcggcagccaatcgcagcgcggtctccccgatctggggcggtcaaacaaatgatcggcttcctctggtcgcctcgcctcacttcacttgaaattcctagacgcggacgcgcttcccactccggcccggacgcttgtgctataaaaacctccgctcgccatcccgcctccctccactccaccaccactcgtccactcctcctccacgtcaagcgaagccactcctgatcgccgatcgctcgccacctcacgcggaccgcccctcgagctgcaacgaccggcctcccctgctccggctcccaccgagcctcgatcgatcgccgcagcagtcgccaatggctgatgcagtggagagccgcggcgggcgggcgcgcctggtctcggacctgggccgcgtgcaggacctggtgcgccagctcgagctgcagctgcgcgcgcccggggacgcagcctccgtcgacctctgccgccgcctcgtccaccagatcgtcgcgctcaccgacagctccatcggcatgctccactcatccccggacctcgcctcgccgctgcccgccattgggaccgggagcccgatcagcagcgacgccgcctccgaccaccccttccgcgccgccgccagcgccagcgccagccccaagaagcgcaaggccacggcgcgctggaccagccagcaagtgcgcgtcagcgccgcgggcggcagcggcgccgagggccccgtcgacgacggctacagctggcgcaagtacggccagaaggacatcctcggcgccaagcacccgcgggcctactaccgctgcacgcaccgcaactcgcagaactgcccggccaccaagcaggtgcagcgcaccgacgaccacccggcgctcttcgacgtcgtctaccacggcgagcacacctgcaggcccgccgccgccggcggcggctccaagagggcggcacagcagcacaacccgcacgcgcaggccgcgctgcagggcctcgccgcgcgcctcacggtggccaccgccacggacgccgccgcgctcccgcccatgacgcccgagagctgccccgtgcggggcgcctcatccccgtggtcgctcgcgtcgtctgtcgcctccgactccaacggctgcatgcaccaggacgtctcgccgtgcccggtacccgggtacagggaatggacctcggacggcgacctccaggaggtggtgtcatctgcgttcgccgccgtctcgtcggttgcacccctgccggtgctcgacgacgaattcatgcctctcgagtgctttggattcgaccataccttcgacattggcaccgcaatgccaagcctctactatccatgaggagaagagcgtccaatacaagtcgacattattgacaccgcagtgccaagcctctgctatccattaggagaagagcatcaaatacacgtctgatcggatcggcagcagccctgtcgtcgtctccatgacaggagggaggagcagaggagcctcttcctaagaactgtgcagtagcagaagccaacagggcttttagaacatcttaatgaatagcttgtttcattaccttttgtttccttctttctttactttttttgtgtcagttctcaacttgcttgatcgggttttgttgatttcagtcagcaagataaatgttaaattttactacttacggtgcaaaaaattaaaaactcataaatgataaatcatcttctcttgaaattgtttcactttcatgtttgcacaccacctaaccttagagagcaacaaatcgtaaaacgcattcaacgaccaagttaaaatcaaac

SEQ ID NO: 1109 - DNA, 1407 bp, Zea mays
gcctcgcctcgcctcagctcacttgaaattcccccacgcggacgcgcttccccctccggcctccctccctcgctttcgcttgctataaaaacatcctcctcttcctccacgtcgagccaagccactcctgagtcctgatctccgatcgctcgccacctcacgaccggactcccctgctccagctctcacctatcctcgaagcagcaatggctgaagccgtggagagcggcgggcgggcgctcctggtctcggagttgggccgcgtgcaggacctggtgagccagctcgagctgcagctgcgcgcgcccgcggacgcggactccgtcgacctctgccgctgcctcgtgcaacagatcgtcgcgctcaccgaccgctccatcggcatgctccactcgtcaccggacctcgccccctcgccgctgaccgccacggggagcccgataagcagtgacgccgcctccgaccaccaccccttccgccccgccggcgccagccccaagaagcgcaaggccacggcgcgctggaccagccagcaggtgcgcgtcagcgccgacgacggccacagctggcgcaagtacggccagaaggacatcctcggcgccaggcacccgcgggcctactaccgctgcacgcaccgcaactcgcagaactgcctggccaccaagcaggtgcagcgcgccgacgaccaccccgcgctcttcgacgtcgtctaccacggcgagcacacctgcaggcccgccgccgccggcggcgggtccaagagggcgcagcagcacaacccgcacgcgcaggccgcgctgcagggcctcgccgcgcggctcacggtggccaccaccaccacggacaacgccgccgggctcccgccgatgacgcccgagagctgccccgtgcggggcgcctcgtccccgtggtccctcgcgtcgcccgtcggctccgacttcaacggctgcctgcaccagggcatctcgccttgcccggtgcccgggtacagggactggacctcggacgtggacctccaggaggtggtgtcatcggcgttcgccgccgtctcgtcggttgcgccccttccggtgcctgacgacgaattcatgcctctcgaatgcgtcgaatacgtattcgaccagaacttcgacattgacaccgcaatgccaagcctctactatccatgagaagagcaactgatcggcagcactgtccacttctccaagacaggagggaggagcagagctgcagcagaggagcctattcctgagaactgtgcagtagcagaagccagcaaagcttttaggatacattttaatgtctcattatcttttctttctttctttctttccctttcatgggttgggttttgttgatttcactcagcaagagaaaagttaattttgaccaaaaaaaaaaaaaaaa

SEQ ID NO: 1110 - DNA, 1139 bp, Zea mays
tgcatgcctgcagtacctggttctccagggtctgaatccacggttcgctatacgtacgttccggccgtcgcgctggccaggactctttcttcgcggcatgcatgtcgcctcagccttgcttgaggcagtgaatgggactggtgacaccaggcgaaagcgtaacaattggcgccatggatgacccgccctcgccggccgggtggtgctcgccccacgtctggctatccctcaccgatgccggtaaccatcatcaggcgacaggtgcccaggttccctggaactctcgcattcagaccggattcaacgtgaagctcaatgaaaacattttgagatgattaggtaacggtgacatcgtattcatacggcgccggcccggctgatatcttggactgctgtacggagtgcagccttaccatacctgacacccaataattctctgaattctcgttcggtaagtggcgacaattggcaatcgtgtgttgtgatagtctcgcaaatggaaacgtatactcatggccaaccacgctttccgagattcctgaaaccgagggctggagtccggatcgatcaccttcaggctccgggacgggactgatcgaagtcgacgaaggaggatcactctgacctaacgctgagctcatcttggatccatgttacgatcctcaaaagcagcagcattttgcgctcagtgtcatttggagagccggttggcagtcctgctgtcagttgaatctccggcgatcctcaaagcaggttgtggcgacgcagcctttttgatcacatggttacacaccacgttcagaattcagagtttgagccagtggagggtgaaatgcgtgttgagatagatgctctaaaggctcaagtgcatcactggttcgaacacgacggtcttagaggggccgatccacacctccaaaggcagatcaaatctccgtgtctagttccgttcaaacttcaaaggacaagcctaattttttctaaaaaaaaatagaagtggacaggcccaaaattagtctaggttgttggttgcaatgccacttgatgaacctgccatttttgcatctgactttgacgcgctagactagctgctgttaggcaaagtgctccctcgacttggctacttgttgcagtcctgc

SEQ ID NO: 1111 - DNA, 865 bp, Zea mays
  misc_feature (829)..(829): n is a, c, g, or t
gggcgaatgggatcctcgaggccggccggccgccccgctccccacacccccgtggtcagcaccaccgaaagccccgagaaaccctaggcaccagggccaggagggcgcgccgcgcagccatggcgaagaaccggaacaagaagaacagggccaagagcggcggcctcgccgccatggacacctctgagggcggccccgccacatccactgccgcggacgtcccacaaccaatggacacgtccgagggaaagcagccatcgtcggccacagcggcgctcggttcgatcaacaagaaaataaagaagggggtgcatatgaaaaggtcacagaatgctaggaaaatgaaagcaattgctagggctgtatcgaagaatgagaagtccgaggagaagatccagaaagcaaaaggcaagaagacaagaatccagtcggccaagtctttgtacgactgaatatttagcactgagcagaattttgtgtaccagtatatttctagattgtagagcaaccgaatctgtgcttgcgacgaagaaatgaaagcttgctttgcttacaaatcttcatgtcagcttctttacaagatctcgggaatctcctttcgcgctacctggtgtctcgtgatacttcgatgttttgatgccttgatggtttggtacttcgatattgacttcaggatatggtgaccaagtgcttggtctgttctacaattccggtgcctttttgctgaatcggcaacatattttcactcagtactgttaaaaaaaaaaaaaaaaaaaatggtctttcttatatgtaccccccttcaacaatttctttgaggctggacggntactggacccaaacaaaaaaaaaaaaaaaaggccct

SEQ ID NO: 1112 - DNA, 6252 bp, Zea mays
  misc_feature (624)..(624): n is a, c, g, or t
  misc_feature (698)..(698): n is a, c, g, or t
actcgtgctccaggcatgccaccttcctctggccctacccccacccatctacccagctctggtctcttcgctcgccccctcttgccagcctcctccctcacccttttggtctctccctcagtcccttttctctcacaaaatattaatttactcatgtcctacatcgttctctggtggccgatagcagctctctccactgccttagctatctccagtagcttaccatcatctcttattttaagctccactatgaaaacagtacaatttataatgcaaaacaatattttacatagccatatgtacaatctgttgttcataaggtaagataatatccctcataaattgttatttcaatatttattttcaagtaaatgattggctagtgagttagaacctgtaggtatattcgatttaatgaaataggtagattagttagtgagttagtcaaactagattagtattgctagatagattgcttatttttagttaggttagattagtattgttagttataccaatgaaatcatctaggactctagtagttttagtgattaatagcgagataaaattattatggttaacatgtgttttgtagagataattaacgtaaggtcataatgatgntaattgtttaggaaatcgttggttttcatgtccctaagtatatggtattcattttgattttcaaatgatggacnatagggttaaggatgaactagttctaagtgtcaattgaagttgagggacacttagagtattttaggactttaactttttctttcaacatactatacaagaggatattaactagtagcttgaactaggtaagacccaaataagtttggatcaagacacatttacattttttcgaaagttggatatgttacaagggtttttgagttgttcttgtgtgatcttgtactcatgctcttgactttgcttctcgtgtgtgtgttgatgcattgtgcttttgtgtgtatattctttctccctccctactataagtgttgattgagatcattgtataaggatgtgagagactccaaatctatgtagattcctcacaaacgggattgtaatataaggaaaaactgtggtactgaagtttgatctttggatcacttaagaggggttgagtgtaaccctcatccattaggaagccacaacatggagtaggcaaacatattacgcttgaccgaaccacagtataaaaatcatcgtgtcacttgtgtcattgacttttttgctatttttctatcttcatagtttctttattctcacttgtgatattgatctaagtctaatttataccttgacagagcaatcaagtgaaaggaaccgctctctctttctatcctctcaaacttggtttaatttgcactaactctaacttttagaccaagtttatgtgttttaagtcatatttttttacctttaactaaacacatatataatgctaacacttacgatatattattaggattataagatgaatcgtcgaatgcatttttcttataataaaagtgtctaaaaatatttggtaaaatcatttataaacctagttaaattaagaaagtttgaccagcatgttcacttattgtaagagctaggtaggagtaccgcgtagctgcactgcaggccggcagcatactttaagcgaaaggtgccatctgcattccggacttccgaagtccacagtaggtatccctaaagtgcgtttgcctttgcaggaaacgaaagcatgagcggatccaaccttgaccaaatgaaaagtcgcatgcatgcgccctggacatggtcgtggcaccactgcaacctccaaaccagctctttgcggcagaaaagaaaaatcgaagcgcatgggtcgtagagctcagggcaatcaccaaatggcaggcaactccagagacgaaaatgatcgagcggacggatgcccaacccacctgaacgcaaatttctgatcagagcgataggaacttggcgtagggatgatgggatcgtggtggttggtccctgccgatgtgttgttcccacctgccgttcctaaccggcggctcactgcactggacaggccttctgaaaggcccggccggattcgccaggttgccagcctaccgtaccgccacgccgaaacgcgcgcagacctctgcactccgcacagctggggtccgaagagcgatgcttttttctcatgttgttcagagtttcagcgttcgcctccaattgtcaacttgctggggcacaaaagctagcaccatctctgctctgacgtttgattttcttgtaaataaattcagtccaagcgcatttcagagccgatctcaactttcaaagaaactgccttcctctgatttgtttttttatggatggatggtacatgcaaacggttcgttttcatgactactgatcgatctgttgcaagcatgaagcataactctagcttaattccaggcttcaccatttcacagttctccgagaattaaaaggtttcgctgttttctaaaacaaaaagagagagaaaataaaaatgaaagccggaaacgtggcacctagaattggactgagcgatcggatccggtgccatcatcgtctgtgtcaaaagattgtttccgaagatttgttggaacaaatatttgacactcgctgcattataggttaccaaatccacctcctccctcgcatcaaaaagtcagtacaaaatgacttcaacgcattagctaggtttattattatgcttgccaacgattcgtcataggcaggggaaggggaaaaaagagctagcacgcggtacgtacgtacgtacgtctaaaacgtcatggatttgacgctctaatcattgggttcggaagcccgagttcctttgcccgcaagtttcagcaagccgcagaaatatgttacgccgtatgtaggcagcatatgatagcggcagaataactaactaatcgaccggccagaggaagcgaaggagacgatgggcagatgggcaacaaacactccggccctcgtgacctctcttctctactacggcctgaaagccaagatgcgtagcaggatgcgcaagtgcaaattaatccctatcccagcgttagacttagaacgccgcgcgcagtgagtagaccatatacacacatggttgcaatgcaaataatgctggtgctttcgctgttttacacagaccgccgaaatgctcttgtggttgtcagaaagagatctgaaactcgacgcaaaatataatgaaaataaccgaacgacgtgacagcgtacgtaagcagagtgtaaaaacccaggcgttgttgtctggttgcagagaagcgtgtaggggagggaactgccccgttctgtgaaaatcgcggctccaaagtgggcaggccagtgggtgcaccaaaccacctgcacagtttgaatgatccgataccacgcgctgcgcgatgacatgatcgatcggtcagctcggagccgcacgcagcagtcactcgcacgaaccgcagcagcctccagctggtaatatttcccccatgctggaattcaaaaggctccaaacctaatcgaccaaccacaccccccccgcccgcggcgggaacggcacgaggcaaagccaacgctagctatatattccgtgcgcgccccgtggcgaagcctctcatcgcaaactcggaaaccttgagaggaaagccaccagcagcaagcgaagaccaccagcagcagcgcagcggcgacgtgtttcgctctcgccatggcgtcgtcgtcctcgtcccggctgctgctcctcctcctcccgtgcctcgcgctcacgctgctcggcgcggcagacgccgaagtgcaccaccacgagttcgttgtacgtgcggcgcacgcggcgtgaataatacgtacatgcatggtagacgtgtttttttccagcgcgcggctggaaataacgattctttttctttgcctgatcggtcggtgtgtgctgtgctgtgtttgtttgctctgggggtttgcgcatggtgctgctcatcgtcaagatccaagagacgccggtgaagaggctgtgcaagacgcacaacatcatcacggtgaacgggcagtacccggggccgacgctggaggtcagggagggtgacacgctcgtcatcaacgtcgtcaaccgggcgcagtacaacgccaccatccactggtacgtacgtcgttgaagctcgtttttctcaaccgtgagtgacatgacatgacatgacatcgatcgtctggtctgtctatactctctcccgttcatggccggctgtctcgatcaatgcgcgctgcatgcatggcgtgtgcaggcacggcatccgccagataaggactgggtgggcggacgggccggagttcgtgacgcagtgccccatcaggcccggcggcagctacaagtaccggttcaccatccaggggcaggagggcacgctgtggtggcacgcgcacagctcctggctcagggccaccgtctacggcgcgctcatcatccgccccagggagaacaagacctacccattcgccaagccctcgcgagaagtccccgtcatcctcggtctgcaccctgctcatcctggcccgttaatttgttgtttcattcacgtctctaataatctaacggacggtgatcgatgggcaggtgagtggtgggatgcgaacccgatcgacgtcatccgggaggcgcagaggaccggcggcggtcccaacgtctccgacgcgttcaccatcaacggccagcccggcgacctgtacaaatgctccaacaaaggtagctagctcatctcgcatacgatgccgcccatgcaaaataaacctgaacgaaacagagcatgctcacgatcgcccgtcggcatgcactgcagagactacggccatcccggtgaaggccggcgagacggcgctgctgcggttcatcaacgccgcgctcaaccacgagctgttcgtcaccatcgcgcagcacaagatgacggtcgtcgccaccgacgcgtcctacaccaagcccttcaccacctcggtgctcatgctcgcgccgggccagaccaccgacgtcctcgtcaccatggaccagccgcccacccgctactacgtcgccgcgcgcgcctacgtctccggccagaacgtggccttcgacaacaccaccaccacggccgtcctcgagtacgactgcggctgcgcctccgacttcggccccaagatacagccggcgttcccggcggcgctaccggccttcaacgacacgtccgccgccaccgccttcgccgccgggatcaggagccccgaccgggtcaaggtccacgagaacgtcgacgagtacctcttcttcaccgtcggcctcggcctcttcaactgcaagccgggccagctctgcgccgggcccaacaacaacacccgcttcgcggccagcatgaacaacgtctccttcgtcttcccgcagaccgactccctcctccacgcgcactactacaagatccccggcgtcttcaccaccgacttcccggcatacccgcccgtgcagttcgactacacggggcagaacgtcagccaggccctgtggcagccggtccccgccaccaagctgtacccgctcaggttcggctccgtggtgcagctcgtcctgcaggacaccagcatcgtcacgcccgagaaccaccccatccacatccacggctacgatttcttcatcctcgccgagggcttcggcaacttcgaccccaagaaggacgtcgagaagttcaactacgtcgacccgccccagaggaacaccgtggcggtgcctgtcaacggttgggcggtcatccagttcgtcgccgacaacccaggtgtgtggctcatgcattgccatctggacgtgcacatcacctggggcctggcaatggctttcctagtggaggacggctatggcgaactgcagtcgctggagccgcccccagttgatcttcccatgtgctagtggaggacggatatttgtgttgaggaagaaagcctggtcacgttgtatgttaattgttactcttttttggtggaggggggcgtgttcgtgatcttaaattcttaggggacttaattttccagcttgttggtttgaagtttcttctgtaaatctatgtaattttcaatgacattcagcatattatttgagaataaattatttctttgtacaaacaattaacgaaactaccggcctcagatgtgcaacatcatatttgaacactaagaaaaattcagctttgatacctcagggaaacattatcgtgtcctaac

SEQ ID NO: 1113 - DNA, 2595 bp, Zea mays
gtgatataaaatatactatagttgtgttatgatattcagcaaaccgtggttttgaaaaactgtgttcccaaacagtcccttaatctagagatcttgtcacgacccatcattgtatttgttttggtcaagcagcatgcgcatatttatcgtaacatttcacgactgcaaaacttaactggcagaacttcgtctaaaatttgcactcgtctgattctgaatggtagtttccagaggacggaagtgcatgcctctattcaccttggttcaaatgagttcagagaatgaagtagagaactcttgaatgggaaagttcaggcacgtggtagagcgatgggtgtgctgagaagggctgtgcccgtgccgtgccctccgcgccgcggtcgactcaggtataccaggccagcacgcggcgcgccattggagctggagaagagggccggtaggtggactcccacagactttgccttcctctcttccgcagtagtgcagtaccaagaccaaccactgtccggcaggctgtcgtcatccaccggccggcacattgtgcatgcacttgcgcatcggatcgcatcagctgctgcttttgtccaccaagcaactattccctttccttccgccgcccaaatgccctcgtgcccggcaccggcaccggcagtggccaccttcctcctcgtcgcgcttctctcgtgcggcacacgggccatccggacgcacggcggctatgtctccgcggtcggggaccccggcatgcggcgcgacggcctccgcgtggcatgggaggcgtggaacttctgcaacgaggtcggccaggaggcccccggcatgggcagcccccgcggtgccgattgcttcgatcttctcggtccgtccattccatctctttctctcctctttcgccggggtggttgagtgggttgccaccaagattaggtttttgaggaagcgtggatctctgttccgttccgcagagacgagctccgacgaggaggggcggccggtgtactcggtggcgcacctggtgagcgacgccgacaaccgcctgggcgcgggcgacccgttcccggggtccccgccgggcgcggcccgcgtcacggacgccgacctctacgcgccggccaaggagctgtacctcggcgaccgctgccaggtggccgacaccccggcgccgtggcagttctggatggtcatgctcaagaacggcaacctcgacacaaccgccgccgcctgcccggagaacggccgccccgcgcgcccgttcccgcagacgtcccgcttcccgtgccccgccggcgccgggtgcatgaaccagccgctgctgttccacaaccgcaccgcgctggacgacgccggccgccggctccgcggcggcctgttcgggacctacgacctcgacgccgccgcgggtctcggcgctggcgacgtctccttctactccgtgacgtgggagaaggaggtggcggcgagcggtcgcggcggcgggtgggcattccaccacaagctgcgcacgtccaccaagtacccgtggctgatgctgtacctacggtccgacgccaccaggggcttctccggcgggtaccactacgacaccagaggcatgaccaagacagtaagctccggccacttcctctgattctgattcatcattcctttatatgctgcgtgcgttgcgagtctcgcacgtggtaaagtaacacggagcagagaacatgtgactgacgagtgagaggccacctcgccggccgggagcaggtgccggagtctccggacttcaaggtgcggctgaccctggacgtgaagcagggcggcgggcgcaacagccagttctacctgatggacatgggcagctgctggaagaacgacgggcgcgcctgcgacggcgacacggcgacggacgtgacgcggtacagcgagatgatcatcaacccggccacgccggcgtggtgctcgccgtcgcggatcgaccagtgcccgccatggcacaccttccggaacggcagccgcgtgcaccgccgcgacggagcccgcttcccctacggcgcctaccacgtgtactgctcccccgggaacgcggcgcgcgcggagcagcccaccacctactgcgacgcctacagcaacccgcaggcgcaggagatcctgcagctgctgccgcaccccgtgtggggagagttcggctacccgacggccaggggacaggggtgggtcggcgaccccagggcgtgggacctcgacgtcggcgccatgtcccaggcgctctacttctaccaggaccccggcacgccgccggccaggaggcggtggacgtcgctcgacgtcggcacggagatatacgtcagcgacagggccgaggaggcggagtggacgctcagtggcttcgacatccttgtgccggacaagtgtatcaagtcacagcaacgggccagcaacagctgctggtagacagacactttaatgtcactgtacgttacgctgagtagcatagcaggccaaagtgttcttcgtactagaagaggtggtgtaggatgacgatattactcatgttagtactacccccccctcaaaaataaccccctcattaatcaacttatttcattccac

SEQ ID NO: 1114 - DNA, 1857 bp, Zea mays
  misc_feature (30)..(30): n is a, c, g, or t
  misc_feature (1611)..(1611): n is a, c, g, or t
  misc_feature (1644)..(1644): n is a, c, g, or t
ggaccctcgggccggccgagaccagaccanccctgtccggcaggctgtcgtcatcccctggccggccctcggggccggcccggacttgcgcatcggatcgcatcagctgctgcttttgtccaccaagcaacgattccctttccttccgccgcccaaatgccagtggccaccttcctcctcgtcgcgcttctctcgtgcggcgcacgagccatccggacgcacggcggctatgtctccgcggtcggggaccccggcatgcggcgcgacggcctccgcgtggcatgggaggcgtggaacttctgcaacgaggtcggccaggaggcccccggcatgggcagcccccgcggtgccgattgcttcgatcttctcgagacgagctccgacgaggaggggcggccggtgtactcggtggcgcacctggtgagcgacgccgacaaccgcctgggcgcgggcgacccgttcccggggtccccgccgggcgcggcccgcgtcacggacgccgacctctacgcgccggccaaggagctgtacctaggcgaccgctgccaggtggccgacaccccggcgccgtggcagttctggatggtcatgctcaagaacggcaacctcgacaccaccgccgccgcctgcccggagaacggccgccccgcgcgcccgttcccgcagacgtcccgcttcccgtgccccgccggcgccgggtgcatgaaccagccgctgctgttccacaaccgcaccgcgctggacgacgccggccgccggctccgcggcggcctgttcgggacctacgacctcgacgccgccgcgggtctcggcgctggcgacgtctccttctactccgtgacgtgggagaaggaggtggcggcgagcggtcgcggcggcgggtgggcattccaccacaagctgcgcacgtccaccaagtacccgtggctgatgctgtacctacggtccgacgccaccaggggcttctccggcggttaccactacgacaccagaggcatgaccaagacagtgccggagtctccggacttcaaggtgcggctgaccctggacgtgaagcagggcggcgggcgcaacagccagttctacctgatggacatgggcagctgctggaagaacgacgggcgcgcctgcgacggcgacacggcgacggacgtgacgcggtacagcgagatgatcatcaacccggccacgccggcgtggtgctcgccgtcgcggatcgaccagtgcccgccgtggcacaccttccggaacggcagccgcgtgcaccgccgcgacggggcccgcttcccctacggcgcctaccacgtgtactgctcccccgggaacgcggcgcgcgcggagcagcccaccacctactgcgacgcctacagcaacccgcaggcgcaggagatcctgcagctgctgccgcaccccgtgtggggccgagttcggctacccgacggccagggggcagggggtgggtcggcgaccccagggcgggggaccctcgacgtcggcgccatgtcccaggcgctctacttctaccaggaccccggcacgccgccggccaggagggcggtggacgtcgctcgacgtcggcacggagatatacgtcagcgacagggccgaggnaggcggagtggacgctcagtggcttcgacatcncttgtgccggacaagtgtatcaagtcacagcaacgggccagcaacagctgctggtagacagacactttactgtcactgtacgttacgttgagtagcaggtgcaggccagagtggtgtttggttccatgaaccactcactccatactagatgaggtggattatattcctcgtgttagtactaactaactataagaaataaaatgatgattgatc

SEQ ID NO: 1115 - DNA, 1726 bp, Zea mays
cttgcagctcctcttgccatcttgtggaattcgccgttaatggcgtcccaaagggggaaaaaaacccggcaagtcaccatccacttggcatggccatgacacaccgatccccaacccacctggctgcaaccaatatccaagaatcatatccatatccaacttgccaatgtgccattgaccatcgcaatgcgtagcgctggtgcatcgatcctcctcttgcatcgaccgctcctccgtgccaagctgccaagcttctgtgcaccatcagtccagcagctcacagatccttcctccttcgcgcgcgccatgcacggccgcgtcaccgtcctgctagtagtagccgcagcagtgctgctgctcgcgtcgtcggccgtcgcgcagccgtggccgagctgcgacggcgccagcggcaactacctggccggcagcgcctacgccaacaacaccctgcagctcatcctgggcctccagacgaacgcgtccgactcgcccgcctacttcgcgtccggctccgtcggcgcgggcgcggccgccgtccacgggctcatgatctgccgcggcgacgtcagcagcaacgactgcttcgactgcggcacccgcgcgtggcaggacgtgcaggctgtgcagccgctctgcaaccgcaccagggacgccgcgctcgccgacaaccagtgctacgtccgcgtcgccgccaccgacttcctcgcctcgcccaacaacaccggcctggtgagcgtcgtcggcggcgccagcatccccagcggcgtcgacgtcgcggcctacgacgccgcgctcaggcggctgctcaacgccaccgcgcggtacgcggtggacagctcggtcccgtcgtcgccgccgaggctgtacttcgcgacggggcagttcgtggggctcgacccgcgggtccccaacatctggtccctggcgcagtgtgcgggggacctggcgccggcacagtgccggaggtgcctggatgacctgatgacactgtggtggaacggaagtgggttcaagccggacggggaaagcgcgatgttcgctggctcgcggtgcaacctcaagtctgacctgggggacaagttctacaccagcagccccatggtgaagctgcagatgaacagcgaagtggtcgttccagcgcaagcgccttccatggcaggtgaacgcttattctatttcatttgattagcagcttagtagctacgtattggcaactaacggcatctttggaacctatttaaataattgttcgcacctaaaattagttaaattagttatatgagttctaaacaatctaactaaagcttctcctaagggttgatttggtgacaagtaaattagcaagggatttttttcgcctaatggctatggtagataatttatcaatgtgtttaaatgcactttgattttatttgctccgattaatggggtattttctatgactttcgaattaacatagatgcttcttttgtcgattaaatgctaagataataaatatgttgattaactaactttgtgaccaatcaacttagctatgctcttatttcaaacagatagttgatctgatgttatattaagaagctaatgtgtttggttaatcagactatcatggtgatattgattaatgtgtaaataaaggaagaaaaagattaagtaacggaatttacatcctaaaaagaaaaaaaatggttttttaagtttgattgaggaccaattgccttaaatt

SEQ ID NO: 1116 - DNA, 4265 bp, Zea mays
  misc_feature (335)..(335): n is a, c, g, or t
  misc_feature (3962)..(3962): n is a, c, g, or t
  misc_feature (4096)..(4096): n is a, c, g, or t
  misc_feature (4246)..(4246): n is a, c, g, or t
  misc_feature (4248)..(4248): n is a, c, g, or t
  misc_feature (4251)..(4251): n is a, c, g, or t
  misc_feature (4255)..(4255): n is a, c, g, or t
  misc_feature (4258)..(4258): n is a, c, g, or t
  misc_feature (4262)..(4262): n is a, c, g, or t
  misc_feature (4265)..(4265): n is a, c, g, or t
cggacgcgtgggcgtgacgcgtgggcggacgcgtgggtttttttcctctcctgcgcctcgccaccgcttcctcttgtcgcccgcctctctcatcgaccctaggcgcgccgcctcgccgccgccgatcccgcagccgtcgatcctggccgctccgatagccggtcagtccgtccccatcatcccctcgctatcgatcgcctccgacttgcgtggttttccggcgcttgcacggccgcgacgcgactactcttggagtcatagttcgtggattgtcaatcgaaagagggctacttgattgttcggccgcgtcggttatagttgattccaagcatggnaaagtctaccaaatggttcagtaaacaatgcggagcataaccatggaaaacaagaagtccatggatgctagtgtgcctgaagaagtacaagatgtttttatttacagagaagatgttgtgagcttgaagtccaaggaggatgtccgtggattagttttagaggtagctggggaatatgattctgaaggtagcatcactgatgatgatattgatactgaggaacatgaagataaaactgttcgtggagcagaaaatggtgctgctgatggtgataatgctagtaatggagctgaagttgaaagccagagttctttgccggataacaaagttcgagtgttatggcttgatgatagtgaaaaaacagaagacattgatgaggtagttgttgttgatagaagtttccttcatggtgatttagttgcctctgcctcagatccaactggtcagatggggcttgttttggatgtcaatcttgtggttgatttgcaaggtgtgaatggcgatatgataaagggtgtttcttccaaggatttgagacgaatcagggaattcaatgtgggtgattatgttgtctctgggctatggcttggtcgagttgatgaagtgctcgatagtgttaatgtgctttttgacgatggctctgtctgtaaagtcaatagagcagatcctatgtgcttaaagccagtatttggcccaatgcatccagatacagattgtcctttttatccaggacagcgtgtgaaggcagtgtcatcatctgttttcaaaacatcaaggtggcttaatggattgtggagagcaagtcgtcttgaaggtactgtcacaaaagtggaaagtgtttctgttatagtctattggattgcatctgcacactttgcttcagatcagcaacctgttcctccagagaagcagaacccaaaggaccttactcttctgtcttgtttctcttatgcaaactggcaattaactgactggtgtcttcctcaccgatacactttatgtactaatgataccgtgattaattctgataagcatacaggtcagatctgtacatgcccagaaagctcagttccactgtctgatattccagaatctcaagctgatgttcagactgaacaagatcaaatgactgatacagatgcaggtcataggcaaatagatgttgattctactgcagatggattgagtatgtcggacggagataattcatgcatagccaaagaatcagaaactagtgtatcaagcattctaaaggagccacaggacaatgcaacatctaggaaaaagcttaggaaagtgtccctaaaaaaacataaaagaacgaaaaaaagagacgacagctttgagcgagctctactcattgcaaatacttgtaccaaagttgatgtaatctggcaggacgggacaaaggaatgtggggtagccgcaacatcgttgattcctatccacaatccaaatgaccatgagttcttccctgagcagtatgttgtggacaaggtcacaaatgatgttgatgattcttctgaaccaaggcgtgtgggtcttgttagaagtgttagtgctaaggaccgaacagtaactgtatcatggtttaagccttcgctacatccagaggagacaaagaatatcgtgtgtaatgaaattgtgagtgcatatgaactggatggccatccggattatgattattgctatggagatattgtcgttcgcttgccgcctgtctcacctgtaattgaatcaaccaataacaaggatcaaatggaactagataggacggtcgatgcctcggaaggatttgctgcctcatatgctgcaccccctgatactagtgcaggcgaacagctttcgcagaaggaatcctgctcgcagtttacaagcctctcttgggctggaaatatagttggctttcaagacggtgagattgaagtcatttggggtgatgggtcgatttcaaaggttgggcctcatgaaatatatgttgttggccgtgaagatgatgatgcctcactagatgacggaacagcctctgatggtgctagctgggagactgttgatgacaatgaaatggatgtacttgatgattctgcaaaggatgattcacaaagcatacctgagaatagcattgaaagggaagatggttcattcagctcccagaatggaagttctgttgcaactggtcccctttcagttgcttttgggtttgtgacccgactagcgagtgatctcttcgctcgaggtagaaggcatttagatagatcgtcaaactcggatgctatggatgaagttgagtctcaccagtctaatgaagtttcagaaactagtgatgacattgataagattaatgagaataatgtggaatcgccagaggatgctgcagtaatagaaaacgattcttctgtcgagaagtctgtagatgtggtcatggctgataatcttgtagatttggaatgtttcaaacactttgatattctgcaatgtcctccagaccaccattaccttgaaaacatagcccagggcacgggtggaagaaagtgggtaaaaaaagtacagcaggaatggagcatacttgagaagaacctaccagactatatttatgtcagagtctttgaggatcgcatggatctcttgagagccgtgattgttggagcaagtggaacaccctaccaagatggcctgttcttctttgatttctaccttccacctgagtatccgcaagttcctccgtcagcatactaccattctggtggtttgcgtgtaaatccaaacctgtatgtggatggaaaggtttgcttaagtctcttaaatacttggaccggcagagggaacgaagtgtgggacccatcatcatcaagtattctacaagtactggtttcacttcagggattggttctcaatgaaaaaccctattttaatgaggctgggtacgagaagcaagttggtactgttgaaggggagaagaatgcagtgccgtataatgagaatacgtacctgctgagcgtgaaatccatgctgtatatattgagacggcctcctttgcattttgaggattttgtgaagagccatttccgcaagcgtggccactacatccttaaagcctgtgaggcatatttgcaaggaaatgttgttggcactctcactgacgacgcatgcaccaccaacagaagcacggagcactcgagctctgtcggcttcaagcttgcactagcaaagattttaccaaggttgattacagccctgaaggagcatggagctgattgcgaccaatacgagcaccttggcaaaacagaccccgttagagagagctgatcattgagtgacttgtacttggatcttttgccttttatatctgttcttttttcgggtttcagaaaagatggtgacttaataccaccaggctgttttcgtataaatgtacattcaaagtttgttgtttccgtcaaacatttggaaaatatggccccaaatgatttattcgatacatggagccgagctaccctgtacagttgcgccgtgtttggttcgatgtaatgtaacgttatcagatttcttggagtattcgataatgttacatttgtttgttatgggttctattaaaattaaatatcggaattggataccgccgaatanaaaacttaaaactctccaatcatctagccagaatcaacgtcggggtcacctgcttcgcatcgccagggccttcctcctcatcggacgctagtgctgcgctgccacccaggcctcccttctcggatgccagcagntggggccaagtcttcggccctctcccttcccttcggcaccaaagtccatctgcctctttgaatctccgataccaccgcccaggtaatgagagtttgcctaggcaccaaagtccatcctgcctctttgaatctccgatagccaccgcccangnaangaanagnttgnctn

SEQ ID NO: 1117 - DNA, 1272 bp, Zea mays
  misc_feature (19)..(19): n is a, c, g, or t
aaatctctctctcagcttncagttctgagcgatctccggccgggaaatctccatcaccatcgccttcaactcaagcgactacagcaaacttgctgagactgcagctgatcatggggtcgacgacatggttggcggccgtgctggcggcactcgtggtcgccgcctcctcaacggtggcatcacacgcctcgctgccggggaaacttgaggtcggtttctacgagcactcgtgcccacaggcggaggacatcgtgcgcaacgccgtccgccgcggcatagcccgcgagcccggcgtcggcgcggggctcatccgcatgcacttccacgactgcttcgtccggggctgcgacggctccatcctcatcaactccacgccgggcaacaaggccgagaaggactccgtggccaacaaccccagcatgcgcggcttcgacgtcatcgacgacgccaaggccgtcctcgaggcgcactgcccgcgcaccgtctcctgcgctgatatcgtcgcgctcgcggcccgtgacagcacctacctcgccggcggcctggactacaaggtcccgtcgggccgccgtgacggccgcgtgtccaaagaggaggaggtgctcgacaacaatgtccccgccccgactgacgaggtcgacgagctcatcgagagcttcaagcgcaaggggctcaacgccgacgacatggtcacgctctctggcgcgcacaccatcggccgctcccactgctcctccttcacgcagcgcctctacaacttcagcgggcagctggggcagacagacccgtccctcgaccccgcctacgccgggcacctcaaggcgcggtgcccttggccgtccagcgacgaccagatggatcccacggtggttccgcttgacccagtcacgccggcgaccttcgacaaccagtactacaagaacgtgctggcgcacaaggtcctgttcatctccgacaacacactgctcgacaacccatggacggccggaatggtccacttcaacgccgcagtcgagaaggcatggcaggtcaagttcgccaaggccatggttaagatgggcaaggtccaggtgctcaccggcgaggagggagagatcagggagaagtgcttcgccgtcaacccacactactagtcaagtttaattatctaattaccccgcgcgtgttatgtttgtttatacgttccatacatcaacattatgtagagtgtttttcgttctcttcaaggctgtgaaatcaaacaagtttatcaagtaaaatggtgttatttgc

SEQ ID NO: 1118 - DNA, 4176 bp, Zea mays
  misc_feature (3278)..(3278): n is a, c, g, or t
  misc_feature (3786)..(3786): n is a, c, g, or t
gcccgaaaccactctgataaaagtcagaggctattgtaaaagatagacatcatggctatcctgaacacgtcaatattcacgaaactaacttgtggcctaacttagtccccgctcccaactcggactcggacggaactctcaagatctcacgtcaagaatggatctgtgggcaggacgattaactcatctacatgtttttgttgtaacaatagaacccgagatacgagggattggtagataaggataggtttacataagaatttttatctgatcttcctataactgattgcttccttagactataaaaggcggtatcagacgtttcatggaaaggagatcaccgacagccacttgaggtaggatattatctcctaggagagcccaaactagtataattatataattatttgtgtccatgtgttcttactttcttctctagatcacgcgcaatccgcccacataaattcactatcgagaaattcctcgacaaggagctttagtggatggaacttcacaggtaggagaaggagcgtcggtcgtaggaggaggagcatccacggatggtcggtatggataatgagaaggatatagatatggaaatccaaatggttaaaatggagctagccaatcagaagctgctacttcagcacgagacgatcggtattgacccgtactttaaagccacggataatacgaccggcaaggtctcaacatgaacaatactgaccttattttaagacatatttaactaaaccactacatcgatataatctcactaaatcactcacaataaatatatataatagtttagagtagtattattaaaaatcgatgaagataaaaaccataaaatacataataaattatactatgtatattttaaattttaggagagtctttagtgggactatataagctctagagcggtacggggcttgagcctcacccaccccacctctaaaacaatcctgtattgaccacgccaactgattggcagggccagtcagtactgacagcatgcaaaggccacatgctcgggtggtaggggcttcggttgaactaaaggcagagagctatgtgggcttatcgggtcatttgaccctataagatttggcaaatcatatacaatatattgttagctagtgattagtgaagctgacacctagccttagtgataacataattcattttgacacggcttcgatttgtcttggtcatgcggcagcggtatcgaccatgtcaatgaaacttgatatatatatatatatatatatatatatatatatatatatatatgatcaagcaagtaatatcattgtccatctctaaacagttgtctgctctgcttatcattacgttgattgatcaaaaataccccctcgtgatagctacataatttacaatcgaaagtgacgcgtgtggcaattcaaaacaaagacaagatgcgtgttttgcagctgttttgttataggaaggtcgaaggagtttttttcatttttaatgatggtgcatggaaattaagagggtctagcagacattagctagggaacgcgaagattgggtcttatttcttgaccgggtgcacatgacatacacacgccatcctccaactgcgacatgtcgccatgcaagcttccaatgtataaatagagacccagcggcggcaccgttcttcaaatctcctcatcagcttcacttctcaacatcaccatcgacctcgatcaactcaagcgactatagcaaacttgctgagagtttgggtatatacgactgcagttgatcatatatggggcggtcgacatgctggctgatgcctgctgccttgctggtggcactcatcgccgccgcctcctcatcggtggcactcgcctcgccgcctgggaaacttgaggtcggtttctacgagcactcgtgcccacaggccgaggatatcgtgcgcaacgccgtccgccgcggcatcgcccgtgagcccggcgtaggcgcggggctgcgacggctccatcctcatcaactccacgccgggcaacaaggccgagaaggactcagtggccaacaaccccagcatccatgcgcggcttcgacgtcatcgacgacgccaaggccgtcctcgaggcgcactgcccgcgcaccgtctcctgcgccgacatcgtcgcgttcgcggcccgtgacagcacctacctcgccggcggcctggactacaaggtcccgtctggccgccgtgatggccgcgtgtccaaagaggaggaggtgctcgacaacaatgtcccagctccgactgacgaggtcgacgagctcatcgagagcttcaagcgcaaggggctcaacgccgacgacatggtcacgctctctggcgcgcacaccatcggccgctcccactgctcctccttcacgcagcggctctacaacttcagcgggcagctggggcagacagacccgtccctcgaccccgcctacgccgggcacctcaaggcgcggtgcccttggccgtccagcgacgaccagatggatcccacggtggttccgcttgacccagtcacgccggcgaccttcgacaaccagtactacaagaacgtgctggcgcacaaggtcctgttcatctccgacaacacactgctcgacaacccatggacggccggaatggtccacttcaacgccgcagtcgagaaggcatggcaggtcaagttcgccaaggccatggttaagatgggcaaggtccaggtgctcaccggcgaggagggagagatcagggagaagtgcttcgccgtcaacccacactactagtcaagtttaattatctaattaccccgcgcgtgttatgtttgtttatacgttccatacatcaacattatgtagagtgtttttcgttctcttcaaggctgtgaaatcaaacaagtttatcaagtaaaatggtgttatttgcacaaaaaaaaaaaaaatatttagtgatgacacccgatcacaaatatagaagctcttttttcccgcgaccagcactgtgtatgtagtctgtacaacactgagagcatctgatttcaccttaattttgatctaatttgtactaacaaaaaaatattgcttttgagaactgcaactgaattttttttacttgtattgatcgaaagttaaactaaaagcccgcatctgacactaaaagcccgcaactttaccggttgcactggctggtactaaagatagtactccagtaccgattcttgcttagaaccgttactaaaggtcccctattagtatcggttcttggctagagccgtactaaagtngaaacattagcaccggttgtaatcacaaattggtactaaagtcaatatatatgggttttcaataactagaggaaacacatgctagacgctaggcaacacgttccaacccaaccaggtcccaacgtctataaaagcagttccagacctctagagtttattttttgacgccaccatcctgacgcacgagcgacgacaacagttccccgagaacgagcagcgatgacggcccgagaggcgcgagcggtgccgacagcccatgaggcgcaggcaccggccacggcctggggaggcgcaagcgagctacgcgcgccacctcactcgccggcggtggttactcgaggcgcgagcagcggcgatggtggccccggaggagcgagtgccgacctcagcccagggaggagcgagcggacacagactcgtgtgagggctccccacgtgcgcacgacagtgatggcccctgtaacaccctaaatttgggggtataaaatttcttctctaaatgcctacnaaattcaggtgttacctcttgtctctccctctagactctctctctctctcttttccttttgagtagaattaggttaagtaagtgagggattaattatttactttgtcaaaactatgtgagtcatgaattgttgcatcatgttgagcctaaattattcttttgtttgatgcacatgtttgaaattatttgaatttgatttggggtttgaatttgatttgaaattcatagagaaaataaaaagaaaagcaattagaaattctaggaaaaagggaaaccaattctagcccagcaagcccatttcagcccagtcatcccgcgtccgtgcgtccgcccctccctgacaagcggtccccgcctgtcagcgtcatcccgcgcccgctctctcttccc

SEQ ID NO: 1119 - DNA, 2641 bp, Zea mays
ccgatagatgtacccgacctattttcacccctaataaaatgcacgtctgatttattttaattttataatttaatcatgtgagggtccgagccgcttgtgaccgtgagcacgactgatatattagttttacactttgcagaggttgcacatcttaacccatagtcatgttacccatttgccaagggctcaatactcacataaatctcttctttggaggtgaggcaggattcactacaaggactttgtaaatttccactagcatgagaaaacccgctacggtttcaaatagaggtggtatatgaacccctcgtctgaaaagcttccacaaagcagatcaacctaagaacctccctatacttgagcaactcctccctgcttgcccatgtcgaggaaggttcttacacaccaactttcgtaatcaattagctaagaccagagccataaaagtaattgtggtcacattgttttctcggttggttctccatgttccaattaaacacggtggccttatcctgcataataaataaaccaacaataataaatcataataaaatatgaccatgattcataagtatcattattcccaaaaacgaagttgagcacaagaatgtctacccaataattagtaacttaggggtacacaaggcacagggaaaacaaagttaggtaacctattaggtcccgtcgggttaacctaactgcaatgcataggtgaggacataataataaatattattaggtaaaagaacgagatcaagaaaacacttgtctttcttagtaaactcctgttgctcaaatgcttttgtaggttgggcttgaaaaccctttgtcaaggatttcccgagggtgaatttatataggttagggtggttcatgctctcgttgtgcgataataccctatgtcctgtgttttgatggctattgatctgttatgttctggtttatgctcatttccatcctaggcactgaggccacgtcgtaggctccggttggaccttgccttagtgatgacacaatccattttggacaaggcttggatttgtcctggtcatgcgataggggcatcgaccatgtcaataaaaaaattaactgtatgtgtcttcatgaattctctgatcaagcaactaacatcaatttcgatctctaaacaactgtctgctttgcttatcatttgctgctacaaccaagtctgggcaacattattaggtacatgctgacatatatgtactacaaagtccactgacacggttcttgtagcagttgttactcgattgttatcgcgatgcagggattatattgggtcttgcttattattcgttgacccggttcacaaacacggttccaagcacattgtataaatagagagtaacatctctcgcggcccgcgatctcctctcctcgtcaccatctcgatcgagctccagagctaaagcagatagaaagctcagagtgagagagcagcatctgatcgatcgaccaattgttcaccttcgtcatgaggtcgacttggttggcatttgccttgtcggcgctcgtcgtcgtctcctcatcagcggcacacgcacacgcctcgccggggaagcttgaggtcggtttctacgagcactcctgcgcacaggccgaggacatcgtgcgcaacgccgtccgccgcggcatcgcccgtgagcccggcgtaggcgcggggctcatccggatgcacttccacgactgcttcgtccggggctgcgacggctccatcctcatcaactccacgccggacaacaaggccgagaaggactccgtggccaacaaccccagcatgcgcggcttcgacgtcatcgacgacgccaaggccgtcctcgaggcgcactgcccgcgcaccgtctcctgcgccgacatcgtcgcgttcgcggcccgtgacagcacctacctcgccggcggcctggactacaaggtcccgtctggccgccgtgacggccgcgtgtccaaagaggaggaggtgctcgacaacaatgtccccgccccgactgacgaggtcgacgagctcatcgagagcttcaagcgcaaggggctcaacgccgacgacatggtcacgctctccggcgcgcacaccatcggccgctcccactgctcctccttcacgcagcgcctctacaacttcagcgggcagctggggcagacggacccgtccctcgaccccgcctacgccgggcacctcaaggcgcggtgcccttggccgtccagcgacgaccagatggaccccacggtggtgccgcttgacccagtcacgccggcgaccttcgacaaccagtactacaagaacgtgctggcgcacaaggtcctgttcatctccgacaacacactgctcgacaatcccatggacggccggaatggtccacttcaacgccgcagtcgagaaggcatggcaggtcaagttcgccaaggccatggttaagatgggcaaggtccaggtgctcaccggcgacgagggagagatcagggagaagtgcttcgccgtcaacccacactactagtcaagtttaattatctaattaccccgcgcgtgttatgtttgtttatacgttccatacatcaacattatgtagagtgtttttcgttctcttcaaggctgtgaaatcaaacaagtttatcaagtaaaatg

SEQ ID NO: 1120 - DNA, 1704 bp, Zea mays
catgaaaaataaaatgataaaagattacccctcttcttgcaagagatcctctaggagaagaggtgttgctacatatatcaaaataatgtttttcttgcttttgagaattcgacgcgtgtggtggcaatcgaaaacaaggacaagaagatgcatgttttgcagctgtgttgttcggaaggagttgtttttattttaaggatggtgcatggaaagagagggtctagcagacattagctagggaacgcgaagattgggtcttatttgttgactgggtgcacaaacacgccatgattattgcgacatactgccatgcaagctacctccaatgtataaatagagaccccgcgccaggccggcccgggatatctcctcatcagcttcagttctgagcgatcaacatcaccatcgacttgaactcaagcgactacagcaaacttgctgagactgcagctgatcatggggtcgatgacatggttggcggccgtgctggcagcactcgtcgtcgccgcctcctcatcggtggcatcacacgcctcgccgccggggaaacttgaggtcggtttctacgagcactcgtgcccacaggccgaggacatcgtgcgcaacgccgtccgccgcggcatagcccgcgagcccggcgtcggcgcggggctcatccgcatgcacttccacgactgcttcgtccggggctgcgacggctccatcctcatcaactccacgccggacaacaaggccgagaaggactccgtggccaacaaccccagcatgcgtggcttcgacgtcgtcgacgacgccaaggccgtcctcgaggcgcactgcccgcgcaccgtctcctgcgccgacatcgtcgcgttcgcggcccgtgacagcgcctacctcgccggcggcctggactacaaggtcccgtctggccgccgtgacggccgcgtgtccaaagaggatgaggtgctcgacaacaatgtccctgccccgactgacgaggtcgacgagctcatcgagagcttcaagcgcaaggggctcaacgccgacgacatggtcacgctctctggcgcgcacaccatcgggcgctcccactgctcctcgttcacggagcgcctctacaacttcagcgggcagctggggcggacggacccgtccctcgaccctgcctacgctgagcacctcaagatgcgctgcccatggccgtccagcaacgaccagatggaccccacggtggtgccgcttgacccagtcacgtcggcgaccttcgacaaccagtactacaagaacgtgctggcgcacaaggtcctgttcatctccgacaacacactgctcgaaaacccatggactgccggaatggtccacttcaacgccgcagtcgagaaggcatggcaggtcaagttcgccaaggccatggttaagatgggcaaggtccaggtgctcaccggcgacgagggagagatcagggagaagtgcttcgccgtcaacccacactactagtcgtcaagtttagctaattaccccgcgaattatgtttgtttatacgttccatacatcaacattatgtagagtgtttttcgttctcttcaagggtgtgaaatcaaacaagtttatcaagtaacattctttgtgtttcaaaaatacaaaaaaaataccgtccatacatatatcgactttaataccatgtgttggagacttgtttcaaaaaaaaaaaaaaaagggtta

SEQ ID NO: 1121 - DNA, 1025 bp, Zea mays
acgcccacgcgtccgcggacgcgtgggcaggtgtagctcttttcttttctgtgcaactcaactttgctgtccctggtataattcatgttacttggtcatactcaagtaactcaactctccattttgattggaaacaggtttcttatttttatagttgaatataatactttggtctgttcttaaacaatagtcttattacaggtagaccccctaggcaaggttgaccctgaagtggaggatttacttctagaaatcgccgatgacttcattgactcggtgactgcatttgcgtgtaccttggcaaagcacaggaaatcatcagttgtcgaagccaaggatgtgttgctgcacttagaaagaaattggcatttatctgttcctggtttctcaagggaggataagaatccccaaagaaattctgtaaagccattggtagatccccaacaatcagaaagtgacgttactggtattagaggtacaagcaataaactaggtgctaataactcggttggcaaccatcaaatacgacctccaatggcagaaacttcggctgtgccaacagtgggctctctatcgaaagcccctcgcttctaagggctatgctgctcttccctattgaaggaaaaattcctgtttcaggacaatctacgtcgaaaacagcccataggctctaactcaaggattgctagcaagtggaagcaaaataaacccacgagcgtctgtggcaaactgcagatgcttgtgtcttacaggaaagcagttgctgacttaccaatcgtctctggcagatcctctctacctggggtcgtatgtaactgtattttctttttgtgcccgtaaatgcccccatccgttgtatataaatgtttttgcaatgggggcattatcgtctccagttttgatgttgctatgtaggcgaacaaatactaaagtggaagttaatgaagtgtaagattgatgtcgttttccgttactgaacagttgtgccatatctaacacgctggccgtcggtgggaagctttggc

SEQ ID NO: 1122 - DNA, 729 bp, Zea mays
cggcacgaggcaaagcacaggaaatcatcagttgtcgaagccaaggatgtgttgctgcacttagaaaaaaattggaatttatctattcctggtttctcacggggggataagaatcctcaaagaaattctgcaaagcaactggtagatccccaacattcagaaagtgatgttactggtatcagaggcacaagcaataaacttggtgctaataactcggttggaaatcatcaaatacgacctccgatggcagaaccttcagcaatgccaacaatgggccctctatcaaaagcccctcgcttctagtggttatgcttctcttccctatcgaaggaaaaattccttttcaggacaatctacctggaaaacaacccgtaggctctaactcaaggattgctagcaagtggaagcacaataaatccacgagcatctgtggcaaactgcagatgcttgtcttacagttacaggaaagcagttgctgacttaccaatcctctacatggggtcatatgtaactttattttattttattttatttttgtgcccgtaaatgcccccatccgttgtatataaatgtttttttttttggcaatggggcattatcgtcaccagttttgatgttgctaggtaggtgaacaaatactaaagtggatgcaacttatataatttaatgaaatgtaagattgatgtcatttttcgttgcaaaaaaaaaaaaaaaaactcgagggggggc

SEQ ID NO: 1123 - DNA, 2094 bp, Zea mays
  misc_feature (9)..(9): n is a, c, g, or t
cggccgggnaaccctacacgcccccgccacgccgcggcatggcggatccgccgcccgtggccgcctccgcctcgccggcgcagcccgaccagctcgccgccgcggcctccgtgtccaccccgcagaaccccaaccccctcctctcccctcaaattcccccgtccccgaccgtctccgacctctccgcgcacatctcgtccccgcagcagctcgacccggcggctgcggcagctgacgcttcgggcggcggaggatccatggattacctcccgcgcccgccgcagctgcaggcgccttcgcccacgcaggcaggggtcggcgccgcggggtttgcccagatcccccgctcggggtcgacctcacgcctctccacggccacccagctccagcagtacgcggctaggatgtacggcgggcagatgagcttctcgggtggcggagggctcgtgggccagcagcagctggcggggcgcgcccccatgcttgggcagggccagctggggatgctgcaaggccagggtaacgcggcatctgcggcacattttgggcttcagtcgcagatgttggcgcaggctaggcaaaaggtcatggcacaaaacacccaattgaataatgctaatacagctcaagtgctgcaagggatgcagcccatgggtgtcatgggtgctatggggatgaaccagacgagaccgaatgtaactattccctatggtgctcaacaaaggtttgcccaggcacaaatgaggccacaagcatctcaacaacctgcactgtctccacagaaggtacctggtcaaggtttgtcgaggacagcatcaattaccgcattaaattcacaactgtctggatcatcacaaaatggacagatggtggcaatgtctatgcctcagcaacagcaacagcagcagcaatggttgaagcaaatgcaaccatccatgggctcaccactttccccacagcaacaatatcagaaccagcagaggctcctgttgatgcagcatcttcagcagaagacaggattgaaccaacaacaacttctccaaatccaacaacagcatccacatctcaatgtccaacagctgattaagcagcaacaatttctgaagcagtttcagcagcagcaaccgctacaatctcctcgtgttttagcatctggttcacagaaatctgcgaatcttacaggctcgcagccgggtacaccattgtcaggtggaactatgactggtggaagtggaagtcagggagctgaaggaactagccaacttcttgggaaaaggaaaatacaagatctggttgcacaggtagatcccttaggcaaggttgacccagaagtggaggatttacttctagaaatcgctgatgacttcattggctcggtgactgcatttgcgtgtaccttggcaaagcacaggaaatcatcagttgtcgaagccaaggatgtgttgctgcacttagaaaaaaattggaatttatctattcctggtttctcacggggggataagaatcctcaaagaaattctgcaaagcaactggtagatccccaacattcagaaagtgatgttactggtatcagaggcacaagcaataaacttggtgctaataactcggttggaaatcatcaaatacgacctccgatggcagaaccttcagcaatgccaacaatgggccctctatcaaaagcccctcgcttctagtggttatgcttctcttccctatcgaaggaaaaattcctccttctgaagtttcaggacaatctacctggaaaacaacccgtaggctctagctcgaggattgctagcaagtggaagcacaataaatccacgagcatctgtggcaaactgcagatgcttgtcttacagttacaggaaagcagttgctgacttaccaatcctctacatggggtcatatgtaactttattttattttattttatttttgtgcccgtaaatgcccccatccgttgtatataaatgtttttttttttggcaatggggcactatcgtcaccagttttgatgttgctaggtaggtgaacaaatactaaagtggatgcaacttatataatttaatgaaatgtaagattgatgtcattttt

SEQ ID NO: 1124 - DNA, 975 bp, Zea mays
atcccccccgccgcgtcggcctcacgcctctccacggccagccagctccagcagtacgcggctaggatgtacggcgggcagatgagcttctcgggtggcggaggtctcgtgggccagcagcagcagctggcggggcgcgcccccgtgcttgggcagggccagctggggatgctgcaaggccagggtaacgcgggatctgcggcacattttgggcttcagtcgcagatgatggcgcaggctaggcaaaagggcatggcacaaggcacccaattgaataatgctaatacagctcaagcgctacaagggatgcagcacatgggtgtcatgggtactatggggatgaaccagatgagaccgaatggaactattccctatggtgctcaacaaaggttcgcccatgcgcaaatgagaccacaagcgtctcaacaacctgcactgtctccacagaaggtgcctggtcaaggtctgtcgaggacagcatcaattgcagcattaaattcacaactgtctggatcatcacaaaatggacagatggtggcaatgtctatgcctcagcaacagcagtggttaaagcaaatacaatcatccatgggctcaccagtttccccacagcaacaatatcagcagcagaggctcctgtttatgcagcaactgcagcagaagacaggattgagccaacaacaacttctccaaatccaacaacagcatccacatctcactgcccaacagctgattcagcagcaacaaattttgcagcagtttcagcagcagcaactgctacaatctccgcgtgtttcagcatctggttcacagaagtctgcgaaccttacaggctcgcagccgggtacaccattgtcaggtggaaccatgactggtggaagtgcaagtcagggagctgaaggaactagccaacttcttgggaaaagaaaattacaagatctggttgcacaggtagatcccctagcaaggttgacc

SEQ ID NO: 1125 - DNA, 1155 bp, Zea mays
atacgcaacgcaacatccccgaagagagcttgcctctcgttaagccaggccggcgaggctgcgtgtgcgtgcatgcggcgacgtcggccgggggctgcagcatggccccgatcgacctcgggcgaggcggccgcacctcaggcactggctcgggggccgcgccgggcacaccccggctcgtgatggtcgtcgtcgaccccgtccgcgagtcgacggcggcgctggagtgggcgctctcccacgccattgtcgagggcgacgacatcctgctcctccacgtcaacatgccgtacccgcacaacggggccgcgggcagatccgggccctcacgctcctcgtctggcgggagcaccggttccccgatcgccgcgctcctaggcggaggtggaggcggcggctcgggcgccggcgcggatccggcggacttcatggaggagatgtgcgccgcgtgcaaggcgcggtacccccgcgcgcgggtgaacgcggagcgcgtcgagcccgctaccgagggccgggaagccaaggcgcagaccatcctcgccgagtcccagcgacgcggcgtcgagctcctcgtcataggcctgcgccgcgcgtcctctttctttgggttaagaagcccgagcgggtcgtcgagccgcgggcacgacagcacggcggagttcttgatcgagcatagcaagtgcctgtgcgtaagcgtccagaagaagggccagaatgccggatacctgctcaacaccaagacccacaaaaacttctggctactagcatgaacgtacatgtaccttcatgatcgatcgatcagacttgttttcatgtatgtgtagacatacatacattaggcatgcatggcgcgtatgcacctacacggtttgcttgattttaccagctggctcgaaccgagcggcggggtaaaaaaaaaaaaagaacgaacaatctcaaatccctggctttgttcatgattcgatcccctctttttaaccaaccgattgtgcacctcggctttttcgataaagaggaggttatttcatccgatctattagagcatatccaagggattctttatttttatcattctatttaactttctatttatcttcctataaaaaaaaaaatcaaaatatatagcaaaaaaaaaaaaaaaaaaactgggggggg

SEQ ID NO: 1126 - DNA, 2672 bp, Zea mays
ggtggtataactaatctaagtacttcataaagtatcattgctaatcaataaatggttttaagtttagagctattaaagataaggctcaaaactcttaatatattttcaccttccacctgtctcaaatggtcaattgagaccttatttatagacccaatgaaagatatagccattataattttaacaaccatatctgcatgaatcctatttttctaattaatttctattttaaaaaaagtttatttttcttaaaaaataaaaattatttagaaaaatagagttctaaaactaccccttaaaaattaaacccaacccctgcatccgtatgtactcgcaccctctcatgtttttatccggacacgcgcctaaaatatactagctattccgtgacccctcgtgaatcactccgacaaccgaaagcagaaaaggttctcccccttccccaaacttggcatacgcaacgcaacatccccgaagagagcttgcctctcgttaagccaggccggcgaggctgcgtgtgcgtgcatgcggcgacgtcggccgggggctgcagcatggccccgatcgacctcgggcgaggcggccgcgcctcaggcactggctcgggggccgcgccgggcacaccccggctcgtgatggttgtcgtcgaccccgtccgcgagtcgacggcggcgctggagtgggcgctctcccacgccattgtcgagggcgacgacatcctgctcctccacgtcaacatgccgtacccgcacaacggggccgcgggcagatccgggccctcacgctcctcgtctggcgggagcaccggttccccgatcgccgcgctcctaggcggaggtggaggcggcggctcgggcgccggcgcggatccggcggacttcatggaggagatgtgcgccgcgtgcaaggcgcggtacccccgcgcgcgggtgaacgcggagcgcgtcgagcccgctaccgagggccgggaagccaaggcgcagaccatcctcgccgagtcccagcgacgcggcgtcgagctcctcgtcataggcctgcgccgcgcgtcctctttctttgggtaagtgcgtgcgtgcaggcgttctcgtatcggccccagatcgatctctcagtttaatttggtcatcatcaggttaagaagcccgagcgggtcgtcgagccgcgggcacgacagcacggcggagttcttgatcgagcatagcaagtgcctgtgcgtaagcgtccagaagaagggccagaatgccggatacctgctcaacaccaagacccacaaaaacttctggctactagcatgaacgtacatgtaccttcatgatcgatcgatcgatcagacttgttttcatgtatgtgtagacacatacatacattaggcatgcatggcgcgtatgcacctacacggcttgcttgattttaccaggcggctccggccgggcgaaaaaagaaaaaagaaaaaggaacgaacaatctcaaatccctggctttgttcatgattcgatcccctctttttaaccaaccgattgtgcacctcggctttttcgataaagaggaggttatttcatccgatctattagagcatatctaagggattctttatttttgtccttctatttaactttctatttatcttcctataaagattacactctctatatatagcaaaaaaaaaaaacagactatatatctagtttggctattcagagtggttaaccaagtttggctagtaagatagtcaatttagagagtcggatagcttgacgagttagatgactagtcttttggagagttattttatcgttaagtagccaaaatttgatttgacgagccatttaactagtctctttgagatgttcttactcccttcattcttttttatttgtcgtgttttagttcaaaaatgaattagctggtgacaatattcgagaacggggtagtactatttagcaaccgaaacaaacctagatccaccaatgctctaatctattactaaaacatccaatcattttgggcaagaatcgccaaggtaatgatctctagcttcagacacaaaacctttaaaagattgtcggccctccccttcagaaagatgctctagaattgaatccaaaaatggccctgtataaaacatgcataggagtagaaataacaatattattgaaaattacatcattccgactaagccaaatcgtccataaaattgtagctccacccaccgatgtaattcttctcagcgccggtttaactccctgtagccagcccctaaaacaatgggcaatattttgaggaggcttaaaaatggttgtgagttctattattctgcatacaaacttatcaaaagagcgatggaaaaacaagtgatctataatctcattacaatactgtctttctaattcttgtttttttttcaaattaagtctagctgaaagttcttgccattgttgcttagttaacccattgaagtgtctcatgcactccaaatttagaggatcaaaacttggcacttcaacaatcgtgacctatttggcagttccaatgttgaacaaaattgggtgttggcttcgtcttaaggttgttgttctcaaccatatatccttccaaaatcttatctgagtaccactctctagcttgaacctaactcgaggaaatgatctttgattattatcattcaacgtcct

SEQ ID NO: 1127 - DNA, 2880 bp, Zea mays
ccgggccccttcttttccgcgtccgctgctttggcttcgcctcgcggtcgcccagtcgcagcagcaacaccgcccccggcctcgctttgcagccccctccctccaccgcctcctccacgccctagcgctccggcccccgccccgagctcgtcgtggccggctgcgctgcggtgcccgcacctgtgggggcgtgcgggccggtggtgaaacgacccgcgacctcggtgcctctcgacgtctgcccgcttcctcgccggcgccattttgttcgtctaaatcccctgtgataagcaccactgctcgtgatgcattcttcggaaaataaactgggttggaatgagacctctatggggttggttcctgtaccaaaaagaccagctagacctgatgcttcccaccaatgcaaatctgattcctttatgaagcgatcaccaaggaaagttagaaatgctactctggcaaaaagcataaagagcaaataccactatagtcccctcaaacagcggaagggttcagattctgttcctgggaaaatcgtaacaggactaaccgcaaggaaaaagaagaaaaggaaaatccaaattacagacgaggcaactcgtttggaacgaagagcgagatattttctaatcaagataaaactggagcagaatttgctagatgcttactctggagatggatggaatgggcaaagccgagagaaaataaagccagagaaggaactgcaacgtgccaggaaacaaatcataaaatgcaaaattgctatacgtgatatcatccgccaacttgatttgtatacttctactgggagtgttgatgacccactaatgcctacagatcagtccaccaatcccgaacataccatgtgctcaacatgcaagtctcatgaatcatttcccagccataaaattatcttctgcaaagggccctgcaaaagggcatgtcatgagaaatgtttggaacctcccttaaacaaaagcgtacttccaacaagtagccatgggtggctttgcaaattctgtttgtgcaaggtgaggattttagaaactattaatgcacatctagggacgagttttacagtgaagtgccactttgaagatatattcaaggaaactactgaactaatagactctgaggatgcactagatgaagattggctttctgagtattcaggtgatgaggactatgatcctgatgaaaatgaggccagtggcgactgtatggacagcggggagaagattatgtctgatgattccaatggttcaggaagccccctttattctccaaatgacgatattcctgacttcatatcagcagacttaaatgttgtggaagggttttgtcataccaatttagatttaggcattgatgccgttgaagatgattttgcacagatcctcacctaccaaaggccaagaagagatgttgattatagaaggcttaacgaggaaatgtttgggaaaataaccgggaatgaagaacagagcgaggacgaagattggggccatgaaaggagaaagaaaaggacgcattcaggtgttgctggggataattctgttggtttcttgaacgttatatctgatgaaaagagccagaagaaggggagaaaacttttcaggattcctcctgcagctgttgaggtacttcgcagagcttttgctgaaaatgagcttccaccccgggatgttaaagaaaatctctcaagagaattgggaatttcttttgaaaagattgataaatggttcaaaaatacacggtgtgctgctctcagagatcggaaggctgaaggaaacagtcataatacagctcccagcaaaagctcaaaaaataaaggaaaagctggaatctcaggcaagactggaaggaatggtcatgttactggtccctgcaataatttgagaacaaatgaagaaaaaacaggtatatcggggaagtttgattcaggagacaactcttgtttggttcccttctctgaagtcatcaatgtgcctacgcgattgccacacaactttgagatgaggaagatggaatcaactagaagtcctgcgaggctacacaataaaggagggttcctgtctgcaacagtccaaattaaggagagtacgttgttacccacaggcaagccttgttggcagtcagaaatgagccatccaacaactaatgaagtgagcacttcagcgcaagctactacttggatcgacgcgggggcgtgtgccgaggagcaagaacctactccttgggtggacatcggggtctcagactaccagcctttcctggatgtgatcgacgacatgtgcggacttgagtggaggctgcagagactgaaggagaacatgctctcatctagcatagacggccaaaccgccgccagtgagagtgacaaaagaaaccagaccgtggtgctagtgccaaccgccgagctcaaggaaaagctgccgcatgacggtttattcgggcattattgcccataggtcttatatacatagcggataaactgtacagagaaccaagaagaagaagaaaacaaaagggaaacagcaaacagacaggtgcccgcttacataccggtccatactgtcaggcactactctcctttcttgggcctcgacacgactaatactgtgctagtccagaacagatgagccatagccattacctgtgtgcctcccaggttcagttcatatgttgtatgtattaatgtatatcagaagagtcgtgcttagtagtagcaagaacctagtcctgatccagaccgtgaatctggatcatcttgtcctgtggttgtaccgtgcagaacagacagatgtcggctagtcgtttggttctgaagtaagaaactataagcatgcgtgattttggccaaaaaaaaaaaaaaaacct

SEQ ID NO: 1128 - DNA, 799 bp, Zea mays
acctccaattctttccggcgttctagcctcccagttccaggttgtagctgcccaaaccaaagccatcccacagggcctccgctctacctgtagcccgaaaaatggaaggggacgcggttctttcgagcatggattccctgtggttctactccagcgtcttcctccggcagccctccaagcacaaggggagcgagtgcgcagaagagccgcagcaagattgggcaggaaccaacaagacgaccagcggccgcccttgttgccaggctcccaaatgcgccaaggaggcagcggggcgaagagcggaggggggaacggtgcgaattgcgcctgcaacgggccgcggggagtgggatgagcgcatggttgcttggcagaaggagcagaggcggcgggcgctggttgccgcggcagcccggtgctcgccggcgacgatgccgccgcctggtggagaaggcgtggccatgaaggcgcatctcaggtcgtgggcccacgcggtcgcttgctccgtcagatgagggctctccattcaggaacctatggaaagtagattttttttgctccatctctgaacgacggcatctcttcatggttgtgcttgcggattattgtggtttatgcagttcgtctttcaggtacgatcactcgaggctcgcataaaggcaagcgattcatttgatacccagtataagtatgtgtccgtgttatacagattatgattgtaagagtagcaatgtgtcgctttctgtgtacacttgttttgcatctggaatctgataaaactcaaaaaaaaaaaaaaaaa

SEQ ID NO: 1129 - DNA, 2392 bp, Zea mays
gccggccggtatctcgccggcgattctttcttcctgctcgcgttgtttcgaactcacgcaacgcaagctgagcaaccgctgccggccgcgcacggccgcccacccaccagtccaccactaaagcctcacaccgccacagcagctgccgcggccgagccgacgacgaggatgagcggggccgcgctgtgcgcggcgctgacggagctggggttcgacggggaggacccgctggacgcggatgcgctggagtggccgttccagtatgaggaggcgcgaccgctgcttgcctggatctgctcctgcctccgcccctctaacgtcctctccccgtcccacctggcccagtatgaacaactcgtggaagagggaagactgttagagggtgaagatttggactctgcttttgatagtatttcagctttttcaagcaagaaagacaatcaagaggctgtgtttggatcggaagaaaccattcttgatatccgtgaagcaaaactagcatatagagccgaagtttttgagttacaaaagcagcttgtgcggcagcaagcacaatttgatttgcttgcaggccaggcttcaactcttattcaaggtagaagatcacgtgtatctgctatgtctgcagttagtggagagcttatatcgctagatgagatactttcttccagaaacttggagatgaattcagttcttggaagaatcactgctactacccaggaactagcccattatcattcaggggatgaggaaagtatatatttggcatattcagacttccactcctatgttgttggtgacttggcttgtacgaaagagctaaataggtggttctcaaagcaatttgagaaggggccatttcgacttgttgctgaggaggggaaatccaaatgttcctgggttagtcttgatgacatcactaattgcttgataagaggagattctgaaaaatcgcatcatcaccaacgtgtcgctgagttgcaacgacttcggtccatatttgcaacaagtgaaagacaatggattgaagcgcaggttgagaatgctaaacagcaggctatactctctatattgaaagcacaagtgtcatccgacgaggctcatatacatagggatatccattctcttaggagaaaaggttctgagcttgctggagagctctcgacactttctcaatctgttcacttgttctccccttcagacaataccgtgcctgtgttcagaacttgctcaacttcaaggcacatatatcttgcaaggggattatgatttaaaggtcatgcgccaggagtactacattaacaggcaaaaaacgttcatcaatcacttggttaatcagcttgccagacaccagtttctgaagattgcttgccaacttgaaaggaagaatatagctagtgcgtactcattgcttagagtaatagaatctgagttacaaagctacctttcagcagtcaatacccgcttgggtcattataattcattgattcaagctgcatctgaagtacgagaacaaggagctattgatgatcgtgacacttcctccatgcagtgcgagatctcctatgtattcactcaaatgtccaagcaacagtgccaacatacatgtcagcacatgcattggttcagcagatatcagcacttcaatctgacttgctttctcttcagtctgagctggagaacacccttccagctgaccggaaaagatgtatcaatgaattatgtactctgattcaaacagtggaacagcttctatttgcgtcgtcaactactgcagaaccaatattgacgccttggccattgatgcgggcacttgatgatatggaaaatgccaacgctcaagtcgaagtttctgtggaagaagtaaccaaggctcgcacccagaagataaagatctttgaaaatcgtgcccatgaggtggggagggagaggcaaatattcgttgatttcttctgcaaccccgaacgcctcaagaatcaagtcagggagctgacctcccgtgtgaaagctctccaggactaacctgtttctgtaggctggtctcacaggtcgtgatgctttttttttctatgtaaagtttgacttcactccagcgtcaggttggggctgctgtgcagggacggtatggaacaatatacccatcatgtagctcgggggggttcaggctgtaggtccttgtgccacccggaataggatggcattgttgtgatattatttgtagcgatatgtatgttgtaaagtatctcagaaatcacgagccctttctttcgtgtatggttttgcttttgagtaggttatggtggtacagttgtggcgtccaaagtcacaatcggtactgtagtttggataaatgggatcgatttcctcttcaaaaaaaaaaaaaaaaaaaaaa

SEQ ID NO: 1130 - DNA, 2713 bp, Zea mays
gaactgaatctgaacccgaaaagaccaataattcggtctatttggatttggttcgggttcgagttcggttttagttttaaaatgtccatccctagcagtgattgtgtgatctgaaaatcgtagaatgttccgagtgttcctgaagctactctgcttttcttaacatcaagagagctaagtgtgtgcctactaatttccctccggtcttatcctcatcagtcctcaactcctctctctctctctctcaacgcacctttaatgcgccgtgatctctctcctccaatcccgacaaagtacaccatcgtctcctgtcttgatgttctctctctcgctcccccaccgtcctagtcctatcatatgctcctatcttctccttcccccggcaatcgtcctagctgcaacgcactagatctgtcgacaaacccaaccagaactccataaaatagtgtcgatcaccacaggcaaacctccctccccgtttctctctctttcactctttttctctctccaagaaataattgactccaacgccaagcgccacaagcacaagcccttgcttgcttgatgtcactctttcgctctcgctagctctaacgccaccgctgacggcgctgccgagcctccagtccaccgcccaacgtcatacaccaagtcaggtcagcagccccacaagaacacttcgtaggtcagcaaatccattattagtaccgatatttctccaggtccctgaagagaaagcatcgtcttgtgtatttatatataccatggcctgatcggctatggacgtcaccggagatgccggcggaggtcgccgccccaacttccctttgcagctgctggaaaagaaagaggaacagccctgctctacgtccccagcggttgctgtgggtgctggggctaatgggtcgggagagatgcagatgaagaaggtggcggcgccgaagcgcacatcctccaaggacaggcacacgaaggtggacgggcgcgggaggcgcatccggatgcctgcaatttgcgcggctcgggtgttccagctgacaagggagctggggcacaagacggacggcgagacgatcgagtggctgctgcagcaggcggagcccgcggtggtggcggccacgggcacgggcaccatcccggccaacttcacctcgctcaacatctctctccgctcctcgggctcttccttctccatcccagcgcacctccgtgcggccggcccacgcttcggcggcgcgcggggggacccgtgggagcgcgtcgtgggagtgggactcgggttcggcgccgccgccgaggaccctccgtccgctacgtcctcggcgtcgtctcctctgctgctgagtttccactccggcagcgtcggtcttgacgtgtcgccgtcgccgtcgtctgccgccgccggctccgacctgtcgaagaaacggaggtgggagcaggaaatgcagcagcagcatcagcagcaataccaccagcagcagcagatggccgggtacacgacgcagagccaaatgccaggcgccgtgtggatggtgccgagcgcgagcagcaacgctcaagccgccgcagcggctggcggtggcggcagcaacgccaacgagtcgatatggacgttcccgcagccagcaagcggcggcggcggcggcgcggcgaccgtgtaccgcggcgtgccgagtgggctacatttcatgaacttccccgcggcgcccatggcgctggtccccggtggtgggcagcagctcgggctcggcggccccgtgcccgtgggcggcgccggcaacgacagtagtggcagtgccagcggcggcggcggcggcgagggccacatggggatcctcgccgcgctgaacgcgtaccgggcacatagtgccgtcccggacgctgcgccagcgcagaacggagcggaaggcggctctcgtcagcgccagcagcacggcggcggcggtgagcgacaggagagcgtgagtcctcccagcgacggctcgtagcgtcttcggagttcggaggcgtgtgcgtgcactggtctgctatggcgtctctctcctgtgttaattagtctgtgcttctcgacttatcgtttgcagtttttgttaattggttgcactgttgtggcctcctctggctccttcacattcttgcaaggatcatacagagtttacgtttcatggcatctgggactgggatagacggatagtcactcactgtccgcattattcgttttggtgtcaccgatcacgcgtcgagggaagacgatccaggagggaatccatggaggcgagaggcttcgcattgttaattagggtttaacgggcctgcatgacggagatggaagagacattggcagcaatgtatgtatgtttgtacgatacacccatgcattgtccaatgttcaatcttgatgacccttcttccgggctttactctagctgattatactgatgccgaagccaattgccctcgtatcttcctcattttcttggagcctttagggccatcttcggccgtcttacttaccttatctactattttaaactccactatataacaatgcagtatataatagctaacttaattagggcaaatcgagctcatccaccacgacttataatccaaatcgtgcattattcatatatacccgcagggggtacgctagtttctccttccgtttgaatctcgttggcaccaaagttatgtcgccgagaacgaaacacgg

SEQ ID NO: 1131 - DNA, 2543 bp, Zea mays
  misc_feature (1985)..(1986): n is a, c, g, or t
  misc_feature (2062)..(2062): n is a, c, g, or t
gggtgaaaaaattagattaaattaacaaaatttatttatggtcaagatcacaagtgaattatgaatcttttttcataacagtataacacacattttttatataagttatcgtgtattatacgtttcacttacaatgcagttcagtcacctggtctataaataaggggcccctgcggccgcccgcaacagagcatagtgccagagtgtgcgctaggaagtatactcgagaaatggatgctcatgccgtggatatcccttccctagccgaggagctgaggaaggagctagctaccgcggacgctctggcggcgcggtccgccagtctctaccccgtcgtcatcgccgaggtcggcccgcgcactcgcaacgtctgcccggaggactacgacccgtcccacgtctccattggcccgtaccaccacatcaagaacccaaagctcgtcaggaagcaggacaagatccggagcctcagcaccgttatgtcggcggcggcgagagtcgacgttaagtcctacatcgatgtggtcgcgggcatcgaggccaaagccaggagctgctacgccaacacgttcgataaccacatagatagcaacgactttgtgcgcatgctgctgctcgacgcatgctacgtgcttgtcaatttcggcggcatcggcggcggcgggcaccgcggcagcgacatgatggaggacgtcggggtggtgcgcgacgtgatctacctcgcggagaaccagataccgttcttcgtcgtcgacgagatccgcaagctcaccattccggacggcggcggcggttctgcgcctgacgcgattacggtctacgtccggaagctcctgcgggagctgcagtactcagtggcgatgccggcggtggctgagcctccggggccagacaaccttctgcatctgctgcacatgcacctgatgcccaccgtcgcactcccgtcgtcacgatcgaccgtaggcaccggcaagccgcgtcggttcggccggtggcgctcggcgacggagtactactgtgccggcgttggattcaggagccggcctctcggcggcaaaggggctcgctcaatcctcgaggtgaagctcgactactacggccgcacactggagatcccccacctgaagatcgacgccgagacgtcgcggctcctgcgcaatctgatggcgctggagcagagcaacccggaggaggtgggcagccacgtgacggcgtactgcgtcttcctgtcgcagctggcgggaacggtgcaggacgtggagctgctgtccaggcgagggatcatcgcgcacggcctcggcagccacaacgaggtcgccacctccctggcgaacctctgcaagggcatcgcgttcgggggcgacgaccccgacagcaactaccttcgtgcgacatgggaggggctggaggagagcttccggagccggccgcgccggtgggcggcatggctgatgctcaagtacttcaggaacccgtggctcgccgtggggctggcggcggccggcgtggggctggtttgtaccgtggtgcaagcagtgtacgctgttttggcttacacatcaaatccttagcaggaattcgtagtcaaacactgtgcggctgtgctgtgcttgtgaaaagtagtcaatattggtgtgcctagtacgtccagcaatgatttcgttactattatctaatcgatgcatcaacaaaaagtttagtcgaaaatacaaataactgtggcggcctcttacgggatgtttgatttatagaaactaatttgtaatctctttattttattttattttagtttataaatcattaaatacggaaattaaatagttttcgtatttagtattttagggtctaaaatgaatgtactaaaaattagtcaaaaaaccaaacactccttaaggccttttcggttgagcagggatcgaaaggaattagtggagatttaatcgcattctatttaaaattggatagaagaggattaaatcccagcnnattttcctcaatttctttgcaacagaacaaggaattaattttataaaaggtaaaatttcattgctcacagataaangcactcaagatacgcaagagaaacaagaagagctagaaatcatagcctgccttgccttctttgttgacgagattaaggtcgcgattggttgttgaatacactgtagtctacctcgggactgaaaccaggccgaggccacccagccacccaggttatgtgcatgcaggtaatgatgtttggtttgcatggtttagctgggccatgacgtactgagctgatgattggttagctcatatgaacatccttgcatgtgtgcacgcgaagaaaaaaaaaatcccgtcgagacacatgtgcggcatcgcgccagccatgccgtctcggaacggatttcattttagtttctgaaagagaaataacctcaaccattcctataatcaattttagtgtttgacgtacatcacaaactatatggactaactagtttatctagtggatatttttctcaggtgtataaagttcacataaacatacaaagaaaatg

SEQ ID NO: 1132 - DNA, 1576 bp, Zea mays
cattgggtacctcgaggccggccgggatatcggttaggttgtggtatttcattgctacaacatgggttattgtaaaataagacatgtcatttggataagactgttgtgcttgtatgggtccctggaaccctcgcgcgcgccgggctctacaccatagctgaagcctcagcttgcaggttgcagccgatgagaatcgagcgtgatctccacatggccacaggggacggagaaactagctacacgaaaaattctaggattcaagagaaaactatgtttcagatcaagcctgtccttgaggaggccacaagagcagtatacacagctctccaccctcaaaccatggttgttgctgacttaggctgctcatctgggcctaacacactacgcttcgtatccgaggtgattggcatcatagctcgccattgcaaagaacatggccgacaacatgaccacccacagcttcagttcttcctgaatgacctgcccggaaacgacttcaacaatctcttccagctgatccagcagttcaataagccgacggcaataaaccacaagagtgaggcagccgaggcactgcctcctccgtgctatatctctgggttgcctggctcctactacactaggatcttccctagcgaaagtgttcaccttttccattctttgttctgccttcagtggcgctctgaggcaccagagggcaacaaaaaaacatgcctagatatctacatcacaaagactatgtcaccgtcgatggtgaagttgtttcaacaacagtttcagaaggatttctccctcttcctcaggctacgctatgaggaactcgtgtccggtggccaaatggttctaacatttattggaaggaagcatgaggatgtgttcactggagagtctaaccatctttacggattgcttgcgcagtcactgaaatccctagttgatgagggtcttgtggagaaggaaaaacttgaatcattctatttaccaatgtattcaccatcggttggtgaagtggaggccatactaaagcaagttgggttgttcaacatgaatcatgtaaaagtattccagacaaattgggatccctacgatgacttggaaagtgatgttgtgcataacagtattaggagcggtgaaaatgttgctaagtgcctacgagcagttatgcagccgctagtcgcaagccaatttggagaacccattctcgataagttattcaaagactacgctcgccgtgttgccaaacaccttgagaatgagaaaaccaagcatgctattattgtcctatccatcgagaaagcaattcacctgtgaagtgtattgtttctcactatctcgcttattattatcacatgctactatttgtgtagaaaactttgtatgtatgttttttgtgtgtttgtgtcactagtgtattgaatgacatagggtgtttttgttgttttatttatcacttctcctgtattcctatatttcatatgtctaagtttttaatgtgatttcatgcaacccttgtacaagcaattaatacaaataaattgcaccttttatgatctaaaaaaaaataaaaaaagcggcc

SEQ ID NO: 1133 - DNA, 1582 bp, Zea mays
gccggccgggccggggcaaattaaatttgtctataaatttagccagccgcccggcccggccgggttggaaaattgttgtgctagcttagcttgtatgtgctgagctttggctccccggcgcaccgctgaagcctcaactcgcagccagccatgccgatgagaatcgagcgtgatctccacatggccacagggaacggagaaactagctacacaaaaaattctaggattcaagagaaagctatgtttcagatgaagtcggtccttgaggaggccactagagcagtatgcacagctctcctcccacaaaccatggttgtggccgacttaggctgctcatcagggcctaacacactgcgcttcgtcactgaggtgactagaatcatagctcaccattgcaagctggagcacaaccgacgacatgaccacccgccgcagcttcagttctttctgaatgacctgcccggtaacgacttcaacaatctcttccagctcatcgagcagttcaataagtcatcgacgacacacaagggagatgcagcaactgaggcactacagcctccttgctatatctccggattgccgggctcctactacactaggatcttccctagcgaaagcgttcatcttttccactctctgttctgccttcagtggcgctctcaggcaccagagcaactgaagggcacccaaaaatcatgcctagatatctacatcacaaagactatgtcaccatcgatggtgaagttgtttcaacatcagtttcagaaggacttctccctcttcctcaggctacgctatgaggaactcgtgtctggtggccaaatggttctaacatttattggaaggaagcatgaggatgtgttcgctggagagtccaaccatctttacggattgcttgcgcagtcactgaaatccctagttgatgagggtgttgtggagaaagaaaaacttgagtcattctatcttccgatctactcaccgtcggttggtgaagtggaggcgatagtgaagcaacttgggttgttcaacatgaatcatgttaaagtatttgagataaattgggatccctacgatgactcagaaggtgatgatgtgcataacagtattgagagcggtgaaaatgttgctaagtgcctacgcgcagttatggagccgctggtcgcaagccaatttggagaacgcatactcgacaagttattcaaagagtacgctcgccgtgttgccaaacaccttgagactgagaaaaccaagcatgctgttcttgtcctatccatcgagaaagcaataattcatgtgtgaagtgtcttgtttctcactatatatctttccattattatcacatggtaatatatgtttgttttgaatgtgcacgtttgtgtcactagctggtgtattgaatgtcatggtgtttttgttgttttctttgtcgcttctcctatattttagatgcctgaattttaaggtgatttcaggcaacactcctgtacaaggaattaatacaaataaattgctccttttatgatcgaaaaaaaaaaaaaaaaaaaaaaaaaaaaaaaaaaaaaaaaaaaaaaagggcggccgc

SEQ ID NO: 1134 - DNA, 1173 bp, Zea mays
caacggcaaggcgtggccgtacctccgcgtgcgccgccgccgctaccgcttccgcatcctcaacgccagcaacgcgcgcttcttccggctgtcgctctccgcggggctccgcttcgtgcacgtcgcgtccgactcggtgtacctcgccaggccggtagcgaccgagaggttcgtcgtggcgccgtccgagatcgccgacgtcgtcgtcgacttcgcggagtcggccgccggcgcggcggtcgtcctcagcgacgacgccccggccccgtaccccggcgaccccggcgagaaggcggagaccatcgccgtgatgaaggtcgtggtcgagggcgccgcggaggacccggacacctcgaccgtgccggcgacgctgatgccgcactaccccaggccggacgcgcgcgaggcggccacggcgcggcacatcaccatgtacgagtacaccagggccggcacggacgagccgacgcacctgtacctgaacgcgcgctcgtacatggacccggtgacggagacgcccaaggaaggcacgtcggaggtctgggaggtgatcaacctcacggacgacaaccatccgctgcacgtgcacctggcggtgttcgcggtgctggagcagcggtcgctgcgccgcgtggacgagttcagggactgcatgaagcgccggaacgacgcgcgcgcgtgcggggtcgaccgccacctggccggcgggcggaggcacgtcgtgccgcggcaggagcgcggctggaagaacgtcttcaaggtgcggcccagcgcggtaaccaggatcctcgtgcgcttcaagccgctcacagacgccgcgtcgccggaggagagccgcttccccttcgacgtcaccactggtccgggttacgtgtaccattgccacattttggaccacgaggacaacgagatgatgaggccgatgaagattgtgcgttgaacggtttccaggaagaaaaacatatattctatgaatgattccgtatcgcaaaagaaacgacatgtttactgtgtctttcccattaatgatttaagcaggaagaacttttagatgattgaacttttcagttaagatagcatttgtcgagtaacaacatatatcctaaatgtttgttaagatagcatttgtcgaagcataatttactcataggttgtttaaaaaaaaaaaaaaaa

SEQ ID NO: 1135 - DNA, 2148 bp, Zea mays
cataaattttcttattatagtagtatagaagagattatatgaatgcaggttgattctaaaatgtagggctttttaaaaaatattaatgcgagatgatcattgaaaccagtgctttaatatagttgagaaaatattaagatagaaaaaaataataatataatccgccgcaatgcgcgaacggtacggtgtctgttttttcttctttcgtggatggaagtcattttcgcttcggcatatatcgatcagcaggttgctggtgagctgtcctccatgtgtacttcaattccacacgggtccggtccggccggagaaggaacaatcagaacctagctagctggctgaaaaacgtgccccggtcaactctcagcagctgaattccacgcgtctctctctccctcgaatgtactctgctcctccgatcctataaatagccgtcgcgaccccgccccgtccgccacaccactgatcaagcaataggacgatcgagcaagaagcaagcagcagtaacaagaaaccatcatcgatccatgtatccaccaatggcggcgctcggaggacggcggaggagggcgtcgtcagcggccctcctgctagccttgttggcggtggccctggtctccctggccggcccagccacggccgcggggaacaagaccgggcaggtgaccgtgttctggggccggaacaaggccgagggcacgctgcgcgaggcctgcgactcgggcctctacaccatggtgatcatgtccttcctcgacgtctacggcccgcagcgcggcggctaccaccagtaccacctggacctgtcggggcacccgacggccggcatcggggacgacatcaagcactgccagttcgtgggcgtgccggtgacgctctccgtcggcggcttcggctccggctactcgctcccgtccacgcaggcggcgctggacctgttcgactacctctggaacgccttcctcggcgggtcgaagccaggcgtgcgccgccccttcggcgacgcgtggctcgacggcgtcgacctgttcctggagcgcggctcgcccgccgaccgctacgacgtgctggcgctcgagctcgccaagcacaacatccgcggcgggcccggcaagccgctgcacctgacggccacgccgcgctgcggcttcccgcccgccggctacctgcgccgcgcgctcgacacgggcatcttcgagcgcgtccacgtccggatctacgacgacgccgactgcgaggccaggtggcacctcgcgtgggacgagtggacggcggcgtacccggccaccaggttctacgtcggcctcacggcgtcggagatgacgcacggctgggtgcaccccaagaacgtctactacgacgtcgcgccgtccgcgcagaaggcggacaactacggcggcttcatgatctgggaccgctactacgacaaactctccaactacaccagcatggtcaaggactacgcttgattggatttctcgactcagttcagagcagacatgcatgctagctgcgtcagccgcttcgatctagctcaccgacctatataagccgaagtactgtgtagtgtgtttgcattttattgtaagaaactaagaaggaataaattggcgaataaacaagagtaaaatacaccgggttgttgagtgaaattcagcattaagggtgtgtttgtttcagcttatagattatataatctggattataatttaaattatataatttagattataatctagatatattataatctatatgtagttgtttgctagtctagattatacaaatgtagattattcataaagacagcagtacccttgtttgtttatgtgaggtgagaaaagaaggatggtatatattgtaatttctatttacataacaatgggtagtgggacttttgccaaaataatctcaaataagctactcttgaggagattatgagattatcataatctaggatttagattatataatttgaacacataatctaggtgtttgtttacctattggattatttgtgctgaattatataatctagagagattataatccgaaataaacagggcctaagtcacttatatggttagaagtctcgctcaaaatctatattttgatctcagaaaagttagtttgactctcatgcaggtg

SEQ ID NO: 1136 - DNA, 1729 bp, Zea mays
ttttttttttttttttgtcaaaatagatgcctgtaattaggatattttggtccactcttcaagctaaccttattgttcttatttatacaacacccggccacattcacaagaaaaccgtcaatctgacaacagatcaattctaaatggcgtgacttcttgatcacgcacgttccactattcctaaatagctatcaaagaaaactagaagaaacagaagtcaaagaaaaacaaaccctgtaacttctaagagaagaacatcagggctcagggtcatttctaccattccatggagttggttcttctaagatcttgtggtgattttttcctgatgactggaactgccctttcggttagctccttaagtctcttttggcgtcggtcctcctgctcccttaacagttctgtctgctcctcctcgagctgcataacctgcgattccagctccgcgacgtatgcctgtttcctgtccctggacctcgctgcggactctcggttcttgatcatgcgcttctgccgctgcatcacggcgcggtccgcgggatccagaagcgcccgcttcccgcctcccctcacgccgcccactccccccgccacgctccctgccgcatctccgtcaccgtcagggaaccccagcgccatgttcccctccatcaccgccgccctgccgcaggaatccctggcaaggaaatcctccagcgtcatctccgcggcgccgccgccgcctctggccccggcgccggagctggcggcgggagggatatggaggacgggcgcggggagccctccagcggcggagatctccttccacacctcctccgacgtccgccgggccgcagcctccggggccgccagggagggctccgccgggccgaggccggcgctttcggcggcggcggcgttgacggcctcggggccgtagatgttacggatgatgtcgtccatgttcatcgatccgacgccgctactcttgaatcgcgcgaggtccgaggacgagcccgccccggcgtgctgcggcggagacgacgacgccatcacccgtgacgacgccatgcgccgaggccgcggcccacggcccagcaggggaggcgacaggggggaaaaactcacagtcgaccagcgcaggtcgggcgaggtcgtgtcggctctcgctttccactcttcagcgtatttgttgctgcgctgtttcttcttgcggccttgcgggtgtcccgttgcctcttgtcccggcctcccgggagagggaggggcacaagcctctggtcgcctgtgaagttcgaggggcgagagcacggaatcaagcgagcaagacagaagcgactgcgagtgagtcagagagcctgggatgaattaatgaaaaaatttccgggttcagattcgtgcatgcgcaccgcggccgcgggctgtgctgagagaaaattggaattgtgccgctatataaattgagttttacagaatttccgtcaaattgatgggtttcatccggatgttatcgtcatccacatcgcatatgccaaaatgcctttttggccatttaataaaaaagaaaactaatttcactgagtaggaagaaaagagctgactggtttgcccttctctttttcgttcttggcgaggagtgggtgtggtggatggcgtcgcacagtccggcttgtcgtccgtcagatcttggtgatgccgcacgcgggagaagatggcgttgagcaggttggcgagcccagtacccagtagg

SEQ ID NO: 1137 - DNA, 1055 bp, Zea mays
gatttaatgtgttattatttttgaaatattttttacttgtagtcatttaatttttaataacgcatatgaatctctaaggttttattacgacaaaaaatactcacacgttacgcgtttcggccgatcttgtccgcggtctgcctccctgacttttgttggcgctagccgtgtcggcccgggccggccaagtcccaagtcccacccaccaaacccaacacatcgtgtctgcgttctccccctttacgccggcgagtgttcgtcgctggctcgctgcagcggggagaatagaggcagagagcagggatgagcgacgagcgggtgaaggcggaggcgctgcagatcctgggcctattccaggtgctcccccgcctcgtcgtcttcgacctcgactataccctctggcccttctactgcgagtgccggtccaagagggattcgccgagccttttcaggcacgccaggggcatcatgtacgccctcaaggagaaggggatcgacatggcgattgcttctcgctcccccaccccggacatagccaaggtgttcctcgacaagttggagttccagtccatgttcgtcgcccaagaaatattctccagctggactcacaagactgagcatttccaaaagatccagaggaaaactgggattccctacaaatccatgctgttctttgatgacgagaacaggaatattgaagcagtatcaaaaatgggagtgacgagtgttttagtagagaacggggtgaaccttgacatgtttaagctgggtctcagtaactttgcaactaactgtgctgcctccagcagaaaggatgacgaataacctcgagaagtgatacatagaagaaaataccttcaaaacactgtactcgaattcattgtaatcaatttgcccgattcatgaacaatttattggtgaaagatgacctcacagactagcttttgaactgatgcaacgcctgtctaatatatttatttgaaggcaaatcactccatgtcattatttcacgtgcaaagcaaatatattggtgcatatcaattttgtggccccta

SEQ ID NO: 1138 - DNA, 1358 bp, Zea mays
gcgccgcgcggggagatgaccggatgggtcatgcacgagttccgcctcgagggcaggcttccccagccgctcccgcgctccgccaaggtccggccctcgtgtacttactcgttccgtcgttcggcgttgcaagcaagtctcctgcccttaatttccggccggtgggcgtgggctaacaagtcccctctcttctttttcttgccgccttgtcctttttgttgcgtgcggtgcaggacgagtgggccgtgtgcaaggtgttcaccttgctgccgcaggcggcgaggagcgagccattattggcggcggccggcgcggcggagctcgagcgcgtgggctcgctgggcttcctcaacgagctcctcgactccgcggagctgccggccctcgtcggagccgacgtggacgaggtgatcgacttcaagggccccgcccccgcgtccgttccggacgcgagctacctcccggtcaagatggaggagcacgcgctgctgcagatgcagcagtgccagtaccagccgccgcccccgatgttctacccgagccagtacttctctcttccggcgatgaactccggccacctccccccggcgatccggaggtactgcaaggcggagcagcaggtggtctcggcgcagacggcgtcggtgatcagcccgtcccgcgagaccgggctcagcaccgaccccaacgcggcgggcggctacgcggagatctcgtcggcggcgaccccgtcgtcgtcgcaccagttcctgcccgagctcgacgacccggccctcaacctcgccgacctctggaagtactgaagcctgggcgacgatcgaccggtggctgggccgcccacccgccccggtcacgtggtctggttggttaatttgcttgatttgattgattatcttggtctcttgtgggatctggggttggtgaccggttcgctgatgcgtcctcgttcgtcacctccgccaggtccggcctctactgacctcgggtctgactagattattatccgtccagaccgccaggggattagggcttccttgttaattaattaatcctaggttcctttgtattggtctctgtacatagtactggtaccctactctgattgtgtcattagcagtagcatgattactgataggattaatgaaatgggggtagattaagggggcctgcatctgcgtcagcaatgcagtgcgtggggggttttacgggttgattagttaatttgggcgcttggtgagccagctagcgctagcttcatatgtacatgtactgccattaattgctgcttgagctcgacataccattatgcgaatttgatgcttcagtgaagctctcgtttaaaaaaggcccctagggcc

SEQ ID NO: 1139 - DNA, 2991 bp, Zea mays
gtggcctgaggccaacctcaaatgcatttaacaaagttatagatggctgggtgaaggttgatatgctcaacgaggcccatgggttctttgatatgatgcctgaaaaggacatagatgatgttacagtggtcattttctactttggaggacaacatgtgggctgggaaatgaagacagaatggttgtctaatggttggctatgtttggtatgtggtgcatctgatactcaagagcttcctctacatttcattaaacttgcaaaggatacgtacacatctgactgcatgttcaaaaaaatcggatatggcactgtgagtgaggctttggtttacatgctgtccttactatttgttcgaagagattattgcaacgaggaaccattttttaggaatgtgcttgagcattatcaatgtggcgttgagatgatacggagggatttatttattggccattggaaacattatcttcaaagtgctataccacttcaaccctgctttgatggtctcataaatgttggcaaggtagccgcacgttccctccaagatactgtgtagggattcttgcatgtgtctagacagcctccatgccacccccaacgtgtcaccatttcagaactatgcatgctgaaactgtggcaaattggaaccacttattcagttggtgttttgcaaattcagatttgggtgaattactgactctcaactgccctgctgacagagcaatggtgctgctgatgtaccaaattgagttgagactgctcaattgggcctgggcagacgagtgtgtcttcaacctgtgtctacttcgattacacagtgttgttcatagcagcctagccaatgcttataaatcctggttgataacagtgattcaccgaacacactcaattggccaagatcatttttggcataacgtggataggggtgtggtgtgtggaattaaggatagatgctgtgcaagattggcaaagctagttttatctgctacactgacacaagattctggcaagctttctcaacttgaattgcaccatccattgttgttgaatactcagtcaagcggcttgaggacaagccgcatttcaagcggtggggaatatcagcatatcatcttctcctcaagtcaaagatggtaccagaagaatacgaacaatgctgctacgacgacgatgaccatacatggagtatatgaagatggaggcatcgcaggaaaaggcacaggcgcgccaggagagcgggctcggtgtctaatgaaagctagcgtccgtctggcttgggctggagtgagccttgtaaatgttggcaggccgattggtcgtgtggaccgagtggtcgtgtggttataagtaacacccaaaccctggctgtaaggggtcatgaacaatttagctatcagatatcaaatcaaatcgtcttcctcgctgctatctccttcttcaacccttcttctacctgaacatctctcttctttccgatattcccttctactaatcgaaaaaagacgacttgcttatttcttatttgctcatcgatcaatttcagttcagttgtgcgtatgtatgtacttcatgctgtcatgtcacgcttgcagctctcgccgccgatctggaggtggttcaccacggagggcgaggagcaggaggcagcgtacgaagcggccgtagagcagctgctggtcctggagaaggagctcgccgtctcctggaagccattcttcggcggggacaaggtcgggttcgtggacctatcgctcggcccgctggcgtacgtgcttccgatcgatgtacgaggaggtgatcggcggcggcgtgagcgtgacgacgaataataagatggtcgcggaggagaagatgccgtgcctcgctgcgtggatggggaggttcctcagctcgccggccgtcagggcccatctgccgccgctcgagaagctgcggcccaggtaccaggccatgcgcgagtcgcttctcgtctcagcgagagcacaagtggtcgagaaggagcgcggcagcagtagctagctacttgctactatctcattatctgtcaggctgtcagctccattcgataatttaataagaaaaaaaactgcccatgttgatgtatcaagtcgatacaaatgcactggcttttccccagtctgagcttgcttctattgggtgagcaaggcaataaagatcctgctaattaagtgtctaatgcttcagactgaactttgcagtggcactatgccagatgatgcttcagattatcgttagtccttattctgatgaatcgtggcagcatgcatgcatgcatgtttgattgtctattgctgttgccttatacaacagtataaccatttcaaactaatgtaaacatataacatatactagcaaaataactaaactactaaatttgaactcaaacaatattattaacaaactaaaacaaaaaggtagtacctgaatgtaatctaatcataagcatgccaactgaaatttctaactatataaataacctaacatagaacacatgcaactacattcgaccaaagtctcatgaagtattcgaactataatatccttttttacttctctacctaaatatattttttcttttaaaaccttgcaattaaggttactctttaaatttactgtagaaacaataaataagagagagagacattaacattgccctggcttactcggaggaagctcgcagggatcaacttttgaaccatgtgtgagtgtgaccaagaccgacgctggttgagaagaagcaagaaaggtgggaggaagagaacagaaagaagagcgggatcgagaaagaggttgttgcgttctgactgcaatgcaatgttattgcaatgttgggtttgttctctgttgaccacagtttcacagacatcacatgtgtagtgcctagctataacaaaggcaaggacacagttttgaccgtccaagacgatcgatgacaagtgcccatggcatctcctgtgactgttctgtcgagt

SEQ ID NO: 1140 - DNA, 3959 bp, Zea mays
gtacaaccccgtgcacaagaaagtccccgtgctggtctacaagggcaggcccgtcgcggagtcgcaggtcatcctcgagttcatcgacgacgcctggagccaccgcggcgaccccatcctccctcgggacccctaccagcgcgccatggcccgtttctgggccaggttccagcaggacaaggtccggtccggactcaggaacaagatatcagcatatcatcttctcctcaagtcaaagatggtaccagaagaatacgaacaatgctgctacgacgacgatgaccatacatggagtatatgaagatggaggcatcgcaggaaaaggcacaggcgcgccaggagagcgggctcggtgtctaatgaaagctagcgtccgtctggcttgggctggagtgagccttgtaaatgttggcaggccgattggtcgtgtggaccgagtggtcgtgtggttataagtaacacccaaaccctggctgtaaggggtcatgaacaatttagctatcagatatcaaatcaaatcgtcttcctcgctgctatctccttcttcaacccttcttctagctgaacatctctcttctttccgatattcccttctagttgctaacatctggtatcagactcggttccattctagacactccttccctatttcctggttagtctcgacaactgcgatggaagtcgaggtggcacgggttctcgaggcgatggtacacatggagctccgcttgaccgcggcactggctggcagtggtggcgagcaggaccccgaatccttctcctacgccaccgcttcctccgccatcgcgccacggtacgacgacagcgtgttcggctcttcggcagtccctgcatacgacgacgttcccgtcgacgacgagctgtaccgtgatgagatcgccaaggtgctcgcgctactggagtacaacgggatgacttcgtcggccacaatcctcgccgattataccaccgctaccacctcagctgtgctggttggctgtgatggcgagcaggccgctcgcggatgcactaccttcttcgacgacgactacatcgatgagctcgatgtgtgggacaaggacgccatgtgcaccgacgcagatggctccagcgaacaacccgcaccccagtgtgccaggaaggagatccggcttccccaaagaggtgtgcttcgcacccgacaactccttctctgggaccggcagctgcctgtgctgggtggatctggttcaaggcatcatcgtctgcatcaacccttggggggcggatgatcctatgctctgctccattcccctgcccgtcgggtgccccgtggtcagtgtgtctgactaccgccaccgcccgcgcgcgtgggagatcagctctgctgcctgtgtcagagtggccatggcttccctaagaacggacaagcccagctggcaactgccctccaccaagtacgacttctctacgatgctcactgacgtggcccgcatcggcgtcatggtgacagctgcgtgcaagcctgcatctacctcattggatgctcacgtggtgttcgatgaaaaggagcaaagctggaacttcattttcgcggagtacgctgcagcagctggacatcatcatctctcaattgtatggcaaatagcggaggattactcccattgcgaatttctgctccaactccccatatactgccccatgcctgctttccgtgctgtcacacaagttcagcaggatgctgttggacaaggacagtcggtgcctggggacaaagttctcaacaccctgtccatcaggtgtttgacgaattgctttagcatcatacagtgtcgtttcttgcactcgtgcaattgcagaacggatgcagtgcagcataggcaatcatggccaccgcctgtacagtatgggatactgggtgatggtgttcaagtctggcttccgccttggccaccacctgtttgggaattctggctgtcactgaagattactggtccacagatgatgcattcggtaggatactttggattgccagttatgccggcgacatgtattacaatttcagagattgtgtctggttcaagcgagcaaatatttcctgaaatatttctgcaaagcttacatgagtgcagagtttgtcttagtgaaaatactggcagaagtttactccagctcccatgccaccatttgttttgcttgatgtgtatgaagtctaattgcagaattcatgtaatagaagggaatttaacccaggtctggttaagagaagatgcagttgcttacttcaaaaatatgtttgatggtggcctgaggccaacctcaaatgcatttaacaaagttatagatcgctgggtgaaggttgatatgctcaacgaggcccatgggttctttgatatgatgcttgaaaaggacatagatgatgttacggtggtcattttctactttggaggacaacatgtgggctgggaaatgaagacaaaatggttgtctaatggttggctatgtttggtatgtggtgcatctgatactcaagagcttcctctacatttcattaaacttgcaaaggatacgtacacatttgactgcatgttcgaaaaaatcggatatggcactgtgaggctttggtttacatgctgtccttactatttgttcgaagagattattgcaacgaggaaccatttttttaggaatgtgcttgagcattatcaatgtggcattgagatgatacggagggatttatttactggccattggaaacattatcttcaaggtgctataccacttcaaccctgctttgatggtctcataaatgttggcaaggtagccgcacgtaccctccaagatactgttgtagggaattcttgcattgtgtctagacagcctccatggccacccccaacgcgtcaccatttcagaactatgcatgctgaaactgtggcaaattggaaccacttattcagttggtgttttgcaaattcagatttgggtgaattactgactctcaactgccctgctgacagagcaatggtgctgctgatgtaccaaattgagttgagactgctcaattgggcctgggcagacgagtgtgtcttcaacctgtgtctacttcgattacacagtgttgttcatagcagcctagccaatgcttataaatcctggttgataacagtgattcaccgaacacactcaattggccaagatcatttttggcataacgtggataggggtgtggtgtgtggaattaaggatagatgctgtgcaagattggcaaagctagttttatctgctacactgacacaagattctggcaagctttctcaacttgaattgcaccatccattgttgttgaatactcagtcaagcggcttgaggacaagccgcatttcaagcggtggggaatgtcagcatatcatcttctcctcaagtcaaagatggtaaacaatgctgctacgacgacgatgaccatacatggagtatatgaagatagaggcatcgcgggaaaaggcacaggcgcgacaggagagcgggctcggtgtctaatgaaagctagcgtccgtctggcttgggcgggagtgggccttgtaaatgttggcaggccgattggtcgtgtggaccgaatgattgtgtggttataagtaacacccaaaccctggctgtaaggggtcatgaacaatttaactatcaaacatcagacaaactcatcttcctcccaactattcccttctccaagtcttattctcctctgagctctttctctccgatcccccttcccaggtggtgctaacactatgtgatcacgtcgctggagtagcagatttttagagagccatgtgctgcattgaaggtagcttaccatacactcctttgtttttttttgaaaattattgtcggaacggagaacctaccaaaaaaactgagaagtaaaaactggacggccacattgatatatatatatatatatatatatatatatatatata

SEQ ID NO: 1141 - DNA, 4716 bp, Zea mays
  misc_feature (4575)..(4575): n is a, c, g, or t
  misc_feature (4580)..(4580): n is a, c, g, or t
aattcggcacgaggcctgtgggctgtgggctgtgggctgtcactgacctcttcccttctccggccgccaatttatctggtgccctgagctctcttgtgtgtgatctgtgaatcactgaatccttctcgccaacagcccaacacatggaaaagagagctgcagaagcagacgcctaaaacatggccgcagtatgctcctcattcacctgccgcgtctagtatttcggaaatattttgtatttattaaagcaggagagggaggcaagcagcagccgaggccgagctatctctctatttccccctcgcccagctcagatccgaagcctgaaggaaatcgcgccaacaggccctagccccagatgcgcgccgccgcttgctgcctgcgctgctgctactgcttctaggggtcttgcggcgatgctgggcgtcgagcccgagagcggaggcgccgcgtcctcctccgccgcagagaattttgacgctggccagtacgccttcttcgggaaggagccactcgaggggttcgagctcgggggtttggaggaagccggcagtgatggcaatggcggtggattcagcgggccagatgaggggctgtaccggctaaactcggttggagacgagattgacgatcagagtaacttgtctgacattgatgatcttgcaagcaccttcgctaagttgaaccgaagcattagtggaatccggaatcctggtgttattggggacaggagatccatttcaagaggaagttctttaactcttgactggcctgaggatgtggagttttcaaactgggtagatcaagatgtatttgaaaatgaggaattccaggaaagtaaaagatggtggtcatccaattcttcagtgcagcaaggggattccaactccagaccactaagtcgaacatcttcctaccctcagcagccactgcagcaccggtcaagtgaacctatcgttttaccaaagacttcttcatttacctcatttccaccacctgttgctggtggtggtagagccccttaccctgctcaaggccttacacgtcatgggagcattccatcaattggcgctgggctccaaatgggttctccgagcatgtcactttctgcttctccatatcatatggtcggaccatctcatgggctgccatacacgggaggcatgccttatggtgctcttaacctgcctgtaaacaattcagtgcagaatgattggtcgaatcatgttaaccctttcactggggagcatcttaatctactgcccaatttattgcacaaacaattatcacttcctaatagcccaatgtcgtcactcctattttctcagcatcagcagagattggcacaggtccaatcatcccatccgagttacctcaatataatgccacacgtcctatatccccatcactccgcagagattacaagcaggtttggttctgttggcagttcccattcatcaagagacaagagatcaaggtcggggaagggaaaacataacattcgattctctcaactaccatctgatactggtagccagaatggtgacagcggaggtataaagtttagatccaagtacatgtcatctgaagagatcgaatcaatcttaagaatgcagcattctgcaagccacagcagcgatccttatattgttgattactatcatcaagcttgtatggcaaaaaggggtgccacttctaagcaaaagaccaatttctccccaacatcaatgaaagatgtaccatccaagtctcgatccagcagtgatcagcacacatatcttcaggttgatgctcttggaagagtatctttttcttccatacggaggcctcggtctcttcttgaagtcgaccatccttcatctgctgatggctctcatgatcagaagtccactgtgaggcccctggagaaagaaccaatgcttgcagcaagagtcactgttgaagacgccctttgccttgttcttgaggttgatgacactgaccgtctgttgcagtctagccagtcacaggacaacattttcgaactgaaacgaagacggcaagtcctcctggaaggtctagctgcatcattgcagtttgttgatcctctcggacccagcaaatctggtcattcatctgggtcagccctgaaggacgatgttatttttctgcgcattgtttctctgcccaaaggacgtaagtttttagcacgttaccttcggcttcttgtccctggcagcgagttgacccggatagtatgcatggctatttttcgccatttgaggttcttgtttgggggtttgccatcagactctagtgcagcagaaactacagttgctcttgcgaagactgtttcatcttgtgtgcatcacatggaacttggtgctcttagtgcctgccttgctgctgttgtttgttcgtctgaacagccacctctgcgccctcttggtagctctgctggtgatggggcttctcttgttattaaatcagtactggaccgagcaactgagttactgactgatcgccatgctgcagccagctacactgtgccaaaccgtgctctctggcaggcatcatttgatgctttctttgggcttctaacaaaatactgtgtcagtaagtttgaaagtatccaacagatgtttgtcacacagacaccgagctcaggaatcggacctgaggcttccaaagctactagtaaggagatgcctgttgagctacttcgtgcaagccttcctcatacaaacgagcagcagcgccagcggcttcttgattttgctcagagatccatgccagtaacaggtttcaatccctcaggtgctagaggtgggcacatcacttcagaatctgttcctggatgatgtaactgaaggagacacacaagggcaaagagtcaatgcttttaaacattgatgagatggtcttcagctgataattgttgtatctgaagacatgcatgccccattataagttgtgagcgagcttggagaagttccgattgctcaggaaagtagccttcacttcaggttgtgacgtaagtttaggtttcagagtaatcgaatagaccagtgaaatgttccttatgtgggtcatttaatatagtacccacctgatgatatcataatactggaacaggaaatgtaccccttcacatttctactagagtcgatgttcttcgtaggccattgtggactggtttgcacatttactgggcatgtatttgtttatattctgacatactgttattgagctactcctgtcctgggtcgggctcttggcttctaaaaccgcggggggggccggttcgggttgtttttgcttgatcatattctgtcagccttcctttcatcatttccctcaatattccttgtggtgtgtgtggagccatctgccttcgcgaactgtgcgatttccagcatgaattcgttcgttaagaaatgccaaccgttagcttagctccatttaacagcgtgatgtgaaaatatattgatattattgactgcttcgttcgtctgaatcaatgggatgcagtcgcactgttgtttgaaggaagcagtgtaactgtagatctttgcatttgatgatgttgttgcaaaagaaaaggtatggattggttctcgtttaatcctggtgtagagcataatcctgttgagcttagatttcctcatgccaaagatcgatatgacgcagactcatgccaagtgtgtgttcaagctcatacagaagcttgttcaaacaatcacatctgatctgagcatccttcgtaaaaggctgcgacttgtaacttgtttggaattgaaagaaaatgatcgtttgattccctagcaatagaaatcctgggtaaaatcctgcatttgctggtgtcaaggtattccaaatggcgctaagattgatcagtctccaaacatgatcgtgtcttccaatatctgagacactgggctaccaggtaccagcacacccactgcactgagccacatcggccaggaaccagcagcggcaggaacaaggcaggcgatccggagaaaccaaccttgctatcatcgccggcctaatatcaatcccctgttttacccctgggccacggcagtcgtccagctggtttgcctcccacacaagggtaaaagcggaacgctaaaacctcaccccctccgcttggaagttccatcgccgccgcctccatcgctacacaccacgacgcagcgcccgattccgccggccagcaacgatgcagagctccctcgcccggccgccggtactggccggatgcggcgagagacggggcctggcagccgtggcacggtgccgcgctgaggcggcggcgcccgtgtggacggcgtccagggcgtctgcggggccgtacaccgggagggacccggaggtgaagaagcccgcgtggctgcggcagcgcgctgcgcagggggagaagtacgctcgcctgcgggagtccatcggcgagctcaagctcaacaccgtctgcgtcgaggcacagtgccccaacatcggcgaggtacgcgcgccgatcagatgacagatgcccccctccgcgtgacgcccatcgcgtcagtacctgcccgtgagcctaggcctagcatagantgatncacgccagcggtttctgcgagaggagcgctttggtctcagtgatgggttctgacggaaccgggtgcttttggtggcgcagtgttggaacggaggagaggggccggcggcgaaggggacggcatcgcgacggccacc

SEQ ID NO: 1142 - DNA, 1867 bp, Zea mays
aagtagtacgagtaaccaacaatccaatggacgcggcgaaatattggcacccggcagcacacccccaccaatcccgtgtccccacgatccagatcagaaacgcaaaggacaatcgacacggacgcgacgcgaaggcgacgcaccagcaccacctaaaattctaaaaaggcaggggccgtttctccgaccaccgcccgacgaatcagcgcgtccgctacaactccggcgacccccgccggcgacgacccaccagggcagcgatccacgcaggcgaacaacgatgggcggccgcaagatcgcgctgctggtgggcatcaactacccgggcaccaaggccgagctcaagggctgctacaacgacgtcgaccgcatgcgccgctgcctcgtcgaccgcttcggcttcgacgaggccgacatccgggtcctcaccgacgccgaccgatccgcgccgcagcccacgggggctaacatccgccgcgccctcgcccgcctcgtcggggatgcccgccccggggacttcctcttcttccactacagcggccacggcacgcgcctgccagccgagacggggcagcacgacgacaccggctacgacgagtgcatcgtgccctgcgacatgaacctcatcacagatcaggatttcagggaactcgtgcagaaggtccctgaaggttgcctattcaccatcgtctctgactcatgccatagtggtggcctgctggacagtgctaaggagcagataggtaatagcaccaagcagaataagacccagtcccgtgaacctgatgagcctcgtcattctggttctggcagcggcttccggtcatttctcaaagagactgtccgcgatgtgttcgagtctgaggggattcacatccctcatagtcgtcgccatggggatgatgaccaggacgacggttacgcacagccaactggaaatggccgcaccaaaaaccgctccctgccactctcgaccctgatagagatgctcaaggaacaaactggaaaggatgacattgatgtgggttctatccggatgacgctgttcaacatctttggtgatgatgccagcccaaagattaagaagttcatgaaggtcatgctcggaaagttccaccagggccagtcaggtgagcaaggcagtggtggtggtggtgtctttggcatggttggtgcccttgctcaggagttcttgaaggctaagcttgaagggaaggaggaagaggctttcaaacctgcattagagcaagaggttcacagtgttgacgaggtgtacgccgggagtaaggcctgggcaccaaacaatggcattctgatcagtgggtgccagactaaccaaacatcagcggatgcaactacaccgcagggtgtctcctttggtgctctgagcaatgctatccaaaccattcttgcagacaagcacgggaaggtgacgaataaggatctcgtgatgaaagcacgtgagctgctgtccaagcaagggtacactcaacagcctggactatactgcagcgatgagcatgttcatgtcgctttcatatgctaaaacttggattgttacagcgattgctttcctccatccttttgtgttgatcggtgcaccagaggttgatgtttttcttcccatgtatgttacagctatattgtatcagtgtttgttgcttgaggatatgtttcaatggactatgtcaatattgaaataacttttgagaaatgtttctatatatgaataatatacacacttgtatcgtgatctgtaccaaaaaataagctacactaaacatatcagttttcctacattccgtcgtcccagtaaaaaaaaagaaaaaaaaaaagggccggctcgagcacgagccgaattccgagc

SEQ ID NO: 1143 - DNA, 709 bp, Zea mays
cattgggtacctcgaggccggccaactccttcagacgagcgagcgagccaccgagagagagggcgagagtgagtgagtgagagggagagtgagagtgggggattcaagtttcaaactcactatcgagggggataggaaggtggtcatcggtccatagctagctcgtcgtcgaccatggctgactggggccccgtggtgatcgcgacggtgctgttcgtgctgctcacgccgggcctgctgttccagctgccggcgcacggccgcatcgtcggcttcggcaccatgcacaccagcggcatcgccatcctcgtccacgccgtcctctacttcgcgctcatcaccatcttcctcatcgccatcggcgtccacatctacgccggctagctagggtgtcttctagtccacacccccttcgtctcttcctctcatcatcggcctcttgcttcctcgtcatgtactactagtctactactactcctagtctactactactactagtcttcgtttcgcggataccccgcagtatgttggtatttattatgggattgttatggtgttttatgttccagctccttccgtcgtcttaacgcttggttgcgttgcgcatccatttcattgaagatgatccggccgggctcttgattcagtctgaacagttgtgtatttatacaagactcagaatgaacgcttaacggccaatggtttgatt

SEQ ID NO: 1144 - DNA, 846 bp, Zea mays
ccccgcgtccgagcccattaattactccccttccccccatcccccagctgcttcagacgagcgagcgagcgagccaccgcccgagagagagagagagggagagtgagagtggggattcaagtttcaaactcactatcgaggggggataggaaggtggtcactcatcggtccacagctagctcgtcgccccccatggctgactggggccccgtggtgatcgcgacggtgctgttcgtgctgctcacgccgggcctgctgttccagctgccggcgcacggccgaatcgtcggcttcggcaccatgcacaccagcggcctcgccatcctcgtccacgccgtcctctacttcgcgctcatcaccatcttcctcatcgccatcggcgtccacatctacgccggctagctagggtgtcttctagtccacacccccttcgtctcttcctctcatcatcggcctcttgcttcctcgtcatgtactactagtctactactactcctagtctactactactactagtagtcttcgtttcgcggataccccgcagtatgttggtatttattatgggattgttatggtgttttatgttccagctccttccgtcgtcttaacgcttggttgcgttgcgcatccatttcattgaagatgatccggccgggctcttgattcagtctgaacagttgtgtatttatacaagactcagaatgaacacttactggctattggtttgattatatcccgcccctcgttcgttccgttaaactgttcgctcttttccttctgcgccgaacttattggatgttagttcttaactctagtcacagtcattagatcgagatggaattatgg

SEQ ID NO: 1145 - DNA, 2260 bp, Zea mays
ctcgatgagcaggcccggcgagaggagcacgaagagcacgacgcccaccaccacgggcgcccagtccagcatcccggccggtcctaaaaactagtctagactaggtagtgctaggcttgtattgtactgctgcgtgcgcgtgggtgtgtgtattgccgcgatgcatactacgtgtgtgcgcgcttgcattttgtggagcaggactgcaggagcagcaggagggagagggaaactggggcaataataatggagcggaaaagagggagattcatggaggaatgagacgtcgacgagatacccatgcctggctgaaccaatcgacgccaaagagtgagaaagcgagcaggggaatcggaggaggaaaagcatcgggatgaggatggggtgagagagaaagggatggttgctgactcttgattaatttggcggtacggtgggcatgtttgcttcccttgtttcattaacttgaatcggttctttttgcatcgattttaatccaaatgaaaaactgacgcttgctgtgtttttgttttgaaaaaaaaataaacaaaggatggagcggagccggctgccagtgtacaaattctgctggacccttgaagggcccaagcccagcaggcctcccgattccctgctgctccggcacggacccgtgcgccgctggggcccgcgtagatccgttgcgtcgcctccctctctcacgcacggtcgcacaccagactccagtactccaatgtgcaagcaaagcagcaagccagcaagcaacggttggattccttgcccccgcccggaccacggagagaggctggaccacgcaggctcctgcccctgccaatgacgcgtggggcccgcctcgctttctttacccctccatgggcattgggtacgccgcgcgccgcattccaatttccaagagagacagagagagcgtgtggatttgggggagcttcttcactggagagtggagagctccggtagcgaggcgaaggaaggaagagggaggaggggaatcagagaggtctccccgatggcggactggggccccgtgatcgtagcgacggtgctgttcgtggtcctcacgccggggctgctctgcacgctgccgggccggggccgcgtcgcagagttcggcagcatgcacaccagcggcctggccatcctcgtccacgccgtcctctacttcgcgctcatcaccatcttcctcatcgccatcggcatccacgtctacgcgggctagtagccgcccggagcaggatgcgatatacggagtagtaggttgcgccgccgccgtgatccagatcaagatctgtttttttttctttgttccttttcgctctctctctctctctgccctcctcctcggatttgctgccagtatggacgaaatcattgattatggtctggacgtctgcttgtaatcaatcatgacttgtgtaatcttgcttgcggccatcagtatcgatcaaatatcaatcgcgctcattccatatttttttaaaaaaaaaaagcaacttcgtttgcgcccccagcgtacctctgattgcttttttgcttgcttggtggccgtcgcttgctttgcccatgttcggggccattgattggtgaggtcgattagtgtgcgcaaatcgcaatccaagtcgggcccgaccgggtccaccggatcggaattgccgtgcggcgtgcgcactagaattatgtcggctaaatccaacgtaaaagtgaaggcaataagattattctttatatagtttatatagtttagggtttaagattaaagttagacgttcgaactccgtaagaataatagaaatcattttagattaaagtcgagcaaacagacggttttaatgcaaattcagtaacattttttccagcactacatcaaactaacaataaaacgatacctttccagcacttcatcaaactaagaggctttctccttgtagaatacgacggaacctgactgctcacgagtcacaaagcacccactttcttctctcttatatttctaccttacaactaaatgccaatagcaattataaaaaatatgaggatgaaacaaacccgtctcaatagatatttcacacgattttcaagactttagaaacgagttgacatacaaattttatacccatgaaactcattcatcttagatcctacgttatgtcatctaaaatggcacactattaaatatggataaatgaccataaaactatcattaagagtattctaatgggatatgttgacggttaatgcatat

SEQ ID NO: 1146 - DNA, 1486 bp, Zea mays
aggcacactgatggccccgccagatccaagccgcgacccagacggcaagatagagcgagcgacctctcgattctccccatcccgccgtgcttcccgtcttcaccaaatccttcgccacgatggcgcgcctgctcatccccctccccttcgccgccgcctctgcctcatcgctccacctcgccgtctcccgccttcctctcgccgcggtctccgccgcgcgtcgcgagtgtctctttgggggaagggtggtaggaggagtggtgagggcgcccgcgaggctttctaagcgcgggttgtgcgccggcgcagaggctggcgactcggccgtcacggtggaggccatggaatgggtcaagaaggacaggaggcgcctgctccacgtcgtctaccgcgtcggggacctcgacaagacgatcaagttctacacggagtgcctgggcatgaaactgttgaggaagagggacattcccgaggagaggtacaccaatgcctttctggggtacgggcctgaggattcacattttgttgtggagctcacttacaattatggtgtggagagctataacatcgggactggttttggccactttggaattgctgttgaggatgttgcaaaaacagtggaacttattaaagcaaaaggaggaacagtcacaagggagccaggtcctgtcaaaggtgggaaatcagtaattgcctttattgaggatcctgatggttacaagtttgagcttatagaaagagggcctactcccgagcctttgtgccaggtaatgcttcgagtgggagatcttgatcgtgctataaatttctatgagaaggcatttggcatggaacttcttcgcaagcgagacaattctgagtacaagtatacgattgcgatgatgggatatggtccagaagacaaaaatgctgtattggagttgacctacaactatggggtgaaggaatatgataagggaaatgcttatgcacagattgctattagtactgatgatgtctacaaaactgcggaagcaattagagtaaatggtggacaaattactcgtgaacctggcccattacctggcatcaccaccaagataactgcatgcacagatccagatggctggaaaacagtgtttgtcgataacatagattttctgaaggagttggaagaatgagctttgctagagatctcaacttggtacatcaagctccatacggttgcaccccgtgagttccatgcatgacctgcaaaatctttgtaaagccacagcctcaaactgaggattgtagataggtcgtccaatctacggcatcatcgcaattgatagttgatagagcattagattttccttgcagatctatatagatgcgcaaccgtttttgtattatgcattttaatgcataagttcaatggaaatgattcatgggtaagaaaatcgtcttctttcaagcggcaatataagggctggtttggtgacttgaaaaaaaaaaaaaaaaa

SEQ ID NO: 1147 - DNA, 2207 bp, Zea mays
tgctttgattttgtctagctctttatctttctcgttctcatagacaggtacacatatcttaattgtttaaaaaatgattttatcaagctaaaaagtatttgctttgttgaatactagtttctatagagtttttgaacatggtgtttgttttcgaattttggtctagattttcacgagaggagcagcacattctaggtgggtgcgcaggcaggcaggcagacaggcaggcaggaggctatatgagagggggtgccccgaggcgcgcccggatagtctactgcttgggaagggaaaacgggggtgcatttgttgggatttttccaactcaattccatccaatccaagagcaagtttcaccggattgattccccaccgcacccgaccacaaatcccaccaagcaaaccctaatccgtcggccatgtcgtcctcccccgcggcgctgcgcttctactgccaccagtgcgaccgcaccgtctccctcgcccctcccgcatccccggacgccgacgtcttctgcccccgctgcggcggcggattcgtcgaggagcttcctcccaaccctagccccgcgcctccggccgccgccttctttgccccgccctccttcgacatccgccaccccagcgacctctccgctttcttcggccccgcctcccccgagccgctcgccccaggcctcttcgatccctccaacttccttcacgaccacttcggcggcctcctctccggcggcgccaccatccagatcgtcctcgagggtgggcccccgcccccaggcctcaactttgccgactacttcgtcggctcctccggcctcgagcagctcatccagcagctcgccgagaacgaccccaaccgctacggcaccccgcccgccgccaaggccgccgtcgcctcgctccctgacgtcgctgtctcggccgacatgatgcaggccgacggcggcgctcagtgtgccgtctgcatggacgacttccacctcggcgccgccgccaagcagctcccctgcaagcacgtcttccacaaggactgcatcgtcccatggctcgacctccacagctcctgcccggtctgccgcttcgagctgcccaccgacgaccctgactacaatcacacccatcagcagcacggtgattcgtctgcccctgctcccccttcccccgctcccgcggtctcctcccccagggtggccgagaggaggtttaggatttcgctgccctggcctctcagggccgcttttggcgctgctcaggcagagagcagcaatcccaccgatgatgacgtgcctccgtctggcagcgatgcagctggtggccctcagtctcagactggatatgatgatctcgactgaggcctcaatagccgttcttggaaacaaataggtatgaacaacaaattgcagttattactactagggttcatcgcttgctgttatctgtttggcgtcacctacctatagttcaggaatcaggtagcaccatgcatttactatcgcatttgattacggttactgtattgactgccaaagaaaaagaaaaaggctctattgtgccatcattgttctacaaaagcgtattacaagagtgaatgaccatccttgttctatgtttacctgatattaacatggtatgcacttggcgtggatgataaccaagattcatctagggcaatcaatgggatgtaacttgcatgttgtaactgcgactatcactggaccgatctgttcttctcttgggttatcagtgtgtacggaagtgctattgatttagatgtctactatgggccttttgtttatctttcttggtttggtttgaaggtatagagctgtcaaaagggtctgcatttgtttaaccgtgtttgatttagttgtggtaacctgcaagctgcagtaggttgaccactaattatgttttgctcttgtaattctgtaggctatccaccaaagatgagagatgataccgtcgtgtaccaaattaataaatgtgcatcagaagtatggagtcctttaggaacctctgctgactgttgatggaatatggttggtttgttgacactgtcagtgcattgtttctgaagggatatgggcctgttaatttaaaatttgtattcactaatggttgggggaggaacggtggagaaactgagtcatgtatagttgttccttttgcaattgctgcatggtttttttctaaaaaaaaaaaaaaaa

SEQ ID NO: 1148 - DNA, 2584 bp, Zea mays
ctgcgccagggtcatagaaatcgacctggcagtagcccttggacttgccgctggccttctcgtcaaagaacctcacctccttgaccgaaccatacttgataagctcagattccagatccgcgtccgtcgtccaccagtggagttcccccacgaacagcgtcgtgccgccagggccgtcacccccgccagcagcgccaccattcccgaccacgatggggccgccggcgaagttccctccagatcggtggaacccgtcgccttgctgaatctggtggtgctgagctggcggcggcgccggcgcggctagcggctgaggcggcggatggaggttggtctgagctggaggtatgccaggagcagggacggccacccccgggatgcgtacctgctgctgcggcggcgggacatgcggcggcggcggtgggagggtgtgggccggcggctgctgctgtggtggcggagggggctgctgctgtggcggaggatggagctgctgcggcggtggggcctgctgagtcggaggccgcggccgcggtggtggcgcctggtgggaggcgtggaggaagccgtccccgacgttgacgtcgttgtataggtcgtcgaagtcgtcgtcgtctccgtagtactggtctacgtcctggaccgcggagatagcctcgttgcggtggaacgccgggtcgccggcggggtccatggcggcggcggggcgatgtctagggttagggttttcgggatccgtgtgggcggagggagtcgggagccggggggccagccgggtggagctggtgttgaagttgacgctgttggcgcgggcgctgagggggtggggccctggtgtcggtggcttgtgcggaggaaggtgtgagaatgttcccttgttgactgatagtgggcttctatccagtgggtcataacgtgttgtgagtctttcaagcccagtagaactgcgcttttcccttttttgttttctttttttctgacaacacagtagaactacccttgtgaagctcaaacgtcatcgtcttctaccctcagaaatggtagatatgcatgttcgctctggtttgctgtagctttaattcgggtggagctatgacttctaaagtattttatctctatcgattgcagctgcaacagttcaaacagctacgacggctatgactacagggcagccaaacagattatcatctctggtttgggagctgcagataatctctagtttgggagtgctgacaactggcatcccatactattaaaacatcatctttttctagcttgaactggagcatgaacataagaacaaactcgaggtgacactcactcgcaccgtcaatcacacagtcaagtctagtcaagcttgcaaccactcttgcatgcataactgcatacatacgtataaccgtcggatttgagagagaggcagatccaacggttgcaaataaacatgccaaaaatacccgcccattttcggcctccgtatggcgcgcaccaccccatcggctaccgccctcgtcggcaggccgcaggcggacgagaggagaccatgcactcaacatgccgcgacgcagagagacaaacagagaccccccaaacatagccaccgactccaccgtgctcctctcatcgtcgcttatatgcgcctcccgtccccgcgccgccggccgtccatgtgttgtgacaccgccacacactagtcggggaaaacgatcgaacgagcacaggcacgcacgcaccatggcccgcgctcttgccctctccgccttcctcctcgtcgcctccgccgccgtggctttcgccgcggaggccccggcagcctcgccgaagcattcggcctccacgccgtcaaaggcacccagcagttcgcccgacaagtctgagaaggcccccacggcgtcgcctgagaatgctgcagagacaccgaaggcaaccccggccaaggccccggcgacggcctccaagtcagaggcgtcgccttccgaggcgcccgactccgggtccagcgctgcgtcacctactagcgagagcgccgcgtcagagaaggccctcgccggtgcccccaaggactcgtcggccagcccttccgcgtccccgtccgaagatgaagccgccgcatcgcacgatagcagcagcggcggtggcagtgccgcctcggaagagccgtcgacggccgaggccggcggcgaatcagccgatagtccacccgagccagcccatgctttggagtcaccagcagagtctcctggcccggccgctgaccacgagagcggcagcccgagcatgggcaccggtatcgtcctggccatgctggccgccgctgccaccgcgatgcttcctttctagatgaccatggtggctttgagctagcatcatagtcacagagcagcaattcttctgggaatctatgttctcatggtcatgcatgggaatgggagtcgatatgactacgcttattaggagtttatgaatttctcctcaagatatctaggcctttgtttcatcctttgggactggttggttaacttttttgcatgtttttcttcgtttgtaatttgaatgacaatcaatgaatttattgtgtagttgt

SEQ ID NO: 1149 - DNA, 1490 bp, Zea mays
cattgggtacctcgaggccggccggaacccagaaacatagaaggcgtgtacaccaagaagaagccggccaaccaaccgactcccccgaccctcctgatcgatcgagggccccttgttctagccagttgtccccttccctctcgccggcgttgctcctgcctgctccaatggccgctgcctctgccgccgcccccacgaagacggcgaacatccccgcgacgatgcgggccgtgcagtacgactcctgcggcgggggcgccgctggactcaagcatgtggaagttccggtcccttcggccaaaaagaatgagcttctgctgaagctggaggcagcaagcatcaacccagtggactggaaggtgcagaaaggcatgctgaggcctttcctgcctcgtaaattaccttttatcccagtgactgatgtggcaggagtcgtggctgatgttggtccaggaatcaatgggttccaagccggagatcaagttgttgctatgctcaactcatttaacggaggtgggcttgcggagtatgctgtggcatcagaaaatctgaccgtcaagaggcctcctgaggtatctgctgccgaaggcgcagggctgcccatcgccgccggcactgccctccaggcgctcaggaccatcggcgccaagttcgacggtactggcaaggccatgaacgttctggtcaccgcggcatcaggtggcgtcggcctctacgccgtgcagctcgcgaaacgggctggtctccacgtcactgccacctgcggcgcgcgtaacgtagagctggtgaagagcctgggcgccgacgaggtgcttgactacaggacgccggagggtgccagcctgcagagcccctcgggcaagaagtacgatggcgtcgtccactgcactgtcgggaccagctggtcgacgttcgagcctgtgctggctgccacggggaaggtgatcgacatcaccccgaacttgactgccatcctcaaatcggcgctgcacagtgtgaccttcgccaggaagcggctcgtgccactgctcctgtcgcccaacaaggcggacctagagttcctggtcgggctgctgaaggacggcaaactcaagacgctgatcgactcgaggttcccgctgagcgaggtgagcaaggcgtgggagaagagcatcgagggccatgccactggaaagatcattgtcgagatggcagactgatctgggatgcgtccattgccgatagagacttgcagtagcatccactaggctgttggacactacagggttaaagtcaacagatacgaagtactactagtatctgagtttggtcgtcgtacaaattgttcgtgagtggtgagccagtttattggcttgtttttcttttgttttcagctataaacatgaacttcttgtacagtttatggttttatggcgttgcatgatagatccgcacagttgcattgtaattaaaaaaaaaataaaaaaaaaaaaaagggcggcggtttagag

SEQ ID NO: 1150 - DNA, 1233 bp, Zea mays
cggacgcgtggcggacgcgtgggcggacgcgtgggcggacgcgtgggatgctcttaactatgtatgttgagtgcatcacattagtcggcctccatatgttgtgttcggtgtgctcatcagccatccgttattggaacttggaaggggtgttctgacatgacgttaacaatgtcctctgtttcgccagaacggaggtgggcttgcggagtatgctgtggcatcagaaaatctgaccgtcaagaggcctcctgaggtatctgctgccgaaggcgcagggctgcccatcgccgccggcactgccctccaggcgctcaggaccatcggcgccaagttcgacggtactggcaaggcccatgaacgttctggtcaccgcggcatcaggtggcgtcggcctctacgccgtgcagctcgcgaaacgggctggtctccacgtcactgccacctgcggcgcgcgtaacgtagagctggtgaagagcctgggcgccgacgaggtgcttgactacaggacgccggagggtgccaccctgcagagcccctcgggcaagaagtacgatggcgtcgtccactgcactgtcgggaccagctggtcgacgttcgagcctgtgctggccgccacggggaaggtgatcgacatcaccccgaacttgactgccatcctcaaatcggcgctgcacagtgtgaccttcgccaggaagcggctcgtgccactgctcctgtcgcccaacaaggcggacctagagttcctggtcgggctgctgaaggacggcaaactcaagacgctgatcgactcgaggttcccgctgagcgaggtgagcaaggcgtgggagaagagcatcgagggccatgccactggaaagatcattgtcgagatggcagactgatctgggatgcgtccattgccgatagagacttgcagtagcatccactaggctgttggacactacagggttaaagtcaacagatacgaagtactactagtatctgagtttggtcgtcgtacaaattgttcgtgagtggtgagccagtttataggcttgtttttcttttgttttcagctataaacttgaacttcttgtacagtttagggttttatggggttgcatgatagatccgcaaagttgcattgtaattacatatttgggacttgggagttgctatatttctgcttgaaacttcagaaatgtttagacaacataactacttaagggcaaaaaaaaaaaaaaaaaagcggcc

SEQ ID NO: 1151 - DNA, 900 bp, Zea mays
cattgggtacctcgaggccggccgggaaccagaaacatagaaaaggcgtgtacaccaagaagaagccggccaaccaaccgactcccccgaccctcctgatcgatcgagggccccttgttctagccagttgtccccttccctctcgccggcgttgctcctgcctgctccaatggccgccgcctccacgaagacggcgaacatccccgcgacgatgcgggccgtgcagtacgactcctgcggcgggggcgccgctggactcaagcatgtggaagttccggtcccttcggcgaaaaagaacgagcttctgctgaagctggaggcagcaagcatcaacccagtggactggaaggtgcagaaaggcatgctgaggcctttcctgcctcgtaaattaccttttatcccagtgactgatgtggcaggagtcgtggctgatgttggtccaggaatcaatgggttccaagccggagatcaagttgttgctatgctcaactcatttaacggaggtgggcttgcggagtatgctgtggcatcagaaaatctgaccgtcaagaggcctcctgaggtatctgctgccgaaggcgcagggctgcccatcgccgccggcactgccctccaggcgctcaggaccatcggcgccaagttcgacggtactggaaagcccatgaacgttctggtcaccgcggcatcaggtggcgtcggcctctacgccgtgcagctcgcgaaacgggctggtctccacgtcactgccacctgcggcgcgcgtaacgtagagctggtgaagagcctgggcgccgacgaggtgcttgactacaggacgccggagggtgccaccctgcagagcccctcgggcaagaagtacgatggcgtcgtccactgcactgtcgggaccagctggtcgac

SEQ ID NO: 1152 - DNA, 3464 bp, Zea mays
  misc_feature (212)..(212): n is a, c, g, or t
  misc_feature (215)..(215): n is a, c, g, or t
ctccatcctttcataacacacctgcaatcataaagagaggtgcagacgtcttctccgtgcttaccactcgccattcctaagtcctaactacctccacccccgcacgcacaacgtggccgcgccaaggcaaagctagaagaagacaacgcaaagggagaggacagaggaggagcagaggacgatgggcagcggcggcgctaacactgcccccntcntcaccccctacaagatgggaaaattcgatgtttcccacaggtacgcccctgcccctttgctttctggttgggccaattcccaatttcctaaccagtaaccacccatagcagcagcaatcaagcggtttctgcttagttcccccatgagaagcggttcgtttgtaatcctttcgtcgtgagaattgcgtcaaagcggccagagtagcgctgcttttccctaaccatgaagatgaccaccataagatcgtacactgtctatgttgtgatatttttttagcgaatttattatttggatgccgtgcgctgttcatcgaagactaggtttcccacatcactgtcccttccctttctctctttttttcccatccctcgtttgccctttggcgcgtcgggtgtggaaccttagtaaccaggttcccggatcgataggatcgaggaacagaaacatggtacgcagtacactacaaaaactagaatttaacactattaaacaagattgttcccacgttcccggaacggaacgaacgttcctccgggaacatggccaagttcccagttcccggttactaagtgtggaactgtcgaatgtggatgctttgttgtacgcagcatcgagtgtgggtcctcaatgcttgtcatcgtgttgacaccaaacaaaaccaatggtgactttaaaagtgatgctgaaagcgaaaggtttgactggggatgtctctgaatttcgcatgcgtgcagcatgccatcatctatatggaagagaaataattctagggctatcaaaagagtggctttagacttgtgctttcagatttggtattacccgtcagaatgagattatagctaggtagcaaaccttttagcagaatcggtaggcaaaataacgaagtgatcaatcaacaaaccacggatcacggcatacatatttacgtgaaaaaaccggaaaaatcataggcaccagccaaacaaaaccgtcactataatgtggagcatttacaggacgttgttcttagatggcgacagaccccgctacgctcgccaactcagccccttatctagaatttagatcacatactcaacaaaaccaagtgcagcgaatcttaattcttttcgtgaaagaaggtccattcgatcctgagaatcccttttctctgtttgtccagggtagtcctcgcaccactgacgagacagcggtcctacggcaatgttcctcagcctcatgccatactgtactatcagcagagggcgactaaaggaggtcttctgatcgctgaggccacgggggtttcagacactgctcaagggtacgtctgtcgtctgctagaccatcaggctactacggctgcttgagatctgtgtggtcatgctaaatttcatcattcagtagtttagtcgatgtctgaataaagatgtgttttctgtatgcgcacaaggtacaaggacactcctggcatttggacccatgagcaagtcgaagcatggaagccgatcgtagacggggttcaccagaaaggagggatatttttctgtcagatttggcacgtagggagagtctccaattccagtatgtttaccacctctaacgcagatcggttctcaaagctataaatttaacggcagtctagtcagcttgcaagagaaaattggattcagagttatccatgaagacttcatggcaacattagctgtgtttgtcatagaccaagatgtttatgaaagcgctcatactatttctactacagttttttttgtaataaaagtgccattataccaacgactgttaaatgttccaatgcagcttttcagcctaatgggcaggctccaatttcaagcaccgataagccactaaagcctcaagtgagagccaatggtatagacgtggctactttcgcagttcctagacgcttagagactgatgaaatccctttggtcgtcaatgatttcagggtagctgctcgaaatgcgattgaagctggtaagctccctgtttgcactctgaatgttcagatgagcctacaaagaaagaaccaacaaatgtttatctgctttagaccgaactaggatcaatagcacacagagattctttggaatatctgttctgttgaaatgttgggcgactagttctgactcctgaacaatgttaacctgcatgtaggatttgatggtgtcgaaatccatggagctcgcccacgcgtccgtgatcagtttctaaaggacggggtcaacgaccgcacagacaaatacggtggcagtctggagaaccgctgccggtttgcactggaagtaactcaagccgtggtcgacgaaattggagctgacaaggtcgggataaggctgtcaccattcgctagctactcggaggcgccggactcagacccggaagctctgggcatgtacatggcgaacgcgctgaacgagttcgggattctctactgccacatggtggagccgcggatggtgaaactcggtgaaaagttcgaaaccccctacagccttcgcccgataagggacgctttcaggggaacgttcatcgttgccggcggctacggcagggaggatgggaatcgcgcgatctccactgggtatgctgatttggtcgcgttcgggcgcgtgttcttggctaatcctgacctgcctcggaggttcgaagtagacgctccccttaacaagtacaacagagacacgttttacatccctgatccggttattggatacctgactacccatttctttcgtcagatgtataaatgttctcttttcagcaatctgctttttagattgtgtagtaactggttggtgtaccagtaaaatattagacgaataaaccattggtctgaatgcctcattctcatatatatggacaaaagcaatatgatcgttgtaattgtgcctcaaatcttatagttatagttgtaaaaaaatattgtgaagaagatcagtcagttgtcaagttgtataaaaagtcagcctggttcacagaatcacaggcaactactatgcccctgttggaatcacatggcgttttcacagacagagcctggctcattcttgcggccttccgactttagcatcttggaagtgctagagttccctgtgttaatttcgtgaagcttttaagtggtgtggtgttatctctatctctattttctctatctctactatgtctaaccagtagaacatcatgctcaaatatttttaatgttagatataaattgtatatatatatacgatttttttaaaataaaaaatata

SEQ ID NO: 1153 - DNA, 1560 bp, Zea mays
ccggggagattcaatgaatccatctccatcctttcataacacacctgcaatcataaagagaggtgcaacgtcttctccgtgcttaccactcgccattcctaagtcctaactacctccacccccgcacgcacaactggccgcgccaaggcaaagctagaagaagacaacgcaaagggagaggacagaggaggagcagaggacgatgggcagcggcggcgctaacactgcccccctcctcaccccctacaagatgggaaaattcgatgtttcccacagggtagtcctcgcaccactgacgagacagcggtcctacggcaacgttcctcagcctcatgccatactgtactatcagcagagggcgactaaaggaggtcttctgatcgctgaggccacgggggtttcagacactgctcaagggtacaaggacactcctggcatttggacccatgagcaagtcgaagcatggaagccgatcgtagacggggttcaccagaaaggagggatatttttctgtcagatttggcacgtagggagagtctccaattccacttttcagcctaatgggcaggctccaatttcaagcaccgataagccactaaagcctcaagtgagagccaatggtatagacgtggctactttcgcagttcctagacgcttagagactgatgaaatccctttggtcgtcaatgatttcagggtagctgctcgaaatgcgattgaagctggatttgatggtgtcgaaatccatggagctcacggttacctgattgatcagtttctaaaggacggggtcaacgaccgcacagacaaatacggtggcagtctggagaaccgctgccggtttgcactggaagtaactcaagccgtggtcgacgaaattggagctgacaaggtcgggataaggctgtcaccattcgctagctactcggaggcgccggactcagacccggaagctctgggcatgtacatggcgaacgcgctgaacgagttcgggattctctactgccacatggtggagccgcggatggtgaaactcggtgaaaagttcgaaaccccctacagccttcgcccgataagggacgctttcaggggaacgttcatcgttgccggcggctacggcagggaggatgggaatcgcgcgatctccactgggtatgctgatttggtcgcgttcgggcgcttgttcttggctaatcctgacctgcctcggaggtttgaagtagacgctccccttaacaagtacaacagagacacgttttacatccctgatccggttgttggatacactgactacccatttctttcgtcagatgtataaatgttctcttttcagcaatctgcttttttagattgagtagtaactggttggtgtaccagtaaaatattagaggaataaaccattggtctgaatgcctcattctcatatatatggacaaaagcaatatgatcgttgtaattgtgcctcaaatcttatagttgtaaaaaatattgtgaacaagatcagtcagttgtcaaggtggacaacagctcgagggggctcacagaatcacaggcaactac

SEQ ID NO: 1154 - DNA, 1472 bp, Zea mays
aaaaaagcaggctcctgcaggaccatggcgtggagcgccgccgccgtctccaggttcgccgccgcctccccacccgcggcacccatctccgtcaggcttggagccgccgcttctcgctcctccctgtccttctccagtgggcgccgacgccccgtggccgcgtccctctcgacctctgccaccgttgtaaaggaggctgttcagacagagaaggcaccaccagcactaggcccttattctcaggccatcaaagcaaataatcttgtgtttgtttctggagttcttggcttgaatcccgagaccaggaagtttatctctgaaaatgttgaggagcaaactgagcaggttatgaaaaacatgggcgagatattgaaagctagtggtgctagctattcttcagttgtgaagacaacgatcatgttggctgatctgcaggatttcaataaagtaaacgagatctatggcaaatatttcccggcgccagcacctgcacgatcaacctaccaagtggcggcgctgccactgaatgcccggattgagattgagtgcatcgctgctctctaactcgagacccagctttcttgtacaaaccgtgcccgggctcgcagttggtagggttctagcatggcgtggagcgccgccgccgtctccaggttcgcagccgcctccccacccgcggcacccatctccgtcaggcttggagccgccgcttctcgctcgtccctgtccttctccagtgggcgccgacgccccgtggccgcgtccctctcgacctctgccaccgctgtaaaggaggctgttcagacagagaaggcaccaccagcactaggcccttattctcaggccatcaaagcaaataatcttgtgtttgtttctggagttcttggcttgaatcccgagaccaggaagtttatctctgaaaatgttgaggagcaaactgagcaggttatgaaaaacatgggcgagatattgaaagctagtggtgctaactattcttcagttgtgaagacaacgatcatgttggctgatctgcaggatttcaataaagtaaacgagatctatggcaaatatttcccggtgccagcacctgcacgatcaacctaccaagtggcggcgctgccactgaatgcccggattgagattgagtgcatcgctgctctctaatcagatcatccaaccactcattaaatcatcaataagcacccaggaatttgtggtagaggtacctgtaccagttcagtgtctgaaaactgcgggtaacaaacctttgtgtcccggataagtgatgtgtgtgtgtgtgtgagtgaacagtgcatctagtaggagaattgttgcgtggtttgttacttggattcttcgctctttagacaagaagtaccatggcatcaacatcaatagcctactgttttcttcccaataagaatgaattggcttccccaacaaaaaaaaaaaaaaaaaaaaaaaaacgcctt

SEQ ID NO: 1155 - DNA, 1013 bp, Zea mays
attttataatttggaccccccccgtccgccgggcgggccactatagtggggcacaggcgatcgcatattcgcacccacccatcacacgacaaaatccctcaccctcgtgagtcctgacgccctcgcccgtgctcgcagttggtagggttctagccatggcgtggagcgccgccgccgtctccaggttcgccgccgcctccccacccgcggcacccatctccgtcaggcttggagccgccgcttctcgctcctccctgtccttctccagtgggcgccgacgccccgtggccgcgtccctctcgacctctgccaccgctgtaaaggaggctgttcagacagagaaggcaccaccagcactaggcccttattctcaggccatcaaagcaaataatcttgtgtttgtttctggagttcttggcttgaatcccgagaccaggaagtttatctctgaaaatgttgaggagcaaactgagcaggttatgaaaaacatgggcgagatattgaaagctagtggtgctagctattcttcagttgtgaagacaacgatcatgttggctgatctgcaggatttcaataaagtaaacgagatctatggcaaatatttcccggcgccagcacctgcacgatcaacctaccaagtggcggcgctgccactgaatgcccggattgagattgagtgcatcgctgctctctaatcagatcatccaaccactcattaaatcatcaataagcacccaggaatttgtggtagaggtacctgtaccagttcagtgtctgaaaactgcgggtaacaaacctttgtgtcccggataagtgatgtgtgtgtgtgtgtgtgtgagaatgaacagtgcatctagtaggagaattgttgcgtggtttgttacttggattcttcgctctttagacaagaagtaccatggcatcaacatcaatagcctactgttttcttccccaataagaatgaattggcttccccaacagatcatggatatagtcgtgcgtaatattgtttt

SEQ ID NO: 1156 - DNA, 945 bp, Zea mays
cccacgcgtccgtccgttcggtcccgcccggccggccggcaaaatccctcaccctcgtgagtcctgacgccctcgcccgtgctcgcagttggtagggttctagccatggcgtggagcgccgccgccgtctccaggttcgccgccgcctccccacccgcggcacccatctccgtcaggcttggagccgccgcttctcgctcctccctgtccttctccagtgggcgccgacgccccgtggccgcgtccctctcgacctctgccaccgctgtaaaggaggctgttcagacagagaaggcaccaccagcactaggcccttattctcaggccatcaaagcaaataatcttgtgtttgtttctggagttcttggcttgaatcccgagaccaggaagtttatctctgaaaatgttgaggagcaaactgagcaggttatgaaaaacatgggcgagatattgaaagctagtggtgctagctattcttcagttgtgaagacaacgatcatgttggctgatctgcaggatttcaataaagtaaacgagatctatggcaaatatttcccggcgccagcacctgcacgatcaacctaccaagtggcggcgctgccactgaatgcccggattgagattgagtgcatcgctgctctctaatcagatcatccaaccactcattaaatcatcaataagcacccaggaatttgtggtagaggtacctggtaccagttcagtgtctgaaaactgcgggtaacaaacctttgtgtcccggataagtgatgtgtgtgtgtgtgtgtgtgcactgcacctctaacaggggcatctagtaaggaaaattgttgcgtgggtctgtactttggattccttcgcccctttacacaacaaagaccatggaattcaccatccataacgctactggttttcttttcctaaaaagaaaggaagtggcctttccct

SEQ ID NO: 1157 - DNA, 887 bp, Zea mays
ttgggtacctcgagcccggcccggggacaaatccctcaccctcgtcaggcctcacgccctcgcccgtgctcgcagttggtagggttctagccatggcgtggagcgccgccgccgtctccaggttcgccgccgcctccccacccgcggcacccatctccgtcaggcttggagccgccgcttctcgctcctccctgtccttctccagtgggcgccgacgccccgtggccgcgtccctctcgacctctgccaccgctgtaaaggaggctgttcagacagagaaggcaccaccagcactaggcccttattctcaggccatcaaagcaaataatcttgtgtttgtttctggagttcttggcttgaatcccgagaccaggaagtttatctctgaaaatgttgaggagcaaactgagcaggttatgaaaaacatgggcgagatattgaaagctagtggtgctagctattcttcagttgtgaagacaacgatcatgttggctgatctgcaggatttcaataaagtaaacgagatctatggcaaatatttcccggcgccagcacctgcacgatcaacctaccaagtggcggcgctgccactgaatgcccggattgagattgagtgcatcgctgctctctaatcagatcatccaaccactcattaaatcatcaataagcacccaggaatttgtggtagaggtacctgtaccagttcagtgtctgaaaactgcgggtaacaaacctttgtgtcccggataagtgatgtgtgtgtgtgtgagtgaacagtgcatctagtaggagaattgttgcgtggtttgttacttggattcttcgctctttagacaagaagtaccatggcatcaacatcaatagcctaaaaaaaaaggccccctagg

SEQ ID NO: 1158 - DNA, 1946 bp, Zea mays
ccggccggggcggcaccgcctcccccgccggcagtaattgacttgacctcacttcccctgtggggaggctttaattttcttccgatcgatcatagtatccgctgcggtgtgattgcctgcccccaccccattgcgcctgcgcctgcgcctcgcttcatccggtgcgctgcccgcctcactcccgtcgtcctcttcctcgtcctcgctctcgtcgcggagcggtgtggaggcgcgcgctccttgaaggcacggggcaagagcggaggaagatcatctgggtgttggagtcatccagaggcacaagctgaggaatggggcaaaaggactccaagccttcacatggatatggctactcttcttatgattacgggagtgcttcatcgggatacacctcgagaaacactgggaattcgtcctccagttatagcgtcaggtacgcgccttcttcggagaacagtgtacagccggagacacatgccaggttgcagaggaagtattccaagatcggtgatgactaccgttctttgagccaggtgactgaagctttggcacaggcaggccttgaatcttcaaatcttattgtaggcattgattttacaaagagcaatgaatggacaggtaaaatttccttcaatcgccgctgcctgcatgatattggaaacactccaaacccatatgagcaagctatatctattattggaaggacactttcagcatttgatgaagataatttgattccctgcttcggatttggtgacgcatcaactcatgatcaggaggtattcagcttttacccagagaaccgcccatgcaatggatttgaagaggcgctagacagatacagagaaatcgttccaactcttcgattagcaggacctacatcctttgcgccgatgattgagacagcaattggaattgttgacagcactggtggtcaatatcatgttcttctgataatcgccgatggacaggttacccgaagtgtcgatacacaatctggacagttgagtccacaggagcgggatactattgatgcaatagtaagagcaagccagttccccctgtcaattgttcttgtcggggttggtgatggaccatgggacatgatgcaccagtttgatgacaatatacctgctcggtcatttgacaatttccagtttgtgaatttcacggagattatgtcgaagagcatagcagctgacagaaaggaggcagaatttgcattgtcagcgctgatggaaatccctacacagtacaaagcaacaattgatctccaactcttaggccgtcgccaaagaataaccccaagaattgctctgccaccaccaacaaggaccgcgtattcgcggtccagtagctttagccaacagtctggtgtttattcgcgatcaagtagctttgaccaacaaacaagtggcgcctctcagcaacgttctgagagcttgaaacagcagaagaaacctgcagccccgaagagacctgacacttatgcttcagaaagagctttagaggacagaattctgtgccccatctgcatgtataaatccaaggaccttgcatttggatgtggacatcagacttgctacgaatgcgggagaaatttggagcgctgccctctgtgccagcagaacataaccacgaggatcaggctctactgatttgatcaggctatgaattagaaaaatgttggaacaacagactcccgggcaagatgttcagaaccagctttgtttgtaccgtgcttcattttgtaattggtgtcacttttctctgtagttatgccaaaggaaagcgcaccagaaaaaataatgtacatatttatcttccagtagtactgtacattgcgagctgcacatagatcaaggtgtttttttgtgtggggggggggggccggtgttcaaataggggccgggtgaagggaagaaatcaaggtgtcatatatatat

SEQ ID NO: 1159 - DNA, 983 bp, Zea mays
tatagatgcaatagtaagagcaagccagttccccctgtcaattgttcttgttggggttggtgatggaccatgggacatgatgcaccagtttgatgacaatatacctgctcggtcatttgacaatttccagtttgtgaacttcacggagattatgtcaaagagcatagcagctgacagaaaggaggcagaatttgcattgtcagcgctgatggaaatccctacacagtacaaagcaacacttgatctccaactcttaggccgccgccaaagaataactccaagaattgctctgccgccaccaacaaggactgcttattcacggactactagctttagccaacagtctggtgtttattcgcgatcaagtagctttgaccaacaaacaagtgtctcccagcaacgttctgagagcttgaaacagcagcagcctgcagccccaaagggacctgacacttgcgcatcagaaagtgctttagaggacagaattctgtgccccatctgcatgtataaatcgaaggaccttgcatttgggtgtggacatcagacttgctatgaatgcgggagagatttggagcgctgccctctgtgccagcagcacataaccacgagaatcaggctctactgatttgaagccaatgggattgaaaaatgttcagaaccagctttgatgctactgtgcttcatcattttgtaggtgtgttcgtcttgctgcataggcatatactaagaactagtaccagttttagtgtttggtaacattgtctcagtagtttcgctacactagttatgccaaaaggaaacgcaccagataataatgtacataattttcctccttttatctcttttgttaggtaaataagttagacagcagtaaaattctgaatgagatgagataatggatattgtgaagcaaaactatggccatttctgagccatggaatatgcattttgaatgcaatgaccccatggattaaagcttcagt

SEQ ID NO: 1160 - DNA, 1805 bp, Zea mays
gtcgatactcaatgatggccatggaaagtttgcaaaaggaaaattttgaccatggaaagaggaagctcatctgggtgttggcctcatcccctgcacaagctgaggaatggggcaaaaggactccaagccttcaaatggatatggctactcttctgattacgggggtacttcatcgggttataacttgagaaatactggaagtacgtcctccagttatggcgcgaggtatgtgccttcttcagagaacaatgtacagccagaaacacatgccaggttgcagaggaagtattccaggattggtgatgactatcgttctctgagtcaggtgactgaagctttggcgcaagcaggccttgaatcttcaaatcttatcgtaggcattgattttacaaagagcaatgaatggacaggtaaaatttcatttaatcgccgctgcctacatgatattggaaacactccgaacccatatgagcaagctatatctattattggaaggacactttcagtatttgatgaagataacttgattccctgctttggatttggtgacgcatcaactcatgatcaggaggtattcagcttttacccagagaaccgcccatgcaacggatttgaagaggcactagacagatacagagaaatcgttccaactcttcgattagcaggacctacatctttcgctccgatgatcgagacagcaattggaattgttgacagcactggtggtcaatatcatgttcttctgataatcgcagatggacaggttacccgaagtgtcgatacacaatctggacaattgagtccacaggagcgggatactatagatgcaatagtaagagcaagccagttccccctgtcaattgttcttgttggggttggtgatggaccatgggacatgatgcaccagtttgatgacaatatacctgctcggtcatttgacaatttccagtttgtgaacttcacggagattatgtcaaagagcatagcagctgacagaaaggaggcagaatttgcattgtcagcgctgatggaaatccctacacagtacaaagcaacacttgatctccaactcttaggccgccgccaaagaataactccaagaattgctctgccgccaccaacaaggactgcttattcacggactactagctttagccaacagtctggtgtttattcgcgatcaagtagctttgaccaacaaacaagtgtctaccagcaacgttctgagagcttgaaacagcagcaacctgcagccccaaagggacctgacacttacgtatcagaaagtgctctggaggacagaattctgtgccccatctgcatgtataaatcgaaggaccttgcatttgggtgtggacatcagacttgctatgaatgcgggagagatttggagcgctgccctctgtgccagcaacacataaccacgaggatcaggctctactgatttgaagccaatgggattgaaaaatgttcagaaccagctttgatgctactgtgcttcatcattttgtaattctgaatgagataacactgtctcagtagtttcgctacactagttatgccaaaaggaagcgcaccagaaaataatgtacagatttttcctccttttatctcttttgttaggtaaacaagttagacagcagtaaaattctgaatgagataatggatattgtgaagcaaaactatcgccatggaaaatatgcattctgtatgcaatgaccccatggattaaagcttcagtaataagtaagatggtcacatctatatatattgcacttatgttccagtaaaaaaaaaaaaaaaaa

SEQ ID NO: 1161 - DNA, 836 bp, Zea mays
  misc_feature (790)..(791): n is a, c, g, or t
attgggacctcgagccggccgggaaaaaatgatacccacctcaccagcaaacgtcttgagctcgtgctggtgatcgtgacaagcattgtcccttttaccaaatcatcgtcttctcctctcccgcgccgaagcttcctcggacaagtgcggcgtgagtaagagacccggcggacaagaaacctctccccccaccttcgttgcggaattgcatcgccttcggcttgagccaattgacttgacctcactccctcccgaagctcatctgggtgttggcctcatcccctgcacaagctgaggaatggggcaaaaggactccaagccttcaaatggatatggctactcttctgattacgggggtacttcatcgggatataacttgagaaatactggaagtacgtcctccagttatggcgcgaggtatgtgccttcttcagagaacaatgtacagccagaaacacatgccaggttgcagaggaagtattccaggattggtgatgactatcgttctctgagtcaggtgactgaagctttggcacaagcaggccttgaatcttcaaatcttatcgtaggcattgattttacaaagagcaatgaatggacaggtaaaatttcatttaatcgccgctgcctacatgatattggaaacactccgaacccatatgagcaagctatatctattattggaaggacactttcagtatttgatgaagataacttgattccctgctttggatttggtgacgcatcaactcatgatcaggaggtattcagcttttacccagagaaccgnnccatgcacggatttgaagaggcactagacagatacagagaaatcg

SEQ ID NO: 1162 - DNA, 1768 bp, Zea mays
cattgggtacctcgaggccggccgggtccgctgtggtgtgactgcctgcccccttgcgcctcgcttcatcttcttgtgcaaagcccccccccccgactaccgtcgtcctcttcttcctcctcgccctcgtcgcggagcggagtggaggcgcgcgttccgggacggcacgggacaggagcggaggaagctcatctgggtgttggcctcatcccctgcacaagctgaggaatggggcaaaaggactccaagccttcaaatggatatggctactcttctgattacgggggtacttcatcgggatataacttgagaaatactggaagtacgtcctccagttatggcgcgaggtatgtgccttcttcagagaacaatgtacagccagaaacacatgccaggttgcagaggaagtattccaggattggtgatgactatcgttctctgagtcaggtgactgaagctttggcgcaagcaggccttgaatcttcaaatcttatcgtaggcattgattttacaaagagcaatgaatggacaggtaaaatttcatttaatcgccgctgcctacatgatattggaaacactccgaacccatatgagcaagctatatctattattggaaggacactttcagtatttgatgaagataacttgattccctgctttggatttggtgacgcatcaactcatgatcaggaggtattcagcttttacccagagaaccgcccatgcaacggatttgaagaggcactagacagatacagagaaatcgttccaactcttcgattagcaggacctacatctttcgctccgatgatcgagacagcaattggaattgttgacagcactggtggtcaatatcatgttcttctgataatcgcagatggacaggttacccgaagtgtcgatacacaatctggacaattgagtccacaggagcgggatactatagatgcaatagtaagagcaagccagttccccctgtcaattgttcttgttggggttggtgatggaccatgggacatgatgcaccagtttgatgacaatatacctgctcggtcatttgacaatttccagtttgtgaacttcacggagattatgtcaaagagcatagcagctgacagaaaggaggcagaatttgcattgtcagcgctgatggaaatccctacacaccgccgccaaagaataactccaagaattgctctgccgccaccaacaaggactgcttattcacggactactagctttagccaacagtctggtgtttattcgcgatcaagtagctttgaccaacaaacaagtgtctaccagcaacgttctgagagcttgaaacagcagcaacctgcagccccaaagggacctgacacttacgtatcagaaagtgctctggaggacagaattctgtgccccatctgcatgtataaatcgaaggaccttgcatttgggtgtggacatcagacttgctatgaatgcgggagagatttggagcgctgccctctgtgccagcaacacataaccacgaggatcaggctctactgatttgaagccaatgggattgaaaaatgttcagaaccagctttgatgctactgtgcttcatcattttgtaattctgaatgagataacactgtctcagtagtttcgctacactagttatgccaaaaggaagcgcaccagaaaataatgtacagatttttcctccttttatctcttttgttaggtaaacaagttagacagcagtaaaattctgaatgagataatggatattgtgaagca

SEQ ID NO: 1163 - DNA, 987 bp, Zea mays
ggccgcttttttttttttttttttgggtgaaaagttattttatttttctctcaatttccgagaatcctgaaagtgatttaagtttctaaaacagactttagacggaggttttgacaatcttttggagacgctaaatcatttaggacacgtggaccctgaactgtgcctggacctggaggaacctcgtgaactgcaccacctttctccgtgtctggcaggacgcgcttggctgcagggtgcgcggcgaagcgctggctccacccgtccagcagcggcgtcgcggacgcgtcgatgagtgagaggccgtggagccgctcgcaggccctgagcgccggtaggaagcatccgagggccaggtccaggaggcctggcgcggcgtcgccaccggagaagaaagccctgccgttgctgcggtccttgaacgcctcctccaggaggctcagcgcggcgcgggtgtcttccgcggcctgcgcgcgtgctcccggggtcggcgccagggagacggcatccagcgccggccaaaacttgtcgtcgatgaaggcggtccagaagcggtgcatggcgcgctcgtaggggtcgtccgggagcagcaggctgccagcctcggcgccgccgctttcacgcgccacgtcctcgatgtactggacgatgactgcggactcgcatatggcgcggccgtcggggaggagcagcacggggatcttcccgtagacggggttggcagcgaggagcctgtcgcttttcttgggccccagcggctcgtcgaggagctcgtacgccacgccgcgcagatccagcgccagacgcgcccgcgccgtgaacgggctgacctccccgcctagcacacgcatggtcccggccgtcatcgacgacgacgagctgcagtccggccggccggctggtctcgacgtgacttctgttggcacctctctgcctcagccctcagcttgatgcggccggcaatttaaacgggagtccccggccggc

SEQ ID NO: 1164 - DNA, 2151 bp, Zea mays
atttaaattggtcaatggtaacaattcctaccaacactagcaacgacttgtagccaaccaacctcccaacacgttgttgttggtcactgatgacaaaagatggctttggctggcacccgtgcagacggagaacaaaacatgcgacgtgccgtgctgtccttccgcctccggctagttttatgcggccgccatgttaaatctctccttccttttgttttaaatcagcgagttttttcgccttccttttgttttaaatctctcctgggaaaaagaaaataaaaatatggttcccaaattagcccttgattagtaaggtcaatcaacggatagttttatgcggccgccatgttaataactgttagtaaatagtgtatctaaagttttattctactctcttttatttttcatagaactctcttatatctctttattaaattacatctcataagaatggtgtagctgtgctgttgcaataaaaaaaaggttgtaggccgagtccccgggccgccgcagtccgcaccaaaccaccacgagagcgcttcgccgcttcctcctgctcgtcctcctcggccctcgccgttgccgtccatcccaatcaatcaatggcgcctgcccgtctcctgccacggctgccgctcttctgggccgccctgctcttgttgccgtttgcgcacccggcagcggcggcgcaggtgggcgacgcgtgctcctcctcctccggcggcggctgcggctccggcctgcactgcagcccctgcggcgccggcgggggcagcatctgcacgcgcgccagccccgtggacccggccacccacggcacgggcctccccttcaacaactactcgtggctcaccacccacaactcctacgccctcgccggcgccgcctccgccaccggctccgcgctcatcaccgagaccaaccaggaggacgccgtcaccgcgcagctcaagaacggtgttaggggcctgatgctcgacacgtacgacttcgacaacgatgtctggttgtgccactcgttccaaggaaaatgctacaacttcactgccttccaacctgccatcaatgtgttcaaagagatccagacattcctcgacgcgaacccgtcgcaagtggtcacgatcttcctagaagactacaccgcggtagggtccttgccgagagtgttcaacgcctccggcctcacgaagtactggttcccggtggcaaagatgccgaagagcggcggcgactggcctctgctcaaggacatgatcagccagaaccagcgcctgctagtcttcacctcaaagagagccaaggaggcgagcgaggggatcgcgtatgagtggaactacgtcgtggagaaccaatacggagatgagggcatggtagcaggcaaatgccccaaccgcgcagagtctccggccatggattccaaaggccagtcgcttgtcctgatgaacttcttcacgactaacccgagccagaccggtgcctgcgggaacaattcggcgccactcgacagcatgctgaagacgtgccatgacgcttcaggcaaccggtggccgaactacatcgctgttgatttttacatgagaagtgacggtggaggagctcccttggctacggacattgcgaacggtcatatggtgtgcggatgcgacaacatcgcgtattgcaaggcgaattcgacattcgggacctgcgtgatacccccaccgccgccgccgtcaccgcccaaggcatccacccccggcagcagaggctcaacagcaggcggcgatgctagcgctggaacgatggccctgtcctcgcaatggagcttcttgctgggactggcttctctgcttcttttgtcgcgctcgtgagagccgagcggcattggtgactggttttgctgctcttgctacatgctctgcgagctgataggagcatcgtcccatgagatgagctgaggctgagctgaactgagctgtatatttgggtttactgcgcaacgtagttagttggatacgggaatcagttaaattcatcattcatttttattgattggcgtcgttatcgtgaatgttctaataagttccttaaaaaaatgtctcatggccctactgtcagtgacgtagccatgtgaaccgggagagagaaattacagcgtgtttatcttgttcg

SEQ ID NO: 1165 - DNA, 2372 bp, Zea mays
gggtacctcgaggccacaccttgtgtcgtaccctccggatcgaaggctggacgacgcgaccgcgcggcggcggctcgacgcgaccggtggctttgacgcgaccggcacggcggcgacgcacagcccgacgacgaccctccccgctgccttctccccgggcatttgctggagctggaaggcggaagcgttcccgttggattacttcttgggctggaaagagtgaaagacccggatgcactaaatcctgtcttggaacagttacggccctggaattgatcccatgctgccgaacgggccctaagttggaacctgttcaggcggggggtcagctcgcagctgactggggatccggcaccgcatcgccagacgccaggaggggactatcagccatggcagcgaggcagccgccgccttcgtccgcgtccgcgcccgcgcccgcggcgggtctctccatgaaggactacctcaagaggtacgtgtcgggcccagggaccgacggcgaccagaagagggcgaagaagaagacgaagaagaagcccaagcccgccggcggggtgctcatcgtcgacgaggacccagtgtggcagaagcccgtgcaggtggacgaggagcccgcgtcgtcaggtgacgacaagcctctggtcgacgaggacatcgaggtcaagcggatgcgtcgcctggaggcaatacgcgccgcaaggccgtacaatgctatcgccgaggatggcagcgggtgggttaccgtggccgccccagaggagcagggcggtgggtccacccaccagcgcaggaacgacacgccgttgccagagcggggacgtgctcctacgagggaggacctttctcctgtgcggcggaggcagcggcgcgacacgccctcacctgtgcatggcgatgctgctgcaaaggatttttcaccacctaggcggccctcacctgtgcatggtgatgctgctgcaaaggatttttcaccacctaggcggaggcagcggcgcaacacgccctcacctgtgcatggcgatgctgctgcaaaggatttttcaccacctaggcggaggcagcggcgcgacacgccctcacctgtgccggacggtgctgctgcaaaggatttttcaccacctaggcggaggcagaggcgtcaggacacgccatcaccaaaggacagtggtgcagcggaccaggacgatatgtcaccaccgcggaagtctaggcagagagaggacctttcgccgccaaggaagggtgctcgtcatatcactgaggagccccgggatatctcgccacgaaagaagagagacatttctccctcaaggaagagtacaaaggaaggagcctcaaaacaggtgaagaaatctggactgatgacagcagaagaagttaaagaggacataagaaagattaaggaggctgagatgattaagtttgcatcacaggatccttcgctggttgggaaaggggcaaaggcagtattcagagataaggaaggaagacgaataagtgaagaagaaatgcgcaaggcaaaggaacctgagaagccaaaggaaatacatatagaatggggtaaagggttggttcagaaacgagaagctgagtctaggttgaaagagattgaagctgagaagagtaaaccttttgctcgaacaagggatgatcctgagcttgataatatgctaaaagaaagaatccgatggggtgatcctatggctcatctggtcaagcggaaagatccagaatttattttggaagacttgggagatgatgaaaagatgaaagaatctggcttcatagtaccccaaagtatacctactcacagctggctgaaacgtggagtggatgctcctccaaaccgctatggcataaaacccggtcgtcattgggatggcgtggatcgcagtaatggatttgagaaggacatgttcaagctgaagaacgagaagcaagcaatggagcaagaagcctatctttggtctgtctctgatatgtgatcccaactgctgctccttacgagaggaatacagttgtgtaaaggaagaaccaatggaagacctttcaaacgattttttttcactcttcttattacacaaagtgacagcattggtgatgctgcgccggagtagcctgaatattttccaggaaagcattttcaggaatgcagttcaatgaagctgcattacgtatttgttggaaatctgttactgctgtaccatttgtcatccttcacgttttgtaatatagatgaacgcactgcaaggttttagaacagttcaaaagatgagattttatattcactttctggtttccatgtgtataacttgtcttagcagctgtcgcggtttaatttaaattaaatgatggtggatttgagagccggc

SEQ ID NO: 1166 - DNA, 4136 bp, Zea mays
tttttaaccatagcctgaaattcacttccatatggagtcgaacctaagacctaaggagtgttactcaggccatctaaacaactaggctagaggccctttcatgaaatttttgaagttcctcaaagggtgattaaaaaacgttttcatatctcctcatgaagttgcaaaaaaattactcaccatatcattggttacatgacctaccgattcaagtctttttctccacccgctaatcatcaatggtaattaaggaaattctcacaaactaattgtattatagaagctagagtctatgtgcaagtcaaacactcttgaaccctgcttaataaatctattgaagttgtttcgtagtgaagctagaaaactgaagccgcaattcttaaagtgaagccctcccaaacggggcctaaatgtcttcttaaggcctacagttccagttcacgattttctgaagcactcgatgaccagctccaccaaattttttggagctgagctggagctattccaaacaggaccttagtctctaaattgccaaacgatagaactaaatcagggactaaactgttttagtctgtagtccctcaatgaacaactaaaaggaactaaactatattaattctactttttggtgttctgaataattttagtttctaaaatcaaacaaaaactttagtccgtgaactaaagcccttaaatgacttctttattacagtactctcaactcttattctgatcttttctttattattttattttatttctttttctacatcttctcagctgaccatattacccctctttcggtttgcatctctctcgcagattgacgcgataaagaaatggctcgacaggaactccaacattcaaggtcgttcgccatcgccatctccatctccaaaccctgaaggcctgaatacctgctgcactcgcaaccccttcttcgcatgtgaccttgccacgatcgacgactcgaggctgcacgtgcgtgcaccgtcgatcggatccgatcgatccaaccaaccaggctctcatcaggtcgtcaagccgagccccgcaggtctccgcgcgcagaggaagaagttgcgagagccaaggtccagcaccttgtcctccagcctcaagcctgacagagttccaaacaagcggcggccgacggtcagtgcacctacctacctagtctggagttccagtcttccagagatatgagaaagagcttaattaggttcgttgttcgtctcggtgcacctactctggagcgagtacttgtcgaggtgcagctcgaagccgtcggccgccgcgccggcgagcggcgggcggcggccctcgcgggcgtaggcggcgacggcggcgcgcacgaggtcggcgacggtggcgtcggcgcccagcacgaggtggacgggccacaggctgcggtccaccgtcacgttcaccagcagccgcgtcagccgcctgcagtcgtccctgtccacgtcgctgtccgccggcgggcggaacgacgacagcggctccatgcgctgctgcagcagccggcggtggggctcgaccacctctggctcgcctcctccgtgcatcgccgccagcgcctgggtggtgcagccgctgccgatcggcatggcgggatgctggctcgttcttgtaggtggtgtggtgctgggtggaggtgagcacgggcggtcgatgcaggtgcgcgcggcgtgggggtgggtggatagatacggagacggccggcgagcagacgggctggaagatatacacacgactacttctacttggccgctgcgactagcgcgcggccggcctgatgcacagtcgccgggtgacacgcggccggtgttcctcagccacgtccacgtgtgggtggttgcagggcatcacgtactatggttgtgtgttgttggtggccaaatcagtgacggattcctacgtacgaccgccgccgctgcacgcgttcagccgattgggaaaacaggcactacgtactcgagctgggcctgccgcctgcatcgctgccacgtcccaatccaagacggtagccgccgtcgtgtccgccacccgcatggagtactcggccgtcgcgactgtcgtcgatacgagtgcctggcctgccgcgcaacggaatggccgacgtcgcttttcgtttcccatgcactccggcggatctgtgtggattcccaaatctggtaggacgccgaagctgctttcgccgatcaaatctgtccaagaccccagttttgttgcggcgatgttgccgcgcagggggcggagtcgtgcacggcatcttctcctgccaaactgcacgcatccgtcctaatcctaattcgaagcagcctcaacctcgaaattccatggccatcaagcatggccaaaggtccaagcctcgttggcttccgctgctcctctcttcatctcatccctcgccgccgttgtcttcttcgacgagataaggctgtccttcgtgacatgtgcttcttatctatttagtgtggtgtcgtttgtaatatgttctgttgaacagccttttgttttatggactggccaatggcctttgttgttgaattattgtgcttccggtgttcttcactttgcttgcacttcaatggaaaaaatgcaggcaaatgcttcctgtgtccttcagtttgcttcttgtgttcttcagtttgcttggacagcagaaagggacaaaggaaaacttgtatacaagaatgcagtttcagtttttcttctcgtgtcggcaacaacatttctgaaaactgtgtcgaaacaccaatccagtagcagctattggttgtttcagcggcacaataacaacatcagaattgcagcatttcaggagcacaatccagaattttggaagcacggaaaccataggttgcagtagttgtatagaagaattctagagaaaaattggttcagaaaccgagcaatacattaccaaactggtttctagagatcatgcatttcagagctttcaaccaagaactgtcaactgcatcaatcgtcagagctccatctgtcatcggccacggattgagggagatccctgtctcgtgcacgggaatatcgctcccaaccaactcctctggtagccacgctgaggacaaggcaccatcgacctcgtcgactaggaggtccgtcggccgctccattggggatgactccagctccagcatagctgcttgcgacttcttttcagcggcgaaagcaacagaacaagacaggacaagacgagggagagaaatttggatttatgtcgttatggaaacgtacgtttcgcttaaatgccatcatgtaaacacgtttcgccgatcaaacagtttgttgcagggctgaagaacgagaagcaagcactggagcaagaagcctatctttggtctgtctcagatatgtgaatccaactgctgctccttacgagatttgagaaggacatgttcaagctaaagaacgataaacaagcactggagcaagaagcctatctttggtctgtctcagtctctcagatatgtgatcccaactgctgctgaatacggttggctaaaggaagaaccaatgaaagccctttcaaactattttttctcactctttttattacacaaagtgacagcattggtgatgcttgtgctggagtagcctgaatatgtttttcaggaaagcattttcaggaaagcagctcaatgaagctgcattacgtatctgttagaaatctgttactgctgtacccttcgtcatccttcacgttttgtaatatagacgaacgtactgcaaaaagcgcaggttttggagcagttgaaatgatgaacacttttttttgttttccatgtgtattagcagctgtcggtgtttaatttatttaaattagatgatggtggatttgagagccggcagttgtcgttctgaaagcaggaaacaacagggttattagtagtaatcaagcctgtgtgtacgagttgatccgtccaattggttgtggtgaggtgatcaagttcgtcttgttagttgaggtggagtatttttatgctaatgatgatgactaccgtgtactttgttgcttgcggactttttgtaaatttcaattattggttttaccatgcgtatgaaaaggaggatagttttgtattactattcgatgaacttgttca

SEQ ID NO: 1167 - DNA, 2611 bp, Zea mays
taggtcagcaagctgcattcctgtatatagctttgttttatgatactgatgtcctgatactgaataatttcttgtgtatttggatgagtaattgaacagtaggaaatggcacaggaatgggacgtacttctgacacaccaacgccacacgttcagtggttaactgacgtagctttatttgcatgtagctggcgcaacaagtttaataacggacccttaattaatgttaacgacgtataataggtgaaagtaaactgatcccaggaatttaataatgtctacagtgttttgttagcctgttggtttggttttaattcgtaccggtttctactgcttctacattgttttatgtctatggattacagatacagcagtttgaacatctgattttaaagtagaagccaatatcactctttaatctgacagtgatagctgcggtagagacggacctacgtgtaatagagtgaggacataagtgtaatggagtgatgacataagtctccactcatttttgtgttgtaagtaatagatactagattttcactattatatcttctgctcagctcaatttatatgccaccgctcttatattttggtggtcttctgctcagctcacttccattttacccttggtccgcccctgagccgcggataccactgctgcctgatgctttgatctcactgatactgtattgctcatgtagcgaattaaatgtccacttgaatggtataataatgtcaaagggaattgccccaggaacaatgcatccatgcgaaccacgtggggagggttctcgatgcaataggtactattggctggcagcaagcacgtccctcaaggtcagatcttgttcagtgcctgcggagtatatgataatatgacaaatctcagcaaacaggaagcatcgctacaatattatatactagatgaggaagcagccagaccacacacacccacacaccccgcttcacgttctcaataatggcgccgttcccacgtcgtcttccggccgccgtgccacttctcctcctcctcggcgccgcagtggccagcgccggcgcggaggacaccgatggcggcaactcccgccggcggcactcccgcttgctgttcgcgttcggcaactcgctcaccgacacgggaaacggggccatcttcccggtgactgcaggcgggccattcacccggccgccgtacggggagaccttcttcggtcgtcccagcggccgggcttgcaacggcaggctcgtcctcgacttcctcggtacgtacgtacgtatatgcatgtcaccaacatcgtcaaacagcaacgtacgtatgcatctataactatacatgcatgatgcatgcagtggaggagctgaaggtgccagagccgacgccgtacctggccggcagtacggccgccgactttgcgaagaacggggccaactttgcgctgggtggtgcaacggcgctcgaccaggcgttcttagcaagcaaggggataaagtcgttcgtgcccatctctctcatcaacgagacgagctggttccagaacgtttcgaagctactggacgcgtcacactacggttcataaatactatatataaaagcgactatatatatacaaaatattattgttgagctaaaacctctcgtcttcgtttgacgacgacagatgagcgtaagatcatggcgaagtcgatcttctacgtcggggagatcggtgtcaacgactacttcgccgccctaagcaacaacgactccgtcgacgtcgcggtcagcctggtgccgcacatcatcgacaccatccgttcggccctgaccgtaagcgtcgatcggccggaggagcccaactcgctcgtcagctcatcagcgtctgttaattattagttatgaacaataaacctgggcaggtcatgatcgatgccggggcgaggacagtggtgatcacggggatgctaccgatcggctgcgagccgcagcagctggcccagttcgcaggcggcccggccggcgactacgaccctaccaccggctgcatcacgcggttcaaccagctcgccgagcaccacaaccacatgctgaggatgatgctgagggagctgcggaccaagtaccgcaggcgcaggcccctcaccctccactacgccgacatctaccgccccgtgatcgaggccgtcgcgtcccccgcctcgtacggcttcggcgacaggccgctggccgcgtgctgcgggggcggtggcggccccaacaacttcaacttcatcgccttctgcggcacgccggcgtcgaccacgtgcaccgacccgtccaagttcgtctcctgggacgggatccacttcaccgaggctaccaacaggcttctcgctcgtaaaatgcttcaggaactgctaagccgtggagcttacaatgttgcaatctgattttttctatgcccgcgagtcgtatcaacgtgtttcccatagcggatcggagctagcgtggaacctcttgtgcaataaaaaaataagtgtcatcacattcctcgcctttgacgagagaaccggatttcctttttcattatccaataaaagatacattaccgttgaactagtaagaggagggctgtacgctgtacaggatccaa

SEQ ID NO: 1168 - DNA, 1435 bp, Zea mays
gccgcccggcccgaacacatacacccacaccccgcgcttcacgttctcaataatggcgccgttcccacgtcgtcttccggccgccgtgccacttctcctcctcctcggcgccgcagtggccagcgccggcgcggaggacaccgatggcggcaactcccgccggcggcactcccgcttgctgttcgcgttcggcaactcgctcaccgacacgggaaacggggccatcttcccggtgactgcaggcgggccattcacccggccgccgtacggggagaccttcttcggtcgtcccagcggccgggcttgcaacggcaggctcgtcctcgacttcctcgtggaggagctgaaggtgccagagccgacgccgtacctggccggcaggacggccgccgactttgcgaagaacggggccaactttgcgctgggtggtgcaacggcgctcgaccaggcgttcttagcaagcaaggggataaagtcgttcgtgcccatctctctcatcaacgagacgagctggttccagaacgtttcgaagctactggacgcgtcacactacgacgagcgtaagatcatggcgaagtcgatcttctacgtcggggagatcggtgtcaacgactacttcgccgccctaagcaacaacgactccgtcgacgtcgcggtcagcctggtgccgcacatcatcgacaccatccgttcggccctgaccgtcatgatcgatgccggggcgaggacagtggtgatcacggggatgctaccgatcggctgcgagccgcagcagctggcccagttcgcaggcggcccggccggcgactacgaccctaccaccggctgcatcacgcggttcaaccagctcgccgagcaccacaaccacatgctgaggatgatgctgagggagctgcggaccaagtaccgcaggcgcaggcccctcaccctccactacgccgacatctaccgccccgtgatcgaggccgtcgcgtcccccgcctcgtacggcttcggcgacacgccgctggcagcgtgctgcgggggcggtggcggccccaacaacttcaacttcatcgccttctgcggcacgccggcgtcgaccacgtgcaccgacccgtccaagttcgtctcctgggacgggatccacttcaccgaggctaccaacaggcttctcgctcgtaaaatgcttcaggaactgctaagccgtggagcttacaatgttgcaatctgatttttctatgcccgcgagtcgtatcaacgtgtttcccatagcggatcggacctagcgtggaacctcttgtgtaataaaataataagtgtcatcacattcctcgcctttgacgccgagagacccggatttccttgttctattatccaacaaaagatacattaccgttgaactagtaaaaaaaaaaaaaaaaaaaaaaaaaaaaaactcgaactagtctcgtgc

SEQ ID NO: 1169 - DNA, 3003 bp, Zea mays
aaaatacatggacgatagctgatgattggggttctgaaaaccgttgcccatctcctgattcagatgctaaggacagtgcaaaagtggatgatctagaaaagtgtagtagcatcgtaggtgaggaccagaaagaaatccttcccccggggtttcattcacatgtttcggccatgccacctgcaaggaagaagaaagcagactctagaaagtattttccattcaggcagggatatcttgccgtagcaattcttcggatcggagcacatgggatccatatgactgtagatggcaaacatatcacttcttttgcattccgagaggatttggaaccagggtttgtaggtgaagtaagaattgcaggagacattaaattgttatctgtgatagcaagtggcctgcctacaacagaggacttcgagcatgtcactgacttagaaatattgaaggctccacctgtgcccatggataaaccggttgatcttttcattggggtcttctctacagcaaataatttcaaacgccgaatggcagttcgcagaacttggatgcagtatgattctgttcgatcaggaaaagttacagttcgattctttgttggcctgcacaaaaatgagttggtcaatgaggaactctggaatgaagcacgaacatatggagacatccagttgatgccatttgtggattactatagcctgattctttggaagaccatagcgatctgcatctatgggacaaatgtcctgtcagccaactatgtgatgaaaactgatgacgatgcttttgttcgagtagatgaaatactttcttctctcgaccgaaccaatatcagccatggactgttgtatggtcgtgtcaattctgattcccagcctcatcgagatccctatagcaagtggtacataacccctgaggaatggcctgaggagaattatcctccatgggcgcatggtccaggatatattgtttcacaggacatagctaaagaagtttacaggaaacacaagaatggggaatcgtagatgttcaagctggaggatgtcgcgatgggaatatggatcaatgagatgaagaaggatggcttggatgtcaagtatgagaatgatgggaggatcttggttgaaggatgcgaggatgggtatgtgattgctcactaccaagaaccaagggatatgatgtgcctctgggataagtttcagaaaacaaaacgaggaacatgttgcaaagaataacagagataatgcaaatgatgctttattttacggtggttgctgttggccgttgcttgaacagacaccgtcacgctaaaacgttcttgacatttgacatatacagcccctcctaagaggaatcttgcagaactggatggcaagcgaagttttgggtatcttaagtttgtttcgtcccagtttgaagagtttctagtcaaactaggggatatgcattgtaggcagaatgcaggtcacatcttttttttttgggtaggtaggagagtgctgctttgcttactgtgtggcttgtaaaatactagtatcttgccagaatgtaggatacatgggcggcagcttacgttaggatagattgagccagtctaccattcttttgaaaggaatgcattttgcatctgatgtaaagctatttttggtgaccattcattctcttgtataatccattctgaagaaatttcaaatcggtactgattaagataggatcacatcacatccaagtttttacagttgctaagaaaacatgaagcataaaatgatcaagccagattcacaggtacggaagaaagttacactgccgtactctctgttccagtctgctgttttttacggagccaaacaaccgatgccgtagcgggtgttggggaacaagaggaagaggccgctgcacacggcgcccaccatgagcgggaagctctccatcacctcgtccatctccttgcggtggccggcgacgaggcacccggagacccggtagtcggcgagcgcgacggcggcaaagaccagcacggacatgacagcgtgcacgacgtcgacgaaggcgagccggtacctttcctccctgggcacctcgacgtcgagcccggtcctgaacagcgacaggccccgcggcgtgacgaagccgtagtacaccttcccgtccggggcgcggaagctgtcggtgaagtggaagaggaagcaggaggtggcgcagagcgcgagcagggccctgagcatcgcggcgctgaccgccgagcaggtgccgtcgcctgcggcggccgggagtagcatctcgaaggttagcagcgtgcccgtggggaggaagttggccagcatggacgtcttggagagcgtcttctgcacgcccctcgccaccgcgcggcgcttccttcccgcgcctggcggcgagccgccgccgccgccgcgcacctcgacggacaccgcaccggcgttgctgcgatccatgggcgcgttcttgtccggagagcgtggaactgttttcgcgacgttcccagagactggaaaagcaaagctgttggtttgcttgctgatcggctgttctgtaatcgtaaatagatgcacggcgcacgcgtagtttggcgaacgttaggcagtgcttgagttcaaatgacgtgcaactgttgctacgcataactgttccctccgaccccttgagttcaaattctcaaatgctggccacatcgctggccgcctggacaacacaatatttcttctccaccctcattcccgtccggataaatcccgtcggatcgaacccgatcaacacttaaattataattataatatatattatttatcctttactactaatatatgacattgtcacttgtatacatggacagatttaagaaattatatatatatatatatatatatatatatatatatatatatatatatatcaaaatagacatatttatacaatagaggatctcttgataagataattaattatttttattattaactagtataaaaaacatcgacacatataagttta

SEQ ID NO: 1170 - DNA, 9828 bp, Zea mays
  misc_feature (3201)..(3201): n is a, c, g, or t
  misc_feature (5228)..(5228): n is a, c, g, or t
ggttaaggtgacgctctaacgcacaaagcccctcgtttaatgatcgtaaggttagttaataattgtacaagataagatggatgcgcagtgccgatatggagctgataatatatacagtgcaaaggaaaggatgtaaatgtggagtaggggccgacagagtgagtgagtgagtgtgcaatctttgttgtgtgcgtgcatgtgagaagaaccccgtcagcagtcgaaaggcaggacgcagcaaaagcacccgtggcgctctacatgaggctgactgagccttatccactaatccagcggaaaggcgggtgtgttaatagggaagctagcctttggattccacttatgatcgatgcaatctaaagttagcccgttcgggtgggtgtggggtgggtggcttctggcgtcgcgccgtcacctgatcgcgaagaccagtgggcgggcggatcggcagttgatgacttcttttcggtgtggagcagaagcgggaggggagacggggaaacaagaaaacggagccggacccaagtttggttagaagatgaacggggtggccacctgctcggaacggccgatagatgcggtggccggccggccggccacatgtatacgtacgtggatgggggatgggccgggatggtgatggtgtccgttttttctccgtctccggtgtgctttcagctcggagttgcaccaagccgaatcgtctttcgttggagtagtctgcagcgcgtgcctggtactcgtcgtcgactttacacttttagctaggggagtttccgttggcgaccagccagccagccagctcttgctcgactccaaattggacaccgcgtattcagcacgtgctactctctccgtccgaatattatggcctcgttggtggttgcctgaagcctcggaggcgtatccgagccgccaattcagcaccactcgtgcgcgtcattcgtccgcacctactgtggccgtcgcgtcggggtccgacgggttactgttaacatataaacagggttgaagcatagcatccaagtttgctggtgtcactatcgtttataacggatctcatcaatactataaccagtgcttaaataatattctacactggatttttccgaattcatcgatgtcagctgacacatgtactaagctttagctccgccccctgcatataaaaaatcggacgatgttaaaaaccctaagtcatttctttctcctccacacatcgcggccgttctgttcttcatcttcttcagctaaccgaagacgtcctctctgacctacttgtattcttttctttgatatgtatttttctatcttatatgtgaattgaccaattcacagttgatattagagttatgttttttttttatcatgagcccaatcccgttatgggtgggttaggattagggtttacctaacccaaatccactatgttcttttcctttcttctataatttggggattatggttatggttaacttatccgaacctctttttgttcttgcgctttcttctgatttgtagattagagttagggttacctaacctaaatcctttttttgttagatttgagagttcaggtttaaggctaccaccctaatcccattattttctgcagtccggctcctcgccatggtctattatcgggttatggatataataggtatttttggaccctatatcccttttgttgacacgagctctgttcttaactctagcttcttatgtatgtgaaatacggactttggtggctccgatgctattgatatatttctaagacccttgggaccggtctaagtcccttgggatcgatgatgtacaaggcttaatcctaatctgagaggttgaggggagaggaaaacacgagtcctaccttcctatgccatgttgatggtcgtgatcgccaacacagtcatgtcctgcatcggtgttcctccatctttgttgatgtatggtgacatcatgtcgctggccaccgatgccatccgatccatgattagtttttgccttgctggtggctccttggaacccggcaacaatggagacgtgggctccattgaccgatatcgtcataggttgatgcgtttctagtcactgatcagaagtgcctagaagatcgggtcatctctgccaacgttgcggcagaagtgcctagaagattgggtcatctctgccaatgttgcggctagggtttaccggagtacaaagcattggcttccgtgcccagtcctaccgtggttttatattgcaaacatgagatttttttaaaaaaatatgataaaataaaaaaggcgatcacacggtcaacatagctgacctccaaatctccaatagacacatgttgtggactgtggtatcgcgagagaaaagctagacaccggtttcggagttattcgctttaggttaaagttaactgttgaaattgtagcagttgtaatacatagagacaaaacaatataaaaagtagtataagttggtatatattaaagttaagcgtacatgctagaattcgttttctctggccgctgcacccacctcctcatctccacgtccactctgtagcttaactttaaagaggctaacccgccgcgtcaccccgccgctgtggcgtcggttagcgcgcgtaaccaacgtcctaatcatcacgcctcctgctctgctcgtgtgcctgcacttggcgctgctgtgcgtatattaaagccaaggcagcagccacggcgtgagcttccttccctcgttcattccctcccggttcaggccctgtagtcctgtaccaagttttcgtaggcattcggatcgaggcaggctaggctttcgtttcgtccggaagaagcaagctaaaggaaggcgatcggatcggaggccatcgggaacggaacggaacggaagaagcctcagctcgaggtacgtacgtgctcatgcatgcttattcccgtttatagttgtggaaccaggatcgctcctgctctgttttcccattaactaaactcgatcagcttgcactgcgctgcggctgcgccttcgttcatcgttcgacgatctctcccccggccggtgctgcaacccaacccgtgcgtgcactgccagccagcgctgctggtcagagcactacactggccgcttgccttgcccaaccgcaaaaccaaatcagagatgaatctttactaatcttctctcccggtagcagtcaccgtgcatgctggnaagcaggacagcaccttccatcagatccttcgcctgtcatcttctccattccatacccataatataggcgacgcgacaggtcactgctcacaaactaccgtcggatttaggtgttttagctcaccaaccacctggattagacgacggacgtggggggtccatgttagcacctaggaaggggggatcgggagaggaaggtgctcggctgggaagaacacttggagaagaagggagcagggcgtcgtttcctttttatcccttagctacaactccacactactgactagcccccattcacttacacggcccactcaggcccagttactcggacgttaccgtgcttcttcctgttgagacgtccttcgtcagcttgcttctctgtcgtctgcttttccttcaatccgctcgcatccagattctgttgagccgcgtggtgctgacagtccagcctgtgtgtgagtgacagccaccggtacttgtgcgctccccttccacagtttgacgacacttgggcgatgctctcggccgacgacactgacaacaggagagtgtgcaaagcatatcagcagcgagcgagtcccggtcccggattcgcatctcaattatttccttccttccgcttccgcttccgctgcgacgtcgcacacactgcgcgcgttgatagtgagacaccctgctgttggacagttccacctctgcacagaagaactcgaaacctctgcaacctaacatccctatgattgagccttgacacgctgtcacggtagactgattagtctttaatggtagcactgttttggcgtcatacgactctctacaaaaactgctccgctctctccgcttcaaatcataatcaatcttataggggtagtatatttgtgaacggagtgagtagtatgttttatggtaaacatactttggcggcataaatgcttatgttattctgtgaaaggaattttggtcaaatgatgatgttattcatttgcttaaaaaaatcccagctctcaagtgtcaaccagttttgagttttatcagatatttatataaaaaatactaacaactacgagtatgcgtgtttggtggcataaatgtttgctgttattctatgaaattgttgtactttttttttggttttaaacctaggcttgggttcttttggggtggagggagtgcaacttttctagtttttttacaacctctacaaaaaaaaaatacaacacaatgaataataccaaattctcaatgaaattatgttttccaagctcatgtatttgaacttgtagatgttagtattacttctaagaaataaaaaaaaagttagaaaaagtttgacccaatttaagtcaattctcaaataaactataggcttagacgaagaaaatgtaaaagtacatgcatatgtcgaaaaagtacttttatgcggttggtatatgccttcagaacgtaaatattactccataagttccaagatacatgaaattttaattttgctttaggtcagactcttctaatttgatcaatgtttaggaaaaaaatatattaatatctgaaatgccaaaaaaaaacatgtgtacatgtttcgtgttaaattcaacaaaaaaactcatttcattctgtagtagatactggtgtattctcttatatttttattggttaatgagttttgagacaaaacaaaaaactattgtatattattcagcacaaggtttatatatttatttgtctttgcattaaactctgaaaccgtcggggctgatgatttcagttatcggaggagtcgctagcaccacaacacagggccttcgattgcacgtattggggtgggaggatgttgcagaaacgatggaagggatgcatcttcttccttcttctctcaggcgcgttaggtatgtatgttgcttttcttcatcctagattataagttttttttttaacttttaagttaaaaaatctcacgcttaactaaatttatataataaaacaataatatttatactgaataactcataatggagggaatacgttcnagccttcgaggttctacgcaggtcctgacgccttttcctgagtcttcagagaatcagaggcaccgggttttctagttgctttttcctcacttctctttatcccttttttttttctgtcatccctccaaaacaactttctttagtgagattctttacttcgctggaaaatgcatgcgtgggcaatgtatgccaatgaaagtgtagaggattgcaacttcttgataagctacaaaggggtaggagtaggatatgcctgtgctttttacacctttttccatgccttatcttgagtcaacaaaggcgtaagtgcgcggtggacacgtgtgccatttccaagtggtttatctgaaccatcttctcgctattatctcgttttgaaaatcaaagatgctgtttggcacgtgtaactgtcgaaaattctgctctgaaacactgaatcctgaactacttactgtgtatgggactgcattgctgttaggtgcactaactaactatacgcagaggtcaatgtgccgccctttgtttcatgtgcattcagtaaacgtgtacctctgtctgctgctgtgaatatttatccggatttacttacagtcctcacaaacccgcaggcgtactgatggcttcagaaagctcttcgtcagagtttgccaagatcgttcagtctaagcagacgaggcaagctcggctgtgcggagcggactctgagctactgagctccctggcgggcagcgacgcggaggtcatggtcaccatccccaacgagcagctggagcacgtggccgagttccaggaggaggccgacctctgggtcgccgccaacgtcgcgcggttcctcccgtcgaccaggatcacgcacgtcgtggcgggcgacgacgtgccggcgaactcccccggcagcgcccacttcctggtcccggcgatgctcaacctccggtcggcgctcgtcgccgcgggcctcggcggccgcgtcaaggtgtccagcgcgatgtccggcgaggcgctgtccgcgccggcgtggtccggcgtcgtgggccacgtcctgcggttcctcgagtcggccggctcgccgctgctcctcaagtcgtcgtcgcgcccgtcggaagaagccagcgacgccagggtcggccgcgcgtacgccgcgatgcgcgcgctgggcgtctcgggcgtccccgtgatcgcgacggacctcgcggccggcggcgacgccgtgccgtactactactcctactacggctacggctacccgggcggtcacggtcggcggcggtcgctggcgacgacggggacgttctgcgtggcgctgcaggacgcggaccccgcggcgctgcaggccgggctcaactgggcgtgcgggccgggccacgccgactgctcggccatccagcctggcggcgcctgctaccagcagaacaacctgccggcgatcgcgtcgtacgcatacaacgactactaccaggagatggccagcaccggcgccacctgctccttcaacggcaccgccaccaccaccaccaatgacccaagtaataatctagctagcaactcataataagcgctatctttttcccttctcttttcttacatcacaaaggaggtccagccagagcgttcgttcgtggacactgattaattaacgccttcgtgttggctgctcatccatttcaggttcagggtcttgcgttttcgcgggaaggtgagcgtgcatgctttatttatttatttcaaacaacgcacccgttctgttctgttctgacagcctgacgtgatctcgtaacccgtcgttgcggttgcgcttcgcagctccacagcgggaggctcctccaactcgagcgtgccggtgggcgcaagcccgccgaccagcctctcccctccgacgggcttcggcacctccagtcggctccagccccccgtcgtcgtcgtcggaggtttgcccccccggcggtcggcaccgcccctttgtccggcttcaccccgccggacggaggcggcttcggcaccccgccgggttccttcaacggcaccgggacgttcgggccgagcggcacgctcagcccttacaacggcgggacccgtgggctgtctcgcgccggcttgagcttgacggccctgtccgccgctgcggtcgccgtgcttctcgcgtccattgatgcgatgtgaatcaaatcaaatcgatgcagagactagacaccccttttctcgcgccgcaacatgttcttagttgttgatctactggtcatgtcatgtagatgtcaggtcagatttgtacgtattatttaggtgccgtgaatgtgaagcgaatgtctctgtatgcgtgtgcgttgggtgccgtagttctgatgagcgcatgtgaatatacgcttatatgtatgtatgacacgacacaaaacttcagtacagtgatggattatatatttaccggtttggaaacaaaaaaaaaaaaaaaacatcctggtttttttttcccgtattgattcatcctgcctgcctgcccgcccgcccgcccgtgacagttgaaattgaaaccgtgtatgcaggtgcagcagcatgaacgatcggtacgagctgttcattatattattcaaagtttcaaacagtggacgactagaataccatggattcttcttcatcattcaggcaagtcatcatatagcagcaatagcctggattatcatcactaatagcaaagcatgtcaaatgccaatgcttagtcgcgtaaggaaaacaactagaacaggattgaatatttacctagcatatcatcggcaaccgatggcactggaacgtcaaatggcgctctggtactgaagacacagaatgtaaccgatgaaacttgcccgccaacccccaccgtccaccaattagcaattaacaatgtcaagagcttgtatcgtgtttaccgttgttggctcttccataatatatgtccgaatctgtgctggtatgggtacaagaagaaactggatgtcaagacatgtatatgtagaccaaaaatgtatcttagccgatttcaaactgcctagcgaaaagatgatcaagctgctccgtgtttgggtgattgcagcattatgtatcttattaaccgaattcgcagaagacttatctctcatggaacagatgaacctattagcagtctacgtatataaagaagtgacttccagactgccatatttagtgattagggctgctagctgtgactgaccgtttacctttgcaaacaatctgtctactgctctgtgttttgcatcgtccatcatgtttatttcccattgttgcagcttacgatatcgtgtatatctggcacctatgtttatgacagtgaagctcaccatctttattctattgacattcattttcatgcaaattacataacgtatggtagaacgaccgaatgcaaattactgctaataaacatcctgcgtgcgcgcaatggtgcaccatctaccaattaatagctgtaacggtactgcaagtaatggtcgaagcgttatgttttccctcctctcttcccaccgtacaggattatatatatacacatgcctctcgaacggcttgaatagttccaccacgttacttccatatatatttcccttggattggattggatcgtcggcgcccaaacgaataataatccggcaatggagccttcacgagggaagctgtctgccgccgccgtcctcctgctgatgacgacgctcctcgtggtggccgccatgcgggcggttgaggcacgcgactgcctgacacagagcacccggttaccggggcacctgtgcgtgcggtcggactactgcgcgatcgggtgcagggcggagggcaagggctacacgggcggcaggtgcctcatctctcccatcccgctcgacgggattctctgctactgcgtcaagccgtgcccatccaacacgacgacataatgatgagacaaagggcggtgggtgcagtgcacgctggccgggggttatcagtccacacatcctaccgtacgtgtctgtgttaataacttttttttgtcttggaagtctgtggtggtaatgacttttaaatgtcttggaataaaccgggttctagtcccttataagctagcagtactgtaacaattcagatcatcaaagacagcaggaaaccggtggttgagttgagactgccttgtcctagaacaccgacggcatgtttggactcttttagtagacttgggcaaaatggtgacgacggtctggttccaccactcgacgatgttgttctaccgatgtcgtgtgccgtcgttagatgtcgtgttcgatgcaatactattcgaactcaacaaaggtgaactcaccctcactgtcagtgtcatcaaccaacaaaagaaagtactactgcttactaccaccgagtgttgctactgtgattggacgcataggtcgccatggaccaggtccagtagtccctcggccctacaacaggaacgaactcctttaatcatggagatgacacagccagagtagaactagtggacatgctcgacgtgtgacaacaacccggtcatcatgccccgttggtcgagcttccattggacatcgaatttagaggtggtcatagctaaacctaaaactcgagccgc

SEQ ID NO: 1171 - DNA, 5922 bp, Zea mays
aacctacatccgacctcttagaaggtctacatgattagaattataggccataccatctaacatatgaatttaagtctcactactatacgaatggtagataacaaagattagatgacgatgggatctaagaagtcgcattcagcgtgattggacgtccagctcgtgggcgcaaggctcgcggcggcctggatgtgcagggatcctctctctccgtatcttcacgcgtacaaactgacacaacaaaaagccactaagttgcatcggtgcatgcaagctcttctccatacatacaacccaccaatcatcggttaagtgtggtaaacggaacgtggagggcctggacgcacgtggctaggtatccaatcacgcggattgtttcccattgctgcatgtacgacccagtttggacatatgagaagagcacacccaatgctagtgaatgcaaaaaagaatgaaatgatatatatatgttccgtccacagtgttagttgagccaaaagaagaaaaagtgattcatatatgtattcagttggattagggtaaaacaacatggtagatatgatagaattgttttttgttttgcaagccagatagtattattattattatgtattaagctgaattagggtagaacaacatgctatctgcgtatcctgcacagatcattttggacatttttttcccgtacataacaattggcagaacaataatttactttcgaaacgaattagactgttccgagctggtcaccgtcagatgctttctgaagcgtatgacatggatgccgccacaatactcatcacaatagtgtgagtgagcggttgctccgccgttggccgccgctgccgagtggagccaatttcagatccacgcgtcgggcgtttggctgcggaacgttgcggcagagaggatcctgcggggtgcgggttagtgtagtaatggcacgacgacgatcgaagcagcttgcagctgtaaagaggatatttgtatgatcgggaaaaaatatatatttgaggctgcagaaaggaagcatgcttgtgcttggcgagtagaaaaaaacaaaaaggcaggcgttcgcgggcaacggaggagagtatactactgaccactgtggatgtctgaccgttggcaaatgtgtgagtgtgtgtggatgcgtgggatacatcgattccaatgttggcaggaggggtaggcagcaggctagctagctagatagatccctgaccctgacccctcccgctgaagagcgctcacgccttcaacgcggctgcaggatcggcaggagcagaagccatcagcagcagcagaagaagctcgtcagtggtgcgcagggggtcagcagtggtgcgagctgctgcaggctgcagggcaggcggcagcggcagggacgggggcaacaagacaagcgggggaagtggaagccaattggaaatcccaccgccaaagatagatagggagtgatcgagaagatctcacagaggaatttcagtgtccccactccgcccacttatattcataaaaccaccccacccacccctttcttttctcttcttttcctatcctatcctttctctctctcttgcaaccttcctccttcctccagttccagaggagagagacgcgagaagctttctcgctctactagtctctctctaccatcccttttcttcttcctctcctctctctcttccatgtcactgtcctaggctgaagaaatcgcaataaaaatcgctagactagcagcagcagcagggcaggaagcgaggtaaggggaggaaaaagacgagcgaaaagggggtgttagagttccccactgaaggctgagagtagatattgatgatgatcatgatgatgataggaacaggaccaggtatatagggtaggggagagaggaagccagtgattaggggggtagatagagagagagacaggacgctctactgcactagctgcgcaactcagagaagatactccaataccctcttggcgtgggcggagaaccagcagcaagttcagctcagctcagctgggaggtgccgcaggaggaagaggaggaggagatttttattcggaccggatccactgcgcgtagcgtagcctccttttcactcctacctgctgccggccgctgcctgccgctgctgccgtaacgaaatctacagcggcgcaagcagcgaaattttaaatctttgcggctgctccgaccgcagcgaagcagctccccactctctctccgctgctgcctccgcggacggattccatccccggccctataagtgtggcttcgggacggcgcttcccatccgacaccggcgccttcgcggactgggtcgcctcctccgccgccgcggcgcgcggggacgacctctccctcggcttcaatgccagcgcggcggccgccgcggccgcggccgcctccggcgcctcgctgggcgcgggcctctggggcccggcgtcctccgcctccgccgccatgcgccaggcggccgccatgaactacgggatggccgacgtggggatggtcgtcgtcgcgcccgccgcctccttccaccacacgcaccaccaccaccaccaccacgaggccgccgccgccgccgccgcggctgcggcggcctccggcgaccccatcttcccgctgctctccggcggcccctgcgtgcttgatccggacaagtcggcctccgccagcgccatccagttctggcagcagcagcctccgccgccgtcgtcgccggctgctgcagcgggcgctaaccctaaccctagcgccagccccttcgcctacctcaagaagcccctcccgatgctggacgccggcgccggctcctcaggctccggcgccaccacgtgccaggactgcggcaaccaagcgaagaaggactgcggccacaaccggtgccgcacctgctgcaagagccgcggcttcgactgcaacacgcacgtcaagagcacctgggtccccgccgcccgccgccgcgagcgccagcagctcgccgcctccggctccgcctcgtcctcccccgccaccgcctccgcggcggccgtcgccgcgtccgcgtccgcgtccgcgtccaagaagccccgcctcctctcgtcgcagaccaccacctcgcacacgtccacctccaacgccacgacgccccgaagcttcgacaccacgtccagccaccaaggtacgtcctacccgccatttaccgagcagcatcacgccgtccacggtcggatccttcccacccaaaccgtgtctcgtcgcgctgcagacgcgtcgttcagggacagcctcccgaggcaggtgcgcgcgccggcggtgttcaagtgcgtgcgcgtgacgtccatcgaggacggcgaggacgagtacgcgtaccaggcgacggtcaccatcaacggccacctcttcaaggggttcctgtacgaccagggccccgacgacgggcgccacgcggccaccagcaacgacgactgcacggccggcggggtgcccaacatctccgagctccatctcggagcggcgtctggttccggcgccggcaccggcacctcgatgtcgatggctcctcccacggggctgtacggtggcggtggcggaggacatcatccgcacattctcggcgggtcgtcgagctacggtaacaccatgaactgatggagtacgttccttccttgtacaccggaagagtcccggcccgttaatttccattccttgttgctcttcattttccacgctatagtagcagagttcaattttctcagccttgtcactcacccggcgccatagatagcagggcatcaatgcatggtgttattctgttctacctccttcattccatcgtcctactgtgttatttagccattcgttggtgtataataacatcgatgagttgttttttcttcttccaaaaaaaaaaaaaaaaaacggcacgagtactgcactgctagttcttttcccccctatcacactagttgggtacgtacgtagagaggagaataattgttagtaggaattgggaagaagatactctcggtagtgcaaagattaaattttttaccattgtgcataagatatcgcctgctagctggttcccaatgcctgtcgttccgtttccacatttggggatgcggtgttctcgccatgcgggtcacctcctcctcctgcctcgtgattgatacatgttcagcatccggagctgcaatgtttgactcctcctccatctgattggcccgccctgcccttttgcgtgcctaatttggcttttgctgtgagcatgagctccactcgttttccgctgcacagttcccttcgttcggcgtctcctcgttttctatgggtaggttaggtgtggaaggcatatggattcttgccgccgtctggacggcggaggaggagcatcttctattgctgggcgcattgggacttgtattctggaggggaggccggaggccaatgtgtagtgcatgcatgtgatgggataatcatccggctaggccattaggatattataagccatgccgatcgcgcatgtgtgtgttacttcgatccttatcctactacgtttacagccgcgcgcctggttcaccgccggctgcttcctgacgtactagaagaggaagaagatgaagatcatggcgcgcagcttgctgctcccctcttctctttatcttctgtgcgaagcccccatatttattccttgtgccggatctcctcgtggttgacaagatgtgaaacgaaagaaagttgtcctccacggtaaaagcattgccattgccatgcatgcactgagagagcctgtgcttttttttgttggggtggacgggctgttcgatttggttcgctgtcttccatcgcagcggcagcggcagcactccacatgtttttacagcgacagctttgctctgcgtttccatggagtaaaagaaaaaaaaacattacagcctatgcatggttgaggctgctcgtaggagtagtagacctctgtaataagtttggagttcactgcacatggctgttgttgcattgcatctcccctcccgtgaactttttcaagttcgggattttggtgctgttgtcctttcttgtcatcatcaaagctgctattatctcatgtacgtgtgatcatgtcactggtccatatcgccttgtccactgccgtcaaccctccgggagcacgtctactattcacattgcttctttattgggtactagacattatgcgtgcatcatggacgccgcgaattgtggtagagctttctttcaggctgcaggccggcttgcagccctactgttccagattgtgctcccctttgtttttttgtcgttgcattgcctacttctgttactacaaagaacacactttactttgaaggggtttcctgagtttaccaattgtagtattataccggagaatagtaatgtaattttcttaatttgtgattactgttgtgttggcattttgttccttattctagctgtcctgaaacacaactaagcaagggcaggttctttgcgtttggtcacgaagaaacgtgtgctacttggacagtccgaccggcgattttcgttttgcttttcatacactgtggacgtaactgcgatcggcatatttatcacatgcacaagttttcttgttggcagtttgcagtttctgatgggtctctttcctgtacaataaattagatgcggctagaacatgaatgtctgtttgctgtcttctgttctgtcttctgttattatgccaaaccaattgactggatcaactttcagttgcctacgaaacccacttaaactatcctgtttgtatgtgtccggtctttttttccccactatctggaaatatgtagtcatcatttggactgaactcaagtttcttctgtttgaaaattctaaatcataaccccgtacataagcaaaaggtaataagcaccgag

SEQ ID NO: 1172 - DNA, 1940 bp, Zea mays
cgctcactctctcctgcctctctgctccctgcccctgcccctgcccctgcccctgccctcgtcactctgctgttggcacctgctcgctccatcagatttcggggagctcaccaaataagcatccccccgatcgaggcaggcttagctaggccttcgtactgtttcgtccggaagaagcaaactagctatagctatagctgcaggaagcaggcgagatcggatcatccgaggccatcgggaacgggagctccagccccggcccgccgagttgccggaggagtgccttggatcgcaccatctttggatgatgtcgtcgcagaaacgacggaagggatgcatcttcttctccctcgccttgcttctctgcagcgcgtcaggaggcgtaccgtcgctggcttcagaaaactctccgtcagagttcgccaagatcgtccagtctaagcagacgaggcacgcccgcgtgtgcggggcggaccctcagctgctgagctcgctggcaggcagcggcgcggaggtcatgctcaccgtccccaacgagcagctggagcacgtggccgagttccaggaggaggccgacctctgggtggccgccagcgtggcgcggttcgtcccggcgaccaggatcacgcacgtcctggcgggcgacgacgcgccggcgcgctccccgcccagcgcccacttcctggtcccggcgatggccaacctccgctcggcgctcgccgccgcggggctcgccggccgcgtcagcgtgtccagcgcgctgtccgccgacacgctggccgccccggacccggaccggtcgggcgtcgtgggccgcgtcctccggtccctcgcgtcggccggctcgccgctggtcctcaagtcgtcaggcccgtcggaggccagcgacgccagggccgacgccgcgtacgccgccatgcgcgcgctgggggtctccggcgtccccgtcatcgcggcggacctcgcggccgccgccgccgacgtcgtgccgtactactactacggctacggctacgccgacggtcacagccacccgggcgtgcagcggcggtcgctggcgacgggcacgttctgcgtggcgctgcagaacgcggacccggcggcgctgcaggccgggctcagctgggcgtgcgggccgggccacgccgactgctccgccatccagccaggcggcgcctgctaccagcagaacaacctgccggcgctcgcgtcctatgcctacaacgactactaccagaggatggccagcaccggcgccacctgctccttcaacggcaccgccaccacgaccaccaacgacccaagttcaggatcttgcgttttcgcgggaagctccaactcgagcgtgccggtgggagcgagcccgccgaccagcctctcccctccgacgggcttcacgcctccagtcggctccagccccccgtcgtcgtcggagttcgggcccccagcggccggcaccaccccgccggctggaggcggccttggaccgggattcggcaccccgccgggctccttcaatggcaccgggtcgttcgggcccagcggcacgctcaacccttacaacggcgtgtcccgtgggttgccgcgcgcgggcttgttcacggctctgtccgccgctgcggtcgccgttcttctcgtgtccgtggatgccatgtgaattgtcgatgcagatatcatatatatatattatatgtggattacctctagtactagacattccttctcgagcccacatcatgttctttattgagctactggtcatgtagatagatctcaggtcggatctgtatcatatacgtataggagtcgtaactacgaagcgaatatgtatctgcacgtgatctgggacagttctgatgagcgtatgcatgtattacatgatgaattacacttttacatgtttggaatcagaaatgtaggacgcaaaaaaaaaaaaaaaa

SEQ ID NO: 1173 - DNA, 1815 bp, Zea mays
ctcgttcattccctcccggttcaggccctgtagtcctgtaccaagttttcgtaggcattcggatcgaggcaggctaggctttcgtttcgtttcgtccgggagaagcaagctaaaggaaggcgatcggatcggaggccatcgggaacggaacggaagaagcttcagctcgagagggccttcgactgcacgtattggggtgggaggatgttgcagaaacgatggaagggatgcatcttcttccttcttctctcaggcgcgttaggcgtactgatggcttcagaaaactccccgtcagagtttgccaagatcgttcagtctaagcagacgaggcaagctcggctgtgcggagcggaccctgagctactgagctccctggcgggcagcgacgcggaggtcatggtcaccatccccaacgagcagctggagcacgtggccgagttccaggaggaggccgacctctgggtcgccgccaacgtcgcgcggttcctcccgtcgaccaggatcacgcacgtcgtggcgggcgacgacgtgccggcgaactcccccggcagcgcccacttcctggtcccggcgatgctcaacctccggtcggcgctcgtcgccgcgggcctcggcggccgcgtcaaggtgtccagcgcgatgtccggcgaggcgctgtccgcgccggcgtggtccggcgtcgtgggccacgtcctgcgcttcctcgagtcggccggctcgccgctgctcctcaagtcgtcgtcgcgcccgtcggaagaagccagcgacgccagggtcggccgcgcgtacgccgcgatgcgcgcgctgggcgtctcgggcgtccccgtgatcgccgcggacctcgcggccggaggcgacgccgtcgtgccgtactactactacccgggcggtcacggtcggcggcggtcgctggcgacgacggggacgttctgcgtggcgctgcagaacgcggaccccgcggcgctgcaggccgggctcaactgggcgtgcgggccgggccacgccgactgctcggccatccagcctggcggcgcctgctaccagcagaacaacctgccggcgatcgcgtcctacgcctacaacgactactaccaggagatggccagcaccggcgccacctgctccttcaacggcaccgccaccaccaccaccaatgacccaagttcagggtcttgcgttttcgcgggaagctccacggcgggaggctcctccaactcgagcgtgccggtgggcgcaagcccgccgaccagcctctcccctccgacgggcttcacacctccagtcggctccagccccccgtcgtcgtcgtcgtcggagttcagccccccggcggtcggcaccgcccctttgtctggcttcacccccgccggacggaggcggcttcagcaccccgccgggttccttcaacggcaccgggacgttcgggccgagcggcacgctcagcccttacaacggcgggacccgtgggctgtctcgcgccggcttgagcttgacggccctgtccgccgctgcggtcgccgtgcttctcgcgtccattgatgcgatgtgaatcaaatcaaatcgatgcagagactagacaccccttttctcgcgccgcaacatgttcttagttgttgatctactggtcatgtcatgtagatgtcaggtcagatttgtacgtattatttaggtgccgtgaatgtgaaacgaatgtctctgtatgcgtgtgagttgggtgccgtagttctgatgagcgcatgtgaatatacgctatatgtatgtatgacacgacacaaaccttcagtacagtgatggattatatttttaccggtttgg

SEQ ID NO: 1174 - DNA, 2456 bp, Zea mays
ttattcatagaacaacgtctcctttccaagacaatcagcgaacgaaacgaaccctaagcaaatcgaggtcgaggggtggtccgatctcggtggctactgattatcggccgcccttcccgcgccgcggtctgcgctttggccggtcctgcggggccttgacatccgcccgggtccccgtcaaccatatcaactgaatatccaattcaaagggcggggagcgtacgtgtaccaccaccgtcttccggccgtccaccgtttccagcacacagggtaaaggcaagcaaacgagcggcgggacggctagcccgcaatacaaaatccggaggaactcccaggaggcgaaaagcagatccgtctcccccgaccggcgatcgctatcgacttgtagcggaagccatggcgtcggcagcgctaatctgcggcacggagcagtggaaggccctccaggcgcacgtcggcgcgattcagaagacgcacctgcgcgacctgatggccgacgccgaccgatgcaaggcaatgacggctgagtatgaagggatctttctggattactcgagacagcaggcgactggtgaaaccatggagaagctccttaaattggctgacgctgcgaagctcaaggagaagattgagaagatgtttaaaggtgaaaagataaatagcacggagaacaggtcagtgcttcatgtagctctgagggctccaagagatgcagtcataaacagtgatggggtgaatgtggtccctgaggtttggagtgttaaagataaaatcaagcagttttcagagacttttagaagtggatcatgggttggagcaactggaaaaccgttgacaaatgttgtgtcggttggaataggtggtagctttcttggccctctatttgtgcatactgcactccagaccgatccagaagcagcagaatgtgcaaaaggccggcaactgagattccttgcaaatgttgatccagttgacgttgcacgaagcattaaagatttggatccagaaaccactctggtggtggttgtatcaaagacattcacaacagctgaaacaatgttaaatgctcgaactcttaaggagtggatcgtttcttctcttgggccacaggctgttgccaaacatatgattgctgtcagcactaatcttaagcttgtgaaggagtttggaattgacccaaacaatgcttttgccttttgggactgggttggcggccgttatagtgtttgcagtgctgttggcgttctgccattatctcttcagtatggctttccaattgtccagaaatttttggagggagcttccagcatcgacaaccacttctactcatcttcatttgagaaaaatatacctgtacttcttggtttgctgagtgtgtggaatgtttcatttcttggttatccagctagggcaatattgccatattctcaggcacttgagaagttggcaccacatatacagcagcttagcatggagagtaacgggaagggtgtttccattgatggcgcccaactttcctttgagacaggtgaaattgattttggtgaacctggaactaatggccagcacagcttctatcaattaatccatcagggaagggttatcccttgcgactttattggtgttgttaaaagtcagcagcctgtttacttgaaaggggaaactgtgagtaatcatgatgagcttatgtccaatttctttgcccaacctgatgctcttgcttatggaaagactcctgaacagttgcacagtgagaaagttccagaaaatcttatccctcataagacttttaagggcaaccggccatcactaagtttgcttctgcctacactatccgcatatgaggttggacagcttttatccatctatgagcaccggattgcagttcagggcttcatatggggaattaactcatttgaccagtggggagtggagctagggaagtcactcgcttctcaagtgaggaaacagctgcatggaacccggatggaaggaaagcctgttgagggttttaaccacagcacttcaagtttgcttgcacgatatcttgctgtcaagccatccaccccgtatgatactaccgtgctgccgaaggtgtaattactcagttgtttttgacatgccaattgctgagttctgacttggcaaggttgagcataagtctttcttcattttgggagttatcacagagccagtttggcagtgctgtagttttggttttacctactctttgtagaagaaaagtgaagagtggatattatggaacaaaatatatacctacggcagcacgcagcatgatgaaacatatttaaaaaatttgggtgctctaccacatgcccgtggaataaaacggatgtaaactcagtgcacttataacaccctaattgtggttttgtttgtggttcaaaaaaaaaaaaaaaaaaaaaaaaaataaaaggggggaccaaaaaaaaaaa

SEQ ID NO: 1175 - DNA, 2202 bp, Zea mays
gcacgagggttaacccgtcccccaatcccccccccccccctcaatctttttgctctctcggtttggtgtgcaccgcgtcacgccgatcctcagcctgttggttaccatagctcgatcgggaggttgcttggacttgtagcggaagccatggcgtcggcagcgctaatctgcggcacggagcagtggaaggccctccaggcgcacgtcggcgcgattcagaagacgcacctgcgcgacctgatggccgacgccgaccgatgcaaggcaatgacggctgagtatgaagggatctttctggattactcgagacagcaggcgactggtgaaaccatggagaagctccttaaattggctgacgctgcgaagctcaaggagaagattgagaagatgtttaaaggtgaaaagataaatagcacggagaacaggtcagtgcttcatgtagctctgagggctccaagagatgcagtcataaacagtgatggggtgaatgtggtccctgaggtttggagtgttaaagataaaatcaagcagttttcagagacttttagaagtggatcatgggttggagcaactggaaaaccgttgacaaatgttgtgtcggttggaataggtggtagctttcttggccctctatttgtgcatactgcactccagaccgatccagaagcagcagaatgtgcaaaaggccggcaactgagattccttgcaaatgttgatccagttgacgttgcacgaagcattaaagatttggatcccgaaaccactctggtggtggttgtatcaaagacattcacaacagctgaaacaatgttaaatgctcgaactcttaaggagtggatcgtttcttctcttgggccacaggctgttgccaaacatatgattgctgtcagcactaatcttaagcttgtgaaggagtttggaattgacccaaacaatgcttttgccttttgggactgggttggcggccgttatagtgtttgcagtgctgttggcgttctgccattatctcttcagtatggctttccaattgtccagaaatttttggagggagcttccagtatcgacaaccacttctactcatcttcatttgagaaaaatatacctgtacttcttggtttgctgagtgtgtggaatgtttcatttcttggttatccagctagggcaatattgccatattctcaggcacttgagaagttggcaccacatatacagcagcttagcatggagagtaacgggaagggtgtttccattgatggcgcccaactttcctttgagacaggtgaaattgattttggtgaacctggaactaatggccagcacagcttctatcaattaatccatcagggaagggttatcccttgcgactttattggtgttgttaaaagtcagcagcctgtttacttgaaaggggaaactgtgagtaatcatgatgagcttatgtccaatttctttgcccaacctgatgctcttgcttatggaaagactcctgaacagttgcacagtgagaaagttccagaaaatcttatccctcataagacttttaagggcaaccggccatcactaagtttgcttctgcctacactatctgcatatgaggttggacagcttttatccatctatgagcaccggattgcagttcagggcttcatatggggaattaactcatttgaccagtggggagtggagctagggaagtcactcgcttctcaagtgaggaaacagctgcatggaacccggatggaaggaaagcctgttgagggttttaaccacagcacttcaagtttgcttgcacgatatcttgctgtcaagccatccaccccgtatgatactaccgtgctgccgaaggtgtaattactcagttgtttttgacatgccaattgctgagctctgacttggcaaggttgagcataagtctttcttcattttgggagttatcacagagccagtttggcagtgctgtagttttggttttacctactctttctagaagaaaagtgaagggtggatattatggaacagaatatatacctacggcagcacgcagcatgatgaaacatatttaaaaaagttgggtgctctaccacatgcccgtggaataaaacggatgtaaactcagtgcacttataacaccctaattgtggttttgtttgtagttggatagcattatgcatgctgccgctgccgtgatttatgtgcttttac

SEQ ID NO: 1176 - DNA, 2905 bp, Zea mays
gtttttccttctctttccgcttccgccgaggccactctctttctctctctgcgcctgcgcctttctcttctccttctccttctccctcctctcaaccccaacaatctctgtctctccatctcctctcgacaaggcggcctcaacaaagtcccaccgcacctttctttaatggagcgagggtgagcctaacaagcactatcgacacacaggaggaggtgctgcccgcttctcccctccctcagtctcactcgctccgctctcctccccgagaccaggaggccaagccaagaaccgcaaaccctcaggccgtggccatggcgcaaggagcaggacgggacccggaggagctcttcgaggagctgtggcgcgcctgcgcggggccgctcgtggagttgccccagaccaacgaaagggtcttctacttcctccagggtcacctagaacagctgcaagagccgacggacccggcgctgctggctgagcagatcaagatgttccaggtgcccaacaagatcctctgcaaggtcgtcaacgtcgagctcaaggccgagacagaaacggacgagatgtacgcccagatcactctgcagccggaaccagatcaagtggatctaccccaattacctgaaccgcccctgcaggagacgtcaaggcccgtggtgcactccttctgcaagatcctcacaccatccgacaccagtactcatggcggtttctccgttcttcggcgtcatgcaaacgaatgcctcccagcactggatatgtcgatgccgaccccgacccaagagctcatcacaaaggacctacatggatctgaatggaggttcaagcacatatacaggggccaaccccgtcggcaccttctgactactggatggagcacgtttgtcacatcaaagaagctgattgctggtgacgcgtttgtctacctgaggagcgagaccggacagcagcgtgtgggagtgaggcgcctcgtgcagaagcaaagcacaatgccagcatctgttatatcaagccaaagcatgcatcttggggtgcttgcaagtgcatcacacgctattaggactcattccattttcctagtgtattatagaccaaggttaagccaaagccaatacatcgtcaggctgaacaagtacctggaatctagtaaaattggattcgatgtgggcatgaggtttaagatgagttttgaaggggatgacgtccctataaagaagttttctggaacagttgtcgataaaggagatctttctccacaatggcaaggttctgaatggaagacattgaaggtcaaatgggacgaagccacaaacttaaatggccctgagagggtttcctcctgggaaattgaaccgttcgatgcatccgcacctgccatcaccatgcccgtgcaaccagcaatgaaaaacaaaaggcctagggagacacctgaaggcctggatattcatgcactggaacctgctcaagaattctggctctctggaaggcctgaacagcatgagaagacaagcgtaagctccagcgaacccaaacatcaagtcgcttggacaagtgaacgcgcaggatacagtgccatgagcagttcaatctgtcagaattctgcagtaactgggagctggttcaagggcttcaattcctccggctcccacccttccctgccagagatctcccagaaactgtttcaggtcaccagcaacgacgcgagggttccctccttggcctgggctctccgcttatcatgctgacgagccctcttccaagctgtcctgcaacactgctctgtgcagctaccagaccgaggaggtggctccaagattttccaatgccgtcgaagaggaaaagaaggagcccggcatgttccgtctgtttggcgtcaatttgattaaccctcctgggagtagtgctaccgctgacaaggcgagtgtgggagcaggggaagcatcggcgcgagctgctggttcttttgaagactctgctcagctatcaagagtgacgaaggatcatacgcacatggtgaacggaagcccccgagaaatccaaagccatcagagttgcagtggaaggagtcgtatcaaggttcaaatgcatggaaatgacgtgtgcagagctgtggatttgggaaatctggatgggtacgagcagctgatgggtgaggttggagtgatgtttgagatcaaagaccttggctccaaagagaaagaggaatggaaggttactttcactaacgacgagaatgagacaatggaagtcggagctgttccttggcaggagttttgccagatggtgaggaagatcgtgatccattccattggagacaggggccatatggaggcttgcccttgcctggggcaggatgggaagagggactattagaagaagggatttttttttttggctggggcaggcaggagatggttgctgctgaaacatgatggcgtagcttgtcgatgacgaagaaggcaacagattggttgctggcgtcagttcttccttgagaaaaaaattcagtggaaggaagaagtgatgtaacataggatttgcagaaaagatttgataatgcgtcttttagaagtttggtttggtttaaagatgacaagttaatgtgtgtctagtgatctgcctaaagccttagcgacgggcaacaagcaataacaaggatggatgatgaccttaccttgggtatgttagctgtgtaaatattatgtatgtatgtatgggacattaaattggttggcatacttgactcatgatttatattgtacgtagtgtgttgcagtgctctggattcagttgtgatgtaccactattacaagtagtagaaggaatctggtttttagtccaagaatcaacatcatatatgtcaatcacaggcacactagtgcgtaattttagtctttttctg

SEQ ID NO: 1177 - DNA, 636 bp, Zea mays
tcactagcccccccccccccccccccccgcgccggcggcccgcgctcgcggcgccggcgatgggggaggtggccgcgctgcgccagctcgtcggccaggttcaggagctctgggacctctacggcgccaacgcccaccccctgcccaggtggtatttacttgactttgaacatggttcaatcatggatgattattgtggaggaaggtctggatacaactcagaattactgaagatcatggaagctaaccaatctccccctcgcaagcgaccgcggagagatcgaaaccgtgaaaaggcaccctcctcaaacaagactgaagtattgcaacaagagatctggagagatttccctgaagatctttttgaaactgtcattgcaaggcttccagttgctgcaatttttcgattccgcactgtctgccgaaaggggtcttctcttttgggctcagacaggttctctcatcagtactctgaagctccacgtgggctgccatggttctatacaatcacccatgagaacgcgaacaacaatgttgcaatgtatgatccttcgctgaagaaaggcaccacccatccgttcctctcactcctacaaagatagttattccagtggcatctgtgggtggccttgtatg

SEQ ID NO: 1178 - DNA, 1837 bp, Zea mays
aattcggcacgagggcggcctcacgccgtcacctgcttcgctgccctcccgtcgcccgagcccattgcgtgggggcgaccggaaggcccgaccccgacccggaagacgaggtagaggagggggcgagcgacagaggcagtggaggggcgcggtgaggaggccggcggcgcgcgcgcgcttgcggcgccggcggcctggcgatgggggaggtggccgcgctgcgccagctcgtcggccaggtccaggagctctgggacctctacggcgccaacggcaaccccgtccccaggtggtatttacctgacttcgaacatggttcaatcaaggatgattattgtgggggaagctcaggatacaactcggaattactgaagatcatggaaactaaccaatctcccccttgcaagcgaccgcggagagatcgaaaccgtgaaaaggcaccctcctcaaacaaaattgaagtcatggaacaagagatatggagagatttccctgaagatcttttcgaaactgtcatagcaaggcttcctgttgctgcaatttttcgattccgcactgtctgccgaaggtggtcttcccttttgggctcagacagtttctctcgtcagtactctgaagctccacatggactgccatggttctatacaatcactcatgagaattcaaacaacaatgttgcgatgtatgatcctttgctgaagaaatggcaccaccaatctgttcctctcaatcatacgaagatagttattccagtggcatccgtgggtggccttgtatgtttattggatctgagccacaggaatttttacatctgcaaccctcttacgcaatcactgaaggagatcccaccaagatcagtccatggttggtcaagagtcgttgtagggatggtgttgaatggaagaagttctagtgatggctacaaagtaatgtggttagatattgatgggacttgcgaagtttatgactctacaaagaacgtgtggtcttgccctggaacttttcctccaagcatcaaacttccacttgctctaaatttgaggtcacaaccagtggcggttggcagcatgatatacttcatgtgcgcagaaccagatggtgttttgtcatatgatgtaagcaccgggatttggaggcaatttgccatcccactgccactgcatctgactgatcacacacttgccgagttccagggaagggttatgctggtgggtctgctgtgcaaaaatgcagcgacctgcatctgcatatgggagttgcagaagatgactctcctctggaaggaggtggacagaatgccaaatctctggtgcttagagttctacggtaagcacatgaagatgaaatgcctgggcaacagtggtttgctcatgctctccttgaaggcgaagcatatgaaccgccttgttacatacaaccttttgaaaagggagtggcagaaggttcctgattgcatgctaccatggagtcgaaaaaggcaatggataacatgtggcacagcatttgatccggtcccctgcgccttggtctgacatggaattttaccttctttgtctgagcactataatattttagtcctttcatatcattggcctatctttagatctttctatgttgttgtgacaagttctgcgaaaacgcattactgtggtttgctttgtataacgccgccgaaacaatcgaacggtttcctttatcacctgctgttctgttaagcttgtaatctttctgaacgtgcagttacctgcccagagctgagttcattatacaataaataccgggatgttaatgttaaaaaaaaaaaaaaaaaaaagcttgtgtgggcggccgctcgacg

SEQ ID NO: 1179 - DNA, 3828 bp, Zea mays
aaggaatatactctcagcttcgatttacctcacattcacatataatccatgccatttgagcttctgtttcccttcacaataatataatggattatcctctgtatactaactctaatctgctgggaaacatatgattggcattgttactggtatactccagtcacgtggtcgacaagagggcatctctgattgtgcggcaaataatataaatatcatatctacgctttagataggaatggtgaatgttggtgggaaaatggatgacaagattgataggtgtgtagctccatgtacaacaacgtgaatgaattgtgcattgggtcaagtgtcaaattgttgacttgatgctttcatacttatatatgcattttttgtccaaaacaatgcttccaatggtaaacaactaaactggggggggggggttatatattgtattatgctttctcttttgcagtaaaaaggaatcttgttcataccctgtccagaatagtcttcacttaaataagattcactaaatgggtttatcaatatcttacaggtggtatttacttgactttgaacatggttcaatcatggatgattattgtggaggaaggtctggatacaactcagaattactgaagatcatggaagctaaccaatctccccctcgcaagcgaccgcggagagatcgaaaccgtgaaaaggcaccctcctcaaacaagactgaagtattgcaacaagagatctggagagattttcctgaagatctttttgaaactgtcattgcaaggcttccagttgctgcaatttttcgattccgcactgtctgccgaaagtggtcttctcttttgggctcagacagtttctctcatcagtactctgaagctccacgtgggctgccatggttctatacaatcacccatgagaacgcgaacaacaatgttgcaatgtatgatccttcgctgaagaaatggcaccacccatccgttcctctcactcctacaaagatagttattccagtggcatctgtgggtggccttgtatgtttattggatctgagccacaagaatttctacatttgcaaccctcttatgcaatcactcaaggagatcccaccaagatcagtccagggatggtcaagagtcgctgtagggatggtgttgaatggaagaagttctagtgatggctacaaagttatgtggtttggaaatgatgggacttttgaagtctatgactctacaaagaacatgtggtctcgccctggaacttttcctccaagcatcaaacttccacttgctctaaatttcaggtcacagcctgtggcggttggcagcacggtatacttcatgtgtgcagaaccagatggtgttttgtcatatgatgtaagcactgggatttggaggcaatttgccatcccactgccaccgcatctgaccgaccacacacttgccgagttccagggaagggttatgctggtgggtctgctgtgcaaaaatgcagcgacctgtgtctgcatttgggagttgcagaagatgactctcctctggaaggaggtggacagaatgccaaatatctggtgcttagagttctacggtaagcacatgaagatgacatgcctgggcaacagtggtttgctcatgctctccttgaaggcgaagcgtatgaaccgccttgttacatacaaccttctgaaaagggagtggcaaaaggttcctgattgcgtgctaccatacagccgcaaaaagcaatggatagcgtgtggcacagcatttgatccggtcccctgcgccttggcctgacatggaatttaccttctttgcccgagtaccataatactatagtgaattcgtatcattggcctatatttttagatctttctaatgttatgatgagctctgcaaaaccgcgttcactgtggtttgttttctatcacgctgacgcatttgaaccgtttcctttgatcacctgctgctacttgggtcactgctacatcaattgggcaagtcgacctgaatatgtttcattgaagtaaaaaacggaacgccaggtgtctgtatttggtcttggttttggtatgtaccgtcaacttgtaatctttctgaacttgcagtttcctgtccagaaccgagtttattatacaataaagaccgggatgttgacgttttgaatcggctgcatggagaggctccttcgtcctattaccatgaaaacacatgtacatgtacttctgtttcaggctgcctactatttatcaatttatgtgcctacttttgatgcctgaactatttgcttcaacttcgtatgattttaggcattctgaaacctacactagctcttccaggcattctgagatctacactagctcccgtgtcgaagtttaggtttcttatctatggtatcttaggatgcatatggtcgttttttttattacaaatgacacaaaatgaagtttaaaataggagatgagataagtaaggctgctagagatagcttgttatttattgagtgaaatttaaaataggagatgtgacgtggaagactgctggagatagtcttatatgtaatgtagatgcaacaaaatataggtatcatgcaaaaagatgcaacaaaatacaggtatcatgcaaaaaaacggacattgcaaaaaaaaaaaaaaagagtggctaatgtccagatctcttgtatcagcatcacgcagaaaaacagatatcgtcaggcatcttagaacacaaccacaagcagaaaaccaggcatcgacacacagggaagacaccctcggcaaacacaacttcactgcctgccgattctcatgaaactgccatttgcaaggcgtccagtactccagttcactgcctgccgaaagtggtctggtcttcggatttgggctcggacagtttccctcgtcagtactctgaagcccaacccgctcctggagcacagcacatgacagagatttcattcagaacaaaacgtactggtacactgggggatggttctataacatctcataggaggcaacctcaagtagtcaagtgccttgcagtttctatcacatcccttctctccgcctttcaaatcgacactgaagatgcctcgacagatggatcaccagattaagtgatcaactacacgaatgatggcgaattattgttacaaatgtacaaacatagcttaggccgttccagactagcagagataccacctctccagcattgtagtaccaacacgatcagttcagcagtgagaatgggaggtctctcatctgcacaagttactatgagcattcatcatattaatttgtttgagatcgcagcaggaaaatttgaatccatcaaccatccagaaagtgtaagtacttgaatacaagctgggtccaaaaaaaaaacctaaacatggtttctaacctgtggtacccattcttcagaacagccaatccgatcctctgatttgttcttttctcataacgagagaatgcctcgctcgtcatcggcatgccttttcttcttatctttcttaccagacgcttcggtttgcactgcaacatcctcaccatccgcgtcagatttcttctttttcttcttctttctcaccttctgaggcagccacagcaggctcctcgccctccttggacttctttttccttttcttctcaccatcagcttcagcagcaggactctcgtcgctttccttggacttctttttcttcttcttccgatcctcctgaccgccatcctcttcaggctctgctgatggtgcaaattcggcctcatgatgtttcctcttctttgaaagccaattctgacttgtttggtatttcttcggtggattgtccaagcaccagatcag

SEQ ID NO: 1180 - DNA, 1667 bp, Zea mays
cattgggtacctcgaggccggccgggacagttcgcctccctctcacaggtcacaggctcacagcacactgccactccgaaaccccaagcgccaccaggaccaggcagcctcctccgtcctctcttctccccgcgccgccgcggccatgctcctctccgggcctccgccggtgcccaccccgccgctgctcctcccggagagcagtggcgaggacggcggccacgattcctcctcccgcgccgcggcagcggtgggatcggcgccaaagaggcgcgcagagacatgggtccgtgaggagaccctttgcctcatcgcgctgcgccgggaaatggacgcccacttcaacacctccaacaagcacctatgggaggccatctccgcccggatgcgggaccaagggttcgaccgctccccgaccatgtgcaccgacaagtggcgcaacctgctcaaggagttcaagaaggcgcgcagccactctcggaacagcggcggcggctctggctctggagggaacggcaacgccaagatggcgtactacaaggagatcgacgacctgctcaagcgccgcggaaaggctacgggaagcggcaccgccggctgcgttggcagtagtgccgggaagagccccaaatcaaattgcaagattgattcctacctgcagttcaccacagataacggctttgaggatgctaacattccctttggtcctgtggaagcaaatggtagaacgatactgagcattgatgatcgtttggaggatgacaggcatcagcttcccttgacggctgctgatgcagttgcaaccaatggtgtgaacccgtggaattggagagacacctctactgatggtggagataaccgtggcaattttggtgggagagtcattttagtgaagtggggtgattacactaaaaggattggaattgatggtactcctgaagcaattaaggaagccatcaaatcggcatttggactaagaacaaggcgcgctttctggcttgaagatgaagatgaggttgttcgaaccttggacagagacatgccagttggaacatacacacttaatcttgatgatgggatgacaatcaaactctgtgatgcaagccgcatgcagacgccagaagacaagacattttacactgaagaggactttcgagatttcctgtctcggcgtggctggacatttctcagggagtatggaggctatagaaacgttgatagccttgatgatctccggcctggtgtgatgtatcaggggctgcggtcgcttggtgattgattttgcaacatctactttggccagacatgtcgaagtggaattgctagcagtgccatttagtgtaaatttaagtaaggccatccagattccagatatatgagcggtcctctcgcatttgtggagcaaaacttgcctccacttatcttttcttcagatcacactcatgtcggagcctctgcgactactatgcaggttgaggcttatgtaaatgtagccgcgtagctaatgatactggtaatgtaaaatgtgcaattggagtgtgcagctaatgatcctccagataactagcttgttctaccattccttgtaaaaatgtggaatgatcctccagctaatgtaaaatgaggcaagtgaaacaaatgtgtaccctgcaaaaaaaaaaaaaaaa

SEQ ID NO: 1181 - DNA, 2486 bp, Zea mays
  misc_feature (90)..(90): n is a, c, g, or t
  misc_feature (137)..(137): n is a, c, g, or t
tccagcagcagccgggaggcccccgccaacggcgcagagcgcgcagcgaaggtgccgcctctatcgcccctcttccttcacccgctcctngatttgccatcctatcgcttcgcagccatacaattcttacacgtatnccccgtgaatcgcggtcgctcgctaggaccgaccgtttccctccaattcgcgagcgaccatctcgttctgaccccgaatgtcgcttcctcctctcttccaggaaaacgccccgtgctccacctcgcagccaggcctgtgccaccacgcgtcgtccgcgcgccacggcggccggagcgacgaggccacctcgtcccggagcggcggccgggtcctcgcctcccgccacaggaagagatcgccctcggatttcttcagctctgatgggtcgccgcagcccgggaatggcacaccggcggcgaggaattgctccgacgccggcattgccaggaatgagtgagtctgcaaccccacccccccttcatctgaaatttccatggcatatttaacaactgcaagtgccattcactgtactacatagacggaaaaagtttctgctagcgaacatggacgcaattatgcatccttcctaactagcatggtgtcaagtatcccctgaataaataaataaataaatatggtagatcatcaatctctttcgaataactcgcgatagcattgccagggaagaatttaacaaaaaacaattgtaaggtgagcgaactgatatagaagttgtaaaaggttgatagctactagtgggttttacgggcacgaggtctctaccggtaaacataaaaggggggatggctgcatcataacgagaaagccttgatttcttgccgagagccattatatgatgctgccctggagtgctccgcaatcccagtaacgctgtagctgatggtagggtagcaaacatgctttttagattatgaaaaacattacatttccacctttttttctggtctatttcgtgtgggtgtgtaggtgggtatgcgagattgtgaggcgccaagtggcaatctgtgtcgattattgcactcgaatgcttaccttctgttggagagaagttgttcatgtctagcagttgagccttggaactaaattttgttgtttctaggatcaactctgactggtaacttgtataggttggaacaccatttggtgaattttggcagcaactcggcatgagtcttgcttcatggttatgatcaaagttctcatggtagattgttcctgttctgttattgcagctttacctgaggcaggcaacctgcgatgactggtgtagatgctgatgctaacattagaaggccagcttttagtgcatccaagctccggggaagatgcggatcacgacggcacggcgagatcagttcccaccgaggcatacatctttcttcgatcatcagttcgtcttcggtcctcaagcaaccttgcacgccgcagagtttaccagagcagcagtcctagaaccatagtagtgttcctaaacgtcgatggcttcgctgagattgtatatgtccccattacttcgttgtgttcgattccgtcctcttctgcttgttttctaaccttagagaaacggtatagggcaggctcgcagttgcaccggcattgttcgatggcctcactgtctgctttcttgaattgtgccctgagtggctgagccctagtttcttgtttcttgacagttctttcggtgagatttattgtctatggttgcagtggcagctgaagcatgcggcactgtcgtcgctgctcacctggcaaatacatacaatctgggcaagttgcaacatggcgaagatggatctggaattgttaatcgcccctttgggcgggcgtggggttattagcatattgttcgtgtatggatgcccagtgatcttgtcagatgggtgttcttagacgggggggaaatatcctgcctggtagggggaacgcggaagtaacgtcatttgaaaatgtgcaggctggtctataggtcagtgacagcaacgtactggttttgatgctgccatggtcacggatgtacgtacgcttgctgctgctcgcaggcccggtcgctgtcgacatcatctcgccacaaagaattgaacctgaaaatgaaagcaggggtttgcttttgtgatgtgaaagaaccgaagcgtttctattgtattctgctggcgtttcgcatggaagcaccgtgcaaacaactgagtggccagtctctgcactgcacagtgcacgggccccaatacattttggttactgaatttaatccaaagcttcttgcttaaactaatgttactacacattccgtggaggattttggaatcactctaaaatatgggcaaggcttcgcatttgttttcgtctttatctctactattctatatgaatgtattgtaggcgcccacagcaccactcttctgccgccgcgatcgtcctctcgcacgcgctgccccaaacccgccccgcca

SEQ ID NO: 1182 - DNA, 2307 bp, Zea mays
tttgacaaaccagctttgactgctccatccaggcaggcaacattgctggtttctcgagaaaccgagatgctgagcaatcttgtggaccaatgtgcacaacagagtttagtgtcagcacaacctttgcaggatgagtcggaacaagcagatttgtctagttcagcatcaactcaacccttgcaatctgagaggcaacaattaatctctgtttccaataggcggcttgaaagagcacggcttgatcagagtcaaccaaattatcagacagatgcggcacctggttgtgcgcagtctgcagaactctttccagtgacgtcaatgatgtttaatcacgcacctattgattctgaaccactgaaaaatgagttgcacaaattacgattacacatggacacactcaataaagtccatgaaatgaagaaaacccaacttcagaccgcatgtagccaagaactagagaaggtaaagagaaaatatgatttgttaattaaagaacatgattccactcatcttcagcaaaagaaggcacttggtgatttttatgagaaagttcagcgcaaccaatcgctggctgaggattttcgggccaaattcatatcactgtctgcagcacaaggtgcagcaaaaggccatacccctccagttcgtcacacacctcaggctacccaagtggtgtcctccacatcatcaattgccctgtcatcagcttgtcgaccaccagtgccgaggcctagggttcaagctccacaggtggaccaaccattattgtcattgtcgcagttctcccgtccgtctttgcaagtggtccaacctcccaacctggaactaggcaatcttttcagagcaacgtcaacgactcttagtcatatgccacctcaacgtgggagctatggagttcagagtgaattggctcctcgctcacctgctcctcatcttcagttcagatcgccacgggcacattccatggcacctggaaatcagcagcaatcgccagcaattagtgtggatgcaatgtcctcaaggacacaaccagtgctggcggcaagcacatccccatcagatatacatgtgggacccctagcagcctcagccttgtcaagtttacactctgttctcccttcaacctcattaccctcaagcttgcatcctagtcacctggcacaacgtgtgccaccaactcctaacccaactttacaagccggggcaccgaaaggctcgaatgcaacaatgccttccatccctacaggcatgcagctgccagattctggttccctatcgctggatgcatggcttacagctaatcttgggttgaatgatgcgtctacagctcctgctaaggatacagccagtcttgggttgagcagtgatgcccctagggcagctcctgatacaaatacggccagtcttgggttgagcagtgatgtgcctaggggtacggctcctgctacaaatacagccagtcttgggttgagcagtgatgtgcctaggggaacgactcctgctacaactacaaccagtcttgggttgatcagtgattcacctagggtgattgctcctgccagcagtaattcgcctggggcgattgcttctgctacaaatggtggttccgagatagatgtggtatgcctgtcagatgatgaatgatgctagcacgtgtacaaggctgacagttatagatgactgcttgaaaggactaggcattattttacggctcccttgagtccgttctgacaaggtgggaatgttgtttgtgctgtgaatggctggtaacagcaatgacagttttattaagttcattgtaaatgtgtattatgacaaatgcctgccaacgtttgctgtaaatcgctaacctctggggaatgtggatattaacctctgagatggagttgggtttcaagcgctatgaggtttctgtacatgtttgtcattgattagttccctgaggtgttcgttgtaggccggagtgctagctccgtgtatcgttttggttctacgtatgtttcttttttttagtttgacttaaaaaaacagtagcaacaaaaaacagtagcaacatctccatgatagttattatgtataataaatgctgaaattttcttgtatatatttgattgaaacggcgggagtatgtaacagagcaatttagaccaaggcggtcacttcaacgttgtattgtatttctcttcttggtgaaatacggcagcgctgtcctatgttaagttttatatctatatagctagctatctatgtatctgtaaaaaaaaaaaaaaaaaagggcggcgctcgcgactaggttctagatcgcga

SEQ ID NO: 1183 - DNA, 1956 bp, Zea mays
ctcgaggccggccgggccaaaaatccatatgctcagctcccgcctcctcccatccccggaccccggaccccggccatgggcgcttgcttctcctccgcctctgccgcccccgccggcgccgccgtcgacgagcgccgcccgtccaaggagggcgacggcaagaagaggcgccgcgccgccggggcatcgccggatgccgcggcgcccgtgcgcgtggagttcggctacgagagggacttcgaggcgcgctacgaggtcggccgcctgctcggccacggccagttcggctacaccttcgccgccaccgaccgcggctctggggaccgcgttgccgtcaagcgcatcgacaaggccaagatgacccgccctgttgctgtggaggatgtgaaaagagaagtgaagattcttaaagcacttaaaggacatcagaatattgttcacttctacaatgcatttgaggatgattcatacgtgtacattgtgatggagctatgtgagggcggtgaactattagatcggattttggcaaaaaagaatagccgctatagtgagaaagatgctgcagtggtagtccgccaaatgctcaaagtagctgctgaatgccatctgcgtgggttagttcaccgagatatgaagcctgagaacttccttttcaaatcgaacaaggaggattcaccactaaaggcgacagattttggtttgtcagatttcattaagccagggaagaagttccatgacattgttggaagtgcttactatgtcgcaccagaagtactaaaacgacggtctggtcctgagtcagatgtttggagcataggagtcataacctacattttgctctgtgggaggcgccctttttgggataagaccgaagacggtatattcaaggaggttctaaggaacaagcctgattttcgtaagaggccttggtcaagcatcagcccaggtgctaaagattttgttaaaaggttactagtgaagaatccaagggccaggctaacagctgctcaagctctctcacatccgtgggtaagagaaggaggggaagcatccgatatccccgtcgacatatctgtgttatcaaacatgcgtcagtttgtcaagtacagccgtttcaagcaattcgcgcttcgggctctggcgagcacccttaacgaggaagagctatcagatctgaaggatcagtttgatgcaattgatatcgataaaagtggatcgattagtatcgaggaaatgcgtcatgcccttgcaaaggatcttccctggagattgaagggtccccgtgtgctggagattattcaagcaattgacagcaacactgatgggctcgtggacttcaaggagtttgttgcggcaactctccatatccaccagatggcggagctcgactcagaaaggtggggcatacgctgccaagctgctttcagtaagtttgatcttgacggtgatggatatatcacgccggaggaactcagaatggtgcagcacactgggttgaagggatctatcgagccgctgctggaggaggccgacatcgacaaagacggcaagataagcctgtccgagttccgcaagctcctacggacagcgagcatgagcaacgtacccagcccaagggggcccccaaaccctcaggctctgtgaattccggctcggccactagggaggagcaagcttaggaagttgccatacaatagccatgtgttctttgggttcttcagagtgccatgtgatgtttctggtttttagcatccaggttatgtgtgcagtgcagccccgagtgagtttcgaagtaaatattcagtgctttctttttctttccggaagagtgagaggtggaggtcaaaatggtaggcaagactcgccttcttctttcctttacactgtacagtgatactgaaatatgtacgatttttattataactgttcgtcgcaataaagttatttggagaagtg

SEQ ID NO: 1184 - DNA, 2208 bp, Zea mays
cggtaagactgtacctattttccttcccagaacttccttttttttttgttttaggaggattcaccactaaaggcgacggattggggtttgtcagatttcattaagccagggaagaagttccatgacattgttggaagtgcttactatgtcccaccagaagtactaaaacgacggtctggtcctgagtcagatgtttggagcataggagtcataacctacattttgctctgtgggaggcgccctttttgggataagaccgaagacggtatattcaaggaggttctaaggaacaagcctgattttcgtaagaggccttggtcaagcatcagcccaggtgctaaagatttaaggccggttaaaaggttactagtgaagaatccaagggccaggctaacagctgctcaagctctctcacatccgtgggtaagagaaggaggggaagcatccgatatccccgtcgacatatctgtgttatcaaacatgcgtcagtttgtcaagtacagcccgttcaagcaattcgcgcttcgggctctggcgagcacccttaacgaggaagagctatcagatctggaggatcagtttgatgcaattgatatcgataaaagtggatcgattagtatcgaggaaatgcgtcatgcccttgcaaaggatcttccctggagattgaagggtccccgtgtgctggagattattcaagcaattgacagcaacactgatgggctcgtggacttcaaggagtttgttgcggcaactctccatatccaccagatggcggagctcgactcagaaaggtggggcatacgctgccaagctgctttcagtaagtttgatcttgacggtgatggatatatcacgccggaggaactcagaatgcacactgggtcgaagggatctatcgagccgctgctggaggaggccgacatcgacaaagacggcaagataagcctgtccgagttccgcaagctcctacggacagcgagcatgagcaacgttcccagcccaaggggccccccaaaccctcaggctctgtgaattccggctcggccactagggaggagcaagcttaggaagttgccatacaatagccatgtgttctttgggttcttcagagtgccatgtgatgtttctggtttttagcgtccaggttatgtgtgcagtgcagccccgagtgagtttcgaaagtaaatattcagtgctttctttttctttccggagcaccggaaggcggggatacgcgcacgctcgtccttgctttctccgtgctcggcttccaggtcctcccagcgctcagatctcatagcctcctccatcagcctgttctccacgcggcaccagacgcacgattcgtctctgcttccctcgtcggccaagctctctctcccgctgccttctctgtgccgcctcctcgccatgctgtgcgctgccagccgcgccggtgagctcgcccaggtccggcgacctgctccggctcgactttgtccacgtctgcatcttgcccaactctgctactcctgactcgccggcgacctgcagctcggacttcagcatcggccttttgtgtgctccgctgcgccagatcgccgtgttaccgtggagctacatgccttgcccttcgctgtcgttgtagcggagtcgtcatcgcccaagtgctgagcgccctgaactcgctaccgttctgcagccccgccgtcgactccctgctcgtctcgctactttgtcatcattcactatccccgtcctcgacgtctacctcgccgctcctcgtgtctagcaagccgtcacgtttggcgggtttcctctatgcggcctcacgcgttcctctcgcttcattcacatgtcgtgtggtagagcaggtatggttatttgattcgatgtatgtgtggatgcggaataaatttcaagagaaataggttcttgtgtgattgtggtcggctgttgttagcgccatcgttcgatattttatgtttgtgtatggtagatcggcgaagaaagaaactagtttgtgtaaaaaaaatgaagtttctggcgattttcgcctgatgcttggtgtgttaccggagtcggtttcgtcactagctatcttggcgaactttcactcaacttcggaattacgtaggcttagatacgctcactgaagcgtattcatttggtcatcaaatatttgcttacttataaatacttttaccgtaggaaaaaaaaaaaaaaaaa

SEQ ID NO: 1185 - DNA, 1448 bp, Zea mays
  misc_feature (782)..(783): n is a, c, g, or t
  misc_feature (793)..(793): n is a, c, g, or t
  misc_feature (931)..(931): n is a, c, g, or t
  misc_feature (952)..(952): n is a, c, g, or t
  misc_feature (1246)..(1246): n is a, c, g, or t
gcacgagaccattacctagaacatcctaatcgaaaaatagtattcgacaggctcacaagtcacaattccagctcaggccaccagcaagcacatcgcaaaggagaacagaacagaacagagagccatggcggcggtcgccgtgagcggggggcactggaggaggctgcggacgctggggcgcggcgcgtcgggcgccgtggtgtcgctggcgtgggacgccgcgtcgggggagctggtcgcggtcaagtcggccggcgcgatcggcgcggcggcgctgaggcgggagcacgcggtgctggccgggctgcgctcgccgcacgtcgtgcgctgcgtcggcggcggcgatgcggcggaggaggggtcgtcgtaccagctcttcctcgagtacgcccccggcgggtcgctcgccgacgaggtggcccggagcgggggctccctcggggagcgcgccgtccgcgcgttcgccgccgacgtgctgcgggggctggcgtacctccacgcccgctccgtcgtgcacggcgacgtcaaggcgcggaacgtgctggtcggcgccggcggccgcgccatgctcgccgacttcgggtgcgccagggcgctgtccggctccggctccgcgcgccggccgatcgtcggcgccacgccggcgttcatggcgcccgaggtggcccgcggggaggaccagggcccccccgccgacgtctgggcgctgggctgcaccgtcgtcgagatggccaccggccgcgccccgttcggcggcatgggtggcgctggcggcgccctcnnggcggtccantggatcgggtacacggacgccgtgccggaggtgccggcctggctgtcgcctgaggccggggacttacctggcccactgcttcgccagagactgccgccgatcggtggaccgccgcgcggctcctggagcacccgttcngtggcgttcgcccgccacgangacaaggccccgcggccgtctcccaagagcgctctggacgccgccgcgttctgggagtccgaaacagagtccgaggacgaagcgtcagggagcgcgtcggagaggatcgagtcactggcgtgctccgccggggccttgcccgactgggacggcgagggaggatggatcgacgtgctcggcgagcactgcggcgcgccaggcaaagcgtccagcgtcctggtggcggtgccagctggggagatggatgtcggcggcggtctacccagtgaagatggactggaagcagaggaggtnccgttcggtggcggcggtgttccagttccagttccagcagctgatgcttcggctgggcgtcatgagaaacactgttcgagttccgactgtcatgcgctctcctgtcagctagtaccttgtaatctagtctttaatgcaataaagttatgggttcccacaaaaaaaaaaaaaaaaaaaaaaaacaataaaaaaaaaaaaaaaa

SEQ ID NO: 1186 - DNA, 2385 bp, Zea mays
  misc_feature (2338)..(2339): n is a, c, g, or t
  misc_feature (2342)..(2344): n is a, c, g, or t
ccggggaaagagagacgtaacgtaacaacctcggcttctacggcgtagcgtaggaggcggcggttccaggcgaccatccaataatcgccaccctcacgcgagaaatccccgaacacatacgatttctgccagtctgaagttttggactttatgtgagctgttgctaattcaactgcttctgctacacgatccattaactgctttccgatccgtgttctgtgaagtttgccctcttcctcagggccaatttggcaacttgtcagaacacacacggtttcggtcagtctgaaggcaacttttggggaactacacgtgtatggagttttattagtattccaggggcatcacaatggcatactttcctgatgaagtagtagggtatatccttggttatgtaacgtcgcatcaggaccgcaacgcggtgtccttggtctgccaggcatggtacgacattgagcgtcatggccgccattcggtgcttgtaagaaactgttatgcggtgtgcccagagcgtgtacatatgcggtttcccaacatgcgtgcactgagcttgaagggcaaaccgcactttgctgaattcaaccttgtcccggcgggttggggtgccactgcaaatccatgggtggatgcgtgcgcccgtgcatgcccaggtcttgaggagctccggctgaagtttatggttgtgactgatgaatgcctcaagttgctttctctatcctttaccaactttaaatcacttgtccttgtttgttgtgaggggttcagtactaccgggcttgctaatattgccaccaattgcaggtttcttaaggaactagacttacaaaagagttgtgtgaaacatcaagaccatcagtggattaattgttttcccaagtcttcaacatcactagaatgcttgaatttttcctgcttgactggggaggtgaatgcggctgcccgcggcgtccttgttgcaaggagtccaaatcttaaaagtttaaggctgaatcttgcagttccatttgatgttttgtccagaatcctttctcgcacacctaagctagaggatttaggcacaggatcctttttacaaggcaatgaccctgctgcatatgccagtttatgtagagctcttgagaactgcacttcactgaagagtatatctggtttttgggatgctccaggcttttatgttcaaggaattttgtcaaattgcaagatcagaaatcttacatgcttgaatctcagctatgctacattgattcagagtacccagcttatcggtattattcgtcattgtaagaagctccatgtcttatgggtgttagatcacattggtgatgagggcttgaaggctgtgtccttttcttgtcctgatcttcaggagttgagggtatatccaagtgttgttgcaccaagaggtactgtgacggaggaagggttggtagccctatcttcgtgtcggaagttacagcgtgtgctcttctcttgtgttcgaatgacaaacacggcgctgatgacaatagcaaggtactgcccacggctaacgtccttcagactatgcattcgcaagcccaggtcagcagacgccgtcacaggacagccactggacgaaggctttggggcgatagtgcggtcctgcagaggcctgaggcgtcttgccatgtccggcctcctcacggacagcgtgttcctgtacatcggcatgtacgcggagaagctggagatgctctcggtaacgttcgcgggggacaccgacgacggcatggtctatgtgctcaatggctgcaggaacctcaagaagctggtaatcaaggagagccccttcggtgacgccgctctcctcgcgggcgcgcacaggtacgagtcaatgcgcagtctctggatgtcgtcctgccagatcaccctgggtggctgcaaggcccttgcggccaccatgccaaacatcaatgtcgaggtcatcggtggggcgagctttggtgcgatggatggtggtgtcagcggtgcgaggaaggtggacatgctctacctctaccgtactctggctggacctagatgcgatacgccaggattcgtctcgatattgtgagctgtatctatggctactgttggtggcgttcagggaaacccgatgttcttaaccgtgcctgctgtgggctgtggctgtgctactctgtctggtagtgtttcggaaacacgatgtttatttgcgtaaggtagtgtttggttctggaaccattttaagccttgttcagatattcctatacctcatggattggaagtgattagaaaaaaatatgaataattttgacttaaaaagaaatgaaacccactcgagccctaaaaaaaaaaaaannaannnagggccgcccccggaatagtaactcgtcgacccaggaaaat

SEQ ID NO: 1187 - DNA, 2148 bp, Zea mays
  misc_feature (8)..(8): n is a, c, g, or t
gtaccctncgagggccttggccggggacaagacgtaacgtaacaacctcggcttctacgactacccgtaggagtcgaagtcacgactggcgtagcgtaggaggcggcggttccaggcgaccatccaataatcgccaccctcacgcgagaaatccccggcaacttttggggaactacacgtgtatggagttttattagtattccaggggcgtcacaatggcatactttcctgatgaagtagtagggtatatccttggttatgtaacgtcgcatcaggaccgcaacgcggtgtccttggtctgccgggcatggtacgacattgagcgtcatggccgccattcagtgcttgtaagaaactgttatgcggtgtgcccagagcgtgtacacatgcggtttcccaacatgcgtgcactgagcttgaagggcaaaccgcactttgctgaattcaaccttgtcccggcgggttggggtgccactgcaaatccatgggtggatgcgtgcgcccgtgcatgcccaggtcttgaggagctccggctgaagtttatggttgtgactgatgaatgcctcaagttgctttctctatcctttaccaactttaaatcacttgtccttgtttgttgtgaggggttcagtactaccgggcttgctaatattgccaccaattgcaggtttcttaaggaactagacttacaaaagagttgtgtgaaacatcaagaccatcagtggattaattgttttcccaagtcttcaacatcactagaatgcttgaatttttcctgcttgactggggaggtgaatgctgttgcactggaggaacttgttgcaaggagtccaaatcttaaaagtttaaggctgaatcttgcagttccatttgatgttttgtccagaatcctttctcgcacacctaagctagaggatttaggcacaggatcctttttacaaggcaatgaccctgctgcatatgccagtttatgtagagctcttgagaactgcacttcactgaagagtatatctggtttttgggatgctccaggcttttatgttcaaggaattttgtcaaattgcaagatcagaaatcttacatgcttgaatctcagctatgctacattgattcagagtacccagcttatcggtattattcgtcattgtaagaagctccatgtcttatgggtgttagatcacattggtgatgagggcttgaaggctgtgtccttttcttgtcctgatcttcaggagttgagggtatatccaagtgttgttgcaccaagaggtactgtgacggaggaagggttggtagccctatcttcgtgtcggaagttacagcgtgtgctcttctcttgtgttcgaatgacaaacacggcgctgatgacaatagcaaggtactgcccacggctaacgtccttcagactatgcattcgcaagcccaggtcagcagacgccgtcacaggacagccactggacgaaggctttggggcgatagtgcggtcctgcagaggcctgaggcgtcttgccatgtccggcctcctcacggacagcgtgttcctgtacatcggcatgtacgcggagaagctggagatgctctcggtaacgttcgcgggggacaccgacgacggcatggtctatgtgctcaatggctgcaggaacctcaagaagctggtaatcaaggagagccccttcggtgacgccgctctcctcgcgggcgcgcacaggtacgagtcaatgcgcagtctctggatgtcgtcctgccagatcaccctgggtggctgcaaggcccttgcggccaccatgccaaacatcaatgtcgaggtcatcggtggggcgagctttggtgcgatggatggtggtgtcagcggtgcgaggaaggtggacatgctctacctctaccgtactctggctggacctagatgcgatacgccaggattcgtctcgatattgtgagctgtatctatggctactgttggtggcgttcagggaaacccgatgttcttaaccgtgcctgctgtgggctgtggctgtgctactctgtctggtagtgtttcggaaacacgatgtttatttgcgtaaggtagtgtttggttctggaaccattttaaaaaaaaaaaaaaaaaaaaaaaaaaaaaaaaaaaaaaaaaaaaaaaaaaaaaaaaaa

SEQ ID NO: 1188 - DNA, 1566 bp, Zea mays
cattgggtacctcgaggccggcccggacccagagctcctccctctctctctgtctgctgtgctcagataatagcgacacctcctttcctctccctcgaggtgtctctcccagaacgcacagcacagtcgcagaacaggaaggcagagagcagcgccgcgatgagaggaggaggagcggggcccactgcggcgttcatgtccgacgagccgcctccagccgacgcggaagaggtggaggagaactccggcgccgaggaggaggacgaggagacggtggtggagcaggacgacgacgagctggagctggggctctgcctcggctccaagcaacagcagcagcagcatccgccgccgtgccggatcctcacggcccgggacctgcagccgaggtccctgtcaccggattcctccgtgtcctcttcctcccccgcggcaggtgcaggtaccgcggcgccaagcaagagggccaaggcggatgcggcgcccaactcgccagggacggtcgcgtctggccacccacagagctttggagtggtgggatggccacccataagaactttcaggatgaacagcctatttaaccaggccaaagagaatgcatcggaggctggcgccaagaagcccatcgtcgaacctgacatgcaggaagacaaggaggagagcaagaaaggccggaccgtcggttgggtgaaggtgaacatggaaggagatatcattggaaggaaggtcgatctcaatgcccatcgctcttacaagacccttgcctcagcacttgagctcatgttcatgaagccgtccattggtctttgcacttctagcagttcaaagactctaaagctattagacagctcatcggagtatcagctcacctatgaggacagggacggggactggatgcttgttggagatgttccctgggagatgtttgtaggttcagtgaagaggctcaagatcatgagaacctcagacgccaaaggtctcggtccacgattccaagggtctcacagacccacagcagcttgcacgagaggcaggacgtgaaaccaccgatgtgcgtttggtgctaacaccgctggtgaagcttgaactgtatttgatatcacgtaacagtaacagcagcccatatcgctggcatagttgtgagattacggggctgtttggtttactgtctaaggcgccacaacatggctaacttttatgtctaagtttagttcttcaattcgaacgactaaacttaggcaacttcattgtgtctagtggaaatagtagaagttttttttttttgcttcttccctgtggtgccctcgttgagcttttcttatgggctatacgagcatcatcgcccccagctcttctgtccacgctgtttacctgtgaggaatggtcgcccaaagtgttggtttttatccttgtgtttgctatggcagaagtatctgctctgctgtttcatatctgtgttcatatctaaaaaaaaaaaaaaaattccatgttgccgcacagtatgtctttgctaattgctgtggtctgcaatgcaacgccaaccacccacccgggtgttggatgggg

SEQ ID NO: 1189 - DNA, 1876 bp, Zea mays
cgtttactacgggcgtattttctgtgtgtaatgtaacgtcatcctgtccgtccatacaatatgcttcttgcgcggcatcaggcaccctgcggcgttggcacgaccagcagggaaaaagccaccacttcctcctcagtccgccgccgcagccgcctccctgtcgcccaccacacctcggtctcaaacccacgcacccgccgccgcgggaaaaatggccatggacgccgcagcgctggagtcgctcatcctggacctccacgccatcgaggcagtgaagctgggctccttcgtgctcaagtccggcatcacctcccccatctatctggacctccgcgcgctcgtctcccacccgcgcctgctctccgccgtctcctcgctcctccacgcgctccccgccacgcgcccctacggcctcgtctgcggcgtcccctacacggcgctccccatcgccgccgtcctctccgtcgaccgctccgtccccatgctcatgcgccgcaaggaggccaaggcccacggcaccgccaagtccatcgagggctccttccgccccggggacaccgtcctcatcatcgaggacctcgtcaccagcggcgcctccgtgctcgaaaccgccgccccgctccgcgcagagggcctccttgtcgccgacgccgtcgtagtcgtcgaccgcgagcagggcgggagggagaacctcgccgctaacgggatcactctgcactcgctcatgaccctcaccgaggtgctcgccgtgctgctcaagcacgggaaggtgaccgaggagaaggcacatgaggtgaggcagttcctcgacgccaacaggaaggtggccgtgccgggggcggcgcctgttaaacccagggtgctcaggaagccattttcggagagggcgaaacttgccaacaaccctatggggaagaagctcttcgagctgatggaggccaagcagaccaacctgtgtgtcgctgctgatgttgggaccgcaaaggaactccttgagctggctgacaaggttggccctcaaatttgtatgttgaaaactcatgtggatatattatctgattttacaccagattttggctctaagctccgctcgattgctgagaagcacaactttttgatcttcgaagaccgcaagtttgctgacattgggaatacagtaaccatgcaatatgaaggtggaatattccgcatattggactgggctgatattgttaatgcgcatatagtttctggacctggaatcgtagatggcttgaagctgaagggttcgcctaaaggaagagggctacttctgctcgctgagatgagctctgccggcaatcttgctcatggagattacactgctgctgctgtaaagatcgctgagcaacattctgactttgtgatgggatttatatcagttaatcccgcatcttggtcagtaacaccatcaagcccggcgtttatccatgccacacctggagttcagatggtcgctggaggagatgatcttgggcaacaatacaacactcctgagtctgtgataaattacaggggcagtgacataatcatagttgggcgcgggattataaaggcgagcgatcctttgaagacggcatgtgagtaccgggtgcaagggtggcaggcatacaagaacagcttgctatgaggagggcgccgtgagcattccaagcataataagggcaaatccaggcaattggcataataagggcatgttcgttttgatctcaatccatatgtattgagtgagattaaatatgaattgagtgggttttaatctcgaacaagtcaaaatctttcataaattttttcaatcacatccaatatatgtgatagtaataaaaaaaaaaaaaaaaaactcgaggcggcctctaga

SEQ ID NO: 1190 - DNA, 4726 bp, Zea mays
ttgcatgcctgcagacttcccacaaccacaaggccacaacacgttctccatttgctgcctacatcttttgtcagatgaagatcttgctccttctgcaaggggactctgacactccgcgagactgtagtttatggttacatggaggaccaagttagatgtggactttggggcaacgctccacggttccacgctggtgcactggggatgctcaagtataaggggccgtttgtattgagatgttgcttttaggcttttggcttaaaagctagctttaaggttttttttttgctattagctattgctagaaaaagagctgggcaaaatcagcctggagacgacaaactagagcaatttggaggaatttgactcattctttttcattgctttgaaaggagacacatcccatcctcatatagacgagaggagacttgggccctaagaaactaatctctaccaataacctaatctaatctaatatctttcctaatccttatctcttgccagcaatgcacatgaattatgcaggaagatgtgcagacagcaatgcacatgaattagtcatgtatgtggtctttccagcatggctgtcacttgagttcatgagagcaacaatagaatgcccatatctacgttagtttagtggttcgaaaattcactgctcggggctgactcctgaattctgtccatttcaggtggtttcggtgaagctagacgagtgggcagatgaacaggttgatattttagctgattcaggtgggaatgctgcagtaaacatgatatatgaagcatttgtgcccgaaaactacgcgaagccaaggcaagattgttcagcggaggagcgcaatgattttattaggtagacgttaattgcaatcttttgatgtcttactgacacatgcatagcaggtttctttaatttatatacatgtgtgtgtgtgtgtgcaggagaaaatacgaggctcaacaatttttgactaacccccagctttcatgtcctccacgacgcaacgagaaacataatcaccaacagcatagtactagttcaagtcgacatggtttaggccattcattcaggaacagctggaggagaaaagagcacgaggccaaatcaacaaagaaaacagtacgattgccgaaattcgcacacctgtctttagtataaatactttaaatgttggaaactatttgactctttgctttatatatctcttctagatcgaggtgggcatggtagagtttgtcggattgattaagatcgacatcataagaggcacaaatctagctatccgtgatgtcatgtcgagtgatccttacgttatcattaacctaggacaccaggtagttaagcaactccaaaattcaccaaacatgcatcctagctagggctatgcaaagcccatgactcttttgtttcacctatgcagacaatgaaaacgaaagtggtaaagagcagtctaaatcctgtatggaatgaaaggctcatgctttcgatacccgacccagtgccgctgcttaaactggtaagcgttttatttatttattttgaggttgttaagatacacagaagaagattttatcaaatgcgcttagttactttggctaccagccagcctagctagcctaccttatgtgcttgagaacccccccccccctgacagcaagtctacgacaaggacacgttcaccactgacgaccggatgggggaggccgagatcaacatccagccactggttgctgcagccaaagcccacgagacctctgctatcgcagataccgcgcagctcaacaaatggctggcgaaagatggcatctggatcccgagggacagcgccatctccatcgtcaacggcaaggtgaagcaggtggtgaatgccaggctccagaacgtcgagcgcggccagcttgagatggagctcgagtgcgtccctctcactcaatagcttgctgctcagtaggagtcgagtcctgagtccagattcacttacttgtgtacttcttcattagtctgcctccctctgtttgtgatgacagccatctgaaccgatgcaaatacttattgggaatgacgattctgtgctgtatacttgtatgtgtgggcaaacgaaacaaggatataccatgcccattcctgttgacatgcgagtctagtatacatgttacagttttctgctgtatctaccgagcatttcctgcaagttgctggaataatccattccatggactgcgagcctggtggttattccttgttttattatgataaaagtcttgacggttttgtaatgcaagctgcccccatcgggtttaattcctgccgcagtttcggcgtcaacatcgccgttgtgtgctgtcatttttcttatgcgaagacatgttgaacgttacagtatttgtcaatggaatgtttacttaggataatccaccagattgtacatgatttttttttaagaaatgcggttcaaaacttcaaatgtgtttgcgtttctgcaatttatctcttctccgtgtaacgtctgtggggcatcctctcatcctgtccgtccatccaaagctgcaggacctggtaacgcccggcatcaagcccgcccggcccaggcgttgcgcttgcgcagcaaatcaacaaactactacaaagccacttcctgctctcgctccgccgccgccgcctccctccccagtcgatcaccaaacctcagtccaaactccaaacccccgccgcatcagaaaaaaaaaaccctagcccatggacgccgcggcgctggagtcgctcatcctggacctccacgccatcgaggtcgtgaagctgggctccttcacgctcaagtccggcatcaaatcgcccatctacctcgacctccgcgcgctcgtctcccacccgcgcctgctctccgccgtcgcctcgctccttcacgcgctcccggccacgcgcccctacggcctcgtctgcggcgtcccctacaccgcgctccccatcgccgccgtcctctccgtcaaccgctcaatccccatgctcatgcgccgtaaggaggtcaaggcccacggcaccgccaagtccatcgagggctccttcagccccggggacaccgtcctcatcatcgaggacctcgtcacaagtggcgcctccgtgctcgagaccgccaccccgctccgcgccgaggggctcgtcgtcgccgacgccgtagtcgtcgtcgaccgcgagcagggtggcagggagaacctcgccgctaatgggatcacgctgcactcgctcatgaccctcacggaggtgctggccgtgctgctcaagcacgggaaggtgaccgaggagaaggcgcaggaggtgaggcagttcctcgacgccaacaggaaggtggcggtgcctggggcagcacctgttacacccagggtgctcagaaagacattttcggagagggcgaatcttgccaccaaccctaatggggaagaagctcttcgagctgatggagaccaagcagaccaacctgtgtgttgccgctgatgtcgggacaacaaaggaactccttgagctggctgacaaggtagagggcttctaatgttttagactttatttagtaggtgtttgaatgcactagagctaatagttagctgctaaaattagctgaagacatccaaacaatctagctaataattgagctattagctacttttagcaaattagcaaatagttagctacctatttgttagctagctaattccactagtgattttttagccaactaactactactcctagtgcatccaaacatccccttagtagtttcggtcttctgatgttgattggtagatggcttatttaatgccttgatttatactcttggatgcacataatttgcacacttttcgatgtgctatcaaggaattctagataatggtggtaatctctgccctcttcaaaaattagggatgcaatttataggcactagcataagctgttgatctgttaacttaggtttagttataggaaactattcacaagtggatgtgctgccggatgtcttcaagttcaacttttggcattgtgaattgtcattatatcacagcatgctattttgtctgcctagtgcctacaggccttttgaattttctaaaaatagtaaaatcggtatttacgagtaaaacagttcttgttctcagttctcacgtcttttggaagaatgactccctggatttgatatgtacatgtactaacactattatccaactattttgcaggtcggccctcaaatttgtatgttgaaaacccatgtggatatattatctgattttaccccagattttggctctaagctccgctcggtatgtgttctcatgatgctataccggtttttgttcatgttgtgttttacttttacaacgatatgctacatgatatttccggtccatatcttaagttgcattctaatttttttccttctttttagtataaaaaaaatcagatgtaggttcttttatatttagcaccatcattgctgtgatgaagtgacaggctgcagctatgcatccaagtgtcttcgagtagacaccatgtcttttggtctagatcgggagcagctgtgtgagcaactgaaaatggattcttaatggccatgattcacacatcctgcgcatgcaattgtacatttgtggggggtatatttagtgcttctttccctccattttctgtttattcgtcattaaagagaatgtcgtcggtggtgtgagttatgcatgc

SEQ ID NO: 1191 - DNA, 2497 bp, Zea mays
ctgcaggacctggtaacgcccggcatcaattcactgcctccctcgccgcgaccccggccggcaaatcaacaaactactacaaagccacttcctgctctcgctccgccgccgccgcctccctccccagtcgatcaccaaacctcagtccaaactccaaacccccgccgcatcagaaaaaaaccctaggccatggacgccgcggcgctggagtcgctcatcctggacctccacgccatcgaggtcgtgaagctgggctccttcacgctcaagtccggcatcaaatcgcccatctacctcgacctccgcgcgctcgtctcccacccgcgcctgctctccgccgtcgcctcgctccttcacgcgctcccggccacgcgcccctacggcctcgtctgcggtgtcccctacaccgcgctccccatcgccgccgtcctctccgtcgaccgctcaatccccatgctcatgcgccgcaaggaggtcaaggcccacggcaccgccaagtccatcgagggctccttcagccccggggacaccgtcctcatcatcgaggacctcgtcaccagtggcgcctccgtgctcgagaccgccgccccgctccgcgccgaggggctcgtcgtcgccgacgccgtagtcgtcgtcgaccgcgagcagggtggcagggagaacctcgccgctaatgggatcacgctgcactcgctcatgaccctcacggaggtgctggccgtgctgctcaagcacgggaaggtgaccgaggagaaggcgcaggaggtgaggcagttcctcgacgccaacaggaaggtggcggtgcctggggcagcacctgttacacccagggtgctcagaaagacattttcggagagggcgaatcttgccaccaaccctatggggaagaagctcttcgagctgatggagaccaagcagaccaacctgtgtgttgccgctgatgtcgggacaacaaaggaactccttgagctggctgacaaggtcggccctcaaatttgtatgttgaaaacccatgtggatatattatctgattttaccccagattttggctctaagctccgctcgattgctgagaagcacaactttttgatcttcgaagaccgcaagtttgctgacattggaaatacagtaaccatgcaatatgaaggaggaatattccgcatattggactgggccgatattgttaatgcgcatatagtacctggacctggaatcgtagatggcttgaagctgaagggtttgcctaaaggaagagggctacttctgctcgctgagatgagctctgccggcaaccttgcccatggagattacactgctgctgccgtaaagattgctgagcaacattctgactttgtgatgggatttatatcagtaaatcctgagtcttggtcagtaaaaccatcaaaccctgcatttatccatgccacgcctggagttcagatggtcgcaggaggagatgatcttgggcaacaatacaacactcccgaatctgtgataaactacaggggcagtgacataatcatagttggccgtgggattataaaggcgagcgatcctatgaagaaggcgtgggagtaccgcttgcaagggtggcaggcatacaagaacagcttgctatgaaggaaggggggcgccatgagcatccccaagtataagggcgaatccagtcagtttggcgaaataagcgcatgcggaaaggttttcctgcagttgagtcaggacctaattgacatcagattcactgcagaggagactcatgccccatcatcgtttctgttacaataatttcctctcggtttaccctgttcttgctggttgagttaggcacgttgtgatgcctgtgctcggttaaatcgtcttactgccatgccacttgaggtttggactcttgagcaagcaattttatcgatgccgagaattgtatgaaacaaaaaaaaaaaaaagcggcctccgtcactgtgtgttggcgcggcaagctccgccagcgtcaaccactcagtgtgcagctgactgcgatggttgcctgccctacatgacgtggcacggtactttagtcacgctagagagattggtgcgcctagttagggcccctagttagacgggttatatttgaaaatagttttaaattttctttttaaaaggattaataaataaaaaacccagggcggcagaccaagcaacgtacactgtctcaggctctcagcgtaccacaccacggcagcaggcttacacggaggagggaagggacggcccaccgggcaccgtccgccgtggcaacgtaacgtcgcagcatcggggaacggttcaccggcaattgggcactttgcgcggcgaagtaaccaggggaaccggcaagggaagcgacgtcatcgcgatcgcgatggcgagacggaatacggaagcaaacaagagcacgtgtgcgtgcatggatgctctgcactgcaattccatcatcgaggcacgattgtttcctcgagttccttgtcttgcagctgca

SEQ ID NO: 1192 - DNA, 1617 bp, Zea mays
ctcgagccgaacagacagtaaaattttttttttttttttggctgcataaacatagagctggttcgtctgaacatttacatacaacccaaaaggtcacatcgcttcccggaaagagaaacaaaataaacaagagcaggaaaacccaaaaggtcggttcggttctttgatgatcccttccaagagaaagtagggaaaagaagaggaagaaaccacgaagaaagatgatacaagctcagaagacgttttcttcttcacagcacaccaacatcactgcaaggaagtgtctaagaggtaaacactggacactcagttaccgtcctcttctggccaggaggtgctgttagagatgaagagaggtcagatgtcttcagaacgcgcagcctcttcaccgaagaaacaaacatcccccaggggacatcgccaaccagcaccctatcgccttcataatcctcataaaccagagtgtactccccagttccatctagtaaacccgatatcgccacctcttcctgtgaacactcctttgcgccggcagccagagggtcttgttgtgctgcaagaagcccccggaatagcttgtcgacagacagagacagctcatcgtaactaccgagggcactcagatcgatttttctaccaatagggatgccgtccatgttgatctttacaaatggagctctttttgtggtctgttcaggtttggctgccttcttcccattctgattttcaagagatgctctgctagaggtggccagatttcttctgaaggcacgaactggaggccacccaataaccggggtatttggagatcttctctgggaggcgttgttggtggatgcaagggcattctctgtagctgctgctggggacccctttgccttgcctggtgagcggggcgagaaagctggggcggagtagccgagagagagcagggaggtgtcgacgacagcagcagcagagcgcatctcctcgtctctggccggcagcattctccaggcggcgggtgctaccacaccacccgcacttgctcctcctccggggaggccgaggctgagctgaagcgtctcctcctcgtcgcgctggtcgctcgacctcggcctcggctcgcccatccagttgtgaagagtcttgttggtctctgctgcgtctcccatcactccgatcctccttcctgcgatcactcccttctcttctcttttctctctctctctctccaagttggcaagcacggctgaagatgttgggtagggctagctactcttatagtgtcctctgctgtctgctccctcggtacgcctccaactccaacctcgtgtgctatgccgggaactcggaatgaacagaacagctagctagcccagccagccaggccgcgcaaaagaggaaggacggaagaggcggtaagcaaacaaaacaagcaaaacggctgccgtgcgcgactgggcttgtggtggagctcgctcgtgaaccacgcgcgctcgccaacgcgcagcagcagtagtggcgaagtgtgagcaggcagccgttggtcggtagtggagacggacaaggaagaagacgatgggggagcagggctcggggcgctgggtgcgggcgcggcaggggttgggttggggt

SEQ ID NO: 1193 - DNA, 1574 bp, Zea mays
gctggtaaaaggcaatctggaaaagatgctactggaaaagttgcacactcagcaggttcttctctacggcgctataatgaagcagcactgaaaaaggtgttgaatttgatgcttgttgacttttatgtgtgcagtaaaagcaaatgtctcagcttattttttaggtgtctttcgtttttgtttgccttattgcaggaagttcaagaattaattgtttcatggaagtcatactttgagacatgtgtttgtgccttcatttatgctccatctaggaaccgccagatgctcttcgacggggggaagactcagtcagtaattcagtcttgtgatgttcgtccagttccattgactgttcatcgccccaccatgaaggaagcgaaacgggtatattgtaacctaacacaactctactatgagatggaatgttcaaccacagatgaaacactacctgatgctggaagtgtgaaaaatgttgaacaaggtcaaggaaaaaagaatgaagtgactgcagaccctggggaatctatttctgacttgtctgcccgtttggaattgttgaataagaatgaagcagcaaccataccatcatcaaagaacgaaacaacacctcttcatgaggcagcaaagtgtggcaatgctcagctgaccctggagttacttgagcagggtttggatccttgcgtaaaagatgcaagaggaaagacatcttattcgctggcttcagataaggaagttaggaatacattcagaagatttatggcgctcaatcttgacaaatgggactggcatgctgcagatgtgcctagtgcactaacaaaagaaatggaagaatcacaagctgcaaaacaagcagacaaggacgccaaaaggaaagcacgtgcaaaggaattgaagaaattaaaaaaagaaagagaaaaggaagaaaaggagaaggagaaggagaaggctaaggctcaagcatcacaatcacaatctgatgttaaaggcacttcgagcggccaaatggccaacagaactgcaactgcgccaggccttataccaaagcatcagacgccacagcaaatacttatagcaaaggaggaggaacgacagagaaaacaagctgaagaaagagagaagagagcagctgcagcagagagaagacttgcggctctcgctgtccaatctgccggaacgagcgcatcaggtgcagcagcaacaaactgctccgcgaagagggcggcaccagatgacaattcgtgttcgtgctgtttcggttccttggtcggcaaggtgccattccaccgatacaactacaaatactgcagcactacatgtatgcatcttcattcagaaatgctgcaggatgattaagaaaaccgcatgatgcgtgattttgatgcaattttacctcatatacaatcaataacaggctttcttccttcccttgtgcctgctttccgtaattttgtcgtgcacatcttcagaactttaaaggttcgaaatcacattcgttctggttcgtgctaaaaaaaaaaaaaaaaaacgcgaccccggttattgagccaagcggaatcgccattcgcattcgacgt

SEQ ID NO: 1194 - DNA, 916 bp, Zea mays
ttgctggttgtgtgtttgatggaaattctatcatagctcataaaacatttcataggtatgtcgtaagagcaaaggctggtaaaaggcaatctggaaaagatgctactggaaaagttgcacactcagcaggttcttctctacggcgctataatgaagcagcactgaaaaaggaagttcaagaattaattgtttcatggaagtcatactttgagacatgtgtttgtgccttcatttatgctccatctaggaaccgccaaatgctcttcgacggggagaagactcagtcagtaattcagtcttgtgatgttcgtccagttccattgactgttcatcgccccaccttgaaggaagcgaaacgggtatattgtaacctaacacaactctactatgagatggaatgttcaaccacagatgaaacattacctgatgctggaagtgtgaaaaatgttgaacaaggtgaaggaaaaaagaaggaagtggctgcaaaccctggggaatctatttctgacttgtctacccgtttggaattgttgaataagaatgaagcagcaaccataccatcatcaaagaacgaaacaacacctcttcatgaggcagcgaagtgtggcaatgctcagctgaccctggagttacttgagcagggtttggatccttgcgtaaaagatgcaagaggaaagacaccttattcgctggcttcagataaggaagttaggaatacattcagaagatttatggcgctcaatcttgacaaatgggactggcatgctgcagatgtgcctagtgcactaacaaaagaaatggaagaatcacaagctgcaaaacaagcagacaaggacgccaaaagtgaggcacgcgctaaggctttttggtcattaaaaaaaaaaaaattgtatgggcggccggctcgcgatgtagg

SEQ ID NO: 1195 - DNA, 1197 bp, Zea mays
ctgttccaacagccagggcagaagtggttgattggactaagaacaatactacaattcagtcagtagaatccccacctaagtacatgtcagaggagagtccaacacttctgcaatctagccagaccacaacagtcttctctaaccaaattaacggcaatagtgatgggacctaccacttgtcattctcaagtggtaatgtgacagacagtctaccagattggcctgtggatgagttcttcagtaactcagaatatgttccaaacttaggcttctccgagcatggttcttctaagggtgataacgctaagctggagagtgctggtggatctctacaatgccgtttagctgaaggctccattgctgaggaactattaggacaggtgcctgggttgatcactgatgattatatgagccgggtacctgagaattcatggacagtacctgaggttccctcgccaccaactgcctcggggctcaattggcatgggaatttgtgtttccctgcatatgacagcacaatgtttgttcctgaaattacatccctccagaactcccaaaatcagttcaccgtaccttcgagtttcaagcgccggagaagagagtattgaggtgacgacaagatcactagacgtccactgtccagtttaggccatcttgagagaaaggtttcttgctgtaccaaatgacggagaaaggatatccaggactgggttatcattcaaacttcaactgaactatccaagtagctaggtttgaagtgtgctgcaatgcttcaatgatgttcattttccaaagatctaagcttcgctagtgttggggtcttcttctccgcgaaggccctttaggcaaaaacaccttcggcaagacagtacaaaggcaggtgcaacatgaagatataagccgaagctacaatcgaaagagcttcggtttggtgtcatgctaaagacgaaggacgataccgacttaaagaggaaaatactgtatagcccttggtagtctgtattatgatcataattagttattaatgatataaatgtaatttcgttcgggctacggctcgcgcctataaatagatgaacagtaccctcgtactgttcacgctgcatggtaatcgttcctgcgtctctcacattttcatcatttgtcgaactgaatgtatcaatgaagcataaatattatgagcatttatttatgttt

SEQ ID NO: 1196 - DNA, 2665 bp, Zea mays
  misc_feature (2647)..(2647): n is a, c, g, or t
aattcgggcaccagctgcaaacatcagagaagagaagagtaggggggaaattactactctacgactcgtgcgcccactcctccactgttcttgggaatctcgggggagaagaggaagaaagcagtgggtctcagcgcaccactcattattcctggctccatggcttcctgacgtccctgtgcggcggggacccggcgatgaggatcgtggtgtggttccggagggacctcagggtggaggacaacccggcgctcgcggcggcggcgcgtgccggtggggaggtggtgccggcgtacgtctggtcgccagaggaggagggcccttactaccccggccgcgtatcccggtggtggatcagccagagcctgaaccacctggacgcctcgctccgccgccttggggcgggaaagcttgtcacgcggaggtcggccgacgccgccgtcgcgctgctccagctggtccgcgacaccggcgccacgcacgtctacttcaatcatctatacgacccgatctcactggtcagggaccgccggttgaaggagatgctggcggctgagggcatcgttgtgcaatctttcaattcggatctgctgtacgagccatgggaagttgtcgatgatgaagggcagccattcaccatgttcgacccgttctggaacaggtgcctcagcatgccgtatgacccccctgcaccgcttctgcccccgaagaggatcaattcaggtgacttatcgatgtgcccatcggaggatctgatctttgaggacgagtcagagaggggaagcaacgctcttctggcccgagcgtggacgccagggtggcagaacgcagacaaggcgctgacggccttcctcaacggcccactggccgactactcagtgaaccgcaagaaggccgatagcgcgagcacgtccctgctgtcgcctcacctgcacttcggcgagcttagcgtgcgcaaggtcttccacctagttcgcatgaagcagctcgtgtggagcaacgagggcaaccacgctgccgaggagagctgcaccctgttcctccgttccatcggcctgcgggagtactcccggtacctgagcttcaatcacccgagcagccatgagaggcccctcctggcgcacctcaggttcttcccctgggtggtgcccgcgcgccccttcaagatttggaggcagggaaggaccgggtacccgctcgtcgacgctggcatgagggagctgtgggcgacggggtggctgcatgaccggatacgcgtggtggtggcaagcttcttcgtcaaggtcctccagcttccatggcgatggggtatgaagtacttttgggacacgttactggatgctgatcttgagagcgatgcgctgggctggcagtacatcactggctctcttcctgatggccgggagcttgaccgcatcgacaacccccagtttgaaggctacaagttcgacccgcatggggagtacgtccggcggtggattcctgagctcgcaaggctgccgacggagtggatacaccatccatgggacgcgcctgtctccgtgctgcaagctgcaggaatcgagctgggctccaactaccctctccccatagtggagctggacgcggccaagggcaggctgcaagcggccctgtcagagatgtggcagctggaggcggcgtcgagggccaccatgaacaacgggacggaggaaggcctcggcgactcctcggaggtcctgttccctcaagagctgcagatggaggtcgaccggcagccagccccagccgaggcagcagccaacgtgcacgtgcacgtgccgatgcctgcccggaggcgcggggaccagatggtgcccaccatgacgacctcttcgctgaacagagctggaacagaggtctccgccgatctagtagtagcgaacagcgaggaggaggacaccagggcgcaggttccgttccacgcgcatctccatctccacccccgagccgaagccccgccagctgcgcgtagaaccaacaacggcgctcgccagcacgacgtcttccagcagcgtcggaaccacaggcgagatgctctgcttgctccgtcggcgtcggaggcttcgagcagctggaccggcagagagggcgccgtggtcccggtctggtcgcctcctgcggcgtcgggccattcggacgccttcgccgccgacgaagctgacgtctctagtaggagctatctgggtaggcatccgcagtcgcaccgcctgatgaactggagccaactatcgcagtcatcgtgagctcggatgcacggacagcagcagaagattctgtgcggccaaacttaatcgagctgaagattctcgtatgtagattgtccactgaactgctcatccatagtctgatgggatggaaaccaggcggcttttcctggttgtggtggctatagctgtgtaaatctctgtcttctagaacgtgtgtggtcgatatagtgcggttggctttacaaccaaaaaaaaaggtcgctattcttgatcagacgacaaaggttttccgtattttttttagccttttttgggggaggtatgtgatgtatgtaaccgtaactgtacattcccttgtgctgaccatattgttagttgtagtttccatgcgtcttgtattgctgtttaaaaaaccgagnggggggaaccggtgaccc

SEQ ID NO: 1197 - DNA, 657 bp, Zea mays
gttcagtgcaactatcaactggggattttacattggatctcttaagtatcttactccttgaggctccattttctctggtagaatgttcacgacgggcaagagaagagcaggcagcaccttcagccacagaatcttttagcgcctcatttccgtgctgaaaatttctcttgcttgttttatctgacctcattatcttctcagtcatagtttgcagcacattatcgctcagacgcgatgccattgcttccaaattgcaacttgcttgcggggcatctggaacgggaacgggggacgcagccggtggttcgtccgacaccccagccgcgcccgcgttccggccacgccgtctacgaggcctccgccgtttcctgcccctcgacgccggcgtggcagcaggaccgatcgaagccaccggggttgtgactgctgcgctctgcggctccacggccagcacggccgcaccgaccttcgttttcgtggctgcagctgcgcgctgccgctgccgcaggcgccgtcggcggtcccgccgcctggacgccgcgcgcgtcgccggcggcgggtccatccgatctaggtcaccgaggagatcccgaaaaggaaagggccggcatctgggcacaagtgagaagcgagaactcagaaatgtcgtgccgaatt

SEQ ID NO: 1198 - DNA, 1164 bp, Zea mays
ggccgctttttgttttttttgcttggctgcaaacagtttgagactgagataatgtcagacaattcattcatttggtctgatacctttcgtagagcctgcaatttaaacccatagcagaaactctgtaatcttcagtacagggatacaagcaaactactcagagaagatcactgtatactgatcatgatcttttgatcatggataaccacagaactcccagaaaaaagcacgacccttgggagttcaagcacaacatgtcaagggtgcacgccctctatcagcaatctgagcatagaagttccaatgcggatcgctctcagtaatgaaaggttgaccaaacggattatcacgaacaaaatgctgaacattatctgcagcggctaggttctgcagatacacacgaaggtctccattgggacccagcgaatcgtcattccagtttaagtaactgtaggagtgaggaaaaatggcagtatgcggaggattgcgcagagctttgtaaggggaatcatccactagtaatgtattcgaaggtgaatagtcccccacttcccatggaagatcttgttcttccacgttccatagttttctcaattccttcagcactaatggcttgtgcttattctccagtgttttatgtccggtgaatgtgcatttagacatgtcctggacataccaacaaaacagtaggcgtggtttgaattcactcataacaatattaacaaccgaatcaacattttctttttttcttgaggaccatatgcctagctcaaaattcagagcacaaaagttgagaaaatcatcgcagtaaggccttcggaatactggaacgggaacgggggacgcagccggtggttcgtccgccaccccagcggcgcccgcgttccggtcacgccgtctacgaggcctccgccgtttcctgcccctcgacgccggcgtggcagcagggccggtcgaagccaccggggttgtgactgctgcgctctgcggctccacggccagcacggccgcaccgaccctcgttttcgtggctgcagctgcgcgctgccgctgccgcaggcgccgtcggcggtcccgccgcctggacgccgcgcgcgtcgccggcggcgggtccatccgatctaggtcaccgaggagatcccgaaaaggaaagggccggcatct

SEQ ID NO: 1199 - DNA, 1843 bp, Zea mays
gcacgagaccattacctagaacatcctaatcgaaaagtactgtacatcgacatgcgacatcttgcttggcctatctgatctttaatgtcgccgcgcacagagaggagatccggtctcatgaagtggctctgcagattcctcaaggggccgaagcccggcgaaccgagccgccggcggccccaggtggcggccggagaaggggagggcgcgctttggcaccaacgaccagctagaccaaagatcgatccacctaggaacgagaatgaggaactagtggaccgtgccattgccgagcctcttgcagaggctgtcaaaccgcccagagagaaaacccataggggagaagacagcaacgacgacgaagatctcacaagagccgtacaggacagtctgaatatgaacccttacacgccttacaacccctatccaccctctcaagcccaacctatagggcacagggtatgcggaggctgcaagcatgagatagggcgtggccattacttgagctgcatgggcatttactggcaccctcagtgcttccgctgcaggtcctgcggtcaccttatccgtgagaccgagttcaccttgctgggtacggattcgtaccacaagctgtgctacaaggagctgcatcatccaaagtgcgacgtctgccttcagtttgtaaggcctcgtgtcctcggaaaacctgagcgatctgcactgcagactgtgataaactgcatcccaacgaacgggagtggcttgatagagtacagagcccacccgttctggggccagaagtattgcccttcgcatgagcgcgacaggacgccacgttgctgcagctgtgagaaaatggaggtacagccaaggaacacgaagtacatgtcgctgggagacggacgcggcctgtgcatggaatgcctgggatctgcagtgatggacacgagcgagtgccagcctctgtaccattctatcagatactactacgaggggatggacatgagactggaccagcagatacccgtgctcttggttgagcggcaagcgctcaacgaagccatggaaggggagagtaaaggcccacaccacatgcctgagactaggggcctatgtctgtccgaggagcggactgtgagcagtatacttaggaggcccagaattggtggaaaccggttactaggcatgagaactcggccacagaagctgacgaggagatgtgaagttactgcaatacttgtcctgtatggcctccccaggctactgacaggttccatcctcgcccatgagctgatgcacgggtggctgcgcctcaaaggttaccgaaacctaaacgcggaggtggaagaaggcatatgccaggtcatgtcttacttgtggctggaatcagagattcttccgtcatcctcgaggcacgcgcagccttcatcatcgtcctcctcctcatcctatccagcaacatcatccgagaaaggtggaatatctcataccgggaagaagctgggcgagttcttcatgcaccagattgccaatgacacgtcgacggcctatggtgacgggttcagaactgcgtacgctgccgtcaacaagtatggccttcgccaaacactgagccatatacgcctaacaggaggcttccctgtataataagagtgacaaaaaagacacaaaatgtccatgcatgatcatatcgatatcaaaaggttatatacatattgggatgaagttcgctatggaagcatagtgattcagtttcggtgaccttgagttttcaaagaggtcatgtgtaagaacactgatttaggggtggaggtatgccgcttccggcatatgatttcctctcacaaaaaaaaaaaaaaaa

SEQ ID NO: 1200 - DNA, 2816 bp, Zea mays
  misc_feature (2808)..(2808): n is a, c, g, or t
  misc_feature (2813)..(2815): n is a, c, g, or t
ctggtccacccccaagacacgacggacccctcaccagtgctcagttccagcagccaccacggctccctcgccacatctcaaatgccgcgttgcagcagcagcaccacccccaccacccaaacggagcgcaccggcagcaacaggagcaaggagaaagttcgaaaggcggagcgcgctggctgcaccggcatttcaatccccgtattacttactaataaatcgtcgcaagcggatacttgtccgtccgcaaatacatattcccgtttcccgccgcagggcattaaaaaaaacgatcagaaaagcggggagagctaatgcgagcgagcatacattcccgttgacacaaggaatctctgcgccccgctctaccttcccttcctttccaaaccatattcttctccccgtgcgctcgctgcagatgcgtccgtccgtccatcaactggcaacggcgagggggatttgtttttgttttgttttactataacgaaagatgggcgggctcatcgttgcttttgcgcgtagcagggatgactgactgggaggaggaggagggagacgagaacgagatgccgtgccgcccgcccgcccgcccttggctcgcttcaccttcaattcttttctttctgtcgcggccagcgccttcgcatcgcaccacgccgctttattctctaagaaccccgtcctctccattccatcgcctcccccgccgccgcccgccatcgtgcagatcttgcttcttcgtcttctcctcttcctcctcctcctcctgaccaccctcctgctcagctcgtcgtacgtagacatcgcgatcgccgacgtcgatcggtctcgccaattaagctcttgcttcctccgttcttttctggttcggtttgttcggtgctctccctctacgtgggctgcgtctatatatatgctgtgttggcgccagctgcataaatggcgtactcctcgcggacttgtggtcggtgcaacaaccacgagaggagatccggtttcatgaagtggctctgcaatttcctcaaggggccgaagcccggcgagccgaaccgccggcggccccaggtgacggccggagaggaggaggacgcgctttggcaccaacgaccagttcgaccgaagaatgatccacctagaaatgacaacgaagaagtggaccgtgcaattgcagagtctctcacagaggacgtcagaacccccaaagagaaaacccgcaagggagacaaggacgacgaagatcttgcgagggccatacaggacagcctcaacatgaacccttacacgccttacaacccctatgctccctctcacgcccaacctagagggcacaggctgtgcgcaggctgcaagcatgagatagggcatggccattacttgagctgcatggggatttactggcaccctcagtgcttccgctgcaactcctgcggccaccctatccgtgagaccgagttcacattgctgagtacagatccataccacaagctgtgctacaaggagctgcaccatccgaaatgcgacgtctgccttcagtttattccaacgaacaggagtggcctgatagagtacagagcccacccgttctggggccagaagtattgcccttcgcatgagcacgacaggacgccacgttgctgcagctgtgagaaaatggagccaaggaacacaaagtacatgtcactgggagacggccgcagcctgtgcatggaatgcctggggtctgcggtcatggacaccggtgaatgccagcccctgtaccattctatcagagactactacgaggggatgaacatgaagctggaccagcagatacccatgctcttggttgagcggcaagcgcttaacgaagccatggaaggagagagtagaggcccacaccacatgcctgagacaaggggcctgtgtctgtcggaggagcagactgtgagcagtatacttaggaggcccaggattggtggaaaccggttactggacatgagaactcagccacaaaaactgactaggagatgtgaagttactgcaatacttgtcttgtatggcctccccaggctactaacaggatccatcctcgcccatgagctgatgcacgggtggttgcgcctcaaaggttaccgaaacctaaacgcggaggttgaagaaggaatatgccaggtcatgtcttacctgtggctggaatcagagattcttccgtcgtcctcaaggcacgcgcagccttcatcttcctacgcctcgtcctcctcttcgtcttactcttatccaccgacatcgtccaagaaaggtgggatatctcataccgaaaagaagctgggcgagttcttcatgcaccagattgcccatgacacgtcgacggcgtatggtgacggtttcagaactgcgtatgctgccgtcaacaagtatggccttcgccaaacactgaaccacatacgcctaacaggaggactccctgtataataagagagagagagagagagagagagagagagagagagagagagagagagagagagagagagagagaagacaaaatgtccatgccagacgcaacacaaagatcacatggatatcaaaggttatatacatattgagatgaagttgctggctatggaagcatggtgattcagtttcggtgaccttgagttttcaaagaggtcctgtcggagtaaatcaggaaaaagagctgtatttgctcggattaataggaactggcgatgccatgtgtaataagatcgccaaaaagcacacactaatgtaatgctctgttactcacactaatataatgaagtgtatacttatgtgtctgcagatttnaaaannna

SEQ ID NO: 1201 - DNA, 639 bp, Zea mays
  misc_feature (26)..(26): n is a, c, g, or t
  misc_feature (46)..(46): n is a, c, g, or t
gacagatgagttgcacactgtaccangaggacgaacctgtcgcccnctgatgcatctccactggcatctgcagcatcatcaggggcgacagatgagttgcacactgtaccagaggacgaacctgtttatcacgatgcgcctgaggtgcagaaagaaaactgaggcaatggccgcaagcagctgaagaaacgaaggaaaacatggggcctgtagtgactagtgaggcgattctgtgtatctgaaagatgggactggctgtttatcttcgcttctgtatatcaactgcgtgtcatgatcagtggctgcttcgcgtttgagtttcatatcggagtcctagatcatcgaagtctttgttggtttgcttgtgagatgtttatgtcgtgatgaacaccatgtagagtactcttctcgtaggtagaagctgccttgcagatgcttatgcagttatgctggggtctgggctctcttgtcttgttttgcggagccggtgatgagctttatgttctcaaatggtagttatctacccggtattatgtgctctgttcagcctgtttactctattgcatattcgttaatggagaaccactactttcctgtatttattattccctggatactggataaaacaattgcttagcc

SEQ ID NO: 1202 - DNA, 4143 bp, Zea mays
gcacgagaccattacctagaacatcctaatcgaaaaaaaaagagcgggcagtactggtggcccgtggccctggtggggcaccactaggctgctacgtgttcttccccaaatcggcctcacagccctcactgttgcaaagtagggactagggagtacctgctctctcgctctcgcccgccctctcgctctcgcccatcccattgccttcatcatcaaatcgccaccgaaaattccccccaaaaaacaataagcacttgttcatcatcatcagagtaaacacagcagaaccctagcgcgccgttcctccgacgactcacatcccacccactcacccaccccatggcggccaagctctccaccagcgccgacgccccggcctcggtgcggctctccgcagcagcgcaggcggctgcgatccagccctcctctccgcgcttcttcttctcctcgctggccgggaccaacccggcctccccgcatcgccgcatcgccattgccgtcgatctctccgacgagtccgccttcgccgtcaagtgggccgtgcagaactacctccgccccggggacgccgtcgtgctgctccacgtgcgccccacctccgttctctacggcgccgactggggttccatcccggtctccgtcgctgacgaggccgacgctgccgaggacgccgccgccgccgccgagggcggcccctccgaggaggagctgcagaagaagcgggaggaggaatacgacgccttcacctctaccaaggcgcaggacctcgcgcagccgcttgtcgatgcccagatccccttcaagatccatgtcgtcaaggaccacgacatgaaggagcgcctctgcctcgaggctgagcgccttggcctgtccgctatgatcatggggagccgcggttttggggcctctcggaaaggcggcaaggggaggcttgggagtgttagtgattactgtgtacaccactgtgtatgccccgttgtggttgttcgctaccctgatgatgctgcagatgccagtggagatgcatcaggggcgacagatgagttgcacactgtaccagaggacgaacctgtttatcacgatgcgcctgaggtgcagaaagaaaactgaggcaatggccgcaagcagctgaagaacgaaggaaaacatggggcctgtagtgactagtgaggcgattctgtgtatctgaaagatgggactggctgtttatcttcgcttctgtatatcaactgcgtgtcatgatcagtggctgcttcgcgtttgagtttcatatcggagtcctagatcatcgaagtctttgttggtttgcttgtgagatgtttatgttgtgaacaccatgtagagtactcttctcgtaggtagaagctgccttgaagatgcttatgcagttatgctggggtctgggctctcttgtcttgttttgcggagccggtgatgagctttatgttctcaaatggtagttatctacacggtattatgtgctctgttcagcctgtttactgtattgcatattcgtcaatggagaatcactacttattattcccagtaaaaaaaaaaaaaaaactgcttagagctagtttgaaaatctcatttttctatgggattttcattttctcttgggaaaattggaatcctttgggaaaacggtgttttcaaactagccctatctatgcttgcatgctctatatttgtattttgtaagactggcatctgacgaatttttagaaataaatttgtcaaaaacaaatgtcatatccatattgcaatgctcttcaaccttactcatgatttgcaagccgcttctagggtcggtttggtttggttgggatttggccgtgaaaaaaagctgccgtgagtgagttgtgaaaaaaaaactgtgggctatgaggtgttaaaaaactaaaaaccgttctgtagaaccattaaaaactactaaaagttcttccgaatatatactacaagaaagttgttctgtatatatactactaaaaaccgttctttagaatcattaaaagccactaaaaaattgttttctgaatccagtcttttactttgatttttggtctttaaggggcaaaagccagagccaaaaattaaaccacacatatctatagatcagtactccccctttgtaaaatgagtgcacagccaggagttaattgattttagatttagctgaatttataaaaaaaaacagtatgcatatctaaatatgtttattataaatacattttaatttgatactataaatattagtgtatgtgtatatatagtcaaatttgagattagtgaactcttaaaatgcgagttgtgtttgaagggcagaagggtgagtacacgtcagcagtgaaattttcgatttggcgcgcctcgcgcacgtgccactttacccaggcccgcagcgcaggaacacctgagggaagcgaggagacgacgaggtgaggactgaggagagctggagaggcttccagcaaaggcggcgagccatggaggagggcatggtaccggtggtcaagttctccggcggcagccaagcctatttcctgacgcacctccaccaggaccacaccgtggcggcgtggtctcggattggcgggcgggtggcgccatgggcctatggctcgctctactgctcgccgaccacggtgcgcctcctccctcctccccatccgcttcccgccttcccgggaatcgaggcatccctccgcccgctcgcaccatacgtcacccctcctgattcgctcgcttcactcttttcttttctctacacgactggcgcggaactactgattttcggctggtttccgtggccggcgcgtccctccacgcaggatcgctcatgtacctcttcctcggagacctcgggtgcatgctgtacacggggtgcttccggtgggagctcgggagcgataaagcgcggcgggcgaagcaggctttactggacgagctcggcggggataccattattgatgtgctctatttggagttctggacaacacctatcgtcgctgagcaggtcaatttcacttaaacccaagcgtattattacgtcaatgattcagtctaccgctgatgatgcccttaggccttagtcgaaacatcattttttttaacaattacatctgaaatattggacgcgttcaataatttgatgataaattcactgaaatactgatgcctgaatgtcataaaaaatacactttccgttcacattgtagagcgtcacgccgatcggctgcagccagatgtagctgcagcaggaatagagactgatgatactttggctattagggtgtagcaagctacagctgccttgtgtttcctcgtttctacccttagtgttttttgctgagtgaaaagtgaaacctaatgtgcacatattggttgcttaagctgcagcagccatctttcctaaatgagtatgaattgggactgatgtcctgctagtgctgccattgtgaacatgctcctgcaataaaatgtcactagcaacttgtaaacggattgtctatgcttatgttttgtgtgttgaatgtatttggcattttggctataaaatgagggtcgggtagctacaaggatagatcatccgatcacattatataggtaatagataccgccataaataggatataggttattatcttattctgagagcctaaacttatataaatctttgtgtgtctcatgtatttacctttagttcttgattatgtgacctgtcatataaattaactaatgaataatcttcagcaccccagataggggaagtcgcgatgatcaccagaaagttgatggcaaccatgagttttgcaccagcagaagcagtcatctttcgcacactgatattcatcgccaataaaatcatgaattttggatttgtcccggatctttcggtggctctaatgtcctccgttcaagctttataagatccaatctacacctcggcgaatctgggttggtttgatcttgtgtcatcgacttggactcgaactccactttgacatcagaaatcttaaggcagtgacatttgagtaagtgggttaaatttagcgcatactatacattcagaaatcagcaaaacagaaccatgagatcaggcagatactgcaaaagggggtaggtaagtgttcgggtggtgat

SEQ ID NO: 1203 - DNA, 2446 bp, Zea mays
tggtatctaaattactatgattttgaaaatgcggttttcaggaatacaaccaactgtaaaatatacaattctaactaaatcgttctggtatggatttagatttgctatatttgataaacagttttatggtggaccttagatttactagtgaagttgctgcttgggaaatcccagattcagattttattattggtgaagccgttccaaataaaaatcgtaaagattaaggcacgaatagacgagctatgtataggggtgacaataaactctaaattttatactataagatttaaagatcggattaggatccgatcctatttctattttctaaactaaaatttatttaagttttcatcgctttttgaagaaggatttagattggaatccattaccaccagacgaaatattagaaaaggcgtggcaaaaggagcagacagtgggccacactcgggtgctacgtgtgcaagtctttcttgcccaaatcagcctcgctgtcgggagtacccgcactttcgcccatttcatttcaaaccaaaaccctctctccccttgccttccacggttccaccacaccccggatcaaatcgccacagaaaattcccagaaaaataacaagcacttgttcatcatcaaagtaaacgcggcagaaccctagcgagccgttcctccaacgactcacctcccacccactcacccaccccatggcgaccaacccctccaacggcgccggcgccgacgtccctgcagccccggcggcggtgcggctctcggttgcggcgcaggcggccgcgatccagccctcgtccccgcgcttcttcttctcctcgcttgccgggaccaacccggcctccccgcaccgtcgcatcgccatcgccgttgatctctccgacgagtccgccttcgcagtcaagtgggccgtgcagaactacgtccgccccggggacgccgtcgtgctgctccacgtgcgccccacctccgtcctctacggcgccgactggggttccatcccggtctccgtcgctgacgaggacgacgctgccgaggacgccgccgccgccgccgagggcgatccctcggaggaggagctgcagaagaaacgggaggaggactacgacgccttcacctccaccaaggcgcaggacctcgcgcaaccgctggtcgacgcccagatccccttcaagatccacgtcgtcaaggaccacgacatgaaggagcgcctctgcctcgaggctgagcgccttggcctctccgccatgatcatggggagccgcggtttcggggcctcccggaaaggcagcaaggggcggcttgggagtgttagtgattactgcgtacaccactgtgtatgccctgttgtggttgttcgctaccctgatgatgctgcagatgccggtggagatgcatcaggggtgacagatgagttgcacactgtaccagaggacgaacctgtttatcacgatgcacctgaggtgcagaaaggttcgcttcttttctttttgtagcgtttactacaagcctgatagcttggtgtgtttcatattactactgccctcatgcttatttaaagacccacgtatctttttggccagacaaattggtttatgctaatatgctatatcaattaacttgcttcatgctcttgtaaactgtgaaaaatactgatagcgtctaatcctacatgtttgctggctctcttagaattatactaggacaatacgctcgtagtggcaaagcaacaaattacatgaaaaatatggtgcaaatacatctgcttctgcagacttcatctcttcactgttttcacttttgatattgttttttttatttcttgcttaatgcaagaatatgcaatgcaacgtagatgaaatatttgaagttttgaacagatatgattttaatatgtttagagtaagcacaagaaattaaaattcaatttttgcagatattaagcaaacactgaaccttgccaattagaattataatatcaatagctatattattagttgcatgtggcagggctgcaggagttggacgtgttacatcttacatctctcagtcatttcttatgaatggataggatgattgataaatcactattttatttgaaaattttaatagttcaatacttactgtagaagttaattataaatcaaaatgctagactatgcttttccagttgaataaacagggaaaatttgcatcatgggacatgatttttagctccagtagctcagatgctttgccaaagatgaacatagctacttagcttactttgcaatttaatcaaagtagtttaatgttgcctggttaaagttagtctctctttttcttaggtctaatcttacagttaagattttcaatgaagtagaaatttattcactgccaccttcgtggaaggtattccacttcaaagcggttattttttgggaggtttgcttaggggcac

SEQ ID NO: 1204 - DNA, 1458 bp, Zea mays
actttcgcccatttcatttcaaaccaaaaccctctctccccttgccttccacggttccaccacaccccggatcaaatcgccacagaaaattcccagaaaaataacaagcacttgttcatcatcaaagtaaacgcggcagaaccctagcgagccgttcctccaacgactcacctcccacccactcacccaccccatggcgaccaacccctccaacggcgccggcgccgacgtccctgcagccccggcggcggtgcggctctcggttgcggcgcaggcggccgcgatccagccctcgtccccgcgcttcttcttctcctcgcttgccgggaccaacccggcctccccgcaccgtcgcatcgccatcgccgttgatctctccgacgagtccgccttcgcagtcaagtgggccgtgcagaactacgtccgccccggggacgccgtcgtgctgctccacgtgcgccccacctccgtcctctacggcgccgactggggttccatcccggtctccgtcgctgacgaggacgacgctgccgaggacgccgccgccgccgccgagggcgatccctcggaggaggagctgcagaagaaacgggaggaggactacgacgccttcacctccaccaaggcgcaggacctcgcgcaaccgctggtcgacgcccagatccccttcaagatccacgtcgtcaaggaccacgacatgaaggagcgcctctgcctcgaggctgagcgccttggcctctccgccatgatcatggggagccgcggtttcggggcctcccggaaaggcagcaaggggcggcttgggagtgttagtgattactgcgtacaccactgtgtatgccctgttgtggttgttcgctaccctgatgatgctgcagatgccggtggagatgcatcaggggtgacagatgagttgcacactgtaccagaggacgaacctgtttatcacgatgcacctgaggtgcagaaagaaaactgaggcaacggccacatgcagctgaagaacgaaggaaaacacgaggcttatagtgaggcaatcctgtgtatctggaagatgggaccggatgtttatctttgcttctatatatcaactgcgtatcatgatcagctgtctgcttcccgttgagtttcatatcggcgtcgtagatcatctgagttttttgttggtttgcttgtgagatgtagagtactcttcccgtgggtcgaaggtgtcttgcagatgcttgagctttatgttgtcgaacggtagttatctacacggtatcatctgctctgttaagcctgtttagtgtttactgtattggatactcgttaatagagaaccgctacttttcagtatttattatcacctgtatattggataaaattattgcttagcttatgcttgcatgctccatatttgtatactgaaagacttgtttgagaagaattcgtttgaaataaatttgtcaaaaatac

SEQ ID NO: 1205 - DNA, 1563 bp, Zea mays
ctcgaggccggccgggaaaaaaaaaaagcatctcgcgggatcggacccccagcgccgccgaccgccgtcctcactccctacccccccacgccgccacacgaaccacctgagctccctgcgccactaccctcggcctgccgccgcacgcctcccgcgctgtcgttgtaagccctagccctacgctccccgatacgccgcacgcctcccgcgctgtcgttgtcagccctccgctccccgcgacgccgcccttggctttctgcccaccgacgtatcgacagcgccgcgtccgccccacttttccgttcgatttggtgggccgaggtctctcgctcgtggagtcgtagtacagcgcttcccgcacggcgatgtcggcgacgccgctgcccccgccgggccccgatggcgcggtggcgctcctgcctccgccgggtacggacatgactgggatctgcttccgcgaccagctgtggctcgacacttacccgctcgatcgcaacctcgtcttcgactacttcgcgctctcccccttctacgacatcacctgcaacaacgagtccctccgatcgcgccaaatccaccccctcgacatgtctcatctgacgaagatgaccgggatggagtaccttctgagcgaagtgatggagccgcacctatttgtgatccggaagcagaagcgggagagccccgagaaatctagccccatgctcgcctactacatccttgacggctccatctaccaggcgccacagctctgcaacgtcttcgcctcacgcataagcagggctatgcatcatatatcaaaagcctttaccatagcatgttcaaagttggagaagattggaaacgtggaaaccgagcccgatgcagtagcctctgaatcaaagacccaaaaggaagcaatcgacctgaaggaactcaaacgaattgatcatatcctgtcatccttgaaacggaagataggggctgctcctcccccacccccttatcccgagggctatgtcccaccatcagcagaacaagagaaagcgccggatgatgtggcagcatcagaggcaccgcctcaacttgaccctatcattgatcaaggtccttcgaaaagaccaagattccaatgaaagatttgtagcttaaacctgctgactcgacaacttcctgtatgctttaaagtcgccgacgtggactttataaatccattcttgctggttggttatttacaggccaaagacagaactaacctcgtggcatgatatctcgttctctgagttactagcttgaatcttgtagattggccagtgccatttgctccgggcttgtaatcttgtagataggccagtgtcatttgatctggtctatctacttagctatcataacttatgaggtggttatagttttgccttggtgcaaatctgcaagactggacatctcatacattatttactatgcatacttacgtgtgatttgtctaaaaaaaaaaaaaaaagtcatatgacctgatacagacggtgacggtcaccaattggaactgccattttctgttggtgtggatgaagtttgacactatga

SEQ ID NO: 1206 - DNA, 1588 bp, Zea mays
cttgatactgatccgatggccatgattcattatatacctggacctagataatatatagataattttttttatctgtcctaattaatcaaaaccgtgtgaagactttccttcctcggcaagccaccgcagcgctataaaactcggcttccttctcccaccccccgccgccccccacccgtcccgtccccacaagcttcctcctccatttttttatctgctttttccccctcggctgttcctactcaggctgggcagcagagctagcagtggtccctggtgcttcaggcgaccggccatggtggagctggagcctagtgtgaagtcggagcatggtggaggagtcggcctggtcctgcctcctggcttcaggttccatcccacagacgaagaggtcatcaccagctacctcctgcacaagttcctgaaccctagcttcgcgccgcacgccatcggggaggtggacctcaacaagtgcgagccatgggatctcccaagcaaggcgaagatgggggagaattccaaggagtggtacttcttctgccacaaggacatgaaataccccacgggcacgcgcgcgaaccgcgccaccaaggagggctactggaaggccacaggcaaggacagggagatcttcaagccagctgcggggcgtgaccgtgaccgcgagctagtggggatgaggaagacgctggtgttctacatgggcagggctccgcgcggcaccaagaccaactgggtgatgcacgagttccgcctcgagggcaagtccaggcacacctgcaacgacctacgcttcaatcccaaggatgaatgggtcgtgtgcaaggtgcaccacaaaggggccgaagaggccagcgccgccaagaagtccgccggcgggggcggcgaggagcactactactccaccgcaacgcccaacgtcagctccgtcgaaggcggcgacgagttcctcgtcgactccctgctggattactccagctacttcaactgcttcgcaaccggtggcttgcctctgcccagcacgacggccaactcagccgcagcacctgcaacgaacgacgacgactcctcctggagcatgcttcgtcacgcgccggcagaccagcaagcaatggtggggagctacagcttgcaccaccaggcaatgaaggcgaaaactgtaggcggcgtcacctccccgagtttctccgctggtttgccgagctcgccggtggcggactacgtgggaaacgatgcttctggctaccatacaaacaactattaattaacgatggatgatgagccgctgccgaaaatatagtgatccaataggtggtgttaggctattcacacttactgtacagttttaaaacaatgtcacatcaaattttgtttatggaaccgtgtacactgagtttcaactagatgcaactctctcatcgcccacagaaatatctttatctatctccttattaaattcttattaccatatcatcctagttgattatgtgacagaaaatttaataaagatgaaactcaaatgaaatcttcactaggaatagcccttagctcttgcttgcattggtagataaagtactggggggggcgg

SEQ ID NO: 1207 - DNA, 5123 bp, Zea mays
  misc_feature (4773)..(4773): n is a, c, g, or t
gggcctttactcggacttctcattcgttcgtccccgagagatcgccggcggggcccgcgaaccagtcagtggtgggcggccaccgtccgcggcgaggcccgcgcgagacgtggtggagctggagcgcggcgtccgcgtcccgccacgctccacgcacgcagagcgcggcggggtcgaggcggttgggttgggaagctgagcaagcaagcggcccaccgccatggcgatgatgatcccctcctcccgtcctagggcgacggagcgcgcccgcgcgcggatggaacgaaacggctgagggcacgcgggcggccgcttctccgtttcctccgtcgccttgcgcttggagctttgcttctggccatggggacctggaaacggcccggccgcccatcgacaaccgtggcgtggaaccgaggccagccgaccaaccaaacgcattttgctgctgccttgccgttgttgatgcgcatgctccgagcggccaccggggctcacacaccgcggggggagcacagcggcaggccagcagcaaaatgcacacgatcccaattctccaccaagcgttctaaaccgggcaaaccaccaagaacagaacgaatttgacgggagtgagagtagtcttgtattgtaacgtcgaattggatacagaaaaacgggtatacagtatactaagatcgtaacaaaatagtagcatgtcctcgacatgttcgtctgtgtttcagtcaatgctacagcggcgtcttacccgtgttcatcacatttcttggccgaccaacaccacatcagcaaacagcagcgtcccacccgtgttccttgccgaatcaacaaggcgtgttcgataaaacgccacgaggttaagcctctcaaacctagcgcgtatataaatctatgttaacgagcctttataccttatattgtccatcttagaggccccttagcgttcttaccaatcaactcttcatcatataatcaacattggtctcatcaatcagaaacaaaaaaaggcaacaaaaaaaaaacaagcacgccacatcaaacaaggaagaaaagggaaaaagagaaagagagaagcaaaaaaaaaaaaatgattgagcctattgcgccaatatcttactcctacaccgccgcaagcggacagcacgcctcgggacaagcagatatcagctcccccacaccgtatcccgtcatccgctcatcctcgccttcgtcgtcttcctccccgccctcgtcgccgtccgcctcctgctcctgcaatgccattgccaccgtctccgacacagcaccaggcgagctacaggacctccaggcctagtacaagtgtgcaacggagtagagcaggaggaaagcaagcgcacggtggttgcgagagcaccagagacgcgctctccctcagcctggacctggagccgctatttatcgcacgctcacacgcaggatgcctcgctctccctcccaaggcggaagctttcttctttctgaagccttttcgctttgtgcggcggggaagctctgcgccttcgccctctcctcctcctcccgcctttatgctttccacacagcgcttgacgtgagaggggatcctccaccaccaccaccaccaccaccgctagcaccaccagtccaccacccttcctcgccgatagctgcctttcctcctcagctggaggacggcgggcccacggcgccgaatctacttttggctggcctcgctgcgcagccctgctcctccacccccgacggcgcgcccgcgcgctcctccatcatcctcctcctcctcctccacctgcagcaaggagaagaagaaaaaaggcaggcgtaagtgctgcggtaagcgactccatcgagcagcagccgggtaaagcaaaagcgagcaggcaggcgagcttttgaacagtgcagagagcacatgcacagacagacaggcgggcagagggaggatcagagaaaacgacaggcggcttgtggcgcggcgcagtaaacaaatccacgcgggcaacgtttagattgcaggatgctgccgaactttttagagcctgcctgcctgatgcaatgcgatgcaatgcaaggactggacggccggcatgcacgcaccgctttagaccgagaggagatggtacgcgtgccggagccaggaggcgggagacgaggcgaggtgcgtgagggaggacgacgcagcgaggaagtgggagcagctagctgcagcagtgggtaagtttcactcaccaacttttccactcccgctcgttccttccttccttctttctttcctgtgcaactgcaacaatggcttcccttcctcactctctctctctctctatacctcactcactcactcacacggagctagctgagcctgctgcctttgctttctctctctagctacttgagtttttgttcgcttctcccacccacccacccttctcttttctccagcagcagcgggggctgggggggctttctttgaggtgtccaatccccgccggctgaaatagggcgcctagatatgcgcggcaaggcagcgagcctgcgcgaatgactgtcctgcccccgcgccccacgccgcggccagggcgagtcgccaggggcagaaccggccgccgcatcgaagggcgcactctcccccgggcaggcaggcaggcagccgtcccctcatcgccctcgccgtcgcgctggggaaatatactacgtacgtggggtgggggcccagtgtcagtcccccagcgcgtgcagcgcaggtgcagcctgcttgctggtacagtaccagcagcagcagtgggggcggcaagcaaggcagctgaccgaccggcccgccagtaggcagcaatactgactgccattgccatccatagtagtattttttacctcgccgctgtggccgacggtaacggtaaaatctttgggtacgacgagtatttatatttacttaccgctgtagtagcagactagcagcgctggttaacagcagttcttgttgttttcactgctgttatcgaattgaatacagtgtgtgatggtaggtatcactagcaaccattctctcccttcttttttttacctgtcatactaactagttctgcgtgcgtgtcttagctgatttttgttttaatttgacaatcaaatttaaattatgtatgcatataagatttgtacttttagatgaacgactgactatagccgtagacagggagacagtggatgggggcttggatcgtcggcgtataggcgtagtagatgaacgagtggtagcagtagttgggacttgggagtcggcacggcaggggcagcgcatgcagtagagcaggccgcggtggtgcgcccatgtgcccgcctgccccaggcgaccgcatcccaacaccaggcgcgaccaccaggaggatgaggagggagggactaccgactacggggaccagtgctctcgcccgcccgctctttctactcatcaatccactccctgcacggcagctcccacacccaacggccaaaggggaatgaagactaccgccgcggctacacatacgtctcgtctaccaccgcggctacacacctacacgcgtacagtacgtagtacatgtgcggtaggtaccgcaggtagcagaccggtccccgcccggttgcggtccgggccaggctccaactccgatccacccacaccagccatgctacccagcccgcgatcacccccaatctccgataagtatgcgcagttaaatacagacaagctagccctggcgcagtgcagtgctgcagcctggcggcttgcaccggtaaactgggcttacgcaagccagccatatgggcatgtcaatgccatgctaaacatgatgacatcccggccggcgcgtgcgacggaggcgcagcaggcgagttggtaggagtaggacgcgtcggcgtcggcgtccgctccgccgagcctccccgccgaagcccgaacagacctccatccatcgtcccggggccagccagcagcgtgcgtgtgtgttacgtacgtacgtacctctgggcctcgtcggtcggacggagactccacatggaagatgcagcaaacgagagcagcaataactcgcggccgtgttctcctcccggaacaccgatgcagcaagcctcgtgcgtggtccttctctcgcctgcagcggcaagagagccctagctactaccagctgctactgtgctagatcgagctcgggatggatggagcgacccaggatatgatgcatggatcggagcagtggaagtggtaatgcatggcaagcagccaccgatcggtccatgtcgctgtgaccactgacctcaccgccccccacctccgcctccgctgctctgcagtttgcaacccctatgtatatatgggacgactgtgggaggcaggcaagggggcatggaggtggcgcctggcgagaacgagatgcatggctctaccgcctctacccaaagccatggtaagtaaaaacctctctctcccggtcccgggccccgtcgccgtcgccgtcgcccatccgggggccggctaatctaaccatggccagccacggcagcagctagctgccgttgaaaaggtaagctggccatgcatgcccgccctctcactcactgcgcgtccagagcgtgctcctgcgtgcgccaccacggcacggcacctctgaagccgctgccaacgcggcacgctgcgacgggcctcggaggccgcagcgcggcgggaagggatgggacgcctgccggccggccggccagtacggtccgcttaagaaaatactcactcctactacggagtaggantactgtgctccgctgcagtgcaggggcaggccgcaaatgtactgcgtacgtactccgcgctggctataggacttgtttggcagtttattttcagcttcttcacaaatttaagcagaaattcacccaaacagctagcttctacagcagcttatcagttcagctgcttctcagaatacactaaaagcagccaacaagcagaagctgcttttcaccagcttatcagataagctgcttttgcaacaagcagcagctgtgccaaacaggaccatagttgggggccgaggccgacgggtcactttcctcagttatggcgctgcttagcttacgtgctccggccggccggtcgcctg

SEQ ID NO: 1208 - DNA, 2514 bp, Zea mays
acaagtgtgcaacggagtagagcaggaggaaagcaagcgcacggtggttgcgagagcaccagagacgcgctctccctcagcctggacctggagccgctatttatcgcacgctcacacgcaggatgcctcgctctccctcccaaggcggaagctttcttctttctgaagccttttcgctttgtgcggcggggaagccctgcgccttcgccctctcctcctcctcccgcctttatgctttccacacagcgcttgacgtgagaggggatcctccaccaccaccaccaccaccaccgctagcaccaccagtccaccaccctccctcgccgatagctgcctttcctcctcagctggaggacggcgggcccacggcgccgaatctacttttggctggcctcgctgcgcagccctgctcctccacctccgacggctcgcccgctctctcctccatcctcctcctcctcctcctccaccgctttagaccgagaggagatggtacgcgtgccggagccaggaggcaggagacgaggcgaggtgcgtgagctagggaggacgacgcagcgaggaagtgggagcagctgcagcagtgggtaagtttcactcaccaacttttccactctcgctcgttccttccttctttctttcctgtgcaactgcaacaatggcttcccttcctcactctctctctctctctctatacctcactcactcactcacacggagctagctgagcctgctgcctttgctttctctctctagctacttgagtttttgttcgcttctcccacccacccacccttctcttttctccagcagcagcgggggtggggggctttctttgaagtgtccaatccacacgaactgaaatagggcgcctagatatgcgcggcaaggcagcgagcctgcgcgaatgactgtcctgcccccgcgccccacgccgcggccagggcgagtcgccaggggcagaaccggccgccgcatcgaagggcgcactctcccccgggcaggcaggcaggcagccgtcccctcatcgccctcgccgtcgcgctggggaaatatactacgtacgtggggtgggggcccagtgtcagtcccccagcgcgtgcagcgcaggtgcagcctgcttgctggtacagtaccagcagcagcagtgggggcggcaagcaaggcagctgaccgaccggcccgccagtaggcagcaatactgactgccattgccatccatagtagtattttttacctcgccgctgtggccgacggtaacggtaaaatctttgggtacgacgagtatttatatttacttaccgctgtagtagcagactagcagcgctggttaacagcagttcttgttgttttcactgctgttatcgaattgaatacagtgtgtgatggtaggtatcactagcaaccattctctcccttcttttttttacctgtcatactaactagttctgcgtgcgtgtcttagctgatttttgttttaatttgacaatcaaatttaaattatgtatgcatataagatttgtacttttagatgaacgactgactatagccgtagacagggagacagtggatgggggcttggatcgtcggcgtataggcgtagtagatgaacgagtggtagcagtagttgggactcgggagtcggcacggcaggggcagcgcatgcagtagagcaggccgcggtggtgcgcccatgtgcccgcctgccccaggcgaccgcatcccaacaccaggcgcgaccaccaggaggatgaggagggagggactaccgactacggggaccagtgctctcgcccgctctttctactcatcaatccactccctgcacggcagctcccacacccaacggccacggacagccaaaggggaaggaatgaagactaccgccgcggctacacatacgtctcgtctaccaccgcggctacacacctacacgcgtacagtacgtagtacatgtgcggtaggtaccgcaggtagcagaccggtccccgcccggttgcggtccgggccaggctccaactccgatccacccacaccagccatgctacccagcccgcgatcacccccaatctccgataagtatgcgcagttaaatacagacaagctagccctggcgcagtgcagtgctgcagcctggcggcttgcaccggtaaactgggcttacgcaagccagccatatgggcatgtcaatgccatgctaaacatgatgacatcccggccggcgcgtgcgacggaggcgcagcaggcgagttggtaggagtaggacgcgtcggcgtcggcgtccgctccgccgagcctccccgccgaagcccgaacagacctccatccatcgtcccggggccagccagcagcgtgcgtgtgtgttacgtacgtacgtacctctgggcctcgtcggtcggacggagactccacatggaagatgcagcaaacgagagcagcaataactcgcggccgtgttctcctcccggaacaccgatgcagcaagcctcgtgcgtggtccttctctcgcctgca

SEQ ID NO: 1209 - DNA, 1029 bp, Zea mays
cggccgggaggcaggtgcattgactgatacacatatattcggctccctcggcgccggccggcagcggctagtgcgcgcgtggtgcaggcgcatctagctactacctggtgcttgttgtgcatacaatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccggagccgctgctatcatcgtcccgtacggcagcggcggcggcaatagcggcttctacagcccgccgcacagcggctccccgtcggccacctcctactcgggctccctagccttctgacttttccgggccttgacccatagttacctttacactccagtcgtcggataagaagaatgttcagcggctggctaaacagtctcaactgctgcagctattcaaattagtgttggagatgcaatttatagagataaaatactctagaagctatcgctgtagccggattaaattctgacctacttgtatagttttacacttacacagtgcaagtaataatatttaagggaagcagagagcactctacttttttacctcccaaaaaaaaaaaaaaaaaaaaaaaaaaaaa

SEQ ID NO: 1210 - DNA, 1097 bp, Zea mays
ttgggtccctcgaggccggccgggattattcaggcaggcgcattgactgatacacatatatacaacaagcaaggcggctagctacagcggctagtgcgcgcgtggtgcaggcgcatctagctactacctggtgcttgttgtgcatacaatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccgcagccgctgctatcatcgtcccgtacggcagcggcggcggcaatagcggcttctacagcccgccgcacagcggctccccgtcggccacctcctactcgggctccctagtcttctgacttttccgggccttgacccatagttacctttacaccccagtcgtcggatgagaagaatcttcagcggccggctaaacactctcaactgctgcagctattcgaattactgcagctgcaatatagagacaaaatactttagaaactgtcgctgtagccgaattaaattctgacctacttgtatagttttgcacttacacagtgcaagtaataataatatttaaggtagaagcagagagcactctacttttttacctctcgaaaaaaaaaaaaaaaatgtgatgatgcatcatcagtcatcatcactaggataattgatgacagcacgtttatt

SEQ ID NO: 1211 - DNA, 1472 bp, Zea mays
gctcggtacccttgctacattcaagcttgcctccatcactttagccgatagacccaatatcgcccatagacccagtattacctcttccatcacttacgacaacaaatgaccagtgagctatataagcgagtcattcgatacaggtcacaacacatctcccactttactagttctttatttgttgcttctaaacctagaagtaaatatcgatatacttgattttgacaaatccagtgggacctctttacctcacagaattcactgtaaaatagtaacagtaaactataatgtatatttttgtgctctttcgattaataagtcgcagcttattctgtcgtattagccaaccttctagcaaggagccgcgagaagccaaggcagagcacggtcgaactgggaactgggttaccggacacactgatgagaaaaagttttttcgacgaaaatacggaacattgtaaggctagatttctttcttctttcgcagcccatgcggcccaactcaacgcattgcgagaacaggcccgccgccacgccgcccaggtaggttttgtttgggatctcaccatttcttccttgtctctgtctcaacacggcgccgccgcttctgccgccgggagccgagcccaagcctaagcgaaagccatggcgattggttctctgatcgcctctactttcgccagatctagccatgccctccccgctgccgccgcttcggccatctctcaggctcccagatcccagcacaccgcatctcctctactctccggccttggagcagcggctcgtgctttcagctcaagggctctatggaagggagcattcgttgacgctttcctgtctagaattaagaagaacagagaaaatatgaatggcaagaagatttggtctcgtagatcctctattttgccggaatttgttggttcctctgtgctcatttacaatgggaaaactcatgtccggtgcaagatcactgaagggaaggttggccataaatttggagagtttgcttttacacggagacgaaggccccatcgaacaatgacaggaaagggaaatcaaggaaaggcaagaaagtaaaaggagaaatgtgcatgaaaggtggttttaaggatagcatgatgaggcagtagttgacgaacaagaacatgaataaccagaaattatgatctggactgctttactgctttttcttagaccaataattgcaggagaatgttagttcatcttacttaaagattcgtccgtgtactttgttcctatctacttcctgcttacttttggtgtcatgagtgaacattaaactgatcgtaagttatgctttagagtgattgtttcttgccacaaaaaaaaaaaaacctcgtggccactcaaatagcagaagttcccgacaaactgaagacaatcaataatactaatttatgcaaacagctatgatagaaaaaaaaaaaaaaacaaaaaaaaaaaaaaaa

SEQ ID NO: 1212 - DNA, 1456 bp, Zea mays
aattcgccacgatcgacagctccatcgattcatccaccgctatctctctctctttcaactgcaagggaaaccgagctcaaagtggcaaccatcaatggatattatggcgcttaatgcgagagacgaggagcagtacgggaacaaccatctcgggctcgggctgagcctcagcctcggcctcggcgtcgccaccgcggctccggtcgaggtcgagcccccgccaccgcccgcggcggcggcagcagcagcagcagcgagctatcagcgtcgcgcccatcacctccctccccgcgccgcagtggtggaagtggaacggccccggtctcttcttcgggacgacgatggatccatctctggagaggaaccagcagcagcagcagccggcggccgcgcgccacggccacgagatgccgttcctgcggggggtggacgtgaaccgggcccctgccggggagaccaggaggggtagctgcagcgaggacgacgaggagcctggcggcgcgtcgtcgtcgccaaacagcacgctctccagcagcctcagcgggaagcgcgcagcgccggcgaggagcggcggagaggtggccgaccacaccccgagagccggaggcggcagcgacgacgaggactccggcggtgggtcgcgcaagaagctccgcctgtccaaggaccaggccgccgtcctcgaggagagcttcaaggagcataacacactcaaccccaagcagaaggcggcgctggcgaagcagctgaacctgaagccgcgtcaggtggaggtgtggttccagaaccgcagagccaggacgaagctgaagcagacggaggtggactgcgagttcctgaagcgctgctgcgagacgctgacggaggagaaccggcggctgcagcgggaggtggcggagctgcgcgcgctcaagctcgtggcgccgcaccactacgcgcgcatgccgccgcccaccacgctcaccatgtgcccctcctgcgagcgcctcgcctccgcgtccgcgtccgccgaccaggcgggccgtgcagggccctgctggggccctctccccgtgttcgtcgacggcccagcccggaggccgtgatccacgaccacgatatggcatgagatggatgcgcttgctaatcgctaccgctagctaagtagctagtgctaattagggctggatcttctttttttctttgtttggttcttattatactcgcaggctattacagcttagtagtgtttattagtccgatatgataaaaatcttcgttgtttggcagtgttttatttgctgaaaaatagataacgatgtcttatgtctttgtactcataagtgatgcaaaattgtcttactactactttgcatatataaggtttcagttgttgaccgcacaaaaaaaaaaaaaaaaaaaaaaaaaaaaaaaaaaaaaaaaaaaaaaaaaaaaaacaaaacgaacgggggacgcg

SEQ ID NO: 1213 - DNA, 1490 bp, Zea mays
cgagaccattacctagaacatcctaatcgaaaaggttccattactggtccctagcaggaagcaggatggagttggcgctcagcttgggggagaccatggcggatgccggaagggacctcatgctggggcttgggatgggggtcggggtgcggagggaggaggaagcgcagagagggaggagggacagggaggtgaggcgggagctggagttcacggcgaggagcgcccggtcgtcgccggagccggcggtgcgactcaccctcctgcacggcctcggcctcccgtggccgccgccgccgtcgtccgagaccaaccggcacctggaggcgtcggcgcgtggcttcgacgtgaaccgggcgccgtcgctgtccgcggccggtggcgccgcggaggaggacgaggagcaggacgaggcggcggcggcggcggcatcgtcgtcgcccaacaacagcgcgagctccttcccgacggacttctccgcgcagggccaggtggcgcccggcgccgaccgcgcgtgctcccgcgccagcgacgaggacgacggcggctccgcgcgcaagaagctgcgcctctccaaggagcagtccgcgttcctggaggatagcttcaaggagcacgccacgctgaacccgaagcagaagctcgcgctggcgaagcagctcaacctccggccgcgccaggtggaggtgtggttccagaaccgcagagccaggacgaagctgaagcagacggaggtggactgcgagtacctcaagcgatgctgcgagacgctgacggaggagaaccggcggctgcagaaggagctatccgagctccgctcgctcaagacggtgcaccccttctacatgcacctcccggccaccaccctttccatgtgcccctcctgcgagcgcgtcgcctccaactccgcgccggcgcccgcgtcatcgccgtcccccgctactggcattgcggccccggcaccggagcagaggccctcgtcgttcgcggctctgttctcgtcccctctgaaccgcccgctggccgcccaggcgcaaccgcaaccgcaggcgccggccaactcgtgaggcgctctctactctatctccggcgacgcgaacggaggtggatctggctgtaaatacgatcacctttttttggcttcctttttcttttgttttcacttgatgcggttcttgagattttttttttgtggattgccgatgggttggtttaccggtttattagagcgcatcatctggccgtcggattggactgcggacggccgggtgcagaaaggaagtgctgcgatagagtttattaacctcagtagcatcgatcatgttttgttaccttgctatctatcttggcgtcaatataggccttgaaatccgaagttaccctgaaaatgatgaaatgggtggtgtcaccatttaactgtcaaaaaaaaaaaaaaaaaaaaaaaaaaattggtctaattgccttttaacggatacaagcatatatacatt

SEQ ID NO: 1214 - DNA, 1783 bp, Zea mays
cattgggtacctcgcgggcgggggggaccatttcattccttccttccttcccctcgctcgccttcctggcttcttcctccccagcacgcacacgcacacgcacacacccagccttttggctgccctgccggccgtcagagagagaaaccgagctctaactaactgaagtggcggccacatagctagctactcttctgatcctgagcgcgcacgcgccatggctcaggaggacgtgcacctggacgacgcaggcctcgcgctgggcctgtccctcggcagcggcagcggcggcgcctctggtccggcgcgccacggtggtatcagccgccggctgagcagggaggtgcggctgccgtcgccgcacccgctggagccgtcgctgacgctgagcttgccggacgaagcgaccgcgaccgggtccggcgggggcggggccgcgcacagcgtgtcgtcgctgtcagtggcgggcgtgaagagggagcgcgtggatgacgccgagggagagcgggcgtcgtctacggccgcgttgccgcgggcctgcgccggcgccgaggacgacgacgacgacgggagcacgcggaagaagctgaggctgaccaaggagcagtccgcgctcctggaggaccgcttcaaggagcacagcaccctgaacccgaagcagaaagtcgcgttggcgaagcaactgaagctgaggccacggcaggtggaggtgtggttccaaaacaggcgagcaaggacgaagctgaagcagacggaggtggactgcgagctgctgaagcgctgctgcgagtcgctgacggaggagaaccggcggctgcagcgggagctgcaggagctccgcgcgctcaagttcgccccacacccacaggcgccgccgtcgtccgcgacgcaggccggcgcggcggcgggcgtcgttccggcgccgccgccgccgttgtacatgcagatgcagatgccggccgccgccacgctgagcctgtgcccgtcctgcgacccgcctggccgggccggcgggcgccgccgccaaggccgagcccaggcccgacaggcccaagaccgccacccaccacttcttcaaccccttcacccactccgccgcctgctgatgatgagggcagggcagcacgcagccacgcaacgcagcggcagtaaacagagccccgccccgtgcagataataccacgtctgtacgtgtcccaagtaattaacaaacgtatggtcctcctctctatctattttcttgattccggagggctaagttagttgttttcgtgtcgatcccaaatgcatcagctaatccatcaatcataggcttgatagagtagtcgaaaaaaatagccgtagctttcctagcactccctccgccccccccccccccccccatccatgtatatttctgttgtaattctgtccctctctcgcggtccacttgctcccttttcgattggagtacgtagctcctttgcctttttgtttttggttttttgtttctgtttctgtttgagacaggttaatataatcgccgtcgtccgagggtgtagtgtcagggattgatatccctgtacaccgattattggattgagatgcttctagctagtcttcgtactgataagcgtgcgtgcgtacgtcagagcaccacagtgctggaatggatgatgacatgagagacaggtagagaagcccagctgcgtggctcttggacctttctgcaggtgtacgtggtgtgtacacacgcacacccttttttatagtacatatatacggctcaaaaaaaaaaaaaaaa

SEQ ID NO: 1215 - DNA, 788 bp, Zea mays
cacacgcgcggaccgtccggccccagggcgcggaccgtccggacgtcaggcaggaaaacctagcccctgcgccaggtcgcggaccgtccggccccaggccgcggaccgtccgcgcctgaccagagagcaccgccgccggttcttcttgagtatttggcgctccgaaaaggcgtcaacaattactattactgcgcactccgctcccttcctcctctcttcttctccggtcatcttacgttgcgtggctgacgagtcgagggcgccgtgcgcgcgcggcgacgcatgcatgcagctgcggcgcgtgcgggtacgacctgcgcctgcggtcgtccgaccgcaacacggcggggatcgtgggcgccggcggcgcggcgtacggacgcgcggcccggcgcggggtcgtggcgttcgacgccatcgacgacgcgcggttcgggcacgccgacgagttccgctgcgtcgacctgcgcgcgcgtcgcctcttcgtgcgccgcacccgcctgctctgccgcaagtgcggcgccggcctcggcttcggctacgacgaccgcggtcaggacggcgccaggcccccgcgctacgacatcaagatccgcgcgctccagcccctggcagcagacgacgaccaccaccaccacggcgacgcggccgcaccgccgacgtcggatgcatgatccttccttcttccgttccgtcctcggtgggcgtgtgcttgcttccctgacacgttagctgctggattttttttttctctgtctgtctgtctgtctgcaagaaagtcactcgct

SEQ ID NO: 1216 - DNA, 3697 bp, Zea mays
  misc_feature (3100)..(3100): n is a, c, g, or t
  misc_feature (3227)..(3227): n is a, c, g, or t
  misc_feature (3547)..(3547): n is a, c, g, or t
tgtacatctagtgatatacaaggatttgtgatattttatttgataatttaattgtacgatatttttgttaaatatcgtagataccgtagtatatcgcgtatcggtttcgctagtgtccaacggacaaattaaacgacgacgtgccgtcgcacactctagaaaatctcccggcagaagcagacatcagctaatggacaacgctgatgtctccgggcgtctatattaatccatctggcatctgtggccggtagcatcgacatcgatcgatcggcaagagggctaacggagtccaagaatcagtttagacgccgggccgccagctcgaaatttccaaaaaagaaaaaaacattattgatccacagctggctattccaaatcaatcaatagtggcggaccaattatatatggtcaaccccctcgccattgccggcaagcaaggtatctgtctccccgttttatggcttgttgatcaggccgtcttcgctcgctgaccaccaccgcctcgctcgtcgagcatatagccatgccatggcaagcacaggctcagagggatagataggtccagtgcaagcgcgcaggcatcgtcatccagggagggtggtggcccgtggtccacatcgatgcgatgccggttcacgttgcgctcctcgccgtgccggcggtggccgctgggttcctgcaggcgttccagttcgcgttcctgctgtggcccttcaacctggcgctgccgctggcgcgccacctgccgcaggcgtgcatcgcgttccgcggggtcgcgtccttgtacggagccgagctgcggcggtacgcgggcgccgccgcccgggccgccgtgcccgtgctgcagccgccgagccaccaccggtacgcctcgctccgcgccgtgcagcagcgggcgcacggggatgccgtcgtcgcgcacgccatggtcgcgctcgtcgacatctcctactgatgccggccgcttgcatcgcgactccgggcgcacttccgggcgattcctcagccttttagcatgccgtcccgagtgtaaataaaacaatatatacctgttcttcctccctaccttcgtcagctgaggtgtgtagtttgtttcttcaccatggacctgtggcgagcttcagtgtgtacaagaccggaattcgagttgcttgatgtgcctcctgttgaagtcacatcaattctagtactagtatcttgaactacattgcgaaaaaaaaaaaaaatgtcaattctgtacagtatgtcatttgaagctactaatcagcgaacggtcgtaaaaaaacagcgaactatcagataatacgtaacttatccttttaggaaaaaaaacaaacatctattagaaagaaacaaaacagaggtacaacatgaaaatacaatcaagagagctattatccagagactgtacttaaaaataaataaagaacccatcgataaattccagcaaaaatgtgaagactcataccccatcacaagaataaacatgctaggatcttttcacctggtaaaaatgaatgatgaagagcttaacatctcaaagcgttacgaagatactatccataagtacttaattttattgttattagtagatgttctttttaatttcgattcaattgtaaacgagttgcactcgtgttgcactcaggagaaaacctgcttgtcgcactgagtgatttttaactaggcaaactctattgtaattctcatcggatagaattgagatcacttctctaaaaactatctgaataaaaaaaagaagggtatccaatatatacccaatcattggcaagcaaaaacttatatgcatctataatctccgtcccaacaaacaatattttgctttcctatcaggaaaacttaccttaataaatctcttagaggcagacctgtaataagcaacaaccaaagttgtaaggactaaggagcaaaggtttttaagaaagggaaatgctctgcgccgcgtacgaggtacgactcatggcgtccaactcttatacgactatctatattttttatgtatctagatctagacccacatgaatggctgctttagaggagtcgaacatgtacagtcgtactcgtacatatagcactactctttaactctcttgggccgcaatgcgagtgttgggccgtctaactctcttgggcctgaacgcggactcagcttcattatcagtagctccttcggtgcgagcaacagagggtagggtaggctctgctcgcagacacctccccgccgatcagtcgctcgccgtccgcccggccggcttgacgtacgctgcgacctgctccagtgctccggcgtgctagctttttccttttccgggcttttggcatttcaccgctttatcgggattgacacgacctcttttcactaatcccacagcacattgtacagtactacatcatcccacccgtaccaggaactaaatgtttattaggttttaatttaaaacatgtaaaaaagtggtgttttagttcttgatattaggttgttgggtccatatatatatcatcagatcaagatcaaggcttcaataatgcatctatatattttcaaggcgattttcatcgaacacttgtttgttcgagacaagaactttaatacaattcacatacgcatgctgctgcatatgcctgtgtgttaatccccataatgcatgtagagctcactcccctggcctctctccctcatcagccagcccggtcctcttgttagtaacatcattactggggagtaaaagcccgaccgatttgacgggcccccgacacactgcatctgcatgctgcattggtgtgccatgcatgcattgtgtgtgtgtgtgtgacactactcccctcatcagacattgctttgcttgctagtaggagtacttcaaagttactaagcccgactgtctgatcgatctcatgccaggaccagcccatgcacgcatgcatatgtaagatcaaccagtcgtgattacgagaaccacctgcgtctgcgtgcaaatatatatatgctaccagtctctttcacatggaaacatatgcatttgcacgcacctcgttttcctgggtgtacccggcaacttccgcacgagaatgatgcatntgcgtaccagttatgtctgctaatttgcatgtcatattagcttccttttctcctgttgctcttctgcctgctctttttttagctgggttattaatcggtttaggttaatcagcaaagccggggaatnagtatacatgtttttttgtcggcgtggtgggatataatcctctacagcatgtcagcatggtactgtttatctacatgtgttagtctcaaacaaggcatatacactggtgctgtcagggagattcaaaattgcaagcatcacaacacaaaagacacaagcaatttctttatcagagttcggttttcaaaggaaacctacgtctctgttgagctgtctctaaagacaggtctctttcaaccctcttgagcggttccaaatataagttcaagccctctctttattctcaatcgaaggaccttagtctccacaaagaatggaanttgaaacacaagcacaagagcacaggaatgcaacattcaactcaacacgatcacccacacaaggcactttctctagcttaaatctcttcaatatagcacttgcgaggctttagatggcttaaagttgttgcgatgaatgtatgaaggttt

SEQ ID NO: 1217 - DNA, 978 bp, Zea mays
  misc_feature (942)..(942): n is a, c, g, or t
  misc_feature (948)..(948): n is a, c, g, or t
tttttttgggtttgggtttgcggcaacgcccgtgcgcgcatcgacctttgattccttcgcatatccccaaagcaagctcgagtgaagaaactcacgaaatcagaagccagctgagttgccagcgacgagcaaaccaagggagggagagaggcggatggggcagtgcccgtgtttcgggtccgtgaaggcggcggagcaggagcggcgggaggaggcggaccggcgcgagtcgcaggatgctcgcgccaaggccgccgaggccgcgcagaggagacagcaggagtatgagaaatcggcagctggaagggcagccaaagcacagatgaaagcaatgaaggaatcaaagacatcaaaccaaggtggagagccggttcttaagtggcagatgggatcatgagtttcgtttctgttgatttgcatccctccgcttacttttgatggccgacagaaaattgattgcgactaatttctgataggatgcactgtgattgtgtgattatgccagtgaagtgtacatccggtttaccatctgctatgctgtacatgctatcccatagactgcccaacttcccagttaaaagtcacaagtttgtgttgtgtaaatgaacaaaatatatattttatgaacacatgtagtctcgtagcatttgcatggaggcttttaccccacttcatagtatttttcaaagccatgtttcatagtgcgactacagtactgaattctgctgcagccttctttttttcccttcacatcatcaagcatccccatggagattctcatatgtaccatgttctgttagctgatagcttatcaagctttggtatatgaaatgctgaacactcgttgcactttacatggattgttttaatttgagtgttactccatagttcctgagaatcatggaccaagtttgtgtcattgaacgttcacgtggatatcanatcgtnctcattctgcttgggcccctgaggtatgcg

SEQ ID NO: 1218 - DNA, 1000 bp, Zea mays
cgccctcgtcccggccccgaccgggatctgcgcggcccagttactacagcgaataggcggcccatcaggtcacgttccgtcccgacgtagagtcgccagtcctcccacaatctccagccgccactacgcctccctctagctccagccgccactacgccggtcgcagagtcgccagctgcctagacgcccggaggcccgcgggcgctccctcctgggctgctggcctccttcacattattggagccagaggagcgggcggcggcttgcactccatcccatcgcttgggtgcgtcgccccgaatccaatcgcctggtcaagtctgttgctgccggaggtagacggacgccttatcgtgctcgtggccgcagctagcgcgccggagccacagctggagcgctcgccggcgacgagtcgccgccccgcaaggagcctacgcaggcacgcaccgccacgtctaggcgccaggcggagacgttattaccacaacattaaaggagatgccttcactccagaaagcattgcctccagaacttgctgataatgtgctcaggttatatcgtgaatgcttacggagggcgaagtatattggccatcagaaacacaatacagaacttttagtcgccatggtgagacaacaattcaagaaaaacatgcatgaaactgatccagagaagatacagaaaatgaaggacgatgctgcaaggggccttatcaatcatattctatatgagtccgagaagattacaggacgcaagttttcaggttaaaaacagaagttgaaactggacttacagtgtgtcgtgctgtatgaataatagtaaaaataatttactttcttgcctttgaatgattccggttctattgtacaaggacctgcaaatgttttttccttcggattgctgagtactcgagctattgcagcaatgattttcagtaaccaagagttggctgtcaaaaaaaaaaaaccgataaatgctgactacaaatcattttggatac

SEQ ID NO: 1219 - DNA, 849 bp, Zea mays
cattgggtacctcgaggccggccgggacgcgccgccggccgggagagtcgccagtcctcccacaatctccagccgccactacgcctccctctagctccagccgccactacgccggtcgcagagtcgccagctgccgagacgcccggaggcccgcgggcgctccctcctgggctgctggcctccttcacattattggagccagaggagcgggcggcggcttgcactccatcccatcgcttggctagcgcgccggagccacagctggagcgctcgccggcgacgagtcgccgccccgcaaggagcctacgcaggcacgcaccgccacgtctaggcgccaggcggagacgttattaccacaacattaaaggagatgccttcactccagaaagcattgcctccagaacttgctgataatgtgctcaggttatatcgtgaatgcttacggagggcgaagtatattggccatcagaaacacaatacagaacttttagtcgccatggtgagacaacaattcaagaaaaacatgcatgaaactgatccagagaagatacagaaaatgaaggacgatgctgcaaggggccttatcaatcatattctatatgagtccgagaagattacaggacgcaagttttcaggttaaaaacagaagttgaaactggacttacagtgtgtcgtgctgtatgaataatagtaaaaataatttactttcttgcctttgaatgattccggttctattgtacaaggacctgcaaatgttttttccttcggattgctgagtactcgagctattgcagcaatgattttcagtaaccaaaaaaaaaaaaaaaggccgcccgcctccgcggtggt

SEQ ID NO: 1220 - DNA, 2245 bp, Zea mays
ctgggccgttactagcttagctcatatacgtacgtacgcaggctgcaagtgatcgagaggagcaatataatggctggttcttccatggacactgaagctgcaggcaaggagctcaagcagggcagcggcggcggcggcggctacaccatgccggctactgctcatgcggtggacacagactcgtggcagcaggtggggctgctcctggtgatcggcttcaactgcgcctacgtgctcagcttctccaacctcatgatggtgcccctgggctgggcgtggggcgtcgcctgcctgctgctcgtcggcgccgccgcgtggtacgccaactggctcctcgccggcctccacttcgtcgacggccagaggttcatccgctacagggacctcatgggcttcatattcgggaggaacatgtactacatcacctggttcctgcagttcgcaactctacttctgtgcaacatgggcttcattttgctaggagcaagagcgctcaaggcaatcaacacggagtttacccacaccccagccaggctgcagtggttcatcacggccacgggaatcgtctacttcgccttcgcctacttcgtgccgacgatttctgccatgaggaactggctcgccacgtcggcggcgctgacgttagcttacgacgtcgctctgctggctatcttgatcagagatgggaaatcgaacaagcagaaggactatgacgtccatgccggatcccaagccgagaaggtgttcaacgcgttgggcgccgtcgctgccatcctcgtctgcaacacgtccgggctgctcccggagatacagtcgacggtgcgggagccggcggtgcgcggcatgaggcgggcgctgctgctgcagtacaccgccggcgccgcggggtactacggcatcagcgtggcggggtactgggcgtacgggtcagcggtgtcggagtacctccccaacgagctcggcggcccgaggtgggccgccgtcctcatcaacgccaccgccttcctgcagagcattgtgtcccaacacctgtttacggtgccgatccacgaggcgatggacacgcggctgcagcggctggacgaaggcatattctcccgctacaacctcacgcgccgcgtgcgcgcgggggctcgtcttcggcttcaacgtcttcgtcaccgcgctgttcccgttcatgggggatttcgtcaacctcgtcggctccttagcgctcgtcccgctcaccttcacgttccccagcatggccgtcctcaagatcaaaggcaagagctgtgggagatgtaacagactttggcattggggcatcatagttctgtcctcggctctctgcgttgctaccaccgccgccgccgttcgtttgatcttcaacaatgctaggatctaccacttcttcgccgacatgtagcgagcgagtagtagtgggattgacatgtgtatcgtcaccatgaggtgatagtatggccacttcgttctcaattttttgtttgcttcaagagtggaagggtacggtggtcacttagctcatgtttgataagggcactacatgattaataagcatgcatcatgtacgtagtcatcctatcaaaatttagaaatgagcttattgtaatcgatggaccacctccctctaaccaaacatctctgttttccgtgaaagcttaaaaggcaactcgtgaatgtgttcttttagacacctcatgcctattatttcttggaagtatagaataatgttgagagttgtaaacatacatgcatgtcgcatctagcccttttgtctatcacacgtgtgctacctgtagactaattgcattatagtgtgactcttgggactcagactcatgattatatataaaaagtattgaaattgaggtgtcttaaactagtaaatcgaagtggaatgtataaaaagactaagggtgcatttggttggagagtcaattagaatggagcggctctattttatttctttagaattaagtcattctatttcgcgtttagcatacagatcagccgctccattttttatttggttgaagagttcaatagaacggagccgctccattctttgtttgtttgcagagtcatatgagtgtatagggtaggacagggaggagaaagctcgcatccgattgtttttgctgaacaggagtattccaactatctatggttcgagccattcagtccatcaacatgtatagtggctctctctctgatcaatgggccattatacatttagtcccat

SEQ ID NO: 1221 - DNA, 1485 bp, Zea mays
gtctgcgagatctcgattcgtctggaagacatcgctactaccccagccacagtacccattgggtatttatctgctcccttgctgaagctggaatgtgcagctcgatcggttagcgctacgagtcctcgctgaatccagccaaatgatccccttgagcttgccagttagagcacgcacctaatataatgctggccttccgtcagaagtaacagctagctaagagaagcacaagaaaaatctggtagcttgagttctgactcgaactcagagatggcttatgcaagccccgggactgatgatacgtcgacagatctagatactgacgagaagaatcacatgttggagctagggcagcttgtgtcccttacagcttctgattccggcaacaaagcaaaggacaagctactaggtcaaaaggcactgcgccgtctggcccagaaccgtgaagctgctaggaaaagccgtctaagaaagaaggcatacgttgagcaacttgagaatagcaggctgaaacttagccagctggagcaggaactccagcgtgctcgccaacagggcatcttcattcctactccgggagacgaccagcagccaaactctactagtgaaaaaggtgctttggcgtttgacaaggactacgctggatgggaagacgagcacaggaagcagataagcgagctgagggccgcgctcagcgcacacgccggtgacgacgagctccggcgcatcgtggacggcgtcatggcgcatcaccacgaagcgttcaggctcaagtgcgtggcagccagggccgacgccttccacgtgctgtcggggatgtggaagacccccgtggagaggtgctttatgtggctgggcggatttcgaccgtcagagattctaaagttcctcgcaagccatctggaccccctcaccgagcggcagctcgcgagcgtacacggcctgcagcagtcctcgcagcaagccgaagagggcatctcgcagcgggtgcaagcgctgcagcagtcggtcgcggagaccctcgcgtcgtcagggtccccgtgcctgcctgtgcctgcaggtcgtgctcctccgcctggcgacgacgccgctccagactgctcggggacgatggcggcggcggttgcgaagcttgtcgctcttgaaagcttggtgcatgaggctgacggtctgcggaggcagactcttgagcagatgcagcgcgtgctgaccacccgccagtccgcgcgggcgctgcttgtgatcagtgactacctttcccggctacgcgctctgagttctctctggatcgcacgaccacgggaatgaattcagctcggcttatgtatctttgtttgacccggccgtggagaaaaataagaatcgaagatgcctccgctccttccatcatcactgcatgtaattgtaatctgaacatcattataaacagccgtaaccgttggccatcatcagggttaaaaacgcaaaaaaaaaaaaaaaaaaaaa

SEQ ID NO: 1222 - DNA, 1263 bp, Zea mays
  misc_feature (694)..(694): n is a, c, g, or t
cattgggtacctccgagccggccggtcctctcttcttccaccaccacctcctactccgctgcaaccccaaatctctccttcctcgcatacgcgcgcagcggaggagctgagaccaacgaagaagaagaagaacaaccgagcaagcacaagcttagctagcgtgtaggtgtccaaggcgacgacggccgccgcgccaggctagccaaccagctgctcatcgctcctagctgcggagccgatatggctggcgccgacgtcgacgtcgggacggagctccgtctcggcctgccgggaggaggcgccgatgcggccaaggctgccaagaggggcttcgaggacaccatcgacctcaagctgaagctgcccaccgccggcatggaggaagctgccgccgccgccgccgccgccgccaagcccgagccggcagccgagaaggccaagaggcccgccgaggcgccggccgctgatgccgagaagccacccgcacccaaggcacaagctgtgggttggccaccagtccggtcataccgcaggaacgtcatgaccgtccagtctgtgaagagcaagaaggaagaggagcctgagaagcagcagtccgctgccaacgccggcggcaacggctccgccttcgtgaaggtcagcatggacggcgcgccctacctgcgcaaggtggacctgaagatgtacaacagcntacacggagctctccgttgctctgaagaagatgttcagcaccttcaccacatccgggaacaacatgaatgagggaaaactggttgatccggtcagcggtgctgatgtggtcactacttacgaagacaaggatggcgactggatgctcgttggcgacgtcccgtgggagatgtttgtcgagtcatgcaggcgtctgaggatcatgaagagttctgaagccataggtcttgcaccaagaacgaaggacaagtgcaagaacaggagctgaagaagatacagcgttaaagacgctgcccattgtgtcaaaagaatggtgcccttgcagtgtgctgcggtttttctagaaatataatgcgttttaattactagttggagggagacctgtcttgttcaatttgttcatggaccagaagcaataatctatctgtgtgtagctggattggtgttatgcgatgtcccctaccgtgtcccagaatctacttggtgattttatcccagtgttgttaatcaagcttgtgtgattgttaagtaaagggcatcaatgagactattacaaaaaaaaaaaaaaaa

SEQ ID NO: 1223 - DNA, 1304 bp, Zea mays
acttccatctctctctctctctcttccatcctcatgctccctctatatatacacatctccaccctgttcctgggtcctctcttccacccactgcaaccccaaatctctccttcctcacacacgcgaagctgagagaccaaagaagaagaagaaggagcgagcaagcagaaagttagctagagctgctagcgtggaagtgcccaaggcgagagagaggcaagctagctaggacggccgcgacaggctagccagccagctgctagctagctcctgcggacgaggcgatggctggcgccgacgtcgacgtcgggacggaactccggctcggcctgccgggaggaggcgccgcggcggccaagaaggacaccaacgacctcaagctgaagctgcccaccgccggcatggaggaagctgctgctgccgccgccaggccggagccggcagccgagaaggccaagaggcccgccgaggcgccggccgccgatgccgagaagccacctgcacccaaggcacaggccgtgggctggccaccagtccggtcgtaccgcaggaacgccgtcgcgtgcgccgtcccggccgtgaggaccaggaaggaagaggaacctgagaagcagcaacagcccgctgctgccaacgccttcgtgaaggtcagcatggacggcgcgccctacctgcgcaaggtggacctgaagacgtacggcagctacaaggacctctccgctgcactcaagaatatgttcggcaccttcaccgcatctgggaacagcatgaacgaggggagattggttgatccggccggcgatgctgatgatgtggtcactacttacgaagacaaggatggtgactggatgctggtcggcgacgtcccgtgggagatgtttgtcgactcatgcaagcgtctgaggatcatgaagagttctgaagccataggtcttgcaccaagaacgaaggacaagtgcaagaacaagagctgaagaagatgcagtgttaaagatgttgcccattgtatcaaaagaatggtccccttgcagtgcgctgccgttttttttcctactagaaatataacgcgttttaattactactagttggagggagacctgtcttgttcaactcgttcatggaccagaagcaataatctatccgtgtgtagctggattggtgttatgtcatgtcccctaccgtgtctcccagaatctacttggtgattttattccagtgttgttaatcaagtttatgtgattgttaagtaaagggcatcaatgagactattattatttattattatggtaaataaatgtggtcaa

SEQ ID NO: 1224 - DNA, 1472 bp, Zea mays
cctcgaggccggccgggccggggaccgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcacggcacccccgggccggccgggcctctcttcttccaccaccacctcctactccgctgcaaccccaaatctctccttcctcgcatacgcgcgcagcggaggagctgagaccaacgaagaagaagaagaacaaccgagcaagcacaagcttagctagcgtggaggtgtccaaggcgacgacggccgccgcgccaggctagccaaccagctgctcatcgctcctagctgcggagccgatggctggagccgacgtcgacgtcgggacggagctccgcctcggcctgccgggaggaggcgccgatgcggccaaggctgccaagaggggcttcgaggacaccatcgacctcaagctgaagctgcccaccgccggcatggaggaagctgccgctgccgccgccgccaagccggagccggccgccgagaaggccaagaggcccgccgaggcgccggccgctgatgccgagaagccacccgcacccaaggcacaagctgtgggttggccaccagtccggtcataccgcaggaacgtcatgaccgtccagtctgtgaagagcaagaaggaagaggagcctgagaagcagcagtccgctgccaacgccggcggcaacggctccgccttcgtgaaggtcagcatggacggcgcgccctacctgcgcaaggtggacctgaagatgtacaacagctacacggagctctccgttgctctgaagaagatgttcagcaccttcaccacatccgggaacaacatgaatgagggaaaactggttgatccggtcagcggtgctgatgtggtcactacttacgaagacaaggatggcgactggatgctcgttggcgacgtcccgtgggagatgtttgtcgagtcatgcaggcgtctgaggatcatgaagagctctgaagccataggtcttgcaccaagaacgaaggacaagtgcaagaacaggagctgaagaagatacagcgttaaagacgctgcccgttgtgtcaaaagaatggtgcccttgcagtgtgctgcggtttttctagaaatataatgcgttttaattactagttggagggagacctgtcttgttcaatttgttcatggaccagaagcaataatctatctgtgtgtagctggattggtgttatgcgatgtcccctaccgtgtgtcccagaatctacttggtgattttatcccagtgttgttaatcaagcttgtgtgattgttaagtaaagggcatcaatgagactattattattatggtaccttgtaagttaacctgtttgttaaaaaaaattataataggtgccaagaggggaaaacccc

SEQ ID NO: 1225 - DNA, 1427 bp, Zea mays
ccccgcgtccgactgggctcactcatgctccaactaactgctaagttgcaaccccactcccatttctatctctctcctcctgccatcaccctagaataggagcatttacctccgctttctctctctccctctcttccatcctcatgctccccctcgagggccccttcggcaccccgaggccggccccgctcttccacccactgcaaccccaaatctctccttcctcacacacgcgaagctgagagaccaaagaagaagaagaaggagcgagcaagcagaaagttagctagctgctagcgtggaagtgcccaaggcgagagagagagacaagcctaggacggccgcgccaggctagccagccagctgctagctcctgcggacgagccgatggctggcgccgacgtcgacgtcgggacggagctccggctcggcctgccgggaggaggcgccgcggcggccaagaaggacaccatcgacctcaagctgaagctgcccaccgccggcatggaggaggcggctgccgccgccaggccggagccggcagccgagaaggccaagaggcccgccgaggcgccggccgccgatgccgagaagccacctgcacccaaggcacaggccgtgggctggccaccagtccgatcgtaccgcaggaacgccatgacgaccgtcgtccaggccgtgaggagcaagaaggaagaggaacctgagaagcagcaacagcccgctgccgccaacgccttcgtgaaggtcagcatggacggcgcgccctacctgcgcaaggtggacctgaagacgtacagcagctacaaggacctctccgctgcactcaagaagatgttcggcaccttcaccgcatctgggaacagcatgaacgaggggagattggttgatccggccggcgatgctgatgatgtggtcactacttacgaagacaaggatggtgactggatgctggtcggcgacgtcccgtgggagatgtttgtcgagtcatgcaagcgtctgaggatcatgaagagttctgaagccataggtcttgcaccaagaacgaaggacaagtgcaagaacaagagctgaagaagatgcagtgttaaagatgttgcccattgtatcagaagaatggtccccttgcagtgcgctgccgttttttttttcctactagaaatataacgcgttttaattactagttggagggagacctgtcttgttcaactcgttcatggaccagaagcaataatatatccgtgtgtagctggattggtgttatgtcatgtcccctaccgtgtctcccagaatctacttggtgattttattccagtgttgttaatcaagtttatgtgattgttaagtaaagggcatcaatgggactattattatttattattacaaacaaggtgcgtggccgccgcgttttcccttctttcttcact

SEQ ID NO: 1226 - DNA, 1347 bp, Zea mays
ggaccctcgaggccggccgggaactgctaagttgcaaccccactcccatttctatctctctcctcctgccatcaccctagaataggagcatttacctccgctttctctctctccctctcttccatcctcatgctccctctatatatacacatctccaccctgttcctgggccctctcttccacccactgcaaccccaaatctctccttcctcacacacgcgaaggtgagagaccaaagaagaagaagaaggaggagctgctagcgtggaagtgcccaaggcgagagagagacaagctagctaggacggccgcgacaggctagccagccagctgctagctcctgcggacgagccgatggctggcgccgacgtcgacgtcgggacggaactccggctcggcctgccgggaggaggcgccgcggcggccaagaaggacaccatcgacctcaagctgaagctgcctaccgctggcatggaggaggctgctgccgccgccaggccggagccggcagccgagaaggccaagaggcccgccgaggcgccggccgccgatgccgagaagccacctgcacccaaggcacaggccgtgggctggccaccagtccgatcgtaccgcaggaacgccatgaccgtcgtccaggccgtgaggagcaagaaggaagaggaacctgagaagcagcaacagcccgctgctgccaacgccttcgtgaaggtcagcatggacggcgcgccctacctgcgcaaggtggacctgaagacgtacggcagctacaaggacctctccgctgcactcaagaagatgttcggcaccttcaccgcatctgggaacagcatgaacgaggggagattggttgatccggccggcgatgctgatgatgtggtcactacttacgaagacaaggatggtgactggatgctggtcggcgacgtcccgtgggagatgtttgtcgagtcatgcaagcgtctgaggatcatgaagagttctgaagccataggtcttgcaccaagaacgaaggacaagtgcaagaacaagagctgaagaagatgcagtgttaaagatgttgcacattgtatcaaaagaatggtccccttgcagtgcgctgccgttttttttcctactagaaatataacgcgttttaattactactagttggagggagacctgtcttgttcaactcgttcatggaccagaagcaataatctatccgtgtgtagctggattggtgttatgtcatgtcccctaccgtgtctcccagaatctacttggtgattttattccagtgttgttaatcaagtttatgtgattgttaagtaaagggcatcaatgagactattattatttattatt

SEQ ID NO: 1227 - DNA, 1502 bp, Zea mays
tcgtaggacgttacaagcctctacagtgagtcgtattatatccgacgccacacgaaacgaaacacaagagaagagagaagagaatagagagaaggtcgaagggctagacccggtcccccaattccaattcgcccctctcgcggccggcctcgcgagacgccgattcggatcccatctcctgctcagagcctcgattcgaccggcgggggcgacgattcgaccgggtcggtagccaggcagaggcagcggaaggagaggatgagcttccaggacctggaggcggggcacgtccggggggcgccgctcggcggcggccggaggaacggcaggggccccgcgggggcggggggcgccggcgccggcgcgtcgcaggccgtggcgtcgggcgtcttccagatcaacaccgcggttgccacgttccagcgcctcgtcaacacgctcggcacgcccaaggatacccccgacctccgcgacaggatacataaaacacggcaacacataacacaactagtgaaggatacatcagacaagcttaaacaagctagcgaggcggatcatcgcgttgaagtcagcgctaccaaaaagattgctgatgcaaagctagctaaagatttccaagcagtcctaaaagaattccagaaagctcaacgattagcagtagagagagaagctgcatatgcaccttttattactcaagcgggcctgccacagagctacaactcaagtgaagtgaacaatggtgctgataagttggcagagcagcgcacgcagcttctagaatctagaaggcaggagttggtcttcttggacaatgaaatagtgttcaatgaggccatcattgaggagagggatcagggaatacaagagattcaacaccaaatcactgaagtaaatgaaatcttcaaagatcttgctgtgctagtccatgatcaaggagcaatgatagatgacattgattcccatatagagaatgctgttgtagcgacttcgcaggctaaaggtcagctttcaaaagctgccaagactcagaagtcgaactcttcgctgatatgcttgttactggttatcttcggcgtggtcctgctcatagtgataatagtacttgcagcataaaagcttggaaggcagctgaggttccgatgatcgagcttattgcgatgaattccttattattattttttttgctgtgcagccaggaatggatcctggcatccgcctggatgtatccaggcggtgattggtgatgtgcttgtggtatggctgtgtatttggtgatgatgtatctggaatgcatgggtggtttcacataaaagtatactctttcctgccagtgtagttcctcttgtctcatatgcacgctttgtttatatattgtaatgtatgagtgcgtgctgtagaacaaggttggattatctgtggtatgaatttcctcgattccatgagaaacgcttttctatatgtggaaaaaaaaaaaaaaaaaaaaaataaaaaaaaaaaaaaaa

SEQ ID NO: 1228 - DNA, 1615 bp, Zea mays
ctgcgcgccgcgagtgaattccgctaccccaatcaatccgacgccagagagagagtgggcgactggcgacgcggtcctccggtcccccccaattcccaacggccggcggcgcgacaccccgatccggatcccatcgcctgccgggagcctcgattcgggcggcggggacgacgattcgaccgcgtcggtaaccaggcaggggaaaggaggggatgagcttccaggacctggaggcgggccacgtccggggggcgccgcccggcggcggccggaggagcggccgggcggggggcgccggcgccggcgccggcgcgtcgcaggccgtggcgtcgggcgtcttccagatcaacaccgccgtcgccacgttccagcgccttgtcaacacgctcggcacgcccaaggacacccccgacctccgcgacaggatacataaaacacggcaacacataacacagctagtgaaggatacatcagacaagcttaaacaagccagcgaggcggatcatcgcgttgaagtcagcgctaccaagaagattgctgatgcaaagctagctaaagatttccaagcagtcctaaaagaattccagaaagcccaacgattagcagcagagagagaagctgcatatgcaccttttatttctcaagcgggcttgccacagagctacaactcaagtgaagtgaataatggtgctgataggttggcagagcagcgcacacagcttctagaatctagaaggcaggagttggtcttcttggataatgaaatcgtgttcaatgaggccatcattgaggagagggatcagggaatacaagagattcagcaccaaatcactgaagtaaatgaaatcttcaaagatctcgctgtgctagtccatgatcaaggagcaatgatagatgacattgattcccatatagagaacgccgttgtagcgacttcgcaggctaaaggccagctttcaaaggctgctaaaactcagaagtcgaactcttctctgatatgcttgttgctcgttattttcggagtggtcctgctcatagtgataatagtacttgcagcctaaaagcttggaaggcagctggggttccgaaatctgatcgagagcttattgcgacaaattccttcataagttatttttgctgtgctgctaggaatgattcctggtacccaggcggtgattggcgctctgcttgtggtgtggcggtatatgtggtgatgatgaaatctgatgcataaaagtactctttcctgcaagtgtagtgcctcatgcacgtttttgtttatatattgtgatgtatgagtgcgtgatgtagaacaaggttggattatccgtggcatgaagtttctccatctcatgagaaacgcttttctatatttcatctcgcaccacgcttctctatcaagatccgccaggtccatcattgtcttctgcttgcttattatgtggtacatcatagggcaggtttgtttttgagaaccttgactgtgaggataatctgagtatcatgaggattacagatgaaaatgaatgagtctgtggtttagaatctagaaagtgacgattttctatcaaaaaaaacaaagtaaaaaaaaaaggtccctcggtcgagaccacgc

SEQ ID NO: 1229 - DNA, 757 bp, Zea mays
cggacgcgtgggggaccccaccaaagggtttttgagttttgacaatcagaacaatagcctccaccgtccaccctcacgcaactgcctcttcgcggcggcgcaaaacaccaacacgtcttctctccggttgcgaggagggtataggatttcgccgcggcgagatgtcggcgtacgacgaggtggagatcgaggacatggagtggaacgcggagctgaaggcgtacacgtacccgtgcccctgcggcgacctcttccagatcacgctcgacgacctccgcatcggggaggagattgcgcgctgcccgtcgtgttctctcttcctcaccgtcgtttacaacgccgaggactttgctgacgccaaggagccgacccacaagccgtccccgagcccagtcgccgtcgcctgatgtggcccgtgcccggcgagatggacgcatggaaatggatctcagagcaggataacgaatgagtttttgtttggcacacaccactacgggagcatttgtactactcttagatgagtcaacccactgcatattttcagagctcaggttgttgaactatcttttttttgtgcttgacattgtaaggtgacatggacagaacatgctatgaaaaaaattgtttagtcactactaaaaaaaaaaaaaaaacccaccgtgtttgagacccgatcgatcttcggtgaatattcatcattgggtcgtgcagaaattctctgcatgaatccaaaaaaaaaaaaaaaaaatttgcggcc

SEQ ID NO: 1230 - DNA, 802 bp, Zea mays
  misc_feature (761)..(761): n is a, c, g, or t
ctcggccccccccggcgggagcaaccgcccaccaccgccctaacccctcacgcaactgcctctttgcggcggcgggaaacactgacacgtcttctctccggttgcgacttgcgagcacggtcggaggagctagggtttcgccgcagcgagatgtcggcgtacgacgaggtggagatcgaggacatggagtggaacgcggagctgaaggcgtacacgtacccgtgcccctgcggcgacctcttccagatcacgctcgacgacctccgcctcggggaggagattgcgcgctgcccctcgtgctccctcttccttaccgtcgtctacaacgccgaggatttcgccgactccaaggagccgacccacaagccgtccccgaccccagtcgccgtcgcctgatgtggcccgttcgaggctagatggacgaatggaatggatctcggagcaggaaaaaaggaacgagttcatgtttgacacacaccactacgggagtatttgtttgtactactaaggggctgtttggttcgtggctaaatgtgccacactttgcctaaggttaggcgttcgaattgaagaactaaccttaggcagaaaagttagacaaaatatggtaagttatgcatcaaaccaaacaggctgttaaaactattttttttcatgtgggtgacatagttgtaaggtgacatggacaactcatgctatgaaaatttttgttcgtccccactataaaaaaaaaaaagtggccttgacgcccgcgtgaaacncgatcgattcttcggtgataaattcatttatgttccacctt

SEQ ID NO: 1231 - DNA, 1055 bp, Zea mays
cattgggtacctcgcggccccccgccgctcaatttgacgagtcgtcggcgctagcaagatcattcgctccgccgctctccgacccatttctaacaagcaccagctgctgcgtaacatatatcacacagtgtatgcacacctgcaggcagcatggccgggtgcaagcaggacgacgacgccggcggccgttctccttcgtcgtcgtccatggacagcagcagcaccacccacccgccggcgctatccgccgcgtcgtcgtcgggcttccggccgacgacgacggagaggagggacgaccttagcaccgaccttcagctagggctctgcagtctgtcgccggcggcgtcctccgccctcctggtggtagcggagagcaagagcgtcctttccacgccaaggggcagcaggaccacccaagactggcccccgatcaaaccattcctcagaagcgccttgacagcctcggcacgccgacgacggcggacactgttcgtgaaggtgtacatggaaggcgttgcgatcggccggaagctggacttgctcttgctggatgggtacgacagcctcctagcgaagctccgccacatgttcaaggcctccatcacctttgctgatgctatggagtaccaccaacgagttcctcacgagaagcctgcacatgttctcacctatgaagaccgggatggagactggatgatggttggggatgtaccgtgggagctcttccttggaagtgtgaagaaacttaggatttgcaagaacagataaatgctagttagcaaagcttattattcgtgcgctgcatggactctatttctttcctctttttatttatatcggttcatacagaaagattttgctggccacagagtggacatgcatgtgataccgaggctatatatactgaccgtgtacagtatactgaagaaaagtcaatcttgataccttccctagaaaattaatttttggtattttttatgtttccttttctgttttctctgagtgccttgtaaataccatggctgtttgttaaagaagaggcgatttgcgtgaag

SEQ ID NO: 1232 - DNA, 3050 bp, Zea mays
tcttatacatgctatcttgccctcgagcttatcgcctgagacggatttatacttctacgggtcttggaagcttggtgggtttggttttgctctttcggttgatcaagcagcagttggtttgagtttgacttcatcacaactatttcattattcggactatgatgtcgaggatacagctttacctcttcaaccatcgttgaactatactgcaccagaattggtccaaagtagagattctaaagttggctctgcttgtgatatgtttagctttggatgtttggcttacaatctggttgctcgtagaccacttctggactgccataacaatgttaaaatgtacatgaatgccttgacatatttaacaagtgaagccttttctaatattccttctgatttggtattggatttgcaaaggatgctatcgatggatgcactatcacgtcctagtgctatggcctttacaggttcttctttcttccgggatgatacgaggttgcgcgctcttcgtttccttgaccatttgcttgagagagataatatgcagaagacagagtttttgaaggcattatcagatatgtggaaggattttgattcccgagttcttcgatataaagtgcttcctcctctttgtgctgagttacgcaacatggttatgcagccaatgattttgcctatggttctaactatagcagaatctcaggataaaggggattttgaactcgcaacactgcctgcgcttgttccagtgtttgcttcagcgtcaggtgaaactctacttttgcttgtgaagcatgcagatctcatcattaacaaggccactcaggaacatttgatatcacatgttcttccaatgctggtccgggcttatgatgacaatgatccccggttacaggaagaagttctgcgtcgaacagtaccactgtctcgtcaacttgacaccaagctagtcaataaagctgtgcttcctcgtgtacatggattagctctaaagacaacagttgctgcggtgcgtgtgaatgcgttgcgctgtttaggagatcttgtgccatccttggacaaagaaggaataatgggtatcttggagactgttcggcgttgcacagctgttgaccatactgcgccaactcttatgtgcacacttggtgttgctaatgcaatctataaacaatgcggtgttgagtttgctgcggaatatgtgattcctctcatcttcccattgctcacagcacatcaactgaatgtacaacaatttgccaagtatatgctatttgtcaaggacattacaagcaagattgaagagaagcgtggtgtgactgttacagataatgggaacacagaggtaaaatcatcaccttcattggcaaacgggatccattctgaacctatgtcaggacaaataccagttgcaaagagcagccctgcatgggatgaagactggggtcctactaagaaatccggtgttccatctctttcagttgattctagtgcacaaacaaagcaaccctcagtagacccttttgacttcggtactcaaacaaagcaatccacaacactcccctttgatttgagcacccaggcaaagcagccaccatcagtttctcatgttacagcagctacaatcccacctgcgcaaccacaaccatcactacaatctcttgcggctagttcaggacctaaaatttctggctcatgtgtccctgtcgacattgagtggcctcctcgaagaagctcgtcatccaacttcaatgcacccttgtctattagcaaggataatggttctggaaggctgtctagcgatggagttgatgatattgatccttttgctgattggcccccaatacctagcaatgttaatagcatttcagcaaccgagcattggccaagcataaatcaaaatatttcgggatttagctcaggcaacatagtttttggtggcagcgggaattctgtagggcaaacgaaaagcaaccaaatgagctggtcaaacacgtctaatctaatgggcacgaactcaactgacagctatttgaatcagagcattgcagctctaggtttcggaaatccaaatggaggattgagcacaggtctctccaatccaagtagttccagtacaggcctgagcatgatgcaaccaaaatctgattctggatcactgtcgacgtcggtcaacaatgccgcacatgggctgctaagacttgcccctcctccatccacatcggttggaagagggcgcggtagaaatcaaggacagtccgcactctcccgagcatcaaggcctcatgccaactcggcatcaggacaacaacctatcctggatttactctagtaagagatggtcgcctctgttcttcgcgttcggattgtcaatgtgtacatcctcaaacctttgtaaggtgagcatcatactgttcttttggacatgcatgtggcgaaagcagttctttttgttcattttgaagctgggtggccttggtttatagtctgaagggattctacttcggggatcttgcagaggtttaccttttctcatgctcccgtgcttagggttttgaattgggcatcgaggccatcttcatactggtgacagaagaaatgttttgtgtatatttctgtccaaactcggctgtagctttcagagttggtgaatagttgacatgtttatatgggctgtgaagttttgaaatgtttacattgcattgcacaacagtgtttaatgggccttacaggtgtgtaccttttctcatgtactccgcgcaaaattgtacaacaatgtttaatgggccttataggtggacctttctcatgtactccacgctcccccaacaatgtttggccttatatatatatttggtgacttcggtgttctagacaaaagccagatgatatactcgctatcattggttggattcttgtgtcccaaatatctgacgttgaccttgtacaggactgggggttcaactgcagtggtgctgtgagccgtacatgcgatggaccactctcctatcgagcattttcaacaattcgctacacggtcctacatccctgggcct

SEQ ID NO: 1233 - DNA, 5642 bp, Zea mays
  misc_feature (1232)..(1232): n is a, c, g, or t
  misc_feature (1617)..(1617): n is a, c, g, or t
gccggcagtggtggggatggcccttgcagcgaccgtttcaattgctgcattgcgaaaaaaagataacttgttttttaagattcagtgttttattatgttttgtgtaactgtatatcatattcatgtccaataataaaaaatactataactaaatgttcaattgcagagacaatgcttatatgaccatgtctgttacttcatcatgtgctactggtacatagttggtaagtgtttcatgttctactagaaaatgaacataacatgaagcagacatttcagttttattttcttggagttaattaccggttcaccttgaagttattgttatttatatattccaattttagtttcttcttggagcgaattaccagttcgtctggaagttactattatctataactttatatggtatgtgatgctatcattcgtgttttcactttctatataccctctatcccaatgtgctccatattctatcaaaccaaaacaatagtatgatattatatcccttgcaacgatccaagaactctatgatatatgaccatgctctcatttttatttgcattttgtaattgtctattctagctttatggacaaccagcgctcgcatcctcgtgctcggatccgcctccgaacggggccaatctcgaggacaccatcgcaactgaggtggcgcggaccaagggcctctggatggtggggaggcggcgatggcgacggtggggtgcagctcactaacaagctcgagatcttcaagatcgacaacttcaatcccaatgcctatgtgcagtccaagtgccagaccgtgaacgagaaggtgagcctagctgcctgccatctctcatctggctgtgttgcgaggtcctgcataatatgtgtgacttccatgtttggacagtggagctagttcatgaaaataagggggtgtttgccaggttccagctccagtgtggagctatagtttataatataaatttaattagttttaaaaatattttaatctaaattataaacaaaatgagttatctaaatgtcttctaaagtcttacaactttagcttcatgattttctggagcacctaatgatctgcttcaccaactccaccaaatttcatagaactgaagctgtcccaaactggttctaatatggactgagtttattgttcacttctcataacttttaaatataccatttttcaatatctgggatacaggcatatagtcatgcatttncatggaatttttatgaattctttgtggtgcattggttaatgctattttctgaggcatgattacattggcattggcctttttacttggaatttcataatatgtttcttaagacatctgcttattgttgtttcttatgacactgaaattatgctgcattcaaaactggctagcaagttaaggcgattagattagtgtcgctatgggagtggaagactagctattatttttggctttagttgttcatacaattattgattagcaaatgtcacagaattggtttacgtttctaatgcatcatttgacaatgtcatatccagaaaagcggcaaaatgagtgtattttttgtatttctcacattttgcaaccaaccttccttaaaaaatgncatccttgttgtacctatgtatcaaaattcgtattttccttaggagtttacatagttattttacctcctaagttatacaccactgatttgtaaaaatcctccaagtttatctgacctcatttcttgcattgtccttgccactggtgtttggtaggactttagataatcagaatttgagaattgtattcaaacatgaggtttaactgtgagatttttgcgattttctattgtaaaatttttagtttagaatctggtatcctatggagttggaacttctcaggccatataagtggtgattgatgcctttaggttctttgttccttccttggtcatgataattgtttagacagccaaagcgtgatcacattttccaattcaacaaattgttaatttctttcttctatttcaggaaatgggactacttgagattaaacatggactgctacaagttgcagagacgttagattttcttcataacaatgctcatcttgcccatcgagctatatcacctgagacggtctttataacttctaacggatcttggaagcttggtgggtttggttttgctctttcagttgatcaagccacaggtggtttgacttcatcacagctattccattattcggactatgatgtcgaggatacagctttacctcttcaaccgtcgttgaactatactgcaccagaattggttcgaagtggagattctaaagttggctctgcttgtgatatgtttagctttggatgtctagcttaccatctggttgctcgtagaccacttctggactgccataacaatgttaaaatgtacatgaatgccttgacatatttaacaagtgaagccttttctaatattccttctgatttggtatcggatttgcaaaggatgatatcgatggatgcagtatcgcgtcctagtgctgtggcctttacaggttcttctttcttccgggatgatacgaggttgcgcgctcttcgtttccttgaccatttgcttgtatgtttttgttattcccctttagtttattttcgttaataagtttaaaggctgctatctggtgtgcttctttgctgtctgaaaatcacctttgactagattgtttgagttatacctgtcaacatagcaggaaagaatcttgcctgcttgactagagaatgaaacggcacaatttggtacctaaaatggtcctgatttttaagataacattcctttcaggagagagataatatgcagaagacagagtttttgaaggcattatcagatatgtggaaggattttgattcccgagttcttcgatataaagtatgttcagtactgcaatccatccttgtcttcttccgaccaatgctacccccatgtgtccactctctgtgagcatcattttgttatgtaccacttcattgaagctcctgaaacctggatatgttaaattatacatctacccagatggccagattccataatgtttggttgctatcagcataccctgtatggagtattggaaataaataaaataatatataaacctcaatttctatatcttaaacttgtcacaatatgaatcaattctctagttgacacattccgacattgtgtttctgtttgtgcttttcaaactgttttgtccaggaaaaagaacagccttatatttatttgatccattggttatttcaaagctgactcacactttgcaaccaggttcttcctcctctttgtgctgagttacgcaacatggttatgcagccaatgattttgcctatggttctaacaatagcagaatctcaggataaaggggattttgaacttgcaacactgcctgcgcttgttccagtgtttacttcagcatcaggtgaaactctacttttgcttgtgaagcatgcagatctcatcattaacaaggccacacaggaacatttgagtccacccagccttcctatgctggttcgggcttatgatgacaatgatccccggttacaggaagaagttctgcgtcgaacagtatcactgtctcgtcaacttgacaccaagctagtcaaacaggctgtgcttcctcgtgtacatggattagctctaaagaccacagttgccgcggtgcgcgtgaatgcgttgcgatgtttaggagatcttgtgccatccctggacaaagaaggtatattgggtatcttggagaccgttcggcgttgcacagctgttgaccatactgcgccaactcttatgtgcacacttggtgttgctaatgcaatctataaacaatgtggtgtggagtttgctgcggaatatgtgattcctctcatcttcccattactcacagcacatcaattgaatgtacaacaatttgccaagtatatgctatttgtcaaggacattacaagcaagatcgaagagaagcgtggtgtgactgttacagataatgggaacacagaggtaaaagcatcaccttcattggcaaacgggatccattctgaacctatgccaggacaaataccagctgcaaagagcagccctgcatgggatgaagactggggtcctactaagaaaaccggtgttccatctctctcagttgattctagtgcacaaacaaagcaaccctcagtacacccttttgacttcagtactcaaacaaagcaatccacaccactcccctttgatttgagcacccaagtaaagcagccatcattagtttctcatgctacagcagctacgatcccacctgcgcaaccacaaccagtacaatctcttgtgcccagttcaggacctcaatcttctggctcatgtgcccctgttgacattgagtggcctcctcgaagaagctcgtcatccgacttcagtgcatccttgtctattagcaaggagaatgaatctggaaggctatctagcgatggacttgacgatattgatccttttgctgattggcccccaaaacctagcaatgttactagcattacagcaaccgagcatcgtccaagcataaatcaaaatatttctggatttagctcaggtaacatagggtttggtggcagcgggaattctatagggcaagcgaaaagcaaccaaatgagctggtcaaacacgcctaatctgatgggcatgaactcaactggcagctatttgaatcagggcagtgcagctctaggttttggaaatccaattggaggattgagcactggcctctccaatccaagcagttccagtacaggcctgagcatgatgcaaccaaaatctgattttggatcactgtccatgtctgccaataatgccgcaaatggcccacccagacttgcccctcctccatctacttcagttggaagagggcgtggtagaaatcaaggacaatcagcactctcccgagcatcaaggcctcctcattcgaactcgtcatcaggacaacaacctatcctggatttactttagtaagagaggcttgcctctattcttggcgatgacgattgtcaatgtgtacatcttcaaacctttgtaaggtgagcatcatactgttcttttggacatgcatgtggtgaaagcatatatatattttttgttcatttcgaagctggctggccttggtttatagtctgaaggagttctacttcggggaatctggatcttgcagaggttaccttctctcatgcttagggttttgatttgggcattgaggctatcttcatattggtgacagaagaaatgtcgttgtgtatgtttctgtctaaaatcggctgtagcttgtagagttgatgaatatagttgacatgcttatctgggctgtgaagttttgaatgtttacataatgtttcatgtgccttatatgtggaccctgcccattttctccccgctccccaacatcatgtaattcattagttaaggctcgtgttgtgtatacttagtctgtcgagtttaaggccaatcggcaattctgcttctatacagttgtttggttgctgcgttgctggtaggatcaccactgttacgttctgataccccacaactgtgtaaagtcgatcttcatgtttggtcttttccctttacc

SEQ ID NO: 1234 - DNA, 3478 bp, Zea mays
agcccgcccttggcagtgccatggttgcaaaattctcctcgcggtctcgcatggcacgagctgcagaaaaccgattaaaaaaaccaaaaaacacacccgtaaagtaattaaaccaaacacgcgctgccacccgccgatccggcccccccccgctccgaggaaatccaccaccgcggccggggcctcccagatctcgctggaggcagcggcagcggcggcggtggggggcgatggcgctcaacatgaagaccctgacgcaggcgctggcgaaggcgtcggctgtcatcgagaagacggtgtccacgacggtgcaggaggtgacgggcccgcgcccgctgcaggactacgagctgctggaccaggccgggtccggcgggccgggactcgcgtggcggatctacacggcgcgaccgcgggacggcgccccctcggcgccctaccccgtcgtctccgtctgggtgctcgacaagcgcgccctcgccgaggcacgggcgcgggcggggctgtcgaaggcggccgaggacgccttcctcgacctcgtccgcgccgacgcggcgcggctcgtgcgcatgcgccacccgggcgtgctccacgttgtgcaggcgcttgacgagaccaaggccgccatggccatggccactgagcccgtcttcgcctccgtagctaacgcgctcgggtgccttgacaacgtcggcaaggtgcccaaggagctcaagggcatggaaatgggactacttgagattaaacatggactgctacaagttgcagagacgttagattttcttcataacaatgctcatcttgcccatcgagctatatcgcctgagacggtctttataacttctaacggatcttggaagcttggtgggtttggttttgctctttcagttgatcaagccacaggtggtttgactcccgcgccccgccgccattattcggactatgatgtcgaggatacagctttgcctcttcaaccgtcgttgaactatactgcaccagaattggttcgaagtggagattctaaagttggctctgcttgtgacatgtttagctttggatgtctagcttaccatctggttgctcgtagaccacttctggactgccataacaatgttaaaatgtacatgaatgccttgacatatttaacaagtgaagccttttctaatattccttctgatttggtatcggatttgcaaaggatgatatcgatggatgcagtatcgcgtcctagtgctgtggcctttacaggttcttctttcttccgggatgatacgaggttgcgcgctcttcgtttccttgaccatttgcttgagagagataatatgcagaagacagagtttttgaaggcattatcagatatgtggaaggattttgattcccgagttcttcgatataaagttcttcctcctctttgtgctgagttacgcaacatggttatgcagccaatgattttgcctatggttctaacaatagcagaatctcaggataaaggggattttgaacttgcaacactgcctgcgcttgttccagtgtttacttcagcatcaggtgaaactctacttttgcttgtgaagcatgcagatctcatcattaacaaggccacacaggaacatttgatatcacatattcttccaatgctggttcgggcttatgatgacaatgatccccggttacaggaagaagttctgcgtcgaacagtatcactgtctcgtcaacttgacaccaagctagtcaaacaggctgtgcttcctcgtgtacatggattagctctaaagaccacagttgccgcggtgcgcgtgaatgcgttgcgctgtttaggagatcttgtgccatccctggacaaagaaggtatattgggtatcttggagacggttcggcgttgcacagctgttgaccatactgcgccaactcttatgtgcacacttggtgttgctaatgcaatctataaacaatgcggtgtggagtttgctgcggaatatgtgattcctctcatcttcccattactcacagcacatcaactgaatgtacaacaatttgccaagtatatgctatttgtcaaggacattacaagcaagatcgaagagaagcgtggtgtgactgttacagataatgggaacacagaggtaaaagcatcaccttcattggcaaacgggatccattctgaacctatgccaggacaaataccagctgcaaagagcagccctccatgggatgaagactggggtccttctaagaaaaccggtgttccatctctctcagttgattctagtgcacagacaaagcaaccctcagtacacccttttgacttcagtactcaaacaaagcaatccacaccactcccctttgatttgagcacccgagcaaagcagccatcattagtttctcatgctacagcagctacaatcccacctgcgcaaccacaaccagtacaatctcttgtgcccagttcaggacctcaaacttctggctcatgtgcccctgttgacattgagtggcctcctcgaagaagctcgtcatccgacttcaatgcatccttgtctattagcaaggagaatgaatctggaaggctatctagcgacggacttgacgatattgatccttttgctgattggcccccaaaacctagcaatgttactagcattacagcaaccgagcatcgtccaagcataaatcaaaatatttctggatttagctcaggtaacatagggtttggtggcaacgggaattctatagggcaagcgaaaagcaaccaaatgagctggtcaaacacgtctaatctgatgggcatgaactcaactggcagctatttgaatcagggcagtgcagctctaggttttggaaatccaattggaggattgagcactggcctctccaatccaagcagttccagtacaggcctgagcatgatgcaacgaaaatctgattttggatcactgtccatgtcggccaataatgctgcaaatggcccacccagacttgcccctcctccatctacttcagttggaagagggcgtggtagaaatcaaggacaatcagcactctcccgagcatcaaggcctcctcattcgaactcgtcatcaggacaacaacctatcctggatttactttagtaagagaggcttgcctctattcttggcgatgacgattgtcaatgtgtacatcttcaaacctttgtaaggtgagcatcatactgttcttttggacatgcatgtggtgaaagcatatatatattttttgttcatttcgaagctggctggccttggtttatagtctgaaggagttctacttcggggaatctggatcttgcagaggttaccttctctcatgcttagggttttgatttgggcattgaggctatcttcatattggtgacagaagaaatgtcgttgtgtatgtttctgtctaaaatcggctgtagcttgtagagttgatgaatatagttgacatgcttatctgggctgtgaagttttgaatgttt

SEQ ID NO: 1235 - DNA, 1527 bp, Zea mays
tgaaggcgctgatctccatgctcctcaaggagggtacgaaacggctcggtcaggtgacggcgctcgcagcgcgccttgacgagctctccggggacggcgtcgcgctgtccgccgccaagcgcgtggtggcgcaggccgccctcgccgcgcctctccgcgcggccgccgacgaggtcgccgcgctccgtgcctgcctcgccgccgtccagggttcgctccgggacgcagaggcgcgggcggctctggaggagagcgccaggggcgaggccgactgcgcggctcgaggaggctgccgcggagagcacgcggtcgatgaagctgctccgggagaaggaagcggaggtggcggccgtgtccagcaagggtgcccgattggaggcccttgtggcggagctagagggcaagaactctgaattttttggtgagaagggtgagctggcggagaaattgggggaggccaaggaggcggttcggattgtgtcgagtgaaaaggcggaggtggagaggagcctgcaggacttcaggaaggcggctgaggcttatcgggtggacatggagggaaaattgaaggcaaagttggatgaattgaaggtgttgggtgccgagaaggcggagattgaggccagagtagagtcattggaggcgaagctggtcgctgcaatggttgacaagagggaactgcaggctgaggtggtggcaaagaagaaggagtctggtttggtgaagggagaaaatgataagcttcagtctgaggttgtggctgctgagaagaagcacaactttgctgtcgcagaggttaaaagtctcaggatggaattggccacgttgctggctgagaatgaggctgctgctaaggcatttgatgctgagaaggctagacttttgggcgagttggagagcctgaagaggaagttggaggaaatccaggcagacaaggaagtagctgaggtagcaacccgtgagaaggatgctcaggccattaagttgagggccaaattggaggagctccacagttccatgtcccaacttcaagcttcctgcaatgatcttgatatgaagtgttcacgcctgcatgatgagaagaattcagttctgaaggctctggacactcagaaggctgaagcagtaaagctgaggtcaaaaattgaggagctcgagaagtgcagtgggaagaaagatgatgacattgggaagttgaatgcagcattggaggaaaagaaggggaagatcaataacctgagcaaggatatcgagctactgcaactcacagtggctgaggcggagaaaagaaggaagggtggcatctggacatggttgtatgctgctaccacaacagtggtggctgccatctccttcatttatgcctccaggtctcattgaaggacctgcacatttcatttttaatgttctgcattccttttgcaccttaagtccgtaaccctgtgctgctcgaaatgatcatgttgccatcctgttgttgctacttaatgaatcagctggttatgaaatgaagttaaacctttgctt

SEQ ID NO: 1236 - DNA, 2394 bp, Zea mays
acgcgggggcacttgacatagcatataccatctacatgaagtttggagaccttgcaagcgctttgagaatttctctgcagcttgagaaatccacccagtatgtgaagcaagtctacacagcaactgatgaccttctgttgaagaaacaattctcatatctcattgcacgccatggtttggctatggagattgatgatgagatcgccgctgatgacaccggccggggggtgtcgctgcggacagcctgtgatactaagttgagtgagggatatcttactcttgctcgcgatattgaggtcatggagcctaaatccccggaggatatatacaaggtcccgggtttgattgatggtcgtggtgccagctccagtcttgattctgcaagacagaatttagctgcaacatttgtaaatgcatttgtgaatgctgggtttggccaggacaagttgatgaccgctccatctgattcatccagcagcgggtcttccggaaattggttattcaagaacaaggaacatggaaaagctagtgcagcagctagtctgggaatgattctcctgtgggatactgattccgggctcgctcagcttgacaagtacttgcatagtaatgatactcatgttgttgctggagctttgctaggtattggaattgtcacttgtggggtgaagagtgattgtgatcctgcgtttgctattcttatggagtatattggcaaggatgactcaaacattcgtattggagcaatattgggtcttggaattgcatatgctggttcccagaaagaagagcttaaaatgcatctatctgctgtgttgggagactcccaatcacctcttgaggtcttggtcttctcggccattgccatgggattggtgtttgtcggttcttgcaatgaagagattgcacagtctattatatttgctttgatggagcgtagtgaggccgagttggcagaacccattatacggttgcttcctgttgcgcttggccttttatatcttggaaaacaggatagtgtggaggctaccgcagaggtctctaaaacatttgatgagaagatagggaagtactgtgatgtaacacttatgtcactggcatatgccgggacaggaaatgtgcttaaggttcagaaacttcttggcatttgctcacagcatcttgagaaaggtgaaacacaccaagggccagctgtcctagggattgctcttattgctatggctgaagaattaggagctgaaatggctgtacgttcacttgagcgtcttctgcagtatggcgagcagaatataagacgggcagttcctcttgctcttggtatactctgcatatctaatcccaaggtaaacgttatggacacactaagcagattgagtcatgatgcagacgccgatgtgtcgatggctgcaattatctcattgggtttgattggtgctggcacaaacaatgccagaatagctggcatgcttcgcaatctttcaagttattactacaaagaagctgctcatctgttttgtgttagaattgcccagggccttgtccacctcggaaagggcttgttgaccctttctccataccattccgatagatttctcctctccccgatggcacttgggggccttgtaaccgttctccacgcgtgccttgatatgaagtccaccatcctagggaaataccactacatcctctacattattgtcctggcaatgcagcccaggatgcttttgactgtcgacgaggatctgaagcccctgtcagtacctgtccgcgtcgggcaagctgtcgacgtggttggtcaggcaggaaggccgaagacaatcaccggcttccagacacactccacgccggtcttgctcgcagcaggggagagagctgaactggcaactgaaaaatacattccactgaccccagtactagagggctttgtgattctgaagaagaacccagagtaccacgaagagtgaagacccagatagcatattggtgtttccgaggcccgtccagataggcagcctcgaatttgcgcggccttggatatctatcttctttcttgctcagcggcagcgccatcctgggcctctccttcctgggtccgtgtccatgtttgattcttatcttaccggagctgtggctaactgaaagagctgtctttggttggcttaacttgtagtacgaccgtatttattaattactagaagacgtttatagagcttacgatgtacggcgaggtgatgacatggtggcatagcgtagtgtaatttttttttggcgttcgtctcggccaaaacatagcatacatagtccttgtttgacattgtgaaccatcattatccgttcccctgtattttgtcggttcgggcggtggacgtaaaaaaaaaaaaaaaaaaaaaaaaa

SEQ ID NO: 1237 - DNA, 1592 bp, Zea mays
tggtgattgtgatcctgcgtttgctattgttatggagtatattggcaaggatgactcaaacattcgtattggagcaatattgggtcttgcgcattgcccttcggtacctcggaaaacaggatagtgtggaggctaccgcagaggtctctaaaacatttgatgaaaagatagggaagtactgtgatgtaacacttatgtcgctggcatatgccgggacaggaaatgtgcttaaggttcagaaacttcttggcatttgttcacagcatcttgagaaaggtgaaacacaccaagggccagctgtccttggaattgctcttattgctatggctgaagaattaggagctgaaatggctgtacgttcacttgagcgtcttctgcagtatggcgagcagaatataagacgagcagttcctcttgctcttggtatactctgcatatctaatcccaaggtgaatgttatggacacactgagtagattgagtcatgatgccgatgccgatgtgtcaatggctgcaattatctcattgggtttgattggtgctggcacaaacaatgccagaatagctgccatgcttcgcaatctttcaagttattactacaaagaagcggctcatctgttttgtgttagaattgctcagggccttgttcacctcggaaagggcttgttgaccctttctccgtaccattctgatagatttcttctttccccgatggcacttggagggcttgtaactgttcccccgccgccgcccgcgatgaagtccactatcctagggaaatatcactacatactttacattattgtcctggcaatgcagcccaggatgcttttaactgtcgatgaggatctgaagcccctctcagtacctgtccgcgttgggcaagctgtggacgtggttggtcaggcaggaaggcctaagacaattaccggctttcagacacactccacaccagtcttgcttgcagcaggggagagagctgaactagcaactgaaaaatacatcccactgactccggtattagagggctttgtgattttgaagaagaacccggagtaccatgaagagtgaaacgctttagcatgccaaatagcatggtgtttcggaggctcgtgcacatggcagtcttcaagccctggcgcacccctcgtcgagaaatcgctcgccctttgctcaacccttcgcctggagttcatgttgaattcttaccagagttgtggctaactgaaagctgtcttcggttgtgctgatatacgattgtatctgtacgattgtagcaattactgggacagcttactctgtatggtgtggtgataacgtggcatagcatttttggcgctggtctaggttagtccttgtgttgacatggtgcaccatcattataagttttctgtattttatggatccgttctgttcgtgtgtactggaaacattgtacacatgatatgtaagtgtgcctccatgtgtatgtgtgccttcgtgtgtgttttggttttgtcccaagcatggcttttgtccccttaaaaccaaaagacaaatcaaagcgctcgaagcaactttttccaaatatatatggaagaacttttagggctg

SEQ ID NO: 1238 - DNA, 1211 bp, Zea mays
tacgttcacttgagcgtcttctgcagtatggcgagcagaatataagacgggcagttcctcttgctcttggtatactctgcatatctaatcccaaggtaaacgttatggacacactaagcagattgagtcatgatgcagacgccgatgtgtcgatggttcgtatttatcaatcctttcacctagcctttcctttgttatcatgtatcatatatatgtggctattaaatttctcttgggtgcaattatctcattgggtttgattggtgctggcacaaacaatgccagaatagctggcatgcttcgcaatctttcaagttattactacaaagaagctgctcatctgttttgtgttagaattgcccagggccttgtccacctcggaaagggcttgttgaccctttcccccataccattccgatagatttcttctctccccgatggcacttgggggccttgtaaccgttctccacgcgtgccttgatatgaagtcgaccatcctagggaaataccactacatcctctacattattgtcctggcaatgcagcccaggatgcttttgactgtcgacgaggatctgaagcccctgtcagtacctgtccgcgtcgggcaagcggtcgacgtggttggtcaggcaggaaggccgaagacaatcaccggcttccagacacactccacgccggtcttgctcgcagcaggggagagagctgaactggcaactgaaaaatacattccactgaccccggtactagagggctttgtgatcctgaagaagaacccagagtaccacgaagagtgaagaacccagatagcatattggtgtttccgaggcccgtccagataggcagcctcgaagccgaatcgtttgcgcggccttggatatctatcttctttcttgctcagcggcagcgccatcctggccctctccttcctgggtccgtgtccatgtttgattcttatcttaccggagcggtggctaactgaaagagctgtctttggttggcttaacttgtagtacgaccgtatttattaattactagaagacgtttatagagcttactctgtacggtgaggtgatgacatggtggcatagcgtagtgtaattttctttttggcgttcgtctcggccaatcgatagcatacatagtccttgttttgacattgtgaaccatcattatccgttccctgtattttttggtttccgggcgcgggg

SEQ ID NO: 1239 - DNA, 1347 bp, Zea mays
tagttactattcagtgaagagatgtcagcgcgatgcatttgtgtatatatatatatatatatatatatatatatatatatggcgtatttttcattgttcatatatactttttgttagtgccccactagcccactttaggagtacttagcaagcacaaagccacctagctttctttctcatcatctctgtgccctttaattgttccatccatccatcacagttgcctcaacaccataaagagccacaagctagctcctctcccacaaacactcgcatgctccgcacacaccaccacacacacacactgacacacccacacactagttgtatgtgctagagctgcagttgccttggcatcagaggccatgaaactgaaacaggagcaagcagacgacgactgcagcaagatgcagggaggtcgtggcctgatgagcagccttgagctcaggctgggcatgtcttcagacaatggcgacgccagctgcggcggtgatccgtggcttggcgttggagtgcacccctggagccttgcctccagacaagcagagaaggtagcccaggagcaagaccaccaccagcgttctccgccgcagccggtgggatggccaccggtgggcgcgttccgcaggagccacctgcaggtttcttcgaagaccgtggaggaaccggcgggcaaggtgaagtccggcggcgagaggctggcgccggcggccaccatgttcgtgaaggtcaacatggagggctgcgccgtcgggaggaaggtggacctgctggcgcaccgcgggtacgcgtcgctgtcgcgcgcgctgcaggccatgttccgtggcttcctgtcagatggtgagtggaggatcgttggcagtgaggacgacgccgacgacgacgagcagcagccggagccgacgaagaaggggggcagtaagagcaacaagaaggcgtacattcttctgtacgaggacaacgagggcgaccggatgctcgtcggcgacgtgccgtgggagctgttcatggcttcggtgaagaggctctacatcgcacaggacccaaggaagacgaagaattagctaattaagctagttagggcctggctaggagaaacgttgctggctgccttattatttctacaaatagctccaagtcgaagcagatagctaagctagcactcccttcttcgatcctgtaatcctgtcgagcatcagttcatatacagcgcgtgtagtcggcatctctagtccaatattaatatataggaaattttgccttggactccgatatgtcctgtagaccttgaacaatacttctaatgtctgacttaagttattgatcatctgaaccccgttctcaaat

SEQ ID NO: 1240 - DNA, 1399 bp, Zea mays
tatatatatatggcatatttttcattgttcatatatactttttgttagtgccccactagcccactttaggagtacttagcaagcacaaagccacctagctttctttctcatcatctctgtgccctttaattgttccatccatccatcacagttgcctcaacaccataaagagccacaagctagctcctctcccacaaacactcgcctgctctgcacacacacaccacacacacactgacacacccacacactagttgtatgtgctagagctgcagttaccttggcatcagaggccatgaaactgaaacaggagcaagcagacgacgactgcagcaagatgcagggaggtcgtggcctgatgagcaaccttgagctcaggctgggcatgtcttcagacaatggcgacgccagctgcggcggtgatccgtggcttggcgttggagtgcacccctggagccttgcctccagacaagcagagaaggtagcccaggagcaagaccaccaccagcgttctccgccgcagccggtgggatggccaccggtgggcgcgttccgcaggagccacctgcaggtttcttcgaagaccgtggaggaaccggcgggcaaggtgaagtccggcggcgagaggctggcgccggcggccaccatgttcgtgaaggtcaacatggagggctgcgccgtcgggaggaaggtggacctgctggcgcaccgcgggtacgcgtcgctgtcgcgcgcgctgcaggccatgttccgtggcttcctgtcaggtcaggaactcaggacacagcacgaacccctcgtatcgcttgtgcacatgctccgtatgtctcaaactctcaatagccatgagatagggtgatggatggatgttgtgtcgttgtcccttttcagatggtcagtggaggatcgttggcagtgaggacgacgccgacgacgacaacgagcagcagccggagccgacgaagaaggggggcagtaagagcaacaagaaggcgtacattcttctgtacgaggacaacgagggcgaccggatgctcgtcggcgacgtgccgtgggagtaagttgtcgtcgttctgatattcgtcgtcgcatcgatgctgagctttattcgggctatggatggatgatggatgtggtgcttggtgcaggctgttcatggcttcggtgaagaggctctacatcgcacaggacccaaggaagacgaagaattagctaattaagctagttagggcctggctaggagaaacgttgctggctgccttattatttctacaaatagctccaagtcgaagcagatagctaagctagcactcccttcttcgatcctgtaatcctgtcgagcatcagttcatatacagcgcgtgtagtcggcatctctagtcccaatattaataacaaa

SEQ ID NO: 1241 - DNA, 2218 bp, Zea mays
  misc_feature (1356)..(1356): n is a, c, g, or t
gccggccgggtcggggctccattcccactgccctgttgggcggccttcaaacacagcccctcctctctctctctaagacgggaaactgcagcacatattaattagtaactagctaggtagaagaagatgagctcgtcgatcagcatgatggaggcgagaatgcctccggggttcaggttccaccccagggatgatgagctcgtgatggactacctcctacaaaagctctccggccatggccaccatgccggcgctgccatcgtcgtcgacgtcgacctcaacaagtgcgagccatgggacctcccagattccgcgtgcgtgggtgggaaggagtggtacttcttcagcctgcgcgaccgcaagtacgcgacggggcagcgcactaaccgcgccacgcactccggctactggaaggccaccggcaaggaccgcgccgtcgtcgccggcggcgaggtggcggtggggatgcgcaagacgctggtcttctaccggggccgcgcgcccagggggaagaagacggagtgggtcatgcacgagttccgcctccacccccatgccgcgccgtgcctgctagcagcagctgcgccaaacaaggaggactgggtgctatgcagggtgttctacaagagcagaacaaccagcccaaggccagaatctgaagacgcccgggacggcaccccatcagctgaaccgcaactgccggctgccctgccgcttgcgcccctcgctgacacctacgccgccccaacggttgcagagcaggtgtactgcttctccggtctgccggcactgccattcagaagaccagtgagccttggggaccttctggagttcgacgcctccgagaaggaatctgtcacgacagcgatgaccagtgtctcgaacaacactagttcagtgctggagctgactccaaattgcaactggaaccaggaaaatggcatgtcacggatgtggagcccccttgggatatgagatagatctgtgttgtttgctggatctggatgtatggagtcttagtactgagtggccagtagggttctgctgcttagatttgattagcagtgtgacttgcagattgtgtagattagattatccgttattggactaatggcttggcgtagtatttgtacatattactactgaaggaacagtgtccttatccttgtttggcgtagtatttgtacatagcacctgctaaacttcagacaatcagtgaaagacaaatgtgtacattgtaacatagtgttaagaaactctgagagttgctccgttttcaggctctaagttctgatgcaatctcgccttcctttcactctttgcattgagacgttctcacgttcagctcaaactttnctatgaatccacacgtgttgcagtaggtagattccgtcttctgaatggcacttgctggaaggcaaaagacatgccaatccaggcgcaaggcacagtactatccagaggtgtaaacttagtccagatcactttgataaactggcactactaacattttttttcaagaattcaaggtgctcagactgaaagataacagatagattctgaaaaaaaaactgaatgagagaaacaaaatcatattcaatcctcgtttcactccaattgttccattccgagtatctacaaaaacaaaatcgaaataacaaacgaacataataaacagaagcgatgcccgatgcattcgtttttagcatcgcagcatccacaaaaataattctccatctattataccccctcccttaatttacgacattttttatacaccagtttttttttcttatcacagagacgactctgtgtttgcttctgatggtgttaaaggttcagtagtggcaaaggatctgattgcggtagagtctgcattgcttggtctctgatcgttgttctcatctaacattacaagagctacagtcattttcggcggtcagaagccgctgaaaataagctattttcgacggctttaggcttattttcggcggttcctggccgccagaaaaaatagccgaaaataagttcatattttcggtggccaaggtctagccgccgaaagtagcttattttcggcagcctcaagtcagccgtcgaaaataacaggtagtttccggcggccagggagtcagccgccgaaaataccgtgtacgaaaataaaatttcttattttcggcggccagggaggccgccgaaaattaataattcagagcaa

SEQ ID NO: 1242 - DNA, 2987 bp, Zea mays
caccaaaccaccacgcatcattggatagcccttggcccttccagcgggtcagcacttgctcgtgaccgtgtgatccataacttgtttgaccatgtagtgtagcccgtttaatacgaggcctggcctaccccccgcgtccgcccacgcgtccgcccacgaaaccagtcaccgcctaccaccgttttataatccacccctcccactccccctgttttttcttcttccgctgttctactccggcgtgttggtcgacggcggcgcagatgacgaccctcgatctgatgggagggtacgggcgggtggacgagcaggtggccatccaggaggccgccacggcggggctgcgcgggatggagcgtctcatcttgcagctctcccaggctggcaccggggagcggtcgtcgtccccaccggcggtacaggcgcagcgccagcagcagaagcagctggagcagatccagcagcaggttgactgccgggagctcacggacatgacggtgtccaagttcaagaaggtgatctccatcctgaaccgcacggggcacgcgcggttccggcgtggccccgtggcggcgcggtcgcagtcgcagtcgcagggacctgcctcccccgagcccgcgcaatcggcgccggctcccgccgcgaggcccctgacgctggacttcaccaagtcggtgtccggttacagcagggactccgggttcagcgtgtccggcgcgagctcgtcgttcctgtcgtcggtgacgaccggggacgggagcgtgtcgaacgggcgcgcgggaggctcgtcgttcctcatgttcccaccggcgcccggcgcggccagctgcgcgaagccgccgcccgccggtgcggcgcagaagcgcaagtgccacgaccacgcgcactcggagaacgtcgccggcggcaagtacggggctaacggcgggcgctgccactgctcgaagcgcaggtctgtatctcttctcttgccctggtggtgcccttggtggcttgtttctctgctgctgaatgaatcggatcgagctccaacctgactggtatgcgcaggaagcaccgtgtgaagcgcacgatccgcgtgccggcgatcagccccaaagtggcggacatccccgccgacgagtactcgtggcgcaagtacggccagaaacccatcaaggggtcgccctacccacggtgagttgaggatgctgcgttactctatctaacccagtccgattgcagcatgctaatccagttgctgtgggcatttgcatctgcagcggctactacaagtgcagcacggtgcgcggctgccccgcccggaagcatgtggagcgcgaccccgccgacccgtcgatgctgatcgtcacctacgagggcgagcaccgccacagccccgcctccggccaggacccgccgccgccgtcgctcgcgccgctgccggagctgcccagccattgatttggcttcctgcctgctctgtcctgtcaattactagtagctgttgtcataagttataaaatcaaaatcgccagttcagttttagcagctccgttttccgatttttttctcttctgtcgttcgcgttagcagctttgtgaaaggattaggaaagtgttagcatcagacttggagaagggaaaagaaaacaaaaggtaatgctcttgttattagtattatttttttgtatacagcaaacaaaagcatccgcagagaaagttgtggatggtgtagtcggtcggaattttgaccgggcttggggtgttccagagccggattgaataattgaattctcagctccgccagatttgggcgatgcgggcggggtggggctgtgaggagtcaaaagccggtgggtcccagtggttgaacaacgggctttggtcccggtggggagcgcgagtggggacacacacagacggaggacgtgatcgcgtgcttggacgaggtcaagaaacgcggcaggtgtggggcccgcgactccggggcgcgcgccgctgcctctggcgtcgttgacccgtgtcagcctgggcgccgttgtctttgttggcttgccattgcccatttgcgcggtggttgggtcagtgggtgtgcggcggggctacgtccacacggcggtgggtgtcgccttcggggccaaaatgctagtagtcgcgtcttggctggcgtggttgaatggcgcggggccagcctgccttttgactgcttgattggatggatggtagtgcatctacacactagagccttttgacaagtttctatgtacaagaaatatctaagaaaccttattatataataaggtgtttttaaaattagtcatatcataaatactaataaaaaatgttatatatagagagttgtatagagacagattattcataaaaagacatttttttaaatgaggttctacatgctctctaacaagaattcaagtaaatactgtttgactaactatttcaatatgaaaatattaatatcgataatattaaataactataattagatatataattgatatatttttaatagatagtatatctatttaattgatattaaattttttatttattgtttatataaattctacatatttagtttgtgtccagtagatcgtgtatatgacttatggtcatgtaaaacactattttgtatgatagataacatcgtttatcgagtgaaatttaaaataagggatagtataggggaactgccttatgactaggtggcggtctacgacatcgtaactcgttggctatccgtgtttcgaatcaactccgacaagtaaatttgtatgtgcgcgttcgagatccaaatagtgtgctcgacgcgagatttatactggttcggttgaacgtccctacttccaagctttggtagatcatgctaccgataccttgttactcaatgctcgtagtagggttacaagcgagcgatagaaaaagttcccaagtctttattcgtcgttactacatatcggagtgctacatagctaagtttatcgagtg

SEQ ID NO: 1243 - DNA, 1638 bp, Zea mays
ccccgcgtccgcccacgcgtccgcccacgaaaccagtcaccgcctaccaccgttttataatccacccctcccactccccctgttttttcttcttccgctgttctactccggcgtgttggtcgacggcggcgcagatgacgaccctcgatctgatgggagggtacgggcgggtggacgagcaggtggccatccaggaggccgccacggcggggctgcgcgggatggagcgtctcatcttgcagctctcccaggctggcaccggggagcggtcgtcgtccccaccggcggtacaggcgcagcgccagcagcagaagcagctggagcagatccagcagcaggttgactgccgggagctcacggacatgacggtgtccaagttcaagaaggtgatctccatcctgaaccgcacggggcacgcgcggttccggcgtggccccgtggcggcgcggtcgcagtcgcagtcgcagggacctgcctcccccgagcccgcgcaatcggcgccggctcccgccgcgaggcccctgacgctggacttcaccaagtcggtgtccggttacagcagggactccgggttcagcgtgtccggcgcgagctcgtcgttcctgtcgtcggtgacgaccggggacgggagcgtgtcgaacgggcgcgcgggaggctcgtcgttcctcatgctcccaccggcgcccggcgcggccagctgcgcgaagccgccgcccgccggtgcggcgcagaagcgcaagtgccacgaccacgcgcactcggagaacgtcgccggcggcaagtacggtgctaacggcgggcgctgccactgctcgaagcgcaggaagcaccgtgtgaagcgcacgatccgcgtgccggcgatcagccccaaagtggcggacatccccgccgacgagtactcgtggcgcaagtacggccagaaacccatcaaggggtcgccctacccacgcggctactacaagtgcagcacggtgcgcggctgccccgcccggaagcatgtggagcgcgaccccgccgacccgtcgatgctgatcgtcacctacgagggcgagcaccgccacagccccgcctccggccaggacccgccgccgccgtcgctcgcgccgctgccggagctgcccagccattgatttggcttcctgcctgctctgtcctgtcaattactagtagctgttgtcataagttataaaatcaaaatcgccagttcagttttagcagctccgttttccgatttttttctcttctgtcgttcgcgttagcagctttgtgaaaggattaggaaagtgttagcatcagacttggagaagggaaaagaaaacaaaaggtaatgctcttgttattagtattatttttttgtatacagcaaacaaaagcatccgcagagaaagttgtggatggtgtagtcggtcggaattttgaccgggcttggggtgttccagagccggattgaattattgaattctgagctccgccagatttgggcgatgcgggcggggtggggctgagagtagtcaaaagccggtgggtcccagtggttgaaccaccggccttggacccggttgcaagcgcgagtgggggcccacacagtacgaggacctgctcccgtgcttggaccaggtcaaaaaacccggcaggggg

SEQ ID NO: 1244 - DNA, 2707 bp, Zea mays
ggccgcgaattcgcccttcgcggatccgacactcgtttgctggctttgatgggcgagctggaaggacggggttcgggcttaggctccagtgcctgttcggtggtcgcggtgctgatggcgatgaatgaacactgtggcactggaattagtccagcacgaacccgagttccaccagagccacacgttttcactgctcccacgaaggcacaccgcacacagccgcggcctgcaggcgacggtgacggcggcggcggcgctccatcctccgccccttcccttactcgcgttcggcacgcaggcgacggtgacggcggcggcgctcaggatcgggctctcagcgacggcggcggcggttttccctcccggctctcgccagtcgcctcgcgctctcgcctccggtcctccgaacgccggccggtgaccctgctggatgacatgagcacactaaatacaatcctgatgaagatggcaggattagcttcctgctgagttttgtcctacaagattgcaaagggcagaatgtcagctagggattctaatcattcatataaatgttcggatgattctcaaatgccgtactacaataactcagcacctgtaggagaaaatggtaggatccatatggcagaaaacagtctaggacatcattactcatcctccgatattggatcacaaaggatcaacaattccaaccctcaagtatttgaagcacagtactgcactctggaatcatcctcagcaaatggtgtttatcctgcacaaagctccacatcttctcatagcatctcccctttaagtgggagccccctgtctcagcatgacagccactcagaccacacatatagttctcctccaagtgcttcctgtctaactgaggttgcagatctcctgattaaacaaaaagaattagagaattccattgttggacctggactggacattagttctgactgctctcggagcttgttgcaagcccatgttccagtgagaccagacaactggagacaacttctgggaattaatggaggagacttgatgcaagtagtcatagcatgtggtaaggctgttgcagagaatgatgtctttgcaacagaactgttaatatctgagcttggtcacctggtatctgtatctggagatccaatgcaacgacttggagcctatatgcttgaaggaattgttgctagactttcttcctccggcagtatgctatataaatctttgaaatgtaaagaacctacaagctctgagctcatgtcatatatgcatctcctttacgagatctgcccattctacaagtttggttacatgtcagcaaatggtgccattgccgaggctattaagggcgagaactttgttcacataattgatttccaaattgctcaggggagccagtgggttactctgctacaggcccttgctgcaagacctggggggccaccatacattagaatcactggtatagatgactcaaattctgcttatgccagaggaggcgggcttgatatagttgggaggacgttgtgtgatgttgctaattcatgtggtcttccttttgagttcaatgccgttccagctgctagccatgaggttgagcttcagcatcttgctataagacatggggagattattgctgtgaattttgcctatcagctacatcatgttcctgacgaaagtgtaagtacagaaaatcatcgggataggattataagaatgatcaagagcatcaatcctagggttgttactctcgttgaacaggagtcaaatacaaacacagctccattcttcccaaggtacatggaaactctcaactactatacagccatgtttgagtcgatagatgttgctctcccaagggatgataggaggcggatgagcgcagaacaacactgtgttgcaagggatattgttaatttaatcgcatgcgagggtgctgaaagggttgagaggcacgagctgtttggaaaatggaagtcaagatttgcaatggctggatttagaccgtacccactgagttcagttgtgaacaacactatcaacacattgttgcatacctacaacagctactacaggcttgaggagagagatggtgtcctttaccttggatggaaaaacagagtattggttgtatcttcggcatggtgttgacatttcctctgcaggttccatcgcactttggcctccatctgacgtttctaaggcaccattatgcttgtctggtatactcagtatatgcttgtatgtaatttgcaaccataccttacccaatggttatcttaccaactagatcttcatggcaaggtgaagtgtcacttaaaatctagaagttgtaactgtcgtgttgacgctagatatagatagttctgctttggtttgacatatgcagatgtgctgtaatgctcaggggttatgctaggcaggcccaagagggtgcctgtttgttatctatcaggctactgtgttgccgcctgctttgtgtgtgcatatatatttggaatgctactgtcctttctctgggatgaagtggattgctaaagtgtcatgtttttcgtaaatactatatccattctcaaatatttgtttgttgtcagctagttcatttataaactaaaccgcgagaaaaaaaacagaggaattggattttgccaaaaaaaaaaaaaaaaaaaaaaaaaaaaaaaaaaaaaaaaaaaaaaaaaaaaaaaaaaaa

SEQ ID NO: 1245 - DNA, 7084 bp, Zea mays
cctttgatactactcgtggttgaatccaaggacacatcatagcttctttgatttataacatatgctcaaaggtgactttggtgtaaactctcaatctttttgctcaaattcttcagttaatttgtcgagctcattgttctcctttaaaaggttagtctcaaaaggcaatgaagagcaaacatcaatttgtgaagaacaaggtatagctaataaatcatcgcaagaggtggagacatacttattttctatatcacaagggttagcaaggtatagataataattcatcgcgagaggtggagacatacttattttctatatcacaagggtatagaaatgttatcgcaagaggtggatacatacttagtttcaagtcctcatgagcaacgttaagctccttgtgagtcaaatttagctcctccagtggacaagtgataacataaagttttttgttgttcataagcattctttagaaatgattttaaattttccaatttcattatcgtagacatctcattttctaaaagtatgttcatgctaactagtttatctacaagctcatcatatgaatagacatgatgaatcacattagcattagatatccttgtgtcacctagtgacatgaagcaacatggtgaatgtgatgggcttatagaagcatcactttcataactcgagcatgaacaatcatcatcttcaaatgaacttgagatagagacattatcatcacttgattttcacttgaggtggagcacccatcaacagtttccttgtaattggtgtgctcatcaccctcaaacatcattccttcttgtgaacactattattatcaattaagttactccatatattgaattaagataggtccaaatttcatggacaaccttcatggtcatgatttctccaaagatctaattactcaagtatttataaaaaacgttagaatcttaatgtttgagatctagacatttctcttttgcttgggtgaggtatttcctcttctcatccaagggcttagaaaaacttacgtttaggattaaagatagcaatgggggcccgatcctgattccccacagagaattcccctattgagggacgagtatgggagtaattttgtccccacggggatcgaaacgaggaaaatttagtccttgtagggtctgcggggacagggattaggaaccatcccccatcctcgttccctgcatacccgcctcacaaacttttcttgatctaaattagttcatttacttgttataattatactaaaaactcaatacataccctattagaaaatagcaaactaaactctaaagtagatgtatatggtttttttaaattttatttgttctgtttatattaatttgacataatcaatttaaatttttctctaaatattgcacatactaacggggacaaattccccgcagagataaattccccaatggggctgaggatgggagaaaaatcttccccgtgagtgtgcacgggaacggggacagagaatttttctctccatggggatgggaatggggagccattcctcgatgaggaattttgtgttgtcgtctctattcaggatccaccataattgaaggctagttctatgaaagtaactagccacataaattttctatcataaaaagtttctaccataaaaatgtctggatctagtttattagatgccatcctctcgggttggttaagacacaaatgagataccgagctttgataccacttgtagggttgagatagtggacaatggactaggggagtgaaaagtatttttaaaaaacataaacctttagtgtagcagaattaaacttgtcggtctagttaggactatacccccactctctattactagcaccttgtacatatcttagttaaacaactaaggtgttagactagatagagctcacctacacaattatacctggcaaggtcacacaaacctatgcaactagtactcaaacaatttgggagctcctacacacactagtgagcaaagtgcagcaagcctaagcacactagcactactcaacttagcaaatgtacacaagctagattagtgaggtaaacaacttaactacataagtcaagtaaagttatgaagctacacaagcttacaagcaaaaaagaagaactacttcactacataagtaaactagttacaagaacaacaataagaaatagctcaaatatgaacaagaatgaataagctagtgttagatagttgcaaaccaataggaatacaaatgttgacatgatgttttttgttgagattcggtggtttgccaaccgcttactctatgttgagacaagcccaaggttatagttgaccctttttaccaatggtgactcttaagtcacactctcccacgtggaatgcatacacttgagctttagcacttgatatggctgaccacttaatgcttttccaaccttactttactagtgttgctctttgtatctcctgtgggtgagcacaatactctatataatgccttcttcccagtcacacacaacttcacgtgggtttccatggagccacaacctccaagccatctaagaggtggcagcctccacgacttaacaagcaacactggctgcaactcgaccacctagtgccactgaaggcaatgcactagaatcaatctcgctatcaaccgcatatgagtagaggaccaaggctaagcgctacacttggaaaacacatccccaagtgctctatttatagaggagagagaggacaagtagtcattactgaactttttgaagaatctacacacttgtggacaatctatagttcaattcacagaaagtctacaatagaacaacaacgaatatatttcaattaaaatcgtgtaggcaacttagttagtgaccgatgaatagtcagtgcaagggtgcaaatagtatgttggccaaacatatctggactcagatagttcctagacattgttcgccactagaaaggtctcatggacagtttgcccccaagcctagatagtccaccgttcaaactttagcacaagacacaaaacattgtgtctctccactctctgggtagctttgctgatagtccaccctctaggtcggacaacgcgtggaacagagttttaccctttttcaacgattgccaactcccaagagttctaccaactcgagcacatgggccaacctttccaaaaacatttctaaagcatttttctctcccttttcgccatacctaattcctcatgtagtcattgatgatactcttaccaacaatttgccgtcacttaccctgatgtaccggcatattagacatgggcttttcatgctactctacttgtcattcatcattatggcctccactgtttaattatagggtgaaacctcattctacggggaacttaggctatgcccagcgggatgcatatatgctcctgggtgtgcattatgagcaatggatgtaaactgtagctctcccaacggactgcacatgtggtctcgcattttgggagaggtgcctacacaatgcgcaaagctatgacttttctctcctcttagcatcgatgcgtctctcgacgtgcaagctgctggtactgtcaaatttacgatgcgccccatgatgcgtaaaaagtctcatttccgcatccgcatccgaataatgctggacatagccttagatagctctagaacctaaagctctaacatgctcaaaagctagagtgaattttgaacataactggaatttcaatcttctaactacataactcggggaaatgagaatggggactttttcgatactctatcagattgcgaaactactcgatcatatctagaattgtttaacaactgtaagactattttcagcaacattacttatacagatatacctgctctaatttcaaacttcaacatttaaagagtgtgcattatactatctggccatatcctaaagcccctctgcctctctctctctcacctcctgtcccctctcctctccgtgtccggtggagcttctccacctccggccaagatctggaaccagcgagggtgcccggcggttctcatcccggaccccgactctttcctcatctctgcaacctctggatcctccatctgcccccctgcaggatctggaagctgcacccgtcggggggagaagcaagcagcacatccagcccgctcgagctcgctcatctgacctcaccactgagcttccgcaggatcttcacatccccattccattgacaacgtgaaagagaacatgtgacggggctgccaagctacatgacaacgacgccgattgccgaatgccgagacaccgcgcacgctcttgcaggcatgtagtcctatgctattcatcctcctctctctctctctctctctctctctctctctctctctctctctctctctggtttctacgcccgtcgtataagaggcgcacacatacatggatgaggtaggacaggaaggaatttggtggtatttttgtaatcgccaaaaaaatcatttcctgcaagaaaacaatttgggttatgttctttgagcggaatttctagtgaccctagactcgtccccggttcttgaactatctgtgatgagtgaatgtttactaaattcgagttagttctgtacagataaaggtgatcggttgatcgacgtggtatttgtaccactttgctgtccgtgaaagcccgctatataggtggtgacatcaagtgatcaagattttatggtgcgcaagaggttgggttatagttcccgtggccatcgaattccaactatgccacgtgttccaaactcagctcgggtacatgttcttttgattaggtgtttttctttaatcacaatatggccattgaatccatgtaacaatcaactgtaatgcaggggaaacgttctaccagaagaaagaaagatgagaatgatgatatgtgtgcaatggatttgctcgcaactgtggcaggaaagttactagcagatcaggacaattcatctagcgttcctaataccagtgcagcgaaagctaaaaaaaggaaatcagttaaggaagaacactttgatgaaattccgcctctaaaaaatgtggctatggagaaagatgtgggttctggtagcgttagtgccttccctaggcaagctaaaaactgcctggcagaaaactcgtcgacaagaaatggagctgatacagtattagagtcactaacagtgaaatcaaatatgctagcaaaaattcctgagtgtggatcttatggaatacaccatgcaggctcctcaagttcagcagagcctgaacaagtgcatcaagctgaacctaaagtgagcagaagacaagcagatggacatcctgtggcttatggtatatttaactccgtggatgtggatggcaaacctccggctttggttagttctgacagtagctcgtgtgttcctctgagcagccatgacaaggaacatcaaacctcttccttgtatcggggtgtagtgcagtatactgcagatagagaagatgatgaaaattcttctgggtgcacgcatccaagcaccatagaaaataagggttgcaaaccacaatatctaggtaaccataggataaggaaattgcttgcctcgaaggtaaggaaggcagcacgtaataagatttgtggagggattccatcaaaaaagatctgtggagggttgtcaaaaaaaggtagcaagctaaacttatgtgggaaaaagatgtccaccacacaccaaaaggtgcaaagaatgattttcaaaaagaaaaagctagcgcaccgtacctcggccgcgaccgcgctgctaactgaagctagtgggacatcatttgctatggaaggtcaaaataaatcatgtgaagctgagaattaccatgttaagctaagaatcaagtcattcaacatcccagaattgttcattaaggtcccagaaaatgcaaccattggatcactgaagagagctgttatggatgttgtcaatagtataatggaaggcgacctacgcgttggtgttcttcttcaaggaaaagatatccaagacgacaacaagacactttgtcaggctgggatatgccacgataaaaagctaaataacatagacttcacgctggagtgcgagcgtgagcgtgagcctccctctggagtcattatacaagaacagatggatttcctcaccacagatatggtggagccattagctaggatgaagtgtgaggaaccttttcctgaagccgacgtcggagatgacagccagcagcctagagcgccttatcgaagccgctctctctctgacctgtactctgtccattgtcctgttcagatggcttcacaggacacgtcggtgagctcccaggccatcgtccctgtttcgcctgcgccttcagacgtgggcgctctagccattgtgcccctttgtaagtccaaggggtctgaagtcgggcagaggcgcatgaggagacccttcactgtcggcgaggttgaggcgctggtgggagcggttgagcagcttgggactggaaggtggagagctgttaaaacgcttgcattcgacagtatagatcaccggacctacgtcgacctcaaggacaagtggaagaccctggttcacactgcgagcatatccccgcagcaacgaagagggcagccggttccacaagaacttctagaccgtgtcctcctagcgcaggcctactggtcccagcagcagcagcaggcgaggctctaggacaagccccgcggcaaggctcctcttcttcctgagatctgctttccctaggagaagggcaagcttgtacttgtgtaaatactgtgcgtaatagaaaacgaggtagaaggggtgtccaaaggaaccagattagtttgtgtgttattgcatactcacaacattgttgttccttttcatgccctgctcgctggtctctgtcgaagccaggggctctctcgcatgtcgataaataagggggagagaaccttgcttggcacttgtaaatggtggcgcaaacttgccgtgttttataagcctttgacatgtcgctggaggtcgaggaattgatgtattcaatactgacgagccaaaaaaaaaaaaaaaa

SEQ ID NO: 1246 - DNA, 1068 bp, Zea mays
  misc_feature (1062)..(1062): n is a, c, g, or t
atcgaacaccaatggcattcttgcattgaaggaaccttccctccacctccaccgcccgagagcgagcggccggacggggttttggttgggcatggctgccccggcgatgctccaagtggtgatcctcgccgcggtcaccgacgatgacgaccgcaacggcaccaccggtcactcctccgtggctgtggtgggaaacggaaaccacacccacggcggcggcagcgtacgacaccaccgctcccgcagccgcaggcgtcgtcgtcgccgacaccgccatggtcgtctgcgtgacggcgatgaggacaatgacgaggacgaagacgaggacgaggacaacgatgaagacgaggatgaggacgacgacgaagacgatgacgaggatgatgatgacgacgacgatgaagacgaccaccgcgcctatagggactgctgccggtggctgaaggaggtggagccggactgcgtgtgcgaggcgctgctccgcctgccacccttcctcgtcaagccgcagcacaagtacaccgtcaaggtgggcaactcctgcaagttcacctacaggtgcggcggcgtctgatgatgagctgaaggccgccgggcacgcacgcctgcatatggcgcgagagcgactagcttaattgtatacgtacgtgctgtgcccatacatgcgcatatatacggtaacggtatatagatactgactgctacatgattcgagagcgacgacgatcgaggattcgaggtcgtctggccttttcccaaagtattgccatccattacagttataaccatcaagagtatgtgtttctccagtgagcctagcaaaaaaaaaaggaaaccaattagagtttggcttatatatgtaaactgatcaccctatataggtagccacaaatttgtaacagtaatattaattgtaataaatacgtgtcatgtatacactggcctgttgtcagtgtttgtcgtgtttccatctagacacgggttggtttcaaatgctacgtacattgcccgtagagaatatatatagtgtgttatatatgtattagttaaagaaaaaaaaanaaaaaa

SEQ ID NO: 1247 - DNA, 2241 bp, Zea mays
ccatggacggaacgtggtggacgagcggtcttcctgccggccgacgcgtccggatcgggttccaaccagcccaaaccaccccgccgccggccgtttccccgcactccaccacctgcgccggcccatcctcccggcctggcccatgccaacgcgccccgcgctgcccttgccgtgcctcagccggatccccctcaaagcacgaccacaccacgccgccggtaccggcgcaccatcgaaaccaaccctagccaaaccaaatcagatcagatccccttcccctctcctcccaaattcgctccgatccgccgcgaccgcgatggacgacgacgacgacgtgtcgccctcctcctccccgtcgccgccctcctcctccgcgctccccgtggacggccccgtcaccgtcgccgctgcgccgccgggcgcttccatggcggtcgcgctcccgatccataggaccgcggcgtccctgtacgctagcgccggcggcgatggcggcggcggcggcgggagggaggacgcctggagcgacggcgccacgtccgcgctcatcgacgcctggggcgagcgcttcgtcgcgctcggccgcggcagcctccgccacccgcagtggcaggaggtcgccgaagccgtctcctcccgtgacggctactccaaggcgcccaagtccgatatccagtgcaaaaaccgcatcgacacgctcaagaagaagtacaaggtcgagaggatcaagccggtctccggctggcagttcttcgaccgcctcgattttctcctcgcgcccacctacggcaacaagcccggcaacggcggcggcgggcacaactccaacagccgcagccagatgcctgcggcgccgcgggtgggcttccctcaacgcagccgcacgccgctcatgcccgcagcaggatccgcggccaagcggagggcgccttcgctggagccgtcggtgtcctccgattcctccgacggcttcccgccaatgccggcccttccggcggtgaacgggaagaggaagaggacggacgatgggcgctccgacgggggcggcgaccgcgcgcaggggcttcgggagctggctcaggcgatacggcgcctcggtgaggcgtacgagcgcgtggaggccacgaagctggaacaggaggccgagatggagcgtcggcgcatggacttcgcgcaggagctggagtcgcagcgcgtgcggttcttcctcgacacgcagatggagctcacgcaggccaagaatcacgcgtctcctgccacggccgccgtccctgctgttggctcgtcgaggaggattccgaggatgtcactggttaccgacgccggtggcagcagcaatcaccatagccgttaccggatcagccatgttgacaggcaccgccatgctccacgcccacattaccagcagtaccatgacaacaataacgcgggggcagcggctgcaagtgacggtgagcagtctgacgaggaagattatgaagaagagagccagtaactgcatcattgttcgccataattcatagggttaattaattggatctctatgccatgacaattccgtgttcgtagtgtctaactgagtcgttcttttttatacgctcgcaacgacgtttgatccacctccaggtcactatattttagtacgaaccaaagtaactcttctttctctggcttctgttcttcgtatggcggtgagtcaccggtgggaggggcgagcccggttggtggcgcgcggtcacggcggacggagcaacgccaacgagcgatgagggcatcgtgagaagggtgagcagagccgaaagtttgcgtgactgcacggcccaggtccatcgtatttcacactctacatgagataattttgtggtggaccgtgccgcgctcagttattaaaagctaggcccggtccaacccgaagaatagtaggctgatgatgtgttgtgtcggctcaagcacgcggacaaaaacctatatatatctaaaaagatatatcatcaaaatattcataactttgatatagataaaaaaccatatgtgaaatagaaattaatattttctataacttttgtgaagataaaaaaatattagagcatgaaataaccatttaaatgctagttttctaattcatgcctcacttcatgccatattggttcaaacacgatccatctagtcgtgccgtgctgtgtcgtgcctaagtttgaggcacggtacaacccagccattcgggccgtaccagtctagccc

SEQ ID NO: 1248 - DNA, 1444 bp, Zea mays
tccgcccggcttctttggccataaataaataaataaataaataaagccccgtctcgcgtcatttcttctcgccgattccccatctcgccctgcccgccgaagagcgcgcaagccccatctcgccctgcccgccgaagagcgcgcaagcaccaccgtcccggcagcgcggagatcggtccactccatccacgcggcgtcaggcgagcggggcgtacggacgctgcgaccgatggatctcaaggatagcctctccaaatttaagcaacagcaggagagatgtcagtcatcactggcgagcatagctgcttcgacctcaaagccaaagcacagggcccaaccagcgcatgctcctaacgtcccagcaagaccatcacaacctattaagttttcaaatgatacagaaaggctgcagcacatcaattcgattaggaaatctcctgttggagcacagatcaagcttgtcattgaacttctttacaagacaagacaagcttttactgcagagcagataaatgaagcaacttatgttgatattcacggtaataaagctgtctttgacagcttgagaaacaaccccaaagtaagctatgatgggaggcgtttctcttacaagtccaagcatgacctgaagggaaaagatcaactgcttgttttgattagaaagttcccagaaggtcttgctgttgtggaagtcaaggatgcatattcaaatgtattggaagatttgcaggctctgaaggctgctggtgaggtttggctgttatcaaacatggactcccaggaggacattgtatacccaaatgatccaaaagcaaagatcaaggttgatgatgacctgaagcaactcttccgtgaaatagagctgccacgtgacatggtcgacatagagaaggagctacagaaaaacggtttcaagcccatgacaaatactgccaaacgacgagcagctgcccagatcaatggcgtaaaacccaaggctaagcccaagaagaagcagcgtgagatcacaaaacggaccaagctcacgaatgcccatctgcctgagctgttccagaatcttaacacttaaacgtgctacagtatctgacgacggaagatggttcattttactcctatttattgctacgttgtgtgtatgtgttatgcagctatgctgtatggcttatggttatgagcgccacaaatttgtttgtcaagattctggatgatatacttatgcattctgacataataggaggcaaaacctcaagattttccttatttttattttatcaattacagcattttctgagtttgcggcaaaaaaaaaaaaagagcccggggccctcgggttggtgtgaggacaagctgaacatattttgatggattgcttagcttgaaatgataccagaatttaaacctcataattacgagtactgcggatctgcaggtttagctctcgtgc

SEQ ID NO: 1249 - DNA, 821 bp, Zea mays
tcgaagccggccgggaacgggtagcactctggggtagcggggggtggcacctgaaacgggaacctaccgttggatggcaccagagatgattcagcataggccatatgaccagaaagttgatgtctacagctttggcattgtgctgtgggagctcataactggcatgctcccttttgctaacatgacagcagtgcaagctgcttttgctgtggtgaacaagggtgtccgcccagctataccccaggactgcctgcccaccctcggtgagatcatgaccaggtgctgggatccaaatcctgatgtccgtccgccgttcactgaagttgtgaggatgctggagcatgctgaggtggagatcctgagcactgtccgcaaggcccgatttcggtgttgcatctcccaaccgatgaccaccgactgaatcaaacagaagagagtcgaaaagaactccatgcaagcataattgataaatttatcttgtgtccagacttcgctcagctgaagtagaaagcacacctgagtgtatggccgtgtgtgtgtgtatactcaggtgtaagcatattgtctttgaaatattcctgccattagaaatatacctagttcgcggtttcagactcttgagatgttttagggctagcctatgccctgtcgaaacatcatgcaggcttcctattcttgtaatgtcgttgtggccctgctgctttgttcatgttataaccctcctactggattatgcaaacactttgttgcttctgagtatatagcatgtataatttccttgcaaaaaaaaaaaaaaaagcgcccccgccaccgcggtggag

SEQ ID NO: 1250 - DNA, 2081 bp, Zea mays
ctcgaggccggccgggaggtaatccccaaccagccgtgccgcgagcaatcaaccagcccaccggccgtgctaacccccgcacttaccaagagagagaaaaagcgagaggcgactccacgcgtctcgtctcgtctcgtctcgtctccctctctctcgtccggtcctccctccccttcctgaggcgttccctctctctcctcccctttcctctgctggtctctactctcttgtcatcgcacccgtctccccgctctgactccgtcccgagcggccgactccgcccgcgccgccgccgccgccgcctcgtcccgatcgacccccgaatcgccggaaaccgtggacttcgcgaggttgtgtctttacctccgagcggtgtagggaatataacagggtgacagctgaattgcagaaaaaaggaggacatttggttgttgcatgatggtggaaggccccaatttcgctggcctgattggtggtcatgacaatggtgggaatttttgcgacatggcatactaccggaaactcggtgagggctcaaacatgtcgatagatagccttaacagcatgcagaccagcacgcatggcggctccattgcaatgtctgtggacaatagcagtgtagggtcctgcagctcccatactaggatgctcaatcatcctggcctcaagggacctgttgttggcaattactccgtcggtgggcacagtattttccgtcatggacgggtgtctcatgccttgagcgatgatgcgctagcacaggcgttgatggacccaaggtacccgactgagacactcaaagattatgaggagtggacaattgatttagccaagctccacatgggaatgccctttgcacagggcgcctttggaaagctctacaggggtacctacaatggggaagatgttgccattaagcttttggagaggccagaggctgatccagagagagctgggttaatggagcagcagtttgttcaagaagttatgatgcttgcaaccttgaggcaccagaatattgttaaatttattggagcatgcaggaagccagtggtttggtgcattgtgacggagtatgccaagggtggatcagttagacagtttctagcgaagaggcagaataggtcggttccactaaaactggcggttaagcaagcattggatgttgcaagggggatggcctatgttcatggtcttgggttcatccatagggatcttaagtcagataacctcttgatatctggtgataaatctatcaagatagctgactttggagtagctcgcattgaagtaaaaactgaggggatgacacctgaaacgggaacctaccgttggatggcaccagagatgattcagcataggccatatgaccagaaagttgatgtctacagctttggcattgtgctgtgggagctcataactggcatgctcccttttgctaacatgacagcagtgcaagctgcttttgctgtggtgaacaagggtgtccgcccagctataccccaggactgcctgcccaccctcggtgagatcatgaccaggtgctgggatccaaatcctgatgtccgtccgccgttcactgaagttgtgaggatgctggagcatgctgaggtggagatcctgagcactgtccgcaaggcccgatttcggtgttgcatctcccaaccgatgaccaccgactgaatcaaacagaagagagtcgaaaagaactccatgcaagcataattgagtaaatttatcttgtgtccagacttcgctcagctgaagtagaaagcacacctgagtggctgagtgtatggccgtgtgtgtgtatactcaggtgtaagcatattgtctttgaaatattcctgccattagaaatatacctagttcgcggtttcagactcttgagatgttttagggctagcctatgccctgacgaaacatcatgcaggcttcctattcttgtaatgtcgttgtggccctgctgctttgttcatgttataaccctcctactggattatgcaaacactttgttttgttgcttctgagtatatagcatgtataatttccttcccaaaaaaaaaaaaaaaaaaactcga

SEQ ID NO: 1251 - DNA, 2080 bp, Zea mays
gttaaaaaacaccgcaattaaccagctcaccctggctaacccaccaccaccacccggccgggcccgtcgaggccggccgggacctccactcgtgactcgtgagtcgtgagtagtgactcgtctggtctcccctctctcgtccgtctggtcctcccgtccagaggcgttctctctccctccccctttcctctggtcatcgcacccgtctccccgctctgactccgcccgcgccgccgactcccggcacggccccccaggcttcatctccgccgccgccgtcgccgccgcctcgctccgatcgacccccgaaacgccggaaaccgtgggcttcgcgaggttgcctctcttcgtccaagcggtagataacataacagtgcgacaggtgaattgcagagagaagggggggcatttggtcgctgcatgatggcggaaggccccaatttcgctggcatgattggtggccatgacaatggtggggatttctgcgacatggcatactaccggaagctcggtgagggctcaaacatgtcggtagacaaccttaatagcatgcagaccagcacacatggtggctccattgcaatgtctgtggacaacagcagcgtagggtcctgtgactcccatactaggatgctcaatcaccctggcctcaagggacctgtcgttggcaattactcggtcggcgggcacagcattttccgtcatggacgggtgtctcacgccttgagcgacgatgcgctggcacaggcgttgatggacccaaggtacccgactgagacactcaaggattatgaggagtggacgattgatttagctaagctccacatgggaatgccctttgcacagggcgcctttggaaagctctacaggggtacctacaacggtgaggatgttgccattaagcttttggagaggccagaggcagatccggagagagccgggttaatggaacagcagtttgtgcaagaagttatgatgcttgcaaccttgaggcaccagaatattgttaaatttattggagcatgcaggaagccagtggtttggtgcattgttacggagtatgccaagggcggatcagttaggcagtttctggcaaagaggcagaataggtcagttccactaaaactggcggttaagcaagcactggatgttgcaagggggatggcgtatgttcatggtcttggcttcattcatagggatcttaagtcagataacctcttgatatctggtgataaatctatcaagatagctgactttggagtagctcggattgaagtaaaaactgaggggatgacacctgaaacgggaacctatcgttggatggcaccagagatgattcagcacaggccatatgaccaaaaagttgatgtctacagctttggcattgtgctgtgggagctcataactggcatgctcccttttgctaatatgacagcagtgcaggctgctttcgctgtggtgaacaagggtgtccgcccagctataccccaggactgcctgcccacccttgctgagatcatgaccaggtgctgggatccaaatcctgatgtccgtccgccattcactgaagttgtgaggatgctggagcatgctgagatggagatcctgagcactgtccgcaaggcccgatttcggtgttgcatgtcccaaccgatgactaccgactgaatcaaacaagagagttgaaatgaactccatggaagcgtaattgagtgtatttatcatgtgtccaaacttcgctcagctgaagtagaaagcacacctgagtttatggctgtatgtgtgtatactcaggtgtaagccttgttgtctttgaaatattcctgcacttagaaatatacctagttcgcgttttcagactcttgagatgttttagggctagtctatgtcctgtcgaaacatcatgcagggttcctattcttgtaatgttcttgtgatcctgctactggaatgtgcctcctactggaggtggtctgttcatgttataaccctcctactggaatatgcacaaatacttcgttgcttgagcaaaaaaaaaaaaaaaaaaaaaaaaaaaaaacccggtgccggcccccgtacc

SEQ ID NO: 1252 - DNA, 2477 bp, Zea mays
aattcggcacgaggcccaccaccaccaccaccataccaggagagagaaaagagagaggcgcctccactcgtgactcgtgagtcgtgagtagtgactcgtctggtctcccctctctcgtccgtctggtcctcccgtccagaggcgttctctctccctccccctttcctctggtcatcgcacccgtctccccgctctgactccgcccgcgccgccgactcccggcacggccccaggcttcatctccgccgccgcgccgcctcgctccgatcgacccccgaaacgccggaaaccgtgggcttcgcgaggtgcaatttcttgggccgcgtctgagcttgattcagtttctggaagcggcctgagcttgggatttgatccgggttgcctctcttcgtccaagcggtagataacataacagtgcgacaggtgaattgcagagagaaggggggcatttggtcgctgtatgatggcggaaggccccaatttcgctggcatgattggaggccatgacaatggtggggatttctgcgacatggcatactaccggaagctcgctgagggctcaaacatgtcggtagacaaccttaatagcatgcagaccagcacacatggtggctccattgcaatgtctgtggacaacagcagcgtagggtcctgtgactcccatactaggatgctcaatcaccctggcctcaagggacctgtcgttggcaattactcggtcggcgggcacagcattttccgtcatggacgggtgtctcacgccttgagcgacgatgcgctggcacaggcgttgatggacccaaggtacccgactgagacactcaaggattatgaggagtggacgattgatttagctaagctccacatgggaatgccctttgcacagggcgcctttggaaagctctacaggggtacctacaacggtgaggatgttgccattaagcttttggagaggccagaggcagatccggagagagccgggttaatggaacagcagtttgtgcaagaagttatgatgcttgcaaccttgaggcaccagaatattgttaaatttattggagcatgcaggaagccagtggtttggtgcattgttacggagtatgccaagggcggatcagttaggcagtttctggcaaagaggcagaataggtcagttccactaaaactggcggttaagcaagcactggatgttgcaagggggatggcgtatgttcatggtcttggcttcattcatagggatcttaagtcagataacctcttgatatctggtgataaatctatcaagatagctgactttggagtagctcggattgaagtaaaaactgaggggatgacacctgaaacgggaacctatcgttggatggcaccagagatgattcagcacaggccatatgaccaaaaagttgatgtctacagctttggcattgtgctgtgggagctcataactggcatgctcccttttgctaatatgacagcagtgcaggctgctttcgctgtggtgaacaagggtgtccgcccagctataccccaggactgcctgcccacccttgctgagatcatgaccaggtgctgggatccaaatcctgatgtccgtccgccattcactgaagttgtgaggatgctggagcatgctgagatggagatcctgagcactgtccgcaaggcccgatttcggtgttgcatgtcccaaccgatgactaccgactgaatcaaacaagagagttgaaatgaactccatggaagcgtaattgagtgtatttatcatgtgtccaaacttcgctcagctgaagtagaaagcacacctgagtttatggctgtatgtgtgtatactcaggtgtaagccttgttgtctttgaaatattcctgcacttagaaatatacctagttcgcgttttcagactcttgagatgttttagggctagtctatgtcctgtcgaaacatcatgcagggttcctattcttgtaatgttcttgtgatcctgctactggaatgtgcctcctactggaggtggtctgttcatgttataaccctcctactggaatatgcacaaatacttcgttgcttgagcatatagcatgtataatttcctgacaaaaaaaaaaaaaaaaaacaaaagttctgatagcgtcagtcctagctaacatgtagaatttggtcgggactaatagaaaatagtatttttcttttttttccctggctaattggctacattgagcacaattcttcagggggtcagtggaaaaaaagttaacaaagcagtgagcggacgaaaacggtgacaatttaggaatctctgtaactagctgtagtctgtttaactgaaggtaaaaacaaagctaactgaaggtaaaacaaagcctatgtctctagcctaccatgctgtacaaaagggcccggtgtcagactccacataagaaatatttgcataactctcattctctcctccctgaaatggcttcagaaatgggcccagggg

SEQ ID NO: 1253 - DNA, 921 bp, Zea mays
tagaaaaagtatttttcttttttttcctggctaattggctacattgagcacaattcttcagggggtcaggggaaaaaaagttatacatagcagtgagcggaggtaaacggtgacaatttaggaatctctgtaaccagctgtagtctgtttaactgaaggtaaaaaacaaagctaactgaaggtaaaacaaagcctatgtctctagcctaccatgctgtacaaaagggcccagtgtcagactccacataagaggtctgagcaacaaatgcggagaggctgctttgaacctgtggctgcaaatatttgcataactctcattgtctcctccctgaaatggcttcagaaatgggcccagctgctgctctggattagtcatgaatggagaacgagcaatcacccgctttccttcaagaggcctcccacttccgctgttttcagcttgtcctcttcgatcttcacaggagcagcgggagcattatcagcagcatcagcatcttcaatccttggtttattttctttgtcattggttttttccaattgaactgcctgtgcaaatgcgtccgacataccagtcacaatatccaccggtgcactggcctgcacctgcttgccagtatcggaacactctggcttctgttgttgcctgtcatctagcatagctttctctcgttgctcatagaagtcgaagtcctcaaggatgtttgtctgggcttcatggttcttgaagatggctaacatctggagaccctgcttcagtttcacctcctgcgtgtccctgctatttgtaactcgcttgttctcattgttctctaggatgatgtgccggacaatgttgtttgggacatccttaacaatgtgccatttgacagggaattggccattccatctttcattctgccagtaatcaacactcttgtcaaa

SEQ ID NO: 1254 - DNA, 579 bp, Zea mays
gcacgagcccgcttcgtgcgccgcaagaacgtgctcctcagcgtcgacttccgacaagacggacgaggcggagctgcaggccgccgtggagcgcgcggcgcgcctgctggcgccctacgacgcggccatcgccgagtacacgagccaggcggacgccaccaccatcccgggccactacgtcgtgtactgggagctcatggtgcgggagggcggggcgtcgcccgacgccgccgtcttcgagcgctgctgcctggagatggaggaggccctgaacgcggtgtacaggcagggccgcaacggggacgccatcgggccgctggagatccgggtggtgcgcggcggcacgttcgaggaggtgatggactacgccatctcgcgcggcgcctctatcaaccagtacaaggcgccgaggtgcgtgtcgttcggacccatcatcgagctgctcaactccagggtggtgtccagccacttcagcccggcgtgccccacgtacagcccgcacaagaagtgatgacctaatagcattggccgtcggaggcccagactgagctactacacttctgctagtactattactac

SEQ ID NO: 1255 - DNA, 1187 bp, Zea mays
  misc_feature (1163)..(1163): n is a, c, g, or t
ccacgcgtccgaccggggaaaaaatataagcgatactgccagaggcgcctagtcgaaataaaggactatctcagcgatttccgaaccctccccacccccacacccacccgatccaaccgagtcccggcggcgatggcggcggcggcgacgaacgccgatgtggaggtggtcgacttcgacctcgatgacgacgacctcatggacgaggacgccgggccggatccagcaccgccccccgcctcccgcctccgctccaccatcgcgggcgacgacgcgccgcgtaggaccaagggccgcggcttccgcgaggaccctaactcctccgcgacccgcgactcgcgctttggcgcggggggacgcgccgacctcgactcgcttggcggccctggacccatccagtcaattgaaggatggattgtgttggtcacaggagttcacgaagaagctcaagaagatgaccttcaaaatgctttccaagaatttgggcaggtcaaaaacctgcatttgaatttggaccgccgtaccggatttgtcaaggggtacgctttgattgaatacgagaagtttgaagaagctcaggctgcaataaaagaactggatggagctgagctttataaacaaagaatgagtgttgattgggcatttagcagtggccctgctaaacgcagaaatactcggaaaaggtcaccaccaagagctcgttcaaggaccccacccaggagaaggcactgatgtttccccagcatgtcttgaactacttgctatgtgtgacagagagcaagaagtctggggattccaaatattaccttggtgtatgtggatcacctgatttcgatggtggttattaaattgcctgttgtttccttattgggattccaaatattagctttgaactctggtgtaagttgatgagacatggatgtgcacttagacgcttaccattatgtttggcatgccagttggagacgattgttggaggcgattgtatgggatcatgcttttggatttttgacgagtgatgagttgatgttggatttttatgtttctgtgtaccagaactatggtgtgttacctttcctcattctgtagtcgctcaagaaatgtttttgttgtcgctcaaaaaaaaaaaaaaaaaaaaaaaaaaaaaaaaaaaaaaaactcgngactagttctctctctcctcgtgc

SEQ ID NO: 1256 - DNA, 1148 bp, Zea mays
  misc_feature (27)..(27): n is a, c, g, or t
  misc_feature (33)..(33): n is a, c, g, or t
  misc_feature (107)..(107): n is a, c, g, or t
gaagccctttcacagacgagcttggtnacatcnacgtgcacattcgccatgctcaagcctaggcgaagctgttcctttctccttcaggcgaaggttggcttcgtctntccttcgtaacgcgcctaaaaaagtcgcctagcaattcccgaaatccccaaaagtcgcccttcccccaaccctatccaaccgaatccagcggcggcggcggcggcggcggctatggcggcggttatgaacgccgatgtggaggtggtcgacttcgacctagacgacgacgacctcatggacgaggatgccgggccggatccagcgccggcccccacctcgcgtctccgctccaccatcgcgggcgacgacgcgccgcgtaggaccaagggccgcggcttccgcgaggaccccaactcctctgcgccccgcgattcgcgctttggcgcggggggacgcgccgacctcgactcgctcggcggcccgggacccatccaatcaattgaaggatggattgtgttggtcactggagttcatgaagaagctcaagaagatgacctccaaaatgctttccaagaatttgggcaggtcaaaaacctgcatttgaatttggaccgtcgtaccggatttgtcaaggggtacgctttgattgaatatgagaagtttgaagaagctcaggctgcaataaaagaactggatggagctgagctttatgaacaaaaaatgagtgttgattgggcctttagcagtggccctgctaagcgcagatttactcggaaaagatcaccaccaagggctcgttcaaggaccccacccaggagaaggcactgatgtttccccagcaagtcatgaatttactatgcgtgatgtagtgaaagaagtctgggatttcaattctcaaatgttagcttggtgtatgtgtatccggctttgagttgatggacacacggagttacttagccgcttaccattacgtttggcatgccagttggagactattgtaagcgatgattttttttttttgtgtaggtctgacaagtggcggtgttggatttttatgttcgtgtgtgccttcactttgttatcgccattctgacgagtgatgctttgggttttgatgttcgtggggcgccccttgcttgattgagcagctagcgattggc

SEQ ID NO: 1257 - DNA, 1135 bp, Zea mays
gagcaacaagagagagaggacatagccgcacaaagggaaggagaccctcgccaacctcgaagctagtccaaactagtgggaggttgagtgcagggatcgatcgaggaagacgagacaagcttcttcttctgctgccgccgccgccagctctagctcaccacgagttactagccaatctgacaccgaccgtccatggcgcggggcaaggtgcaacttcggcgcgtcgagaacccggtgcaccggcaggtgacattctgcaagcgccgcgcggggctgctcaagaaggcccgggagctctccgtcctctgcgacgccagcgtcggcatcatcgtcttctccgcgcacggcaagctctacgacctcgccaccaccgggaccatggaggagctgatcgagaggtacaaggctgccagcgccggagaagcgacgaccgacggctgcggcaggcacaacaggatggaccccgaacatgaaaccacggtgctgcaacaggaaatcaacctgcttcagaagggactgaggtacatctacgggaacagggcgaacgagcacatgaatgttgacgaactgaacgccctagagaggtacttggagatatggatgtacaacacccgctctgcaaagatgcagataatggctcaagagatccaagcactgaaaagcaaggaaggcatgttgaaagctgccaacgagattctccaggaaaagatagtagagcagagtagtttgcttgacgtaggcatggtggtagcggaccagcagaatgggcgttttagcacagtcccactggtagaagaggtgatcagtagtaacccactgactgtactgagtggctattctagctgtaggggttcagagatgggctactccttctgaccgtaataacaaacagcctgggggctccttctgttgattactactagtgtgtaatacatacagtcaataaagtctgtaatgggttggttgttctgctgctttggtgtatcatattcgtatcatgtaggccttagataagcccttcaggagtgcccctggtattgtgtcgtcgtgccttttacttctccagaatgaagaaatattgtctattgaggagatctgatgatgtgctatttcttcctcaaaaaaaaaaaaaaaa

SEQ ID NO: 1258 - DNA, 1086 bp, Zea mays
gggaggggggaatatagtgcaaggaggagcctcgccaacctcgaagctagtccaaactagtgggaggttgtgtgcagtgatcgatcgaggaagacgagaagcttttcgctgctagctaccgcccgcccggtgtctgtcgatctgtgacgaccgccaagccgaagccgaaggcagcagcagtcgtcaagttcatcgatctcggcatcgacgaccgcccggccgtccatggcgcgaggcaaggtgcagctgcggcgcatcgagaacccggtgcaccggcaggtgaccttctgcaagcgccgcgccgggctgctcaagaaggcccgggagctctccgtcctctgcgacgcccacgtcggcatcatcgtcttctccgcgcacggcaagctctacgacctcgccaccaccgggaccatggaagagctgatcgagaggtacaggactgccagcagcggagaagcagccgacggctgcggcgacaataacagaatggacgcaaagcaagaaaccatggtgctgcaacaggaaatcaacctgcttcagaaaggcctgaggtacatctatgggaacagaacaaatgaacacatgaatgttgaagaactgaatgctctagagaggtacttggagatatggatgtacaacatccgctctgcaaagatgcagataatgattcaagagatacaagcactgaaaagcaaggaaggcatgctgcaagctgctaacgaagttcttcaggagaagatagtagaacagagtagtttgcttgacgtaggcatggttgtagcggatcaacagaacgggcattttagtacagtcccactggtagaagagatgatcagtaacccgctgactatactgagtggctattctaactgtaggggctattccttctgacactgtcataacaccctggggggctaactctctgttgattactactactagtgtgtaatactaccagttaataaagcttgtgtaactttgccatatagccagccctccaggagtgccctggtattgtatctgtggccttttttttttttttacatcccataataaagaactgttgaggagctctcatgttgtgct

SEQ ID NO: 1259 - DNA, 1748 bp, Zea mays
cattgggtacctcgaggccggccggggcaacactctcctcccgggcctcccccgccgaaaaaaacatctcctttgtatcggcctcggcaatcctgaccggatcaacaaagacgtagctaccccctcccgcgtccgtcgaattcgcctccgccgcctgctcgatccggtgggaattcgccgctgccgggttgttttcgctggggtgattaaggctcgggattcgagatctacgcgagtcgcgggcaagcagccatgagcgaggtgttcgagggctacgagcggcagtactgcgaggcctccgcctcgctctcccgcaagtgcaccgctgcctccgccctcgatggggagaagaagaagcagaagctgtccgagatccaatccggcgttgaggaagctgaatcgctgattcgtaagatggacctggaggcaaggaacctacagcctagcattaaggctggtttgcttgcaaagctgagggagtataaatctgacctcaacaacgtcaagagtgagcttaagaggatctcagcgcccaatgctaggcaggctacccgggaggagctcctggagtctggaatggctgatactctcgcggtgtctactgatcagagggggagattgatgatgacaactgaaagactgaatcagtcaactgacagaattaaagagagccgaagaactatgttggagacagaagagcttggtgtgtcaattcttcaggaccttcaccaacagcgacagtcactactacatgctcatactactttgcacggagttgatgacaacattggcaagagcaagaagatcctggctgcaatgtcaaagaggatggataggaacaagtggatcattgggggaattatcacggctctcgttctggccatccttctcatactctacttcaagctcgctaattaagcctctgcctgcaggtaggttccccctacatatctgtgttcagtaattgtgtgatatgagttgtctgaatgccgtgtattgagcaacacgcagctctccgagcgtcatttgttccccctcaaacctgtaaactcaaaatggcttattctgtgtatagtctgttattcccaactatgtaaaatgtctaaagagtaaaaaaaataatacttggtgttgagtctcatgtgcacatcgcacgttgttctgtcatgttaaactagagtggttactagagcagtatgtactacctctgtcccaaaacaaatcaacttctaaagttgtcatccctaagtcaaactattttaagttcgattaaatttatagaaaataccagtgtttgtaataccaaattagcatagttagatccatcactaagtatattttttataatgtatttatgtagttctatagacgttgttagttggtctttcctataaattaaatttggtgaagcctaagatagtttgactataggtgattataggtttactttgggaaggaagtagtagtaactattgtgtgtgcatcagcctatttgaactgctgtcgctgtctgccttggaattattgtgattaggcagctctgcggctagtctgttatggttgtcgtgctagtgtttgtgcagatgcttcctgaatgattgagtggtagaataggtgggccttggcagctagctagcgtgcatgcgcagaaggtgcaggtctatcggtgctgcagtaacttgagtcgcagagctaggttggcatgcaatgcaagtgggctaagcgatgaggcaggcgcatcttgtgca

SEQ ID NO: 1260 - DNA, 1281 bp, Zea mays
agataggcctcccacgacagcaactcacctcccgggcctaccaagcagtctctagaaacaaacaaacagcggcaatgtgctaatctcttctgcatttgggcacggcaatcctgacccgaccctccagatttcccgtcgccgagccacgcggatcgagtacccgtcgaactcgccgctgtcggatcgagtacccgtcgaactcgccgctgtcggatcgttctcgcttggggcgatcaagctaacgggatttgaggagatctaggccagccgcgggcagcagccatcagccatgagcgaggtgttcgagggctacgagcggcagtactgcgaggcctccgcctcgctctcccgcaagtgcacggctgcatccgccctcgatggagagaggaagaagcagaagctctccgagatccagtccggcgttgaggaagctgaatcgctgattcggaagatggacctggaggcaaggagcctacagcctagcattaaggctggtttgcttgcaaagctgagggagtataaatctgacctcaacaacgtcaagagtgagctcaagaggatatctgcgcccaatgccaggcaggctacccgggaggagctcctggagtctggaatggctgatactctcgcggtgtctactgatcagaggggaagattgatgatgacaactgaaagactgaatcagtccactgacagaattaaagagagccgaagaactatgttggagacagaagaacttggtgtctcgattcttcaggaccttcaccaacagaggcagtcactactacatgctcatactactttgcacggagttgatgataacattggcaagagcaagaagatcctggctgcaatgtcaaagaggatggataggaacaagtggatcattgggggaatcatcacggctctcgctctggccatccttttcatactctacttcaagctcgctcattaagcttgcctgcaggtaggttccttccacatatctgtgctcagtaattgtgtgataagagttgtctgaatgctgtgtattgagcgacacacggctcttgaagcatcatttattccctcccaaacctgtaaacttaacgtggttcatgttgtgtacagtcagatacgtccaactatgtaaacctaacgcacgttgttctgtcgtgctaactaaactagagaggttagtaaagcagtacttcgtatgtaaaaaaaaaaaaaaaaaaaaaaaatacgaagagggggggctgcccgccttggaatttattgtgattaggcagctctatggct

SEQ ID NO: 1261 - DNA, 1334 bp, Zea mays
  misc_feature (361)..(361): n is a, c, g, or t
agatactagtagataggcctcccacgacagcaactctcctcccgggcctaccaagcagtctctagaaacaaacaaacagcgccattaatgtgctaatctcttctgcacttgggctcggcaatcctgacccgaccctccagatttcccgtcgccgagccacgcggatcgagtacccgtcgaactcgccgctgtcggatcgttctcgggggctggggcgatcaagctaacgggatttgaggagatctaggccagccgcgggcagcagccatcagccatgagcgaggtgttcgagggctacgagcggcagttctgcgaggcctccgcctcgctctcccgcaagtgcaccgctgcctccgccctncgatggagagaggaagaagcagaagctctccgagatccaatccggcgttgaggaagctgaatcgctgattcggaagatggacctggaggcaaggagcctacagcctagcattaaggctggtttgcttgcaaagctgagggagtataaatctgacctcaacaacgtcaagagtgagctcaagaggatatctgcgcccaatgccaggcaggctacccgggaggagctcctggagtctggaatggctgatactctcgcggtgtctactgatcagaggggaagattgatgatgacaactgaaagactgaatcagtccactgacagaattaaagagagccgaagaactatgttggagacagaagaacttggtgtctcgattcttcaggaccttcaccaacagaggcagtcactactacatgctcatactactgttgaaagaactgtgccgcttgctaaccatccagacccaaacaacgccaaaagctgccatgctggctgctgggctaccggggtcggggccgcgctgcgggcagaaggcgaagcggtggtggaccgcggagcgtggagggcaggagcggagcacgtagggcaggggcggaccgactcgccgatgcctagagcggcagagcccccaaggggataggacggcggagctggtcttgggcggttctggcggcgctgaggagagcggagatgaacttgttcgtcagttcgtgggaggctgggattaataggattttctaaattttggtatgtttgttgggctgaatcgaggtattgcccaagcaacactgagcaatattgggccctccacccctgtaaacagataaacatcgcttagagaggtttcttgcccccatgaaccacctagtaagtttttggtgtgtttggtttgaggacaagggtggatgtgatatgtccatccatagatttcaggatatgaatagaatatccatgttgtctgtttggttggacg

SEQ ID NO: 1262 - DNA, 1235 bp, Zea mays
tattgttttaggagctcttggagatgctctaatctcttctgcacttgggctcggcaaccctgacccgatcctccagatttcccgtcgccgagccacgcgggtcgagtacccgtcgaactcgccgctgtcggatcgttctcgcttggggcgatcaagctaacgggatttgaggagatctaggccagccgcgggcagcagccatcagccatgagcgaggtgttcgagggctacgagcggcagtactgcgaggcctccgcctcgctctcccgcaagtgcaccgctgcctccgccctcgatggagagaggaagaagcagaagctctccgagatccagtccggcgttgaggaagctgaatcgctgattcggaagatggacctggaggcaaggagcctacagcctagcattaaggctggtttgcttgcaaagctgagggagtataaatctgacctcaacaacgtcaagagtgagctcaagaggatatctgcgcccaatgccaggcaggctacccgggaggagctcctggagtctggaatggctgatactctcgcggtgtctactgatcagaggggaagattgatgatgacaactgaaagactgaatcagtccactgacagaattaaagagagccgaagaactatgttggagacagaagaacttggtgtctcgattcttcaggaccttcaccaacagaggcagtcactactacatgctcatactactttgcacggagttgatgataacattggcaagagcaagaagatcctggctgcaatgtcaaagaggatggataggaacaagtggatcattgggggaatcatcacggctctcgctctggccatccttttcatactctacttcaagctcgctcattaagcttgcctgcaggtaggttccttccacatatctgtgctcagtaattgtgtgataagagttgtctgaatgctgtgtattgagcgacacacggctcttgaagcatcatttattccctcccaaacctgtaaacttaacgtggttcatgttgtgtacagtcagatacgtccaactatgtaaacctaacgcacgttgttctgtcgtgctaactaaactagagaggttagtaaagcagtacttcgtatgtaactgttgtgtgtgcatcggtctattcgaactgctgtggctgtgggccttggaatttattgtgattaggcaaccaaaaaaaaaaaaaaaaaaaaaaaaaaaagaaaaaaaaaactcga

SEQ ID NO: 1263 - DNA, 2162 bp, Zea mays
acctgctctgcctgcttctttccccctcccctctgcgcgcgcaccatcgccttcctcatcacccaccccaccgagactgtactctgtagccataccacacccctcctaccactgcaaggccggccggcccgcccgctcgccgcttcctcgcgtctcgagtccgtgcctgcctggtgcgtcgatcgaccccgagtcccgaccccggccgcctctcacggtggtggtggtggttcttcgacgccgcggtgggcggggggcacgcgtgtggttcgtgcaagccggagggagggggttctgctgtgactgtgatggcggcggcgatgtgcgtggatgacgaggccgcctccgccgccgcggaaagcgcgggggtcgacaagctggatctcggcgcggccgcgggcggcaagaggagcgtctacctcatggactgcgcgccggtctggggctgcgcgtccacgcgcggccgcagcgccgagatggaggacgcctgcgccgcggccccgcggttcgccgacgtgccggtgcgcctcctcgccagccgcagggacctcgacggcctgggcctcgacgccggcctccccgcgcgcgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaataaagggctaatacagcagcaatttatgctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaagtcttttatcaggctactcgttttctggaacaggattcatgcttagctttccctcctgtctgaatgtgatggttgcctgaatcctaatttgcctgtctgtggtgtgagaccatctccaaccattcccctcatatttctcctcctatctgtactttctattatattttactactttacctcaaaagatactcctacatttagaaggtttccaaccattcaccgctccctttgtatactataattcaattatatttgatatattttttatcagtttttaaagtttgaaaaatcagactattttagttaccttttaatacacactggttcactaggatggcaactgatgtatagccgtcggtagttaaacaaataatatcctgagaaggattttttagctgagatgtgttttattattgataataatggtatgatgtggatatattttacctacaggtacataagtatgggtagtatccactcatactcgtttacctaacagttataaattcttgcccactaacatatccattggtagagaaattattctatacccactttgacatcgtgtaaaattcgtcggatttttggtttcgggtactcattgcctctaggttccaccctatagtacacgttaaagagggtggagggaggtgtgtggggtgttgttggagaaggcctcaatatacgagcatctccgcccgatctctgatagtgcaactcctatacgttattttaggcgagtagcttagaatcaatt

SEQ ID NO: 1264 - DNA, 1053 bp, Zea mays
cattgggtcccgcccgggcttccaccatcgcacccacccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaataaagggctaatacagcagcaatttatgctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaagtcttttatcaggctactcgttttctggaacaggattcatgcttagctttccctcctgtctgaatgtgatggttgcctgaatcctaatttgcc

SEQ ID NO: 1265 - DNA, 619 bp, Zea mays
cccacgcgtccgccctcgttgccttcaggttccacgtcaacctgctcaggctgacgtggaggacggcgttcgtggtggtgagcacggtgctcgccatcggccggcccttcttcaacgatatcctgggcttcctcggcgccatcggcttctggccgctcaccgtgtactacccagtggagatgtacatccggcagcggcgtatacagaagtacaccagcaggtgggtggcgctgcagctgctcagcttcctgtgcttcctggtgtcgctcgcctcggcggtcgcgtccatcgagggagtcaccgagtcgctcaaacactacgttccctttaagaccaagtcgtgatgactgactgagcttaaattctccggtcactgtacaatgcaatggcttaccaccttgcagtgctcgctaagggttatagtccacatgaaaaactgatgcacatagaaaatcctgaccttcaaaaacagatctggtgtgtgattgttttgcaccgttatatctgattttgaagactaggattttatatgtgtacatgtataccaaacctccatgtgtaccaaataccatgggctagtgaaaaactgatgcaattgagtcccgtgcccaaagcggcc

SEQ ID NO: 1266 - DNA, 1000 bp, Zea mays
tcgaggccggccgggacctgatgttgctttgcccgcaacttttgcttgccacgacggaggccagatccagctcctgggcgtccgtcatccttccatctcccgccctccctcgtcggagcacgagcaccaaaggtgcccagatcttcgtcggccctgcccctgcttccttcaactccaccaccaggcgatgccctagacttaattgaatgggctctcttctcaccaggactggcgtcctgccatggctccacgccaagattgttgatcccgtgctgcaggtcatcagaaggggagcagaacccaagcaactagccttctctgctgcccttggtatcacgattgggatctttccggtatgtgggacaactgttattcttggtgctgttgctgtagcagtgttgggaagtcgttgcaatgctgttactgttatggttttaaatttggccgccactccaattgagctaagcttgatcgtccctttcttgcgtttgggggaaaccatcactggcagtgggcacttccccttgacagccaacgcattgaagaatgttctcactggtcatgcatcaaaggatgtgctgctgagcatcgtcaatgcgatgctgggttggcttattgctgcaccatttgtacttgccgtgctgtacgctgtttcgttcccttgtttcaaggtcctggttaacaggtttggcagcattccttcgagccccaggaccccattcaaggcggtgtaggtagtgtgtagcatgctgaatgctcctgaaattgtgtacaccaaattctttgtgatgccgttgggttgagatgggttccggcgtcatgttgctcggccatcccaggcactggcgaataaatccgacttgagaggcacgtgtcctctataattctgtatgctggcttggtaatcatatagtgatatgtgtatttatgaatttacaaactcttcatgaataaagccatgtttggataaaggattaaaaaaaaaaaaaaaaaagcggcc

SEQ ID NO: 1267 - DNA, 1450 bp, Zea mays
gtgcggcgctcgaggcggccggctcgagctcttgtctcgtgcgtgcgacacttctgggcgaccgccgccgccgccgccgccgccctacgccaggtgcgcaggtcttcgtcggatccttcgccggcgaggcgacgagcacccaccaggtgatgcccccggcttaattgaatgggctctcttctcaccaggactggcgtcctgccatggctccaggccaagatcgttgatcccgtgctgcaggtcatcagaaggggagcagaacccaagcaactggccttctctgctgccctcggtgtcacgattgggatctttccgatatgtgggaccactgttattcttggtgctgttgttgtagcaatgttgggaagtcgttgcaatgctgttactcttatggttctaaatttggccgccactccaattgaactaagcttgatcgtccctttcttgcgtttgggtgaagctgtcaccggcagcgggcacttccccttgacggccgacgcactgaagaatgttctcactggtcatgcctcaaaggatgtgctgatgagcatcgtccatgcgatgctgggttggcttattgctgcaccaatcgtattggtcgtgctgtacgccgtttcgttcccttgtttcaaggtcctggtcaacaggtttggtggtattccttcgagccccaggaccccaatcaaggcagtgtagccagtgcctggccggatcctctgcagttacgtctgtggacatagctgcagatgggtcgctgacatctggagccggccatggcatggccccaaacgtcagtgaccagccagtgaggcatgctgaatgctactgaaattgtgtgcaccaagttctttgtgatgccgtcggattgagatgggttccggcatcatgttgctcgaccatcccaggcactggcgaataaatatgatgacttgagaggcatgtgtcctctgtgattgtgtatgctggtttcacaaccatatatagcgagatgtgtatttatgaatttatgaagtcttgataaataaagctaggaagcacaggggtcacggaccattgtgccattcttcccgatgtaggcgtgggttgtgtacttgtgttcagcaaaattttctgtaggcgttgtacatgcttgcaggaattcagtgccagctgtttgaaatttgaatcataggttcagtggcaaggcaacttggtgcttaacctactaaaatgcattcactacgtttcaattataagatttttctagatgtatgccaatatatcggtgatattaggtgttttcatcttattcccatcgaggaatgttgtctttacaaccatccgatgtaactctaagttgtaatgagcagtaagcgtcatattattctagaggaatctttcctgctgaatcaggtgaggaagttttcattataatcaattccttctctcaaaaaaaaaaaaaccccccccc

SEQ ID NO: 1268 - DNA, 1957 bp, Zea mays
ccacgatgcagtgcaggggggcagccaaatgcccagatccagttcctgtgcgtcctcctcctcctcctcctcctccattccggccctctcgcccgtccgtctcctgcccccgtccctggtcggaccacgagagccccggactgcgttcacctctgccttttgttcacccctgcacgcattctctgccgctcttgtctcgtgcgtgcgacaacaactgggcgaccgccgccgccgccgccgccgccctacgccaggtgcgcaggtcttcgtcggatccttcgccggcgaggcgacgagcacccaccaggtgatgcccccggcttaattgaatgggctctcttctcaccaggactggcgtcctgccatggctccaggccaagatcgttgatcccgtgctgcaggtcatcagaaggggagcagaacccaagcaactggccttctctgctgccctcggtgtcacgattgggatctttccgatatgtgggaccactgttattcttggtgctgttgttgtagcaatgttgggaagtcgttgcaatgctgttactcttatggttctaaatttggccgccactccaattgaactaagcttgatcgtccctttcttgcgtttgggtgaagccgtcactggcagcgggcacttccccttgacagccgacgcattgaagaatgttctcaccggtcatgcctcaaaggatgtgctaatgagcatcgtccatgcgatgctgggttggcttattgctgcaccaattgtactggtcgtgctgtacgccgtttcgttcccttgtttcaaggtcctggtcaacaggtttggtggtattccttcgagccccaggaccccaatcaaagcggtgtagccagtgcctggccggatcctctgcagttacatccgtggacatagctgcagatgtgtcgctgacatccggggccggccgtggcgtggccccaaacgtcagtgactcgacgtaattgcagaggaaacggtttcagccagtgaggcatgctgaatgcccctggaattgtgtgcaccaagttctttgtgatgccgtcggattgagatgggttccggcatcatgttgctcggccatcccaggcactggcgaataaatatgatgacttgagaggcatgtgtcctctgtgattgtgtatgctggtttcacaaccatatatagcgagatgcgtatttatgaatttatgaagtcttgataaataaagctaggaagcacaggggtcacggaccattgtgccattcttcccgatgtaggcgtgggttgtgttcagctaaattttctgtgggcgttgtacatgcttgcaggaattcagtgccagctgtttgaaatttgaatcataggttcagtggcaaggcaacttggtgcttaagaatcctactaaaatgcactcactacgtttcaattataagatttttctagatgtatgccaatatatcggtgatattagatgttttcatcttattcccatcgaggaatgttgtctttacaaccatccgatgtaactctaagttgtaatgagcagtaagcgtcatattattctagaggaattttttgttgaaacaggtgaggaagtttttattataaccaattccttctctgaagtttttggccccaagacttgctttagatctgtctaaattctctttagtcatattttgtcttgtagactcatttgcagcttgttattttgatgcctttaggatgtctctaccggtctttcgtagcacgctctctatttcaaatcctactctgtaaacaatgtattctataatgcaaaccagtgttttgtatatacatatgcacgctctgttggagatgtctttagaaaattctactaattcctaaacttggttgatattcattgactctattttatccctcatggttttgatccatatgaacgggtcaatatttcttatgacttcctcaaaagaggtgggatcacc

SEQ ID NO: 1269 - DNA, 869 bp, Zea mays
  misc_feature (760)..(760): n is a, c, g, or t
  misc_feature (766)..(766): n is a, c, g, or t
  misc_feature (815)..(816): n is a, c, g, or t
  misc_feature (828)..(829): n is a, c, g, or t
  misc_feature (851)..(851): n is a, c, g, or t
  misc_feature (863)..(864): n is a, c, g, or t
agatccagttcctgggcgtcctcctcctcctccattccggccctctcgcccgtccgtctcctgcccccgtccctggtcggaccacgagagccccggactgcgttcacctctgccttttgttcacccctcttgtctcgtgcgtgcgacaacaactgggcgaccgccgccgccgccctacgccaggtgcgcaggtcttcgtcggatccttcgccggcgaggcgacgagcacccaccaggtgatgcccccggcttaattgaatgggctctcttctcaccaggactggcatcctgccatggctccaggccaagatcgttgatcccgtgctgcaggtcatcagaaggggagcagaacccaagcaactggccttctctgctgccctcggtgtcacgattgggatctttccgatatgtgggaccactgttattcttggtgctgttgttgtagcaatgttgggaagtcgttgcaatgctgttactcttatggttctaaatttggccgccactccaattgaactaagcttgatcgtccctttcttgcgtttgggtgaagccgtcactggcagcgggcacttccccttgacagccgacgcattgaagaatgttctcaccggtcatgcctcaaaggatgtgctaatgagcatcgtccatgcgatgctgggttggcttattgctgcaccaattgtactggtcgtgctgtacgccgtttcgttcccttgtttcaaggtcctggtcaacaggttttggtggtattccttcgagnccccanggaccccaatcaaagcggtgtaagccaagtgcctggccggatcctctgnncagttacatccnngtggacataagctgcagatgtngtcgctgacatnnccggg

SEQ ID NO: 1270 - DNA, 949 bp, Zea mays
  misc_feature (823)..(823): n is a, c, g, or t
  misc_feature (887)..(887): n is a, c, g, or t
  misc_feature (920)..(920): n is a, c, g, or t
gccatcctatcctagatgttgctttgcccgcaacttttgcttgccacgacggaggccagatccagctcctgggcgtccgtcatccttccatatcccgccctccctcgtcggagcacgagcaccaaaggtccccgtaccgcccttacctttgctctccttttcttctcctgttcacccctcgtgccataactgggcgaccgccgctcccgccctacgccaggtgcccagatcttcgtcggccctgcccctgcttccttcaactccaccaccaggcgatgccctagacttaattgaatgggctctcttctcaccaggactggcgtcctgccatggctccacgccaagattgttgatcccatgctgcaggtcatcagaaggggagcagaacccaagcaactagccttctctgctgcccttggtatcacgattgggatctttccggtatgtgggacaactgttattcttggtgctgttgctgtagcagtgttgggaagtcgttgcaatgttgttactgttatggttttaaatttggccgccactccaattgagctaagcttgatcgtccctttcttgcgtttgggggaaaccatcactggcagtgggcacttccccttgacagccaacgcattgaagaatgttctcactggtcatgcatcaaaggatgtgctgctgagcatcgtcaatgcgatgctgggttggcttattgctgcaccatttgtacttgccgtgctgtacgctgtttcgttcccttgtttcaaggtcctggttaacaggtttggcagcattccttcgagccccaggaccccattcaaggccgtgtagngtagtgtgtagcatgctgaatgctcctgaaattgtgtacaccaaattctttgtgatgccgttgngttgagatgggttcccgcgtcatggtgctcggncatcccaggcactggcgaataatccgact

SEQ ID NO: 1271 - DNA, 1579 bp, Zea mays
  misc_feature (1565)..(1565): n is a, c, g, or t
gcacgagaccattacctagaacacccccagccgggggtttctcttgatcgctttgtcacttgaatccgtgcctgctctaacagagagcggagacgaccacgacgacggcgaggccaggctctgcgatggagcaggagccgcaccggcccatggagctgcccccgggcttccgcttccacccgaccgacgaggagctcatcacgcactacctggcccgcaaggccgccgacgcccgcttcgccgcgcttgccgtcgccgaggccgacctcaacaagtgcgagccctgggacctgccatcgctggcgaggatgggggagaaggagtggtacttcttctgcctcaaggaccgcaagtacccgacggggctgaggaccaaccgggccacggaggccgggtactggaaggccacgggcaaggacagggacgtcttcaggggcaaggcgctcgtcggttccaagaagacgctcgtcttctacacggggagggcgcccaggggcgagaagtccggatgggtcatgcacgagtaccgcctccacgccaagctccacggccacggccacggccaaggcgcagccgtcgtcgtcgtccccaaggccgccgggtccaagaacgagtgggtgctgtgcagggtgttcaagaagagcctggtcgtaggtggtgcagctgcagcagcagcaccaaccgcaggcaagaggggcggcacggagacgtcgtccaactacaagacgggcgacgtagaggccatcgcccacctccctccgctgatggacgtgtccggctccggctccggcgccggcgccgccgccgcggcggcggcacacgtgacctgcttctccgacgcgctggagggccagttcttggaccagacgacgaccacgccgccgccagaagccgccaccgccgccacggacgacgacggccacctcggcgccctcggcgcctcctcctcgcccttccagctgcccggcttcgcgcactactactacggcggcgggccgccgcacctgcaccagcaccacggcgccgccagcctggtgcagctcctggagggcagcgtgccgccgtgcaataagggcggcgagcgggagcgggagcggctgagcgcgtcgcaggacacggggctcacctccgacgtcaaccccgagatctcctcctcctccggccaacgcttcgaccacgaccacgaccatgaccaccacctctgctgctggggctactgatcgtcgattcgatgagcctacgacgactaccgagcgcgcatcatgcatgcgtcgcgttattactagcgattagtgtatagcacactgctgtaaataaaacatctactagtactacatctgcgtgaggtcgacgatcggccgtgtggtggtggtggtgcgtggcatgcatgcgtcgagctgcctacgtttcattatctgctcgtgtgatttgttactgtagacgagtgtgggggtgtgtaattagcattgttgatgtattattattcacgatttggtggaataatatctccttggttaatgacgccgccaaaaaaaaaaaaaaaaagcggccctcgagctgccagnttgttgttctcctt

SEQ ID NO: 1272 - DNA, 1879 bp, Zea mays
accgacgctagaatgcagctccccatagaatgccggccgggaatccaagaacgggtcaacttttccttaaggttatccacacaagtgtatgggcggggcaaaagcgtcttgggcagctggccaagtggaaaaccgctgaggaggttgctgcattggttcgatctcttcctgtagaagagcagccaaagcaaattattgtgacaaggaagggcatgttggatcccttggaggtccatctacctgacttccctaacattgttattaagggcagcgagctgcagcttccttttccaggcttgcttgaagattgagaagtttggtgatcttatactgaaggcaactgaaccacagatggttctttataatatatatgatgattggttgaaaagtatatcatcatacacagcattctcccgcattgtgcttattctacgtgcacttcatgtgaataatgagaaggcaaagatgttgctcaaacctgacaaaacaattgttactgaaccacatcatatatggccgtctctgaatgatgaacagtggttgaaggttgagtgtgcactaagggacctcatcctttctgattatgcaaagaaaaacaatggtaatacttctgcactgacacaatctgaaatgcgagatatcattcttggcgctgaaattgctccaccatcacagcagaggcaacagattgctgaaattgagaaacagccaagagagactactcagttaactgctgtaaccacaaggacgacgaatgtgcacggagatgaactcattatcacaaccacaagtccatatgagcaacaagcattcgcatcgaagactgattggcgtgtcagagccatctctgccacaaacttgtatctacgtgtaaatcacatttatgtcaattctgatgatataaaggaaactggctacacttacattatgccaaagaacatattgaagaaattcatatgcatagcagatctgcgtacacaaatcgctggattcttatatgggctgagtccacaggacaatcctcaagtcaaagagattaggtgtatagccatccctccgcagcatggaacacaccagatggtgactctgccatcaaatcttcctgaacatgagttccttaatgatcttgaacccttgggaccgcgcctcccgcggccagccgtccctccgcagctatcaccacaggacctgacatcacatgccaagattctggagaacaacaaacaatgggatggtgagaagtgcatcattctgacatgcagcttcaccccaggatcttgctcgttgactgcttacaagctgacaccaagtggttatgagtggggacgcagcaacaaggacaacggaagcaacccacatggatacctcccaactcattacgagaaggtccagatgcttctgagcgaccgcttccttggtttctacatgattccggataacaccccttggaacttcaacttcatgggagtgaagcacgacccacagatgaagtacaacatgaagctgggcatgccccgggacttctatcacgaggaccacaggccgacacacttccttgagttcagcaacatcgaggagggagaggtcgctgaaggtgatagggaggacacattcacgtagggcgctgggcgcctgttttagaaactcagtatctcaaacgcactttagctctgttttgaatggcaatgtgtgaaaggctgaaagctgtaacctgactcgacgggtgtcatctgtttttttggcttaatcctgtatcataccttgttgtaagacagccctggagaggggtaaaaattgtacaagtgcacgccatggcaacagtaaagattttacttagtagctatgctattctaattaaaatgtgcccgcggccatgtcg

SEQ ID NO: 1273 - DNA, 1225 bp, Zea mays
tgcagatactgtgtgtatcagtgacttcaaacagacaaggacggcattttaaaccgtacgggctcaaaggcacgagaccattacctagaacatcctaatcgaaaaacgtaacaaacttcatcagatcggccgccttttgcgccattcacgtcggcgtcggcggcggcggccagattagaatccacccacaccgagtcgtcgccaaagaaactaaacctctaatcccccgtcctccccgcccgtgcgcgcatatataatggtattacccccgtcgtcaaatgcaccgccacccaaccccatggccgccgccaccggaagaaccatgaagacgatggcgctcgtcgtcgtcctcgccgccctcctctgctccatctcggtcgccgctgcagccagcggcggcctttcttcgtacgtggtgtacctcggccagcacgcgcacggcgcggcgctgggcacgcacggcgccgaggagctgcaggcgctggagcgcgacgccgccgaggcgcactgcgacctcctcgccggcgtcttgggcggagacaagcagaaggcgcgggaggcgatcttctactcgtacacgaagcacatcaacggcttcgcagccaacctggacgccgccaccgccgccgagattgcggggaaacccggcgtgatctctgtgttccccaaccagggccgcaagctgcacacgacccggtcatggcagttcgtcggcctggccgggcccggcggcgtcccccacggcggggcgtggcggaaggccaagttcggcgccgacaccatcatcggcaacttcgacactggtgtgtggccggaatccgagagctttagagatgacggtctggggccagttccgtcccattggaaaggagcctgcgacaaaggccaggatgataaattccattgcaacaggaagctgatcggcgcgcgctacttcaacaagggctacgcggcggcggcaggcgcgctgaacgcgtcgatgaacaccccacgcgacatggacggccacggcacgcacacgctgtccacggcggtcggctcgcccgtgcccggcgcgtcggtgttcgggttcggaaacggcacggcgtccggcggctccccgcgcgcgcgcgtggcggcctaccgcgtgtgtttcccgcccgtgaacggcaggcgagtgcttcgacgcggacatcctggcggcgttcgacgccgccatccacgacggcgtgcacgtgctgtcgct

SEQ ID NO: 1274 - DNA, 4356 bp, Zea mays
gtgatgggcagtgtgttgtgatgctccagacaaaatttgagaagttctttgaaaaaattgatctgactctgttgaacaggcttctgcggttagtcttggatcataacatagctgactatgtcactgcaaagaacaatgtagtgctggccttcaaggacatgagtcacacaaattcttatggtctcattcgagggcttcaatttgcatcttttgttgttcagtattatggccttgtgctggatctcctgattcttggccttactcgtgcaagtgagattgctgggccacctcaaatgccaaatgagttccttacatatgctgacacaaaagttgagacaaggcatcccataagattatattctcggtatattgacaaggtgcatatattgttccggttcacccatgaggaagcacgagatctaattcagcgttacttgacagaacatcctgatcctaacaatgagaacatggttggttacaataacaagaaatgttggcccagagatgcaagaatgaggcttatgaaacatgacgtgaatcttggaagaagtgtgttctgggatatgaagaaccgccttccaaggagcattacaactttagaatgggagaatagctttgtctctgtttacagcaaggacaatccaaacctgctttttagcatgtctggctttgaagtccggatactgccaaagatacggatgacccaggaggcattcagcaacacaaaagatggagtatggaatttgcagaatgaacagacaaaagaaagaacagcaattgccttcctgagggttgacgatgaacatatgaaagtgttcgagaaccgtgtccggcagattctaatgtcatcagggtcaacaacattcaccaagatagtcaataagtggaatacagctctcattggccttatgacatatttccgcgaagcaactgtccatacccaggagcttttggatttactggtcaaatgtgaaaacaagatccagactcgtataaagattggcctgaattcaaagatgcctagtaggtttcctccagttattttctatactcccaaggagattggaggtcttggaatgttatcaatgggccatattcttataccgcagagtgatcttaggtatagcaaacagacagatgttggtgtaacacattttacgggcgcgtggggccatgaagaggaccagctcattccaaacttgtatcgctacatccagccgtgggagagcgagtttattgattcacagcgtgtttgggctgagtatgctttgaagaggcaggaagcacaatcacagaacagacgattaactcttgaggatcttgaagattcatgggatagaggtatacctcgtatcaacactcttttccaaaaagaccgccatacactagcctatgacaaaggatggagagtgagaacggattttaagcaatatcaagtgctgaaacagaacccattctggtggacacatcagcggcatgatgggaagctttggaatctaaataactacagaactgatgtcattcaagcacttggtggtgtagaaggcatcctggagcatacattatttaaagggactttacttccccacttgggagggtctgttttgggagaaggcatcaggtccccgagccgcccggggatccaggaaactgacaaatgcacagcggtctggtctcaatcaaatccccaatcgaagatttaccctgtggtggtcaccaaccatcaatcgtgcaaatgtctatgttggtttccaggtccagctagatcttacgggcatattcatgcatggtaaaatcccgacattgaagatttctctgatccagatcttccgtgcacatctgtggcagaagatccatgaaagtgttgttatggatctttgccaagttttagaccaggagttggatgcacttgagattgagactgtgcagaaggagacaatacatcccaggaagagttacaagatgaacagttcctgtgctgatatccttctctttgctgctcatagatggcagatgtccaaaccaagcttagtttctgagtcgaaggatgtatttgatcagaaagcaagtaacaagtattggattgatgtgcaactgcgttggggagactatgattcacatgacatagaacgttatacaagagccaagttcatggattacacaacagacaatatgtccatatacccatcgccaactggtgtgatgattggaatcgatctagcgtataatttgcactctgcttttggcaactggtttcctggatcaaagccactacttcagcaggcaatgaacaagatcatgaagtcaaatcctgctctgtatgtcctgagggagagaataaggaagggtctgcagttgtactcttctgaacccactgaaccatacctgtcttcacagaactatggagagatattcagcaatcaaatcatatggttcgtggatgatacaaatgtgtatcgagtcactattcacaaaacatttgagggtaacttgaccaccaaaccaattaatggtgctattttcattttcaatccaagaacgggtcaacttttccttaaggttatccacacaagtgtatgggcggggcaaaagcgtcttgggcagctcgccaagtggaaaaccgctgaggaggttgctgcattggttcgatctcttcctgtagaagagcagccaaagcaaattattgtgacaaggaagggcatgttggatcccttggaggtccatctacttgacttccctaacattgttattaagggcagcgagctgcagcttcctttccaggcttgcttgaagattgagaagtttggtgatcttatactgaaggcaactgaaccacagatggttctttataatatatatgatgattggttgaaaagtatatcatcatacacagcattctcccgcattgtgcttattctacgtgcacttcatgtgaataatgagaaggcaaagatgttgctcaaacctgacaaaacaattgttactgaaccacatcatatatggccatctctgaatgatgaacagtggttgaaggttgagtgtgcactaagggacctcatcctttctgattatgcaaagaaaaacaatgttaatacttctgcactgacacaatctgaaatgcgagatatcattcttggcgctgaaattgctccaccatcacagcagaggcaacagattgctgaaattgagaaacagtcaagagagactactcagttaactgctgtaaccacaaggacgacgaatgtgcacggagatgaactcattatcacaaccacaagtccatatgagcaacaagcattcgcatcgaagactgattggcgtgtcagagccatctctgccacaaacttgtatctacgtgtaaatcacatttatgtcaattctgatgatataaaggaaactggctacacttacattatgccaaagaacatattgaagaaattcatatgcatagcagatctgcgtacacaaatcgctggattcttatatgggctgagtccacaggacaatcctcaagtcaaagagattaggtgtatagccatccctccgcagcatggaacacaccagatggtgactctgccatcaaatcttcctgaacatgagttccttaatgatcttgaacccttgggatggatgcatacacagccaaatgaagctccacagctatcaccacaggacctgacatcacatgccaagattctggagaacaacaaacaatgggatggtgagaagtgcatcattctgacatgcagcttcaccccaggatcttgctcgttgactgcttacaagctgacaccaagtggttatgagtggggacgcagcaacaaggacaacggaagcaacccacatggatacctcccaactcattacgagaaggtccagatgcttctgagcgaccgcttccttggtttctacatgattccggataacaccccttggaacttcaacttcatgggagtgaagcacgacccacagatgaagtacaacatgaagctgggcatgccccgggacttctatcacgaggaccacaggccgacacacttccttgagttcagcaacatcgaggagggagaggtcgctgaaggtgatagggaggacacattcacgtagggcgctgggcgcctgttttagaaactgtatctcaaacgcactttagctctgttctgaatggcaatgtgtgaaagctgtaacctgactcgactggtgtcatctgttttttggcttaatcctgtatcataccttgttgtaagacagccctggagaggggtaaaaattgtacaagtgcacgccatggcaacagtaaagattttacttagtagctatgctattctaaaaaaaaaaaaaggaaaaaaaaacccg

SEQ ID NO: 1275 - DNA, 2443 bp, Zea mays
gatccccctggtatgcttctgaatatccatgaactgccattttttatcctttttacttgtttgatttaaatttaatataactaatgttcattgacatctgttgcaggtgcgatgattggaatcgatctagcatataatttgcactctgcttttggtaactggtttcctggatcaaagccactacttcagcaggcaatgaacaagatcatgaaggtatataatgttgttaaaatctctccctgacttgatgaccactctactgtaattgatgttcaacttgaataatcttgatttttctttcagtcaaatcctgccctgtatgtcctgagggagagaataaggaagggtctgcagttgtactcttctgaacccacagaaccgtacctgtcttcacaaaactatggagagatattcagcaatcaaatcatatggtttgtggatgatacaaatgtgtatcgagtcactattcacaaaacatttgagggcaacttgaccaccaaaccaatcaatggtgctattttcattttcaatccaagaacgggtcaactttttcttaaggtttgttcttttcgaatttctggtctagttatcatgtaattttgggtttcctgtaaagccctaaacatggtaggtttaaactgagcatgtatcataatgtgcaggttatccacacaagtgtatgggcagggcaaaaacgtcttgggcagctggccaagtggaaaacagctgaggaggttgctgcattagttcgatctcttcctgtagaagagcagccaaagcaaattattgtgacaaggaagggcatgttggatcccttggaggtccatctacttgacttccctaacattgttatcaaaggcagcgagctgcagcttcctttccaggcttgcttgaagattgagaagtttggtgatctgatactgaaggcaactgaaccacagatggttctttataatatatatgatgattggttgaaaagtatctcatcatacacagcattctctcgcattgtgcttattctacgtgcacttcatgtgaataatgagaaggcaaagatgttgctcaaacctgacaaaacaattgttactgaaccacatcatatatggccaactctgaatgatgaacagtggttgaaggttgaatgtgcactaagggacctcattctttccgattatgcaaagaaaaacaatgttaatacttctgcactcacacaatctgaaatgcgagatatcatccttggtgctgaaattgctccaccatcacagcagaggcaacagattgctgaaattgagaaacagtcaagagagacgactcagttaactgctgtaaccacaaggacaacaaatgtgcatggagatgaactcattatcacaaccacaagtccatacgagcaacaagcattcgcatccaagactgattggcgtgtcagagccatctctgccacaaacttgtatcttcgtgtaaatcacatttatgtcaattctgatgatataaaggagactggctacacttacattatgccaaagaacatattgaagaaattcatatgcatagcagatctgcggacacaaattgctggatttttgtatgggctgagtccacaggacaatcctcaagtcaaagagattaggtgtatagccatccctccacagcatggaacacaccagatggtgactcttccagcaaatcttcctgagcacgagttccttaatgatctagaacccttgggatggatgcatacacagccaaatgaagctccacagctatcgccacaggacctgacatcacatgccaagattctggagaacaacaaacaatgggatggtgagaagtgcatcattctgacatgcagcttcaccccaggatcttgctcgttgactgcatacaagctgacaccaagcggttacgagtggggacgcagcaacaaggacaacggaagcaatccacatggataccttccaactcactacgagaaggtccagatgcttctgagcgaccgcttccttggattctacatggttccggataacgctccttggaacttcaacttcatgggagtgaagcacgacccacagatgaagtacaacatgaagctgggcatgccccgggacttctatcacgaggaccacaggccaacacacttcctcgagttcagcaacatcgaggagggtgaggccgctgaaggcgatagggaggacacattcacgtaggcgcctgttagaaactgctctgttttaacggcagtgtgtgtagctgtaacctgacttgacgggtgtcatctgttcgcctgttgcttaagcctgtattatactacctctttgttgtaagaagccctggtgagggattaaaattgtacaagtgcgcgccatggtaacagtaaaggttttgcttcctcccaagcttccaccttcaaaaaaaaaaaaaaaaaaaaaaaaaaaaaaaa

SEQ ID NO: 1276 - DNA, 1526 bp, Zea mays
caaaagatacaataggtttttttaatctccaatttttttttttttttgacgaaaaggctggagttactttaattcagcaaggcagctagagttcttcacacttgaaaaatcaatctcagctcaatcaatcgcttcggcaaatccacaccgctaattaattaatgaacccaacgcagcactccagcaccagctactgctcctctcgagagcccaagcacactacggaaaagatggagaggctgaacgaacaaaaaaaaggagtcccaattcgaaccaacaaaggggccggcgggtagattcttcccagctagaccatcctgagcagcgcggcgagcacggcgacggcggcgtagatgacgggcgcgtgggacctggcgaaggcggcgatggcggcggcggagcggtcgctggcggacggcggcggcgacggcggcggcaacttctcggccttgatggcgaggcgcatcccgccgaagcagtagccgtagctgcagatgaagtagtaggtcttggtctcgttgagctggaaggcgaagctgcgccccttgctgtagttgtagatggcgttggtggagtcgcacttgttgtagcccacctcgtccacctgcaccacgtccgcctgccccgccgtgtagtagaacaccacgcgcccgcccgggtggggcggggggggggagctcagatctgagaggagggggccccgcgtcgtccaccggcaccacgtccgcgtcccgccgtgtagtagaacaccagccagtcgtccttgtagaaggggctgtgctgcttcagccagtcggtgtagttcacgttgggcttccagttgatgctgatcttgttcgccgccgttctcgccggcagagccgcgcacgccgccagcaccagcagggccgccgccgccgccgccacgctcgtccgccccatcattcctctccccctcttctttctcctccaaggagaaggagaacagatcaacaatggcggtgcagtggcccgaaccaagcaaagcgaccggagcgcggtggtggcgttcgttcttgttgcctcttgtttgaactccctggtcgctagtgagctgtgcggggagcgtgggtgaactcgtgatgcgggttgctacttgcgactgccagtgatctggggccggcagtggggcgccgggtgcggcctaattaaaggcgcgggggcgggggcgcggggcacatggggcgcccaggcggtgtgccgccccggcttcatcgcggcctgtccgctcttggctcgtaggcagcgccccggcgtggccgcgtgggacatgtggtggcctgataggctgtggaggcggggcccaatcactcgagaagtgggttccgtcagggtttcgcggtgtgcgctgtgcggtgcactggtgtaggctgtaggcgtagggtgatctggaggtttcaaccgaatcatatgggacacgcactgtcaaggcagctcctaaaatgactttggccgtttggcacactgctacgcagctcggcgtccttcaaaacaatttcgtttctaat

SEQ ID NO: 1277 - DNA, 991 bp, Zea mays
tttttttttttttttttattactttaattcagcaaggcagctagagttcttcacacttgaaaaatcaatctcagctcaatcaatcgcttcggcaaatccacaccgctaattaattaatgaacccaacgcagcactccagcaccgccaccagctactgctcctcttgagagcccaagcacactacggaaaaagatggagaggatgaacgaacaaaaaaaaggagtcccaattcgaaccaacgaaggggccggcgggtagattcttcccagctagaccatcctgaggagcgcggcgagcacggcgacggcggcgtaaatgacgggcgcgtgggacctggcgaaggcggcgatggcggcggcggagcggtcgctggcggacggcggcggggacggcggcggcagcttctcggccttgatggcgaggcgcatcccgccgaagcagtagccgtagctgcagatgaagtagtaggtcttggtctcgttgagctggaaggcgaagctgcgccccttgctgtagttgtagatggcgttggtggagtcgcacttgttgtagcccacctcgtccacctgcaccacgtccgcctgccccgccgtgtagtagaacaccagccagtcgtccttgtagaaggggctgtgctgcttcagccagtcggtgtagttcacgttgggcttccagttgatgctgatcttgttcgccgccgtcctcgccggcagagccgcgcacgccgccagcaccagcagggccgccgccgccgccacgctcgtccgccccatcattcctctccccctcttctttctcctccaaggagaaggagaacagatcaacaatggcggtgcagcggcccgaaccaagcaaagcgaactttggcgttcgcgtgggttcgttcttgttgcctcttgtttgaactccctggtcgctagtgagctgtgcctgtgcggggagcgtgggtgaactcgtgatgcgggttgctacttgcgactgccagtgatct

SEQ ID NO: 1278 - DNA, 875 bp, Zea mays
gcagcggataaggtccccctgcgccgccgggatggaacctatcaaaccaagccggcgattctccgatcccaaccagactcatggtggcgttcatggcgagcagcggggccatgaaggcgtcgagcaggccaaccttcgtcacccctcgcagcttctttaactggggcaaaagcgcgagagaaaccgagacgccgccgccgcagctgcagttctcctaccacgacgtcgagccaccgttccccatgtcgctcgtggcaaaaacacacctcagagaccgtgagctcaggtgctgctacaaggccaccgtggacggcttcagtgctacggacttccaccggcggtgcgacttcaagggcccctgcgtcgtcgttggctacaccgacggtggcttccgtttcggcgggttcagcccggaggggtaccgaagcacggacgactactacgacacgctggacgcgttcctcttctactgggcggaatctacggaggtctcggcgccgcccgtggtgctgcccaaggtgggcgggagcggcgcggcgctgttcgactactcccgcggcgggccacagttcggcgccgacggcctgctcatcggcccgccgctcaccgccgtgatgggcgtgttcactggacccgactccagcgccggcgtcggcgacctccgcagcgctcgctcgcggcttggcctgtcgtacgcgaggcggccggacgggaaggagagcctgttcggcgacgagggcagggcccagctcgtggaggtgctcgtcttctgcaatccgcagatcgcgagcctgtactgactgctcattgttactagcttgcagctagagtctgtataaactattcattatcgcttaatttggagtctaaacata

SEQ ID NO: 1279 - DNA, 1662 bp, Zea mays
atggaacctatcaaaccaagccggcgattctccgatcccaaccaggcaagcagtgtacgcagaaattgatgattcccccgctttgatctccgtacgtcctgtcatctcatcgatctgcttcgcatccacgcctgagcagactcatggtggcgttcatggcgagcagcggggccatgaaggcgtcgagcaggccaaccttcgtcacccctcgtagcttctttaactggggcaaaagcgcgagagaaaccgagacgccgccgccgcagctgcagttctcctaccacgacgtcgagccaccgttccccatgtcgctcgtggcaaaaacacacctcagaggtaattatcatatccttttggcgattaattggttattaagaggccgattgattggctcgctgtggttacttgtcatgtcattgcgaatcacttcaattgtcatatattttgtttttacatttagcgcacaatgactaactttgttttccgttcactgttcttgatgataaattgataatatggtggcgcagaccgtgagctcaggtgctgctacaaggccaccgtggacggcttcagtgctacggacttccaccggcggtgcgacttcaagggcccctgcgtcgtcgttggctacaccgacggtggcttccgtttcggcgggttcagcccggaggggtaccgaagcacggacgactactacgacacgctggacgcgttcctcttctactgggcggaatctacggaggtctcggcgccgcccgtggtgctgcccaaggtgggcgggagcggcgcggcgctgttcgactactcccgcggcgggccacagttcggcgccgacggcctgctcatcggcccgccgctcaccgccgtgatgggcgtgttcactggacccgactccagcgccggcgtcggcgacctccgcagcgctcgctcgcggcttggcctgtcgtacgcgaggcggccggacgggaaggagagcctgttcggcgacgagggcagggcccagctcgtggaggtgctcgtcttctgcaatccgcagatcgcgagcctgtactgactgctcattgttactagcttgcagctagagtctgtataaactattcattatcgcttaatttggagtctaaaacataccaataataacaatgtaaaattgtgggtacggttaattagttgattattaagttattgaaagatcaaataagtaatgacgaaattacttttattctctaatgaaaatgcatggccataagttatgcctgtccatgggcatgaggtaggtcggctgacatgaacagaagcggaacgacgcggagtttggattatttgcttcggattaaagccattgtttggactactacagctgtaatttatagagataaaacactgtaaaatcagtagaaatcggtattgattaaagccaagagaaaaggtgatcattgattcagcgcccaggggttctatccaagggattatgtcgttttcaatctgcaactgccaacgattatctagaattcagagcaggcattacagattcaccacggtccaccgcatcagacgatcagcctcccactcgtcttcacttcgagtttgaggtgtcttcatccaccgccccgtccgcagccactagtagaaaatagctcaaaggctataatacgcacgaaa

SEQ ID NO: 1280 - DNA, 1678 bp, Zea mays
ctcgggacacgagggggcatcccatcgatgccttgctgggacggcctgccgctgccgtgtggacccacgcgagggggacagcgactgtgtagcaccgtgggcggggtgggccccagcggagtcaagcgggtgtaaattccattgggtccctcgaggccggccggtgctttcatcattccgctccccacacccctgttcgtggcggcctccgcccctccctctcaggctctcaccaccgtctgctggtggttgccgcggcgccgctcctccctcgtggtggcggtggaggactacggtcggggatcgacggcttcttcgtccgttggttggcaggcgaggcgatacatcaaccaaccaaaagaaatgtcagctggcaggcaagcatactggtgttaccagtgccgacagagggtgaggccacggggccgggagatggtttgtccctactgcgattctgggtttgtggctgaaatggatgatgtagatgctctcatgagccacttcgttgggacggatcctgatttccatcgcgacccacggttcgggatcatggaggcgatctccgccgtgatgcggcatggtatggcagggatgaaccgggaggttgatgtcagagggaggccgaacttcttttcagacctggagatggagttcggttcagggccatggctgctcttccgtggccagctccccggccatctcaccgaggacaacggtttcgatgttttcgtcaatggacgacgtggcggcggcggcggcggcgtcggcatgaggagggccaacatcgcggactacttcgttggccctggactggatgatcttatcgagcagttgacccagaatgatcgccgaggaccaccacctgctgcacagtcctcgatcgacgctatgcccacagtgaagatcacccagaggcatctcagtggggactcgcactgccctatctgcaaggagaagttcgagatgggatccgaagaagcaagagagatgccatgcaagcacctgtaccactccgactgcatagttccttggttagagcagcacaattcctgccccgtttgccgttacgagctcccgccacagggctctgccacgggtgctagctgctcgcgcgcgagatcaaccgaccagagccagagctcaagtagttcaagcagcagcgggagaaccagtgggcgtcaaaggagaaggaacccgttctcgttcctgtggcctttccgctcatcaagtagttctcgctagattagcctctggtaatctttgctcaggttcgaaatactgtttgtttttttgggtcaaatacgctggtctaatgggctttaatgtggtgggatctcaatctgtactgtatggtttgttaatgatcgccacacgatgcttctccttgcaagtatattattattaccacggtatcaaaaaaaaaaaaaaaatttgtttacttgtttgtgagcttgcaaacaattagtataagcctgattaatggatgttcggcttctttttaaaagaggctaaagttatgatcgcccatgttcggctgattgtttgttgcgactgtacaaataattactcgcaaagctgtcagttaccgaaaaagataaagatggacgactgtgaccgttccttcaccacccgctctaggagcagtggagcacagcttggctagcatgtccgtgctttc

SEQ ID NO: 1281 - DNA, 2009 bp, Zea mays
gccacgctgtgctcagtcgcccgcagtccgctgagtctgccgagtgcgtccggcgggcgggagatctggccgacggcgcggcgctgcagatcccctgcctgcgcgggcacggctcactgctgctgtggaggctgttgcgcgcggtggtgccgatgggctacgggtacgtggatcccttcctgccccctcagcagccacagcaggcggcatacgtcgcgccgcagcagggggactacgggcagccgcagccgcagccggctccgcggccaccggcttgcccgtactcgtcgtccgcctccgctccgccgggctccgcgtcctaccatttttcgcctccggcaacgtcccctccgccggtaagtagcccacctccggcgtcccctttaccggagccatcggcgccacctgcaccattgctgccatcgccgccgccacctgcaccattgccgccgtcgcctccgccgccagcattgtcgcctcctccgccggacgccctccctccgtcgcttccaccgtcaccgctgccatatccaacccgatcaccacctcaagccccgccgcccccgctgacgacggatcagccgcgcgttcagccccgcgtatacccatcaccgccaccgccgtccctccctcctccgccgcctcccaccgtctcgccgccagcgccggctccatccaattcgccgtcgccgtcgcctgctccagctgcacaagctccgggtcccgcgcgtgttgctgcctattcgcctcccccgcctagaatcgcccctccgccgcctccgcactatcacggcaagtcgcattacacgccgcactcgcccgtgaagtcgcattcgaactcgagccatgcagctagtggcagtggcaagaacatcgagatatcgagggaagcggccaccaccattgtagcactggccggtctcgccatgctcagctttattggcgcgaccatttggttcgtcaagaaaaagcgccggcgcatagagcctccggctacattgcctacacagcaaccagctcctccgccaccgcccaactacattccatcttcggctggatcctcgctagcatcagacggattctacttgagatcgccagggtatcctttcatgaggtacagcactgggagccatggttttccatactccccagccgactctgggattgggtattcccatatgctgttcacaccagagaatttggcagctatcacagatgactttgcagaagataaccttttgggagaaggtggatttgggtgtgtgttcaagggcattttgccggatggtcgccctgtcgccgtcaagaagctcaagattgggaatgggcaaggcgagcgtgagttcaaggctgaggtcgatactatcagcagagtacatcataggcatttggtttctctagtaggctattgcactgcggagggccagcgaatgcttgtttatgattttgttcccaacaacacactatattaccacctccatgtaagtgaaacatcactggattggcggacaagggttaagattgcagctggagcagcccgagggattggttacctccatgaagattgtcatccacgtattattcatagagatattaaatcatccaatattttgttggacaacaactttgaagctcaggtttctgattttggacttgcaaggttagcggctgattccaatacacatgttaccacacgtgtcatggggacatttgggtatttggctccagagtatgcattgtcaggaaagttaacagcaaagtctgatgtatattcttttggggttgttcttttggagctgatcacaggaagaaaacctgttgatgcttctcagccattgggagatgaaagtctggttgaatgggcccgctcccttctgacgaaggcgatcgagcatcgggagttcggggaccttcctgaccccaggatggagaacaggttcgacgaaaacgagatgtttcacatgatagtagccgcgcccgcagatccagttagtacgcggcaggacgtc

SEQ ID NO: 1282 - DNA, 2756 bp, Zea mays
  misc_feature (2351)..(2351): n is a, c, g, or t
tgtatagatacagtcgtagcaaatggaataacagatgaatgagtaattttgactctacatgcaacgacgtggatctcaataatagtggagcgctcgtgcctgtctgcgggaagcgcgagcggcgcggcggccggtcgatcggtccaacactcttcaacccgctcgccgccgttggtggtggtggcggcgtagaccgtggacgcatgcatagcatcgaggatgcagagggaatccacgtacgccaaacaatgtggcggcggcggcgggtgcgtggctctcatgcagcggcggcgcgcaccaccatgcaccaccctccgccccactgggtggcatcccggcatgtgtcggtgagtcggtcgctcgagatagccaccctcagcttcagaatctgtcgtataggagtatgtatgtatataaaacgagataaaatctgcatcgaattttctcattccacacccagaacgagaagagaggaggggattttaaaactcgaattccggaagaaaaaaaaggacttttagatcctctcgatctccatgcatgtaatcttccaccattttgtttgtctgttcgttcgttattgtagctactgcgtgcatggtgaatgccaatattcttcctctgctgcctctctctcatcatgcagagcagatgcagactccatcgatctccattccatccaaccccaccagcagctacagcaccactgctttctctctatctctctcaatctccttcgaattcacatgcctacagtggttcggcacacacactgctgtccggcgtctccctccctccctccctccatccttcccttctctatataatcacgactagtccaacccccaaaccacaaacacaacaacatctcctccattctcctaactccagcaacgaacaggcttctccggcccccctcctcctcattcttctatcatagctagctagctagcttcacatcagcagctacatactcacactcaccgatagatacagacctcagagcaccacactcctagctcagagcacgcatccgcatggacagcctcttctccccgcgctgcgtgtgggtgaccgggcccatcatcgtgggcgcggggccgtcggggctagccgtggcggcgtgcctgcgcgagcagggcgtgccgttcgccgtcctggagcgcgccgactgcatcacctcgctgtggcagcggcgcacgtacgaccgcctcaagctgcacctgcccaagcagttctgcggccagctcctgcgtatgccattcccggacggctacccggagtacccgacccgccgccagttcgtcgactacctcgagcgctacgccgccgagttcaagatcaagcccgagctcggcaccgccgtgctgtctgcgcgctacgacgagacgtcgtcgggcatctggcgcgtcgtcaccaacggcggcgacatgaagtacatcttccatggggccgctggacatacggctggtggaagccggcgccttcgacgcgctcatggacctgttggtcagccagggcggctccatcaaccagtacgagacgccacggtgcatcgagccgggcggcgccgcgctggagctgctcgactccaaggccaccgcctcgttcatcagcccgtgccccgtgtaagctttcgggcttctggtgactgaggttgttccgagctcgatctgctactctaaagctagctaatcctctgctggatctaaataatctgagaattttcgtctgggttatcccgccccgttacattgtacttttgtgaggctttgctactatgcaaagaagcctttttcttatatgagatcgttcgtgatcatcaattgcctaaaaaaaaaaaaaaaaaaacggctttactccatcacttgacgacttttgtgtgtgtgtgattgacggagcgcatggattatataacaataaaagaaagtaaagagagagaggccatgcatgcttttccgaaagcatcagtggttagtgtgcttttcaaccattacaactatacaaagcgcggcgtaaaagtaaacttttaggggccgttcgttttcattggaataaacccggtttcgttccaactcatcaaaatttatataaattagagaagtaatccggttaggaattattccggatctccaatccgtgaaaaccgaacaaggccttagccgtttcatcagattttagcggccaagaataactccgcgtatcggatcttggaacagcctcgatggttccagggcagcatatcaattacgcaaagaagtcaggtgctcctatgcgcaaaatgcatccagtcgatccgttctgtatccaacggtgttatgacatttttgcaaataagtcctctcacgctncccacgttagtgctgttcactaaaaaaacctggtacaccgttggatattggatggatgggttgaatgcatgttgcgcatgggagcaccggggtcctttgcgtatttcagacagcgaacgaacggggtggggaaatggacccaccgctcctcactcagtatgcgcctgccgtccattactcctagacgcatcgcggcggatcgtctttctccgtgctccgcctcgccggcctcgtgcggtcgtgccccgcagccccgactccccatccgccgcctccacctcatgggccaccgggtccaccctcgctgtccagcttggcgacatctttgatcgtggtgtcgacgagctccgcctcctcgccccttctgctgaggcccacgtcggcgtatttctggcatagtcgaca

SEQ ID NO: 1283 - DNA, 1086 bp, Zea mays
cgccaagcaagcagcgccactgcaccaccacccgcccccggagcgcatccactcatcatcgtccccctgcccggtcgctccactcccctccccccgcgcgcacaaacaacagcagcccgatgtccgccgccgcgtcctctgccaccgcctgcttcctctccccgctcccgccgcctcgccgcccgcgtcatttcctcaggcacctcgcgcgcgccgcggtcaccaagcccgagcccgcctccgcctcctcgctcgccctcccctcgccgtggctttgggcccggcggctctgcgagctggtccccgccgaagccgggggccggcttctgtcgtcggccgcgggctccctcatcgtcgcgctcgcctcagcgtcgcttgtcctaggtgacaccggcgccgcctccgcgttcgtcgtctccacgccgcggaagctgcaggcggacgagctcgccaccgtgcgcctcttccaggagaacacgccatccgtcgtctacatcaccaacctcgccgtcaggcaggacgcgttcacgctcgacgtgctcgaggtgcctcagggatccgggtccgggtttgtctgggataagagcggccatatcgtcaccaatttccatgtcatccgtggcgcgtcagacctgagggtgacacttgctgatcagtcagtgtatgaagcgcaagttgttggatttgaccaggacaaggatgttgctgttttgggtatcaaagcaccaaagaataaactaagacctatacctgttggtgtgtcagcagacctactggttggtcagaaagtgtatgccattggaaacccatttggccttgaccacactcttacaacaggtgttatcagtggattgcgtcgagaaatcagttcagccgccacaggacgtcctatacaagatgtgatacagaccgacgctgctatcaaccctggtaacagcggtggtccactccttgatagttctggaaacttgataggtgtaaacactgctatatactcgccctcaggagcatcatctggtgttgggttttccattccagttgacacggtcgggggcattgtggaccaactcataaaatttggcaggg

SEQ ID NO: 1284 - DNA, 931 bp, Zea mays
agacgggggaaaagtgagcacattcttgcacgaagcttgccgccgctgagctggggaactgggaagaggaagagatcttgcctaggtctagcgaggaggaggtcgatcgatcgattggctaggactctaggaggaggagctggttcataagcagacctaccgacccacccatcgactgtacttgttcggaggaagggatggccgatctgctgagcttcctgaagacgatcttggaggccgggttcagtataatgagcgcgctggagaaggctggccacaacgcggacgactgccgcaggatcggtcagctcctgcaaacactgagtgccatcgctaacgccaagtacctgcaggacaacacgacgaaaggtctgaaggagaccctccagcgcgcgtccgagatcgtcaagacgtgcaaccgcaagaccttggtgagccgtgccttcaaggccaatcaaatcgccgacgagctacgcggggtttgcattgacatattgctgaacctgaatacggtgctccttgccaacgtggccgacattaagaaaactgttacctacaataactcaatgttggcccaaattttggaaatatgtgctgctaatcccgatgttcgtctgctacggcaaaagattgacagattggcacagacctactgtaattcaagtgatgatgatagttatcaaaatgaaaacaaaagggagacaaagagaacagaccttgacagaccaggatttaagacagagaaagacaatgcaccagtggatagcaaggtgccacgtgcttccttatcagatggtggctcaatcaagtctactccagtgaaaagtgtgattggacaaggtggccctagcatcgtcaagaaggcacatagcagcaacccaactgatggtgatggttctagcaaaaaaaaaaaaaaaaaactcgagcccgg

SEQ ID NO: 1285 - DNA, 1996 bp, Zea mays
tgcaatcaatcactcttcccgtacttatctcgaaggcataaagtttggtgattttcgctacaccgagaacaatttcagccagaaacttaatggattggattcatctgatgcacatgcattaaccagcagtgatatgaatgctcctacgggcgcctgcccgtcgcgtggcgctccctacgcaaaccacagctatcaaactggaaaacaaaatacggctacatgtgtcgccttcagatgatctgcaatttgctcatagagatcacgctgcaggaacagagaagccaaattttgagaaagttggcagtggtgcaataccatcagcggatttgtgcatcaaggatgattttgataaaaggtttcaagaagatcttgatgaagcagtgcgccaaagccttggatacgatgcttatcctgctggtacaataagcacttcaaatgaaacagaagtgtatggcactggccttaaaaatgccgctggtgaatacaattgtttcttgaatgtgattattcagtcattatggcatataaggcggtttcgggacgagttccttaaaacatcatcactgcacaagcatgttgaagatccttgtgctgtctgcgctttatatggtatcttcattgacctgagcaaagcagccaagggacacggagaagctgttgcgcctacttcattgaggatcgctttgagcaaatcctacccgaacagcaaattctttcaggagggccagatgaatgatgcatctgaggtactgggtgtaatctttgagtgtttgcataagtcatacacttcgcgtactgtctgccatgatggagtctcggcggctcaaatatacttcatttttccacaatattaatgcggctagttcactccgaaccgcgaagatgatgtgtccagattcttcatttgatgaacttttgaaggttgtcataatgggggatcaactagctggtgatcaagacgttggcggctgtggaaaaccgaatcacatacaccacatcctttctactcccccacatgtctttacagttgttttgggatggcagaacaacaaagagaatgtggatgacatatctgcaactttggctggtatttcaactgagatagacattagcatattctaccgtggcctagatcaaggaagcaaacacaccctggtgtcagtggtttgttactatggccagcattatcattgttttgccttcaaggatggacgatgggtcatgtatgatgaccagacagtcaaggttgtaggtagttggggtgatgtgctcgtgatgtgtgaaaagggtcacttgcaaccccaagtgcttttctttgagtctgcaaattaatcattcttcagagtcgtaaagtgttgtgcagtggttaacatgccctcaaatatagggtttttacctgtggccgtgaagattagaaatagagtagcaaattcgttttgagcgggggtatagagtagcaaattcaacagctgcgttggtctctgagctttggtcgagcccctcgtaataagtagtcacctgaggattaaaggagagctgtttacccctctgtttttttaacctttggtatacttgctgaacttcggatccttcatctgccaatgagatttcactgccgatcaagttggtggggacgcattcgacatgaactgccatccaacaattctagccggatctgcctaaagctcttcattatgcaccagttatgtatagaattttgtgcttacaatgaggtgacaggtataggagtgtgactgttttgaggccagaaggtttagagaatggaaggaaatggaattgttggtgcggtgtgtatctgtggagtactgtttgaaaagaggaacgatatctggaatacggtagactttgagaaatctgtagtacacgagtctatgtaaacagggactcgatgagattatgtgagatgagtatagcgatgaataccagactccttatcactactgtttttattttaaacattttaaatgcagattct

SEQ ID NO: 1286 - DNA, 1775 bp, Zea mays
gatgaagcagtgcgccaaagccttggatgcgatgcttatcctgctggtacagtaagcacttcaaatgggacagaagtgtatgggactggacttaaaaatgctgctggtgaatacaattgttttttgaatgtgattattcagtcattgtggcatataaggcggtttcgggacgagtttcttaaaacatcattactgcacaagcatgttgaagatccttgtgctgtctgcgctttatatggtatcttcattgacctgagcaaagcatccaagggacaaagagaagctgttgcacctacttcgttgaggattgctttgagcaaatcctacccaaacagcaaattctttcaggagggacagatgaatgatgcatctgaggtactgggtgtaatctttgagtgtttgcataagtcatacacttctcgtactgtctaccatggtgtatcccacgagaaaaattctattggatcatgggattgtgcaaatatttcttgcataacacataatctttttgggatggacgtatatgaacggatgaactgtcacaattgtaagatggagtctaggcagctcaagtatacttcatttttccacaatatcaatgctagttcactccgaactgcgaagatgatgtgtccagattcttcatttgatgaacttttgaaggttgttataatgaatgatcaactagcttgtgatcaagacgttggcggctgtggaacaccgaatcatatagaccacatcctttctaattccccacatgtctttactgttgttttgggatggcagaacaacaaagagagggtggatgacatatctgcaactttggctggtatttcaactgagatagacattagcatattctaccgtggtctagatcaaggaggcaaacacaccctggggtcagtggtttgttactatggccagcattaccattgttttgccttcaaggatggacggtgggtcatgtatgatgaccagacagtcaaggttattggtagttggggtgatgtgctcgtgatgtgtgaaaagggccatttgcaaccccaagtgcttttctttgaggctgcaaattaattattcttcagagtcgcaaaacgcgctacagcggttaacatgccctcaaatataggttttttccctgcggccatgaagattagaaatagggtagcagattcgttttgagcggggatatatagtactagcattcaacggtgcttttcgttgtgagtccgtaataagcagtcatctgagcattctagagcaaaaaagggagctgtttatcccccccttttttgctttaacctttggtgtaggcgctgaacttctgatctcatctgccaataaatcttcactgccgatcaagcgggtggagcattcgacttgaactgccatccaacagttgtagccgaatctgcatgaactcttcgttatacaccaatcatctatagaattttctgcttacattgggccgggcgggcgttctctctctctctgttttttttttggggtgggggtctggtataggagtgacagttttgaggccaccagatatagaatggaatgatatgggaatgggtgatgcggtgtgaactgtattttgctgtggatgatcttttgaaaagagtaaagctatctggaatatggatatggtaagaaatctgtagtacacgagtctatatatacaatgactcaatgggattatgcgagatgattataacgatgaataccaaaatccttatcacaactgtcgcgtgggggggcccggtacccaatcg

SEQ ID NO: 1287 - DNA, 1658 bp, Zea mays
ccggccgggaagccaggccaggcaacccacaacacaaggagaaggggaagggcggcgagggaagggctccgcgtcgtgtcccttctcttcctcctcctcctcctcctctctccaacaccccatccatcagcgctgccctccgcattgctcttgatcccatccagtacatcgattctccccccaagatcaaaggccggaggaggaagaaaggttagggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctggaagagctgaaggaaattacaaaaaacttcagcagtgatgccctcattggcgagggctcgtatgccagagtctattttggtgtgctgaaagatgggacgaaatctgcagtgaagaagcttgactccagcaaacagcctgatcaagaattccttgtgcaggtttcagctgtctcaagattgaagcatgagaatgttgtccaactcgtcggatactgcgccgaagggagcacccgcgtccttgcttatgagtatgcaactaggggatcattgcatgatatcctccatggtaaaaagggtgtcaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagcttagcacgaagagtgatgtctacagctttggagttgtgctgctggagcttttaaccggtcgcaagccagttgaccacacactgccccgtggccagcagagccttgtgacatgggctacaccgaggcttagtgaagacaaggtgaggcaatgcgtcgatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctactgcctcgtcggcctcccacgctgccgagcgatccggactgtgatttctcatcgctgcgacaactttgggttcacgaaaaaggaccgtcttgtggagcgttggtgttgctgtgtcgtgactgccaaagccttggcgcagagaagagctttgccatgcagctgtgtattgtaaattgttttgtaagcgatgcgcctcctggtttgtgtgccctgtcatcatcctattctattctagaaaatggtgtacgatggatcatggatgataccaactatttggtctcttttggaatgcgaaaatgcagcacttggcttcctatgagtgtagatcagctttgttgttctattgctacaa

SEQ ID NO: 1288 - DNA, 5895 bp, Zea mays
gggtccgcccacgcgaccccaggcgacccacaacacaaggagaaggggaagggcggcgagggaagggctccgcgtcgtgtcccttctcttcctcctcctcctcctcctctctccaacaccccatccatcagcgctgccctccgcattgctcttgatcccatccagtacatcgattctccccccaagatcaaaggccggaggaggaagaaaggttagggagtcggccatgggatgcttttcatgctgctgtgtggcagatgacgacaacgttggcaggaggaagaagcatgacgatccctatgttcctatccctgctcatgtttataattttggacctagccggttcccagccccaacccctgtcatctccactggcagagctcagccaattgcagtaccggccattcatctggaacccacgcgtccgattacaaaaaacttcagcagtgatgccctcattggcgagggctcgtatgccagagtctattttggtgtgctgaaagatgggacgaaatctgcagtgaagaagcttgactccagcaaacagcctgatcaagaattccttgtgcaggtttcagctgtctcaagattgaagcatgagaatgttgtccaactcgtcggatactgcgccgaagggagcacccgcgtccttgcttatgagtatgcaactaggggatcattgcatgatatcctccatggtaaaaagggtgtcaaaggagcccagccagggccagtcctgtcatggatgcagcgagctaggattgccgtatgtgctgctcggggtctcgagttcctccacgagaaggccgatcctcgagtggtccaccgcgacatcaagtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagcttagcacgaagagtgatgtctacagctttggagttgtgctgctggagcttttaaccggtcgcaagccagttgaccacacactgccccgtggccagcagagccttgtgacatgggctacaccgaggcttagtgaagacaaggtgaggcaatgcgtcgatccaaggctcggagacgaataccctccaaaggctgtagccaagatggctgctgtggccgccctctgcgtgcaatacgagggtgaattccgtcccaacatgagcatcgtcgtcaaggctctgaaccccttgctgcacagccggtctggcaaccgccctactgcctcgtcggcctcccacgctgccgcagcagcagagcgatccggactgtgatttctcatcgctgcgacaactttgggttcacgaaaaaggaccgtcttgtggagcgttggtgttgctgtgtcgtgactgccaacgccttggcgcagagaagagctttgccatgcagctgtgtattgtaaattgttttgtaagcgatgcgcctcctggtttgtgtgccctgtcatcatcctattctattctagaaaatggtgtacgatggatcatggatgataccaactatttggtctcttttggaatgcgaaaatgcagcacttggcttcctatgtgtgtagatcaggtttgttgttctattgctacaaaccaggaatactacagtatgaatattacaactactgggcagccggcatatgtaccagagaagcatgcacaccagggcaggacaggaaccgctcctggactgttgtcctagtcctaattgtgatgtgaaccaaaattgaatttctatttcgattattagctagctagcgtatctatggttcaaaatgttttctcagacagcagccacgagacgagcgcagcacctcgatctccaactagggaagctgcatatctatggttcaacatcagcttcttcatcggagtcggcggctaggacatcggcagccgtcgtctgctccctgttagcttgttcaccagagtcggcagctgggacatcgacagccatcgtctgctctctgttagcttgttcaccgaaatcggcagctcggatatcttgttcatcggagtaggcagctaggacatcttgttcaccggagtcggcaggtgggacatcgacagtcgtggtctgctccctgttagcttgttcaccggagtcggcagctaggatatcttgttcaccggagtcggcagctgggatatcggcagccgtggtctgctccctgttagcttgttcaccggagacggcagctgggaagcctgggatatcttgttcaccggagtcggcagctgggacatcggcagccgtggtttgctccatgttagcttgttcaccggagtcggcagctgggacatcatgttcaccggagtcgacatctgggacatcggcagccgtggtctgctccctcttagcttgttcaccggaatcgggagctgggacatcttgttcaccagagtcggcagcagggatatcttgttcaccagagtcggcagctgggagatcttgttcaccggagtctgcagccgggccatcttgttcaccggagtcggcagctggtacaacggcagccgtggtctgctccctattagcttgttcaccggaatcggcagctgggacatcttgatcaccggagtcggcagctgggatatcttgttcaccggagtcggcagctgggacatcttgttcaccggagtcggcagccgtcgtctgctccctgttagcttgttcatcgcagtcggcagcttggtcatcttgttcatcggagtcggcagttggtacatcggcagccgtcatctgctccctgttagcttgttcaccggagtcggcagctgggacatcggcagccttcgtctgctccctgttagcttgttcatcggagtcggcagctgccacatcggagtcggcagctgccacatcggcagccgtcgtctgctccctgtctgactggctcttgatttccatctgggacaacagagatgttgtttggtcgaaatcagatccatccgttccttcgtcgtctaactggctcttgatttccatcagggacaacagagatgttgtttggtcgaaatcagatccatccgttccttcgtcgtctaactggctcttgatttccatcagggacaacagagatgttgtttggtcgaaatcagatccatccgttccttcgtcgtcgtcataagtccaccggctgtcacctgtatcatgcatgcggagaacaactacagtcatcagttaaccggacggtgggtcagcaagcaactagcaattagtagtaattaataaattaatgccggtgccaaccagcagcaagtgttcgtttttatggattaatttttagtccctctacttcatatctattttagtttctaaattattaaatacagaaactaattagttttcatattctgtaatttagaaattaaaataatataaagtggatggaataaaaattagtttctagaaaccaaacattttccaattaggcgtcagttctattgctgtacatgcacgctgttcaatctgaacatataacattaacatctacaagagtagtataaaccgaagcagacatgcaattgaacagacactacaacaccattcgatcgatgaattagggaacaatgtttagatggaaaacaacgaaatcgcaatgaggatcacccttgcggagaagcgttggcggcagcacccaggcatcaacgaagcaggagtaccggaccctgagttgcccgtaataatcggggtctaacgagtactccatgtggtgcaggacctgcctggcttgtgcgtccagtgcgaagagcgtcttgtccaggaagaagtagaggatgttggggttgttggggtcgacgaaggcgagcgagggcaccacgcccgacggcagtctggcatcggcatagctgcggtggctccatatgtcggcgaaggtcaccgtgtactcgtgttcccaggaatgctggcccccctgcctgaggacaagcgtgaacatgcagaccgtggcctgatccttggggattcgctggacctggatcgcgacgtagcgcagcttgccctggctgagcctgatgatgcgtcggcggtccatcatgtcttcgaggaagaggcgggcgcgcccggtgagggccttcatctggcagccaagcgggagcgggatgaagcgcaggcgcaggccgtcgtcggcagcgaaagggttgcagacgagcatgccgtaggcgacgtcgatccaccagaggaggccgccgtgggcgaggacgccgtgagcgccccaaggcgggtggtccggggcggagaccagcggcctggcggtccactggtcggtgacggtggagtagcagagcagggtctggtggcgggtcgtggaggtgggatacagatgggccaccatgtagtggccaccgtgtcgcgggtcggcgatgaggccgatgctgcgtcgcgggaaattagtttcgacgccgaggtgggcggggacgtcggggaggagggcggcagtgccggcgtgggcgtcaccgaggaagtaggcgtagttcctgtcttggtcgccgcggctaacgaggaagaggaggcggtcggagcaggcggagatgacgcagggaaagctgaaccacttcgagtcctggaccaggcgcttgggcaggaccaggtaggaggcgccgtccagcgggggccggaggtcgagaaggaagtcggaggcgccgggcgcgagcagctttgctcgctcctcgtttccggcggagtcgtcgaggacgacggcgatggaagagagtgccgcccacgggccgggctggaacttgacctcgtatttgcgattcagttcctcgcgggcgcgagacgactcccccgctttgaacgacgacgacgacgacatggctggcgtggttcgctctgcctgcctagtcggcgccggcggtggggttggggctgcgcgcggcttgggagggtggcgagttggttggtttggttcgtttcgatccatatcgctgctgctggttgattcgaggggaatgggaggaaggggacgggggctttataggtgagcgagcaggcagacagactgcgttccggcgccgagccgatgatgatgcgctcgggtctacgtacacgtatgatgagctcactattatccaacccaaccgactggagacttcacagcgcctggactgtttgttggatgggcccagaccagatagccatgaaatctgacgatgccaatagagacactggctagtcaagttggacgccatgcaaaccaggcaaccggcgctggcgttcgcacttcccagcatacaaaagtgagccaatctcatatttgtttttatactagtcctatgatttttatatatcatatagataaatcttatttaattaaattaattgtaggaacacgtttttaaacctttacaataataaatggtggcttgagccaatataaaaagaatagctacacatcacaaataaagcgagacactaatggtttcttggtggacatctgcttgtgtactcgctgaggtttaaagaaaaaaaggaagacaacatcataagtctctcactaaaggcaaaaccaacggtacaacgtgacatttaaatgagctcagcagaatgttcaaagacaagacaaatttagaaaaatatttagcaaagaacattaattaatattttgcataacgatatgtgaaacctcccgtcgtgtgcagtttgcagttaagtcctcaatataaatagtacttgatgcatccgacggaagaggaggctcaggtctaccaccatatgtcatccctatgttgtctataccaacaacacccatcataggtctaccaccatatgtcatccctatgttgtctataccaacaacacccatcataggccggtc

SEQ ID NO: 1289 - DNA, 1452 bp, Zea mays
cggacgcgtgggcgcaagtacgcccgcccggcctccagaaacaggacgcgggctcgacgacacaccgatcaggcgcgccgaagcagcgtccgcagccgcagccgacggtcatctcccggcgccggtcgcggccatgtcgaagaagaaggcggtcacgacgatgacgctcaaagacttccacggcggctccatcccctccgagctcccgctcccctccgcccccggcgtcaccccgcgccccgcggatcgcaccgtcgcctccgcatcccccgtcgcagccgcggtcgcacggccacgcgtaccggtcgcttcgcctgccgccgctgcggcggcagccgcgatgccttccttcctcacaaacccgtcccgaatcggccgtcacttcgacgaggacgagcgcacccccttcgagcccaccacgccacgccgtcccgcgccgtccccaacgtcgttcgcacccgctcctgtggtggcgcccaccagatcaggtccggggaacgcatggggcccgaagaaggaggcctcttcggcgccttcccctgtgggtcatgctcctgcctccgccggcgaccagatctggtccgcgacacgcatcgcccaggcgagcgccagtggagaaggtaatctccggaagatggcacccgccgaagcccacgtctccgccggcgccggtgtcagttccggtgttggagactcccgtggccccgccagagattgagaggcctaggtccgttggggtgagagagctggatagtggggtggagaggggcgccgcaccagtgagacccgcgtcacatgaaggaaggattggggaagggagagctggggaggtgccagagagacccaagttgaagctgcttcctcggtccaagccaattgaggatcctgaacagcgtcctacctatgtcgaagcgaagcaggtgcaccaggtccaggttactgctggcctcatgaaggctgaggataaccatgatctgcaccagaatgcaagggctactgaaacaggagttttgggagcagatgctgagagcagggtagcagagcgaccacggctgaatctgaagcctcgttcctatgtaacaggacagtctgatgaaattgctgtcaaggaaaggccatctctctttggtggtgctcgccccagggaacaagttctcaaagaacgtggagtggatgttttggccagtgatctcgagaagacttcaccagttggcaggttgttatatgttgtgatgcatcatgttaacattgatagatgcatttcagttgtggcagggcataagttcttatttatttattggatcttgatatcaaagggggttagagcatcttcaagagttcctaaaaagacaattggtaaatcaatgaattctctatgtggttaaaaaaagttgggttcctccaattgtttccaaaaatctttcttttaagagatataaggaatttttttgt

SEQ ID NO: 1290 - DNA, 1223 bp, Zea mays
  misc_feature (327)..(327): n is a, c, g, or t
ttttgtattgcttgaacctgcatagtatgcatttgtaaatataatgaactcacacggttcaactatatgcacgtgtagttgggttcttagctaggtgtgcatgcacacaagcttagcggaatgcaagctatatttagttcaaaacacagtatgttctcagttatccaatgcagtcatcaattctcgtgcattcagttgtttcctagataacatttctccatttaggtagtctgtctatatcaataatgaagcagtgtgtgtgaatatttgatcattgttctggagagtgtgtggaatacaatattgagtaatgctgtgtcttacagnccgcatatttcctaggttttgctttcttgtttcgttcttgttttaactactctacatcactatcaaatcataatgtttgttggaagtatttagctttaactctttttttcttggttgtaattactgttatatattttttttataattttgttagtgatggcagttggtcaaataattcattgtaggttgacaggcggagagagactgctggccactcatgtaaaggcgctgccttagccgccagcttcaagtttgaggggacattttagtttggcttagtagtaaattttgtggaataagtgcctttgataactatacaccactgtccagatgctccctcttagtagtggcaaggagtgcgttaagtagttacttcaaaaagatatgcaagcttcataggggttgatcacatgcaaaccagtgtatgtatatgaagtatatctatctcattcttttaacttttttgaagtgaagactgtagttaaaacagaaatgcaactataacacaaatgtgatattcattttatattagctcgtgtgctgagatgtccaaagatgctaaaatacgatcatcggacatcattccgttggtattggatcctgatgacggattattactattgtgatgatttgaccgattttgtgtctatgttgcgtttggatggttttcattaaaccgattcttacaaaagcgggttgaaaaactagatctagcaatttgcagcagcttttagtggccaaaagttagaaaaaacttgaaacaaatacctcctatatctatctcattgaagcatggttattaaagcgttaaaatgttatgaaccacctttttaacatttaaacgtttaaacgaacattgaaacgtcttttcagacattacataaaatttcacatta

SEQ ID NO: 1291 - DNA, 1011 bp, Zea mays
ggggaccggccgggaacccgtctggaggagaaaacccaaccagcgaaaagaaatcgggtgtcgagtcgtcgcacggtgttgctcgccatatccccttcccccctcctccctgcgtcccccggctccggcgatccgccgcacctgaacccttctccacgtcgcctcgccggttgggttgaggtgagccgatcagatccgatcggggccggtccttgcgccactgctgcgtgagctcatctcggtcgcccgcctgctcggctcgatcggccggggacggcggcggccagatctgcaatggagggcaacaaggacgacgcggccaagtgcctgcgcatcggcaagggcgcgctcgacgccggcgaccgcgcgcgcgccatcaagttcctgtccaaggcaaagcgcctggacccctcgctgcccatcgacgacctcctcacctcccttctcaaccccgaaggcgactcccaggcttcttcgcccccgccgtcttcaccaccgcaaactgccgcagcaggggcatcggaggcagttgaggctgatgggctgagagagaggaagcacaagggcaagaatagggaggaggaggcgactcctgctgccagggagtacaccgcagagcaactcgaggtcgtgcgccaggtcaaaaagcacaccagggactactaccagatcctcggcctggaaaaggactgcagtgtcgaggacgtgcgcaaggcctaccggaagctctcgctcaaggtgcaccccgataagaacaaggcccctggcgcagaggacgccttcaaggccgtctccaaggccttccagtgcctgacagatgctgagagccgcaacgttacgaccttgttggctcggatgagccagtaacacaccacaggagggcctccactgcccgtgcatacaatgagttctacgaggatgactttgacccagatgaggtattcagaaacttcttctttggtggtatggcgcctgccaccaccaggcagtttggacagtttagaacttcca

SEQ ID NO: 1292 - DNA, 1793 bp, Zea mays
ttggtgtcgctcgccatatccccttttcccccctcccttcgtctcccgactcctgcgatccgccccacctgaaccctactccacgtcgcctcgcctcgcctcgccggttgggttgtggctgagccgatctgacccgatcgggtgggtccttgcgccgccgctgcgtgggctcatctcggtcgcccgcctgctcggctcgatcggccggggacggcggcggctagatctgcgatggagggcaacaaggacgacgcggccaagtgcctgcgcatcggcaagggcgcgctcgaagccggggaccgcgcgcgcgccatcaaatttatgtccaaggcaaagcgcctcgacccctcgctacccatcgatgacctgctcacctcccttctcaacgcgcaagacgactccccggcttcctcatcatcatcgccgcctccaccaccgcaaactgccgcagcaggggcatcggaggcagctgaggctgatgggctgagagagaggaagcacaagggcaagaagagggaggaggaggaggcgactcctgctgccagggagtacaccgcggagcagctcgaggttgtgcgccaggtcaagaagcacaccagggactactaccagatcctcggcctggaaaaggactgcagtgtcgaggacgtgcgcaaggcctaccggaagctctcgctcaaggtgcaccccgacaagaacaaggcccctggcgcagaggacgccttcaaggccgtctccaaggccttccagtgcctgagtgatgcggagagccgcaagcgctacgaccttgttggctcggatgagccagtagcacaccacaggagggcctccactgcccgcgcatacaatgggttctatgaggatgactttgacccagatgagatattcagaaacttcttctttggcggtatggcgcctgcaaccaccaggcagtttggacagtttggaactttccattttaggactggtgggatgcatgcccatgcccatgcccaacaaaactctggtggctcaactgtcaggatgcttattcagctgttgcctgtcctactgctgctgttgctcaacttcctgccatcctctgagcctgtctactcgctgtcccgttcatacccttatgagcataagttccaaaccccacgtggagttgcatactatgtcaagatgtctaatttcgaggagcagtatccacaccaaagcactgagcgagcgacgctggagcggcatgttgagagggattattactccataatcacacagaattgcagggctgagctgcagcgtcgccaatgggggctgtcataccagacaccacattgtgatatgcttaaaaattttgaggctgcagcaaagtaataactcatccaattctgtaaggttgacatggggagagagactgctggccactcatgtaaaggcgctgccttagccgccagcttgaagtttgaggggacattttagtttggcttagtagtaaattttgtggaataagtgcctttgataactatacaccactgtccagatgctccctcttagtattggcaaggagtgcgttaattagttacttcaaaaagatatgcaagcttcataggggttgatcacatgcaaaccagtgtatgtatatgaagtatatctatctcattcttttaacttttttgaagtgaagactgtagttaaaacagaaatgcaactataacacaaatgtgatattcattttatattaaaaaaagaaaaaaaaaatccgacggggcgcccggtaccccgatcatcggacatcattccgttggtattgg

SEQ ID NO: 1293 - DNA, 2813 bp, Zea mays
cgttgctgtcggaaaaccccacccgggccggaaaagaaatcggctgtcgagtcgtcgcaaggtgttgctcgccgtatctcctttccccctcctccctgcgtcccccggctccggcgatccgccgcacctgaacccttctccacgtcgcctcgccggttgggttgaggtgagccgatcagatccgatcggggccggtccttgcgccactgctgcgtgagctcatctcggtcgaccgcctgcttggctcgatcggccggggacggcggcggccagatctgcaatggagggcaacaaggacgacgcggccaagtgcctgcgcatcggcaagggcgcgctcgacgccggcgaccgcgcgcgcgccatcaagttcctgtccaaggcaaagcgcctggacccctcgctgcccatcgacgacctcctcacctcccttctcaaccccgaaggcgactcccaggcttcttcgcccccgccgtcttcaccaccgcaaactgccgcagcaggggcatcggaggcagttgaggctgatgggctgagagagaggaagcacaagggcaagaatagggaggaggaggcgactcgggagtacaccgcagagcaactcgaggtcgtgcgccaggtcaaaaagcacaccagggactactaccagatcctcggcttggaaaaggactgcagtgtcgaggacgtgcgcaaggcctaccggaagctctcgctcaaggtgcaccccgataagaacaaggcccctggcgcagaggacgccttcaaggccgtctccaaggccttccagtgcctgacagatgctgagagccgcaaacgttacgaccttgttggctcggatgagccagtaacacaccacaggagggcctccactgcccgtgcatacaatgagttctacgaggatgactttgacccagatgaggtattcagaaacttcttctttggtggtatggcgcctgccaccaccaggcagtttggacagtttagaactttccatttcaggactggtgggatgcatgcccacggcacacaaagcactggtggctcacctgtcaggatgcttattcagctgttgcctgtcctactgctgctgttgctcaactttctgccatcctcggagcctgtctactcgctctctcgttcctacccttatgagcataagttccaaaccccccgtggagttccatactatgtcaagatgtctaattttgaggagcagtatccacaccaaagcactgagcgagcaacagtggagcggcatgttgagagggattattattccataatcacacagaattgtagggtcgagctgcagcgtcgccaatgggggcttgtcataccagaccccccattgtgatatgcttaaaaattttgaggctgcagcaaagtaataactcatccaattctgtaaggtatggttcaactttctctgaacatggtttagcagtaataatgtatttctgtgccatgtcgaagattttctctagagtttgccgttcggctgccctatatctaacggctgcagcagctgtggaataataaacaaagcagcaccaaagaagcagcagcttgcagcgtcagccaagaaaaagagcagccgaacggcttacttatctgctttgtatgataacttgctttgctttgtatgctatgttcttaacacttgttttatttttggtttaatactaataaccctgtccttactggtgaataactgtagacaaagaccacgaaaggcacgctttccatatggttttgcttgttaaatagaggaagcagaagctgacagtttttttttatatttgagtgtctgtagagtgtttggtaaccagagatcgatgaaaaaaatttgatcaatggtgcacatatgcagtgttatcctttcccatcttttttcatgctgctggggttatctgaatagtgtttcttaaatgtacctagctgggtggagatgcagagctgcatgcctgacaccctagataggtgattatatcctttccaggaggcttgtgtgttactacactgccttttgggtgtcttgaggggagagtggaggagagcaaattgagggagagaacgcagggggtaggaggacagaggtcggttccgatcagccaggatcaccgaaggagccatcccaaacaaggagtttcttattccttcgatgaaaaagctttgtacagactagctctcctttatagattagaaggcccactaatagatggaaactctataacagaacagaaacaatatagctttaggaaataaatttatctaaggaaaccaaccgatctagacctccctagaaatcctcctgctatctggcctgatctcaacctccctgggcggggatctgctcctgacgcctgggccggcgtcgctgctattggtgcccaacaagggtgtatataacatcccccctcccccctccccggcaaacagctggtctgtgagcttcacttcagtagagcgaaacttgaattcttctagctattctcaagatgcatctgctgctgaccttcccatccactggacaagcacttcccgcaccgtgattatgtcttgccttgacaaccttggccacatggaatgatggaataggtggtaatggtaccattgtattaggaggagcaccatcaaaccgtttgagcaacggcacatggaatacataatgagtctgggccttggtgggtaaagctagtatatatgaaactgagccaatgcgctgaaccacctgaaaaggaccctaaaatttgggacccagcttagaatgagaggcggcctttacccctaactaatgttcgctgcaggcatgcaag

SEQ ID NO: 1294 - DNA, 4114 bp, Zea mays
  misc_feature (1607)..(1607): n is a, c, g, or t
cctgctggctgctgcggttgttgacggcattacctattccgtaccatcgaggccggcaaccgacttctaacacttttcccgtcttccccttcctcgccgcctccactacagggctttgctcctcccaactctcgaaaccctacccacccgatgagagatcgatcggtcgagcgcgaattccccagccgcgagcggggggatcggccgccgcccggggtgctggggcccccgcgccgcgggccggcgtacaagacgaagttgtgcgcgctgtggcagcgcggcggctgttcccgcgacacatgcagcttcgcgcacggacacgccgagctccgccggttccccggatcgcgcacctcgttcccaccccgcgccggtatacacagccttctctcgtgcccccattatcctctcgcacgcttttcttttcagtcgaatgtttaacctctgagatcgggatcccctggtggtgtagcgttcgttgtagatctggaggtctggttgtatgttcttttcctgcaaatcatgttcctcgtattgtttttattggtaggttttgttgtaagatgtcactaattctgcaccctaccgtgaatggttgctcatgtaatctatgtgatctatctgtttcggaagaacaacggtatgtgaccattcaatttatgagatgaagaagaaaggccacggtgcagcaaaaaaagggggatatttaactttttgccatctttatggatggccctaaaccaccagccactgaccatctgtggagctacaaggggttacatacatggacatgggaccacatgtgttctgggtatcaatgtccgattttaggtgtatgatttagcagattttttgaaatgccgaatagcaccggaattctgacacggtgtttataattatactggtgtcagtccgggtaactaatgtacctctggacatcgtggttcaaatggaactttattttttctccatgattttatagtagcatgttctctatgttttgtattaagtgctcgtgtgttttattaaattcgtgcttcaattcaacctcagttgctgcagatagaaaataattctcacaagtggaagcttgttgcagtctgcagaattaggcggcattcttactggttgccttttgatttaactaccattcaaattagcagactcctgagcagatttattagattcaactgctgccagaggataagatgacttttatatagattcttcagttggcatttcaacgatttattgtgacctgtaatgcttgtccctacatcaagaaggtgggcatatcagtatcttggatgatgactccactgaatgatgtccataatacatttgatgtgctatggtcatgtgcttagcagctttaacggttaattgcacatacccttgaatattgtgcatcagttagatcattgggaagtgttattctcactggtaattgcaagttattgtaattcttgcaagtcgccgcggaagatatctggacaaatgatagtagatttatattgtgatattgggattatagaagacatcaacttgtcataattgttatgtgatgttgttcatggtcttcatcaatttgattttcaacaatcaanattatgagtttggtatcatcttaatgggtatgtcagtggtttcataccatactttggtatctacccatggcattaatttttggctctactttgttgtggctaatgatattatcctggagacccttctacttattgtgcattgaattatcttatagctcaaaggctgtggtaaggttacaggcttatgggtgacctatctctattagttcatattgacacattttttgttcagcttcatttatccttttcttgtataaatttttctctatcctgacttctagggagaagagattatagaggtggtgactttagagataggtttgataggaggcgctcacctcataggaggcattcccctgatggagattccaggggccatcgctcccttcgtgaccgacgaccaaattcccaagaaaggggtaattatggccttattttaaatctggacctgacacttctattacattcaaattgaattccatgtccgttgcatataaattattaaaactgaaattttacttgcagaatctagctattcacggtctcccagtaggaagaggtatgcaattcatttaatatatgattaagtcattcatttgtaaatatgcttttacaaatgtaacacagctgtgtccactgctcaaattatcacttgtttatttattgtttcccattatctttttgttatcgccttatcggccttgtttacatgatgcaattttctcattactgttaattatgaagtcgcgaaagggcctctggccgggtcccccccccccccccccccccccccccggtcctaggttcgactccccgttggggcgaatttcgggctatggttaaaaaaccccctcgtctgtcccacgccaaagcacatgtgtaaggcccggtcgcggtcgtttctcacatgggctacggtgccgctgtgtatgggtggggcaggggtttggggttttctcgacctgtgtgagaaggtcttcttcttaatataatgcccgagggctatctaccccccctccccgcaggtcgatttttgtttttaaattatgaagtttggaactcaaataactaaaaatatttaacattgaatattatgttaaagcatcctctctgaaaccattattttcatatttttgcaaactcacagttgtggcatttattcaccatactattcactgtattggcatatgcatgtaagatgtgcccctagagaacatgcaagcacattttatgtcaacgattactaagttcatgatgtggtatctgtttgtggttatctaatgtgtccaactctgatgcgcggcttctggaaacaaccaaatctgcttgttacaaatataattgcttattctgataaaatattctgaatagaataagttacatacctctgaactcttatcttactgattttttgggttcccaataaatatgtgaaatatggaacatattgatattgtagcttacttttccactctctctcagtgaaatgaggcatgataagaagcctgatgatggagaaactaactcatctaggagtctcagtgtctctgacaataatgatgatagaaaaaaggagacactgttaagtggtgatgataaagaggatcacgaaatacaggtgtgatgcattatacattttgtagctccacatcaccttttagcacacccttctgtgtaattgaaagcaagatttttctgcagctcaaacaaataagacaggacatggaacttttgcgtgatgataaatctctcttggaggttagttttgacagtctctattacactatcatatattgcatgctggtaaaccatgtcagtttttaggtgatgtttctatgggtaattcgtggtgtgcgtgtgtgtgtggttgggggggggggagggctctggatttcatgcatcggaacaatctaatatctttggtcagatttaggtgttctattttgttttgcactactatactggctaaaaaatggtgtatatagaacttggtaattgtaattgataacaattgtcttgtctattttttgttgtaagcttaaccattctgttcatattgtgggacaccgaccattcatcatcaatcatgctgtaattgcttagtttgatgatttcatttttgtgcttcactctccgtgctgattgaacggtagggcctggtgtagtggtgagagctgtctcactgagtcaccaggtcatgggttcgaagcagcctctccgcatttacggtgggaaggcttgcctcggtttatccttctctaggccactcatgtgggagctttcggcactgggtctgcttttctactctcagtgctgattgcaataactattctgtttgtatctttgttttaaacattttgatggagcaaggagcagtaatttgtagaagtttctgtgtgttccttgcttcgcaatgcctattgcctattatttcctccattccaaattgttagtcgttttggcttttctaggtacatggttttttatatccatttaaataacaacaa

SEQ ID NO: 1295 - DNA, 1753 bp, Zea mays
cattgggtacctcgaggcacttccacgtaacacttttcccgtcttccccttcctcgccgcctccactacagggctttgctcctcccaactctcgaaaccctacccacccgatgagagatcgatcggtcgagcgcgaattccccagccgcgagcggggggatcggccgccgcccggggtgctggggcccccgcgccgcgggccggcgtacaagacgaagttgtgcgcgctgtggcagcgcggcggctgttcccgcgacacatgcagcttcgcgcacggacacgccgagctccgccggttccccggatcgcgcacctcgttcccaccccgcgccgggagaagagattatagagctggtgactttagagataggtttgataggaggcgctcacctcataggaggcattcccctgatggagattccaggggccatcgctcccttcgtgaccgacggccaaattcccaagaaagggaatctagctattcacggtctcccagtaggaagagtgaaatgaggcatgagaagaagcctgatgatggagaaactaactcatctaggagtctcagtgtctctgacaataatgatgatagaaaaaaggagacactgttaagtggtgatgataaagaggatcacgaaatacagctcaaacaaataagacaggacatggaacttttgcgtgatgataaatctctcttggagataattttggatgagaagaatgctgaagtgcgcaagatttctagcagattaaatgatcttgatctgcagctaaggaaggagaaagaggaatgccacaggatgacctcaaaaattaaaaagttccttaaagcccatgctcgctttttgaaagcacaggaagaattgaaaaggtcacaagctcgttttgagagactcggtgatttacttgcttcagatattctgaaacgtggtgctaatgaagaagtttctagtatcaatgttgatgaagatccaaatgttccttatgaaaggagcccaaatgctgctatagctaagaagagatcaataccatactcaacaagtgaagaagcgaaagccgtgaagaaaagaagagagcgggactctgacacaactaggccagataaatataggtttgaaggtactattgcaggatttgaaaaactaagcaagggaaccgagccaacaaaatctttatatttgaagaagaaactgtgggaagatgaaaaggataagataggcaactttgtctcctcagccaacaccgacaaggtcaaagaatctccggtcaaacatgttttgccctccactggtatggctgctcatgctttagacgatctgtttgaagctgttgaactggaggatagacgtgacacatcaatagaaaatgatgctgatgacgaaactaggtcgcctgttatgcccccacaaccaccaccggtggttaatacttacgagcagtacgaggctgatgatgaggaagtcgacgtggaataagtagaatgccgagatggtactggaatgagctatatagctctcgcgcctgtgtaaagcattatgtaatatgtatttgatgctggagtttaccttgcatacaaagaatcgtcattaatgatccttggtggatgcggtttaagcactcaactcttttgttaatttgctgaaggcaacatgccctgttacctgtacctaatataccacgtggtggctagctagccagccttgtcaaaaccctggtacttttgggtggtcttgctgtgctgttcgcggcacttgag

SEQ ID NO: 1296 - DNA, 2351 bp, Zea mays
taatgtacctctggacatcgtggttcaaatggaactttattttttctccatgattttatagtagcatgttctctatgttttgtattaagtgctcgtgtgttttattaaattccggccccgattcccccgctcgtcccgcgcgtccgaaataattctcacaagtggaagcttgttgcagtctgcagaattaggcggcattcttactggttgccttttgatttaactaccattcaaattagcagactcctgagcagatttattagattcaactgctgccagaggataagatgacttttatatagattcttcagttggcatttcaacgatttattgtgacctgtaatgcttgtccctacatcaagaaggtgggcatatcagtatcttggatgatgactccactgaatgatgtccataatacatttgatgtgctatggtcatgtgcttagcagctttaacggttaattgagccacatacccttgaatattgcgcatcagttagatcattgggaagtgttattctcactggtaattgcaagttattgtaattcttgcaagtcgccgcggaagatatctggacaaatgatagtagatttatattgtgatattgggattatagaagacatcaacttgtcataattgttatgtgatgttgttcatggtcttcatcaatttgattttcaacaatcaacattatgagtttggtatcatcttaatgggtatgtcagtggtttcataccatactttggtatctacccatggcattaatttttggctctactttgttgtggctaatgatattatcctggagacccttctacttattgtgcattgaattatcttgtagctcaaaggctgtggtaaggttacaggcttatgggtgacctatctctattagttcatattgacacattttttgttcagtttcatttatccttttcttgtataaatttttctctatcctgacttctagggagaagagattatagaggtggtgactttagagataggtttgataggaggcgctcacctcataggaggcattcccctgatggagattccaggggccatcgctcccttcgtgaccgacggccaaattcccaagaaagggaatctagctattcacggtctcccagtaggaagagtgaaatgaggcatgagaagaagcctgatgatggagaaactaactcatctaggagtctcagtgtctctgacaataatgatgatagaaaaaaggagacactgttaagtggtgatgataaagaggatcacgaaatacagctcaaacaaataagacaggacatggaacttttgcgtgatgataaatctctcttggagataattttggatgagaagaatgctgaagtgcgcaagatttctagcagattaaatgatcttgatctgcagctaaggaaggagaaagaggaatgccacaggatgacctcaaaaattaaaaagttccttaaagcccatgctcgctttttgaaagcacaggaagaattgaaaaggtcacaagctcgttttgagagactcggtgatttacttgcttcagatattctgaagcgtggtgctaatgaagaagtttctagtatcaatgttgatgaagatccaaatgttccttatgaaaggagcccaaatgctgctatagctaagaagagatcaataccatactcaacaagtgaagaagcgaaagccgtgaagaaaagaagagagcgagactctgacacaactaggccagataaatataggtttgaaggtactattgcaggatttgaaaaactaagcaagggaaccgagccaacaaaatctttatatttgaagaagaaactgtgggaagatgaaaaggataagataggcaactttgtctcctcagccaacattgacaaggtcaaagaatctccggtcaaacatgttttgccctccactggtatggctgctcatgctttggacgatctgtttgaaactgttgaactggaggatagacgtgacacatcaatagaaaatgatgctgatgacgaaactaggtcgcctgttatgcccccacaaccaccaccggtggttaatacttacgagcagtacgaggctgatgatgaggaagtcgacgtggaataagtagaatgccgagatggtactggaatatgagctatagctctcgcgcctgtgtaaagcattatgtaatatgtatttgatgctggagtttaccttgcataaaaagaatcgtcattaatgatccttggtggatgcggtttaagcactcaactcttttgttaatttgctgaaggcaacatgccctgttacctgtacctaatataccagccttgtcagtgccctggtaaaaaaaaaaaaaaaaaaaa

SEQ ID NO: 1297 - DNA, 1982 bp, Zea mays
acggatgcgaaatctcaggccacggccacaccacacccctctcccctccctccaccttctccctcccacgccggtccttcttgagcgccgtgagtcgctcgcccgtgtccgccgcacactattccatgtcagccggcgtccgccctctccaccgagcgctgcatcaacgctggccacgccgcggggcagaagcagcagggcagccacagccctgacgccttgcgtcgaccttggaccctcttttggcgccaacaataggaggaggagcggagccacgttccccgcgccgccgctcctgtcccggatgctgtcacccaccacgcggccggcagctcggactgacgagagatctggcaccagcccggagaagcccctgttgcgccggtgggtactgcgggcgccgtcgggaggatctacgtggttagggttgcagtccccaagtgcgatgagatccagaacgccatctccgacggtgaggctgagctagcgcccgtgccggtgttcgtgtttttggattttgtggatctgaggatgctcgtagaccttgtgcaccgggtccggaacgatgtcggcgggaggtgaagcagagatgaaggagctgcccgaggagcttgcctgcctcgcatgcgaaacatcggcccaagtggtggcggcgggacctgccgcgtcggcaccgcttatgtgtcgcatgtgagcttcttttccgtttgtctgccgacactaggacctcccctgcccccacgagatttgtatctgtacctgactacgatgaggagtacaatgactgtgatgatgatgactatgatggaaccgaatatggcatcaaccatcctgttaatatggggaaaggaagaagggcgagcccatcaagctcgtcttcaccggcaagaagaagggaatcactcccgtcgcctccttcagcgccctcgacaaggagggcgaggaccccaccccgtctgccgcagccgagccgaagcccagcaacgatccagccgaggacgacataagcactttgtaaatctcccactcctctcccatggttttcccctatgtcgcttggtttcttctttttgccaagcttttaaggtttaagaagctaactatgaaactactaaaaaagatttttgggtaacaaatttacatctggacatttgggttgaaatgttactttatttttctccatgattttgtagtagcatgttctctatgttttgtattaagtgcttttgtgttttattaaattcgtgcttccattcaacctcacttactgctcacttactgcagatagaaaataattctcacaggtggaagcttgttgcagtctacagaattaggcgacactcttactggttgccttttgatttaactaccattcaaattagcaactcttgagcagatttattagatccaattgctgtcaaaggataagatgacctttatatagattgttcagttgccatttcaacgatttattgtgattgtaatgctcgcccctatatcaggaaggtgggcatatcagtatcttggatgacgactctactgaatgatgtccataatacacttgcggagtatttggtttgtagagtcactttatgtttcatgaagtgatgcattataagttcattccatcaattttggtggaatcaactcactcctcgtatatatactaattattagcttatgaagaatggagtggtgatgtatcaacccattttattccacaaaccaaataaaaaagtgagaaatgagaagaagatggatcacttcattactcaaaccaaacagcctattaatgtgccatgatcatgtgcctaactgctttaccggttaattgagccgcataccattgaatattgtgcatcagttatatcattgggaagtgttattctcaccggtaattgcaagttattgtaattcttgcaactccatagaaagtgtctggacaaatgatagtaaatttatattgtgatattgccatattg

SEQ ID NO: 1298 - DNA, 2712 bp, Zea mays
acgcggacgcgtgggtgcgagcggtcgcccttttttttttttttttttacctgctatggttaccttggctgatgcaaattacataacctcgacggttttgtacaagcacacggaagaaaaaggcagcttgcaatgcggcctgtatgtgaccaagaaatctagcgacgcggacacacgcacatgatgcatatgaattacctagctgggccggatcgagcgaaggggaacattcaacatttctacacagtgacacaacacatcaacacaacccaccgagcacaaacgggccagggccaggcccaggcgagtgaccagtcgtttcacgctcacacgaaacggacaatgcgctttatcaatcagtgaagtgccctccactccactccacctcaaggatgcagcgccgagtaggtccggtacctgtactccgccgccgcgtcgtcggccggctcgctggagctttggtatttgctgcggcacggaacgtagttgttgaccgggcatgacttgggctggcggaggaacttggcgcagtcctcgtgcgagcgctggttgggcgcccactggatgcagttgcggtcgacgttgagcctcccttccttgatcaggtcccagcagcaggacccgagcgacgtgaagtagttgtcggagagcgtgaggttcttgaggttgctgaacgcgagccggcagagcgcgtcgggcacctcgccgtacaagaggttgcccgccaggttgagctgctccaccttgcgcaggcacgcgaacgacgccgggatggtgcccgtgaggcggttagcgccggcgtcgatgaccgtggccttctccaggaggccgagctcgtgggggaggcagccgctgaggctgttgttgaggaagagcacctcgaggagcgtgccggcgttgcgggcgatggacctgggtatctcccccgtgaacctgttgttggccagagagaggtagttcaccggcgactgcccgatgttgtcggggagggcgccggagaagcggttgttgttgacgaagatggcctgcacccgcgggagcttgcagaagacgccggcggggagctcgccgtagaagctgttgaagcggatgtcgacgaaggtggcgttggtgaggcccagcacgtccgccgggaacgcggcgggcgcgagcttgttgttgctcaggtccagctcgtagaagtactgcaggccgcccagcgcgggcacggcgccgccgaagtcgttggagttggcgtggaacagcgccaggtccggcaggctgtcgacgaagccccgcagggaccccgcctgcagcatgtagccgttgaagtcgacggacgcgatggcccggtccgtcacgttgggcggccgctcgcagaagaagcccttgtagctgcacacgtcggtgccgctccagctctgcgtgacgcccatcgggtcgcacgtcaccgtgctccggaactgctggatcacgaggtacgccctgtacagccgctcgttctcgaagtcgcacggctgcggctgcgacgacggcggcgtcggagaaggcgacgaagggctgccgccgccgatgccgatgccgatgccgacgcccccgccgccgaggccgacatcgaggtcctgccggctcggccggctggctccgccacggctgtccacgagcgcagcgcaggaaaccaggaaacacaggagagcaacgctccgcgcggtgcgcgctggacctggacccgccatttcttggattctgatcacgggaagcgtctgcggcagaagacgagggaaaccacgtgcctagctccccctgcgctttttcacgcaagccgagagaaccagccggtcccgcacggcgtctcctgccaaatctccccgcgaaccgtgttgtgcgggagggagcgcgaccacgacggcgcgatcgagtgggcgagcgagtcccggcccccccggggggacccggatataaacgcccgcacaagggcaggggccgcagggcggggacctgttgcacgcttgcattttaatcacttggctctggccggttaggaaggcagaaggctcggtagttggcgcagcaagagtcaagaccccaagagcgaactttcctttcctgcgatggcaattcgcatgtggagtaccggtgctgtggtacgttgctccagtaactgcgctgctctgaactgtcattctatgaaaggaagaattgtactgtaattcagttcggtattcactgtcattcggcgggggttgtttttcagtttcagatgaagagcttgtcctgttgcctgttggactatacatgtgcaattatgcagtatccggatccaattgtagaggttgactagtctggaggctctgagctactggttttttaagaacaactggatgcatttgattcagaaaacagactattattccacaattttaccgtaggaatggagcttccatttgataattgatagtactgagctaagctatcaaatccaccaaagtgaacctggtgagcggtgaccaacattgacttgtttttaccggttcgctgccctcaatctcacttgattgttagttttttttaaaaaatatatatttacatttacacctcttatacacttactttcgcctttcgatcctaagattggtgttgtagggctgtaagcccttgtggtctggtcattcgttgtggcgtcttaagctgtcacaccctattttaactttactctgtaaattgtatatctac

SEQ ID NO: 1299 - DNA, 3077 bp, Zea mays
agatgaggtatctttctctggtgcaagccatcctgccaatatgtacacacaagaagaccttcccaaacaagtttctcgtacccttaatcagggttctaatgttatgagcctggatttccaccccgttcaacaaaccattcttttagttggaacaaatgttggtgacattgcggtgtgggaagttggttcacgggaaaggatagctcacaagactttcaaagtttgggatattggttcctgtaccttgcctttgcaggcttcgctgatgaaagatgctgcagtatctgtcaatagatgtctgtggagccctgatggaactattctaggtgttgctttctcgaagcatattgttcagacatatacttttgtacctaatggagatttacggcagcaagcagagattgacgcacacatcggtggggttaatgatatagccttctctcaccctaataaaactctatctatcatcacatgtggtgatgataaactcatcaaggtgtgggatgctcaaacaggacagaagcagtacacatttgaaggccatgaagctcctgtgtattctgtatgccctcactacaaggagtccattcagtttatcttctctactgccattgatggaaaaatcaaggcatggttgtatgattgcttgggctcaagagttgactatgatgctcctggacattggtgtactaccatggcttacagtgctgatgggacaagattattctcttgtggtactagtaaagaaggtgattcacacttggttgagtggaatgaaactgaaggggcaattaagagaacatacaatggcttcaggaaacgttcactcggtgttgttcagtttgacacaactaggaatcgcttcttggctgctggagatgaatttcttgttaaattctgggatatggataacaataacatactaacaacaacagactgtgacggtggactgccagcaagccctcgtttgagattcaatagagaaggttcattacttgcagttaccacaagtgataatggaataaaaatacttgccaacactgatggacaacgcttgcttaggatgcttgagagtagagcatttgagggctctagaggacctcctcaacaaataaacaccaagcctccaattgtcgcccttggtcctgtttcaaatgtcagcagtcctatagcagtaaatgccgagcgacctgatcggatcttgcctgcagtgtcgacaagtggcttggcacctatggatgctagcagaactccagatgttaagccaagaataacagatgaatccgaaaaggtcaaaacctggaagttggctgacattgttgataatggacatcttcgagccctgcatttgacagacacagacactaatccaagcaaaattgtccgtttgttatatacaaataatggggttgcactcttggctcttggctccaatgctgttcataagttgtggaaatggcaacggagcgacagaaatcctagcggcaagtctactgcatctgttgcacctcacctgtggcaacctgcaaatgggattctgatgacaaatgacacgaatgatggcaacccagaagaagcaaccgcctgcattgcattgtcaaaaaatgactcctatgttatgtctgcatctggtggcaaagtctcgttgttcaatatgatgacattcaaggtcatgactactttcatggcacctccacctgctgcaactttccttgcattccacccacaagataataatatcatcgccattggaatggaggactctaccatccaaatctacaatgtccgcattgatgatgtcaaaagtaagctcaagggacatcagaagaagattacggggctggccttttctcaatcaatgaacgtgctagtatcatcaggtgctgatgctcagctatgtgtgtggagtattgatggctgggaaaaaaagaaatcaagatatatccaacccccagcaaaccgacctggcactttggttggtgacacaagggtgcagtttcacaatgaccaaacacatcttttggtcgtccatgagagccagttgggaatctatgatgggaatcttgactgtttgcgcttgtggtctccaagagatgcactcccagctccgatatcgagtgcgatatactcgtgcgacggtctcttggtttacgctgggttctgcgatggtgctatcggagtcttcgaagcagaatctcttaggctgcgctgccggattgctccttccgcttacattccaccttcaatactagcctgtgctggacgggtctacccgttggtagtcgctgcacaccccatggagcctaaccagatcgcgatcggcatgagcgacggcaaggtccatgtggtggagccattagacggggacccgaagtggggatcggcacctccacaggacaatggagcgcacccgcacccgcatccagcgatatcagcggcaccgtcgaccgccaccaaccaggcatctgatcagccaacaaggtgactctggcctgcagcactggaggagattcgttagcgcagagactggtaggacctgtaggagatagggagaaaaggtaaacgattagatgacgagaggatgatgctatatttatcaagtccgcagcgccctgcctctcttgtgacggcccgcgacacaagtgtggtgattgacagtgacatcgctcactctaagttaggttttggttcttccctggcccccggaaatcatcacctggcgccgccacattcgaatggagatggatctgctggcatcatcttgcttcctcttttgtaaagcttttcctgctgagtttagtggtaccttagattgtcgtccatttctgccctgttctccgggcagctatttgtagtgtaaaaatatggtggcgtgctggatggtgttatttatgcgtgcgtggcctgtcatgacgaattccaccatgtttggggctatttgatggatgtttactgatcatggctcgaaattatttttttcttcgtgccatttgcaattgtagaccgtggacgcggtgtgagttgatgagatttgctggtgagctgtttctggaaaaaaagggggggcccggtaccca

SEQ ID NO: 1300 - DNA, 1031 bp, Zea mays
ccggccgggaccgccggtgcacgcccgaccgcaactgtggactcaccaacgccggcatcccgtgccaccaatgaccaaaaccttctccggctctccagtccctccacgacggctctacaccccctacctaccgcatgtccgtcaattttaccgccaactccccatcccgccgtttctcctatatatgccctcgggcacctcgggcccggccgggaggaaggcaggaagaaccgccgccacgccacacaaaaagcagtgactcagtgagaaaggacagcaagcaagccctccctccatctccgccccgtcgccatggtccttctcttcgtggagaagctcctggtcggcctcttggcgtccgtcatggtcgccatcgcggtgtccaagatccgtggccgcaagctccggctgcctcccggccccgtccccgtgcccgtcttcgggaactggctgcaggtcggcgacgacctcaaccaccgcaacctcgccgcgctgtcccgcaagttcggcgacgtcttcctcctccggatggggcagcgcaacctggtggtggtctcgtcgccgccgctggcgcgggaggtgctccacacgcagggcgtggagttcggctcccgcacccgcaacgtggtcttcgacatcttcacggacaaggggcaggacatggtgttcaccgtgtacggcgaccactggcgcaagatgcgccgcatcatgaccgtgcccttcttcaccaacaaggtcgtgcagcagtaccgccaccggctgggaggccgaggccgccgccgtcgtcgacgacgtgcgcctcgaccccgaaggcggccaccgacggaatcgtgctccgccgacgcctgcagctcatgatgtacaacaacgtataccggatcatgttcgaccggcgcttcgagagtatggatcgaccccctcttccctccgcctcagggcgctcaacggcgagcgcagccgcctcgcgcagagcttcgagtacaactacggcgactccatccccatcctccgtccgttcctcgcgggctact

SEQ ID NO: 1301 - DNA, 812 bp, Zea mays
  misc_feature (635)..(635): n is a, c, g, or t
aaaaaaaaaaaaaaaaaaaaaaaaaaaattgctgcagtccctcggtgccggccagatcgcctccacgaacaaccacacaccccacctaccccggccggaccggcaggcagcacagcatggacctcgccctcctagagaaggccctgctgggcctgttcgccgcggctgtggtggccatcgccgtggccaagctgaccggcaagcggtaccgcctcccaccggggcccccgggcgcccccgtggtgggaaactggctgcaggtgggcgacgacctgaaccaccgcaacctgatggccatggcgaagcggttcggcgacatcttcctgctgcgcatgggcgtgcgcaacctggtggtggtgtcgaccccggagctggccaaggaggtgctccacacgcagggcgtggagttcggctcccgcacccgcaacgtggtgttcgacatcttcacgggcaaggggcaggacatggtgttcacggtgtacggcgaccactggcgcaagatgcggcgcatcatgaccgtccccttcttcaccaacaaggtggtggcccagaaccgcgccgggtgggaggaggaggcccggctggtggtggaggacgtgaggaaggaccccgagccgcgccgcgggcgggcgttnttgcttcgccgccgtccttcagctgatgatgtacaacgacatgttccgcatcatgttcgaccgccggttcgacagcgagcacgacccgctcttcaacaagctcaaggcgctcaacgcggagcgcagccgcctgtcgcagagcttcgagtacaactacggcgacttcatccccgtgct

SEQ ID NO: 1302 - DNA, 4508 bp, Zea mays
  misc_feature (4287)..(4287): n is a, c, g, or t
ggatggacatctttcatcaatttattagatttagtgagaggctccaagatggtatatgtagaatgggaggtaaagacaaactttggccagtttacattttcaaaactacaactatatatcttgcctatccttgtttactataaataagagtggtaatggatcacgatccaaatgtttttcgtaatttatttgtgcctttaattaatattagttcaaaattgaatagaattagagtccaatcttaatcgatctgacacttaaaatttttagtgtaaaatttagagtcattaccacccctaactataagaacccatcacagtccacttatctgcacattctctaattttgttctgtgaattagctgaagcatttttgtaaggacttggctgcgtttcgtaattagtaacagtaaacttttccatggaaaagacgggttagcggagctgcaacttcaccgactgcagtctcagcggtgatccatgaatcccctttgggccttccgctgccagcaaatagcaatagtagtgtttgatcccgttccaaaaacaaaaacaaaaagaagagccacacattttggaaacttttttgtggggcccgcccgcagcaccaaaaccataccaacccccgcaatggcaaaccaaacaaattcgtgtactcaaattggacccgtctcggcgctctctcccaaaaaaacgctataaaatcattgggaccctgggtacctcgaggccggccgggatcgcctccacgaacaaaccacacaccccacctaccccggccggaccggcaggcagcacaacatggacctcgccctcctagagaaggccctgctgggcctgttcgccgcggctgtggtggccatcgccgtggccaagctgaccggcaagcggtaccgcctcccaccggggcccccgggcgcccccgtggtgggaaactggctgcaggtgggcgacgacctgaaccaccgcaacctgatggccatggcgaagcggttcggcgacatcttcctgctgcgcatgggcgtgcgcaacctggtggtggtgtcgaccccggagctggccaaggaggtgctccacacgcagggcgtggagttcggctcccgcacccgcaacgtggtgttcgacatcttcacgggcaaggggcaggacatggtgttcacggtgtacggcgaccactggcgcaagatgcggcgcatcatgaccgtccccttcttcaccaacaaggtggtggcccagaaccgcgccgggtgggaggaggaggcccggctggtggtggaggacgtgaggaaggaccccgaggccgcggcgccggcggcgtcgtgctccgccgccgcctccagctgatgatgtacaacgacatgttccgcatcatgttcgaccgccggttcgacagcgagcacgacccgctcttcaacaagctcaaggcgctcaacgcggagcgcagccgcctgtcgcagagcttcgagtacaactacggcgacttcatccccgtgctccgccccttcctccgcggctacctcaaccgctgccacgacctcaagacgcgccgcatgaaggtcttcgaggacaacttcgtacaggagcgcaagaaggtgatggctcagactggtgagttcctgtgcgccatggatcactttttcttttgagctggccacctgggctggtggttggttgacggcgggtggagttgcaagttgcatcgtcggcgggtgaggtatgagctggaggctggagctgggcggaagacagttgcatgcattgcatctgggcctctgtggtggtggctgcgcacatgctgcaaccgatgccatctaccggtggacaaatcaatgccatctgccagtggacaaggacgaatcaacagccaagtccatattttattttattttgctagtcattgaattttggcgagatcggacgacttttgtgatgcatggctggctccagtcatgtttgacacgtaactaaaagacccaccgcacgggttagggagtactagtacctactactcctaaacaacaacttgtagttgtccacaacaggttaacagatcaaagaaggataggtgagcggcactactcatctcgtggcttccggtgacagatgatcagcccacgaaggaaaaagaaaaagggactcgcttgatttgcgttgctttgctttccgcgcaaggccgaaagcttaaggtcggggcaacgacacaccgagagcgacggagatataccacgctctgctgcttcatgatagctggaaggacatcagcatgacacgcatgccaataatgtagtagaagactagtttatttgtcacctactaggcagagagtgcggtggttccatgaaccaaccattcgtgcgtgcgtgcgtgcccaccgcacgaccacgagggggcatgcaacatatactttacaaaattcattcggttgttgacttggtttcaattcattgggttgggaagacaaaactaacatggatgcgttgcgtactcacaggaaggtgatggctcagactggtgagatccggtgcgccatggatcacatcctcgaggccgagaggaagggcgagatcaaccacgacaacgtcctctacatcgtcgagaacatcaacgtcgcaggtatcgataatcgtcactgctcagtgcaatgaaacggaaacagagtatgctatgtctgaagaaccaagtgagacttatcattcaactactgcagtccagcgctactacacaaacaaatagcactgcaatatcggaagatataataatataaggcacgtcttaatcaagtctccgtcagccaacttaattccgtccttaattaaccggcaacatactgagcctaatgcggtgtcacacttcaagtgggctcccgtatttatctgctaggcgtagtatctatctgtgtatcaaaaggtagttgaagccgccaccacgtgaccacgcctcaaaaagaattgcgttttgatttgtatatccaagctgccacaccggcaggcagtcggtgccaaaaaaaaaaaactaatttgtttgccgtcgcagcgatcgagacgacgctgtggtcgatcgagtggggcatcgccgagctggtgaaccacccggccatccagcacaagctccgggaggagctcgcctcggtgctgggcgccggcgtgcctgtgacggagccggacctcgagcgcctcccctaccttcaggccatcgtcaaggagacgctccgcctgcgcatggccatcccgctgctggtcccccacatgaacctcaacgacggcaagctcgccggcttcgacatccccgccgagtccaagatcctcgtcaatgcctggttcctcgccaacgaccccaagaggtgggtgcgccccgacgagttccggcccgagcgcttcctggaggaggagaagtccgtggaggcccacggcaacgacttccgattcgtgccctttggggtcggccgccggagctgccctgggatcatcctcgcgctgcctatcatcggcatcaccctgggccggctggtgcagaacttccagctgctgccgccgccggggctggacaagatcgacaccacggagaagcccggccagttcagcaaccagatcgccaagcatgccaccatcgtctgcaagcccctcgaggcctagaaatcaatgcgtgtttcctgcacgcgcccccgcagatgaagcactatgtattttctcttttttttgtgtgttgtgttttttttactaagaggagatgtatttcttgttcgtaaaatgcacttagtcaaatggatcgagattatgttgatcattaaacaccaaaatcacttagtcaaacgggtcgggatccattttcctcacaatgtcaacctttgactgatgacaatataatccaagcaagcaaatattaaataaaaaaatatgtactgctacttgcaatagatgcatgtgcatatgcaacgtgtatgagaaactaaattgatagatatgcggtcatttagagcatataggaagacatgttaaagtatacacgaagctatcaaatacttgccctctaaaatatttctctccctaaaagaaagttctccacatttggaaaaacagtctctccctttgaggaaaaggacatacaccccctattggaaaactctctttcaatacaagaggaaaaaaagacaagaatgaatagactaactccccttaatttatgcatagttaaatggtaaaggatattctagtgataccaaataaagaatttaaaagcatatgcatatgtagggatggcaacgggtacatacccgtcgggtaataccatnccatatccgtacccatcaaaaaattctacttgttgcgttacccatatatgctcgcgggtataaaatcttacccatactcgtacccgcgcgggtatttttacccatcgggtaatccgtacccgctaggaaagtcttaaaattccaatataccaatcactaaaaaatagctagagaaaggttttattttagatgggttatagttggtattgatgctattttac

SEQ ID NO: 1303 - DNA, 2088 bp, Zea mays
gtctacctgcagtctcagcggtgatccatgaatccccctttgggcccttccgctgccagcaaatagcaatagtagtgtttgatcccgttccaaaaacaaaaacaaaaagaagagccacacattttggaaacttttttgtggggcccgcccgcagcaccaaaaccataccaacccccgcaatcgcaaaccaaacaaattcgtgtactcaaattggacccgtctcggcgctctctcccaaaaaaacgctataaaatccccggcattcctccttgcctgttccatcgcctccacgaacaaaccacacaccccacctaccccggccggaccggcaggcagcacagcatggacctcgccctcctggagaaggccctgctgggcctgttcgccgcggctgtggtggccatcgccgtggccaagctgagcggcaagcggtaccgcctcccaccggggcccccgggcgcccccgtggtgggaaactggctgcaggtgggcgacgacctgaaccaccgcaacctgatggccatggcgaagcggttcggcgacatcttcctgctgcgcatgggcgtgcgcaacctggtggtggtgtcgaccccggagctggccaaggaggtgctccacacgcagggcgtggagttcggctcccgcacccgcaacgtggtgttcgacatcttcacgggcaaggggcaggacatggtgttcacggtgtacggcgaccactggcgcaagatgcggcgcatcatgaccgtccccttcttcaccaacaaggtggtggcccagaaccgcgccgggtgggaggaggaggcccggctggtggtggaggacgtgaggaaggaccccgaggccgcggccggcggcgtcgtgctccgccgccgcctccagctgatgatgtacaacgacatgttccgcatcatgttcgaccgccggttcgacagcgagcacgacccgctcttcaacaagctcaaggcgctcaacgcggagcgcagccgcctgtcgcagagcttcgagtacaactacggcgacttcatccccgtgctccgccccttcctccgcggctacctcaaccgctgccacgacctcaagacgcgccgcatgaaggtcttcgaggacaacttcgtacaggagcgcaagaaggtgatggctcagactggtgagatccggtgcgccatggatcacatcctcgaggccgagaggaagggcgagatcaaccacgacaacgtcctctacatcgtcgagaacatcaacgtcgcagcgatcgagacgacgctgtggtcgatcgagtggggcatcgccgagctggtgaaccacccggccatccagcacaagctccgggaggagctcgcctcggtgctgggcgccggcgtgcctgtgacggagccggacctcgagcgcctcccctaccttcaggccatcgtcaaggagacgctccgcctgcgcatggccatcccgctgctggtcccccacatgaacctcaacgacggcaagctcgccggctacgacatccccgccgagtccaagatcctcgtcaatgcctggttcctcgccaacgaccccaagaggtgggtgcggcccgacgagttccggcccgagcgcttcctggaggaggagaagtccgtggaggcccacggcaacgacttccgcttcgtgccctttggggtcggccgccggagctgccctgggatcatcctcgcgctgcctatcatcggcatcaccctgggccggctggtgcagaacttccagctgctgccgccgccggggctggacaagatcgacaccacggagaagcccggccagttcagcaaccagatcgccaagcatgccaccatcgtctgcaagcccctcgaggcctagaaatcaatgcctgtttcctgcacgcgcccccgcagatgaagcactatgtattttgtcttttttttgtgtgttgtgtttttttactaagaggagatgtatttcttgtttgtaaaatgcacttagtcaaatgagtcgagattatgttgatcatcaaacaccaaaaaaaaaaaagccccgtttgaatcattggaattgaattcaaaaagaagccgcctaatttaggtatatatcaattaagat

SEQ ID NO: 1304 - DNA, 769 bp, Zea mays
ggcccgggaaaaaagaggtaccaggccgggaatcgcctccacgaacaaaccacacaccccacctaccccggccggaccggcaggcagcacagcatggacctcgccctcctggagaaggccctgctgggcctgttcgccgcggctgtggtggccatcgccgtggccaagctgagcggcaagcggtaccgcctcccaccggggcccccgggcgcccccgtggtgggaaactggctgcaggtgggcgacgacctgaaccaccgcaacctgatggccatggcgaagcggttcggcgacatcttcctgctgcgcatgggcgtgcgcaacctggtggtggtgtcgaccccggagctggccaaggaggtgctccacacgcagggcgtggagttcggctcccgcacccgcaacgtggtgttcgacatcttcacgggcaaggggcaggacatggtgttcacggtgtacggcgaccactggcgcaagatgcggcgcatcatgaccgtccccttcttcaccaacaaggtggtggcccagaaccgcgccgggtgggaggaggaggcccggctggtggtggaggacgtgaggaaggaccccgaggcgcgccggggcggggggcgtcagtgctccgccgccggcttcagctgatgatgtacaacgacatgttccgcatcatgttcgaccgccggttcgacagcgagcacgacccgctctttaacaagctcaaggcgctcaacgcggagcgcagccgcctgtcgcagagcttctagtacaacta

SEQ ID NO: 1305 - DNA, 4503 bp, Zea mays
  misc_feature (1320)..(1320): n is a, c, g, or t
tcctgaaagagaacaataaactcagtcaacaacaattttataattgacaaattacatctactttgtatgatgtcgtaccctatcatgaattgtcatcccactttgatttctagtttgaatattgttgatacatccacaaaatttgctcactgcatcttggatagaactccaacgatgcaacaatgatccctcactacgttctgcaaaatgtcctcggttatcctcatagaataagtagacccttctccaaaatgtgcctctagtttgatttgtcccttgagtaggatctgtactaacattcaaccaagcggtaacaagaagtctatcttcatcgccagtaaagtttttacccttttgctttaggtttggcttcgatgacttgttgatatcctttattggggcagtggattgcaagtcaactggtgtttcagaaacatcttctaaattttcaaaagctccattgacaagattggtaaagtaacaaccatccccttccatacctgtaaagagtaaaacatatgtaaaacacatgttactagatacataaaaactaagtccatgggtctgtctctactatgaagacaagcagaagtagatagcagcaatgtcttcactcttcagtaaagttcagctgctttcgacattctatttgtagtgttatcttgttggagcaacacaatgtagtagtagacacaaatggaaatcatcatatattggcacatgatgtccttcggtgactcaaattacatgaacaagaatacatacgtacacatgaatagaattgtagaggtacaagtgctactttcactagaataaacagaatggagattcaatgaaaccaccattgggattaaaacagatttgtttaaaatcatcccggggatgccacatcaattccattatcatgtatatgggttccagaaacacgatgaacactatatatgaccgttctgttttaagagtatgatccccacaccttttggatgatttgcaaaatacacgagtcaccaacaaatggagaaaaactatggcaaccaaatcggagttatataggggaaccagactgacataaaaaaaataaagtgaacaatagagtatctacaaaatctcagtgctttttgggggagggcagtcgccagggacgatggcctagcggtggagcagcaaatcccagccaaggggagctaagcggatgggggcaggcggaggcggaggcgtcgaggaatggaaggcgatgcaccggcagcgagggtgggaccaggtcacagggacgtgagaacggcagcttaccgaaggagcagtaatccttgccgacggganctaggcggtggtgtccaggaggaatccagacggacggaggctagacggatgtgttagggaagggaagccctaggccaggcaacaatgacgagatcctggggcgacggaaactggacgggacagagaaaaaatggtgcgagtgggttgtggcggcgaggccaacgcgccagaataaggtgatgaaacaaaaaaaatggcgcgactggccttttcgggagtgggaaactagttgctacatgtagagactaaattgattgtgatagcaacttagtaaatttaccaagttgatttcaggagctattggagaggggatttcataaaaactctccaaattttttatttagggaatattttaggtaactactggagtggttctaacgaagtgtagcaattactaagcaataagtaccactcagtagaaaagggagggcgacggatgagggtagcgtgctatagctatcacacagcggcaacaggcaggtgtaggcacaccgctcctcctcgctgttctacgcccacccgcacaagcaatcgtcgcatcgccaccaccaccaccgagaagcagccgcctcgcgccccagatctcgccggcaggggtcgcacgccctagcatgcgcgagtaagtacatgagggcggcgcccttcagtgccgacgggaaaggggcggggaccatagaggcgctgctttggccgaacgggaagggcggcggcggaggggacctgctgttggagccgacgtcggtgctggactgtagacggagcccgagcccgcggtactcgtcatcgacgctgtcttcgtccctgggtggcgccgcgggagactcctcttccggcgtggcggcggtttcggagaacagcgccgccgccgccgccgaagccaccaaatgggcggcgccaggcgagcaccgcggcggcggcgaaggaggcggaggcggaggaagcaggaaggagtggcccggcggtgagctgccgcccataccggggaccctggacatcggattcggcgcggaggagggctgggatgccatgctcggcgacgccgcggcggtggtcgggcaggaccagacattcctcaactggatcatgaccgcgccgggcgacatggaaccgccggcgctggcgctcctcggtaatgccgccggcttcgagttcccggcctcggacccgatcgggttctccctgcagcatcaccccaccggcggcggcacctcggttggggcgctggcctccgacctatcgtcccccagcgcgaggtcgctcaccagcagcagcggcagcagcagtaaggccacttccactttcggcctcctacgaaccgaggcagtttttcagccgccgccgccggccacgaccatgcctttccacgacggtgccgacataaagcccgctcaccttggagtcccgtcggcaagtctactcctcaatcaacaccaagcgttgtcagcagcctccttcatgccgctcccctccttccctgaccatcagcaccagccacatctcccgcccccgccgaagcgccaccactctatgcccgaaaacctgttcctcctccaaaaccaactccagccgccgccgccgccgccgcagggtctacgattcccaccactgcataccaccgcgcccttccagctccaaccatcgctgcaaccaccgcgaggttcgatgaaaacaaccccggcggcgcagcaacatcaacagcttctggatgagcttgcggcggcggcaaaagcggctgaggtcggcaactccatcggcgggcgcgagatattggcgcggctcaatcagcagcttccccctatcgggaagcctttcctccgctccgcttcctacctcaaggaggccctcctcctcgcgctcaccgacggccaccaaggctccactcacctatcctcccctctcgacgtcgccctcaagctcggtgcatacaagtccttctccgacctctcgcctgtgctccagttcgccaatttcacggccactcaggcgctcctcgacgagatcgcctcaacaacttcatcttgtatccacattattgatttcgaccttggtgttggcggccagtgggcttccttcttgcaggagtttgcacaccgccgtggaactgggaacgcccccctgccaatgttgaagctcacagccttcgtctcaagtgcttcccaccatccccttgagctgcatcttactcgggagaacctcacgcaatttgctgtggaccttggcattccatttgagttcactgacatcaatcttgatgcgtttgatccggcagaattcattgctcctagccccaatgaggttgtggctgtttgcatccctgttggttgctctgcacgcacgccaccgctccctatgttgcttcagttggtgaaacagcttgcgcctaagattgctgtggctattgaccatggcagtgaccggggtgacctcccattttcacagcacttcatgaactgcttccagtcttgtatgttccttctcgactcacttgatgctgctggcactaacgcggatgctgccagtaagattgagaggtttctgattcaaccgagagtagaggatgcagtacttggccggcggaaagctgaaaacgcaatggcttggcgggcagtgtttacatcggccgggtttgctccggtaccgctcagcaacctcgcagaagcacaagctgactgcctgttgaagcgcgtgcaggtccgaggattccatgtggagaagtgtggaatgggtctagcactctactggcagagcggcgagctcgtgtctgtctcggcatggcggtgctgatcatacggaccccatccatcaaccatcatgacacctacaccaatttgcaggcatgtttaaccctggtaatgtgcattttgtcttgcaatttcaaacatcgtgaagaaaactattgtatttgttgttacacgcctctgattgctttgctgatgttggagtaccgcctctctaaaatgtaacatgttggtctagggtctcataactctgttcttgctctcttcttggttagccagaggataatttggcaaatctgtggcaatgatgttgttattttactaggtaattcagatgaaaactgacatggactgaaatggttgggtatattaactttcttggcctcatattccaagattgatgtatagatttctaaagcgtggatcatgggtgggcccggtaccc

SEQ ID NO: 1306 - DNA, 3233 bp, Zea mays
  misc_feature (2757)..(2757): n is a, c, g, or t
atccgaagaaagaaagaaagggaaggcggcgcgaggccggccaaggcaccacctcaccaccacccgacgaattcaagcatgaggccgcagagcgcagagcagggctgccgccgctgccgctgaggagcggctacagagtgctatacctattacacagcggcaacaggcaggcaggtgcgtgcaggcacaccgctcctcgctgttccgcgcccacccgcacaagcaagcgccgccaccaccaccaccaccaccaccgagaaggaaccgcctcgcgcccccagatctcgccgccaggggtcgcgcgagtaggtacatgagggcggcgcccttcagtgccgacgggaacggggcggggaccatagaggcgctgctttggccgcacgggaagggcggcggcggaggccacctgctgttggagccgacgtcggtgctggactgcagacggagcccgagcccgccgtactcgacatcgacgctgtcttcgtccctgggcggcgccgcgggggactccttttccggcgtggcggcggtttcggagaacagcgccgccgccggcggccacgaccatgcgtttccacgacggtgccgacataaagcccccgcttctgggagtcccgtcggcaggtctacttcatcaacaccagacgctgccggcggcctccttcttcatgccgctcccctccttccccgaccatcagcaccagccacatctcccgcccccgccgaagcgccaccactctatgcccgacaacctgttcctcctccaaaaccagctccagccgccgccgtcgcagggtctaccattcccgccactgcataccaccacgccctttcagctccagccaccactgcaaccgccgcggggagcgatgaaaacaaccccggcggcgcaagcaacatcaccagctcctggacgagcttgctgcggcggcaatggcggctgaggtcggcaactccatcggcgcgcgagagatattggcgcggctcaatcagcagcttcccccaatcgggaagcctttactccgctccgcttcctacctcagggaggccctcctcctcgcgctcaccgacggccaccaaggctccactcgcctaacctccccgctcgacgtcgccctcaagctcggtgcatacaagtctttctccgacctctcgcctgtgctccagttcgccaattttacggccacacaggcgcttcttgacgagatcgcctcaacaacttcgtcttgtatccgcatcattgatttcgaccttggtgttggcggccagtgggcttccttcttgcaggagctcgcataccgccgtggaactgggaacggtcccctgccaatgttgaagctcacagccttcgtgtcaagtgcttcccaccacccgcttgagctgcatcttactcgggagaacctgtcgcaatttgctgtggaccttggcattccatttgagttcactgccatcaatctcgatgcgtttgatcccgcagagctcattgctcctagcgccgatgaggttgtcgctgtttgcctccccgttggttgctctgcacgcacgccaccgctcccgatgttgcttcagttggtgaaacagcttgctcctaagattgttgtggctattgaccacggcagtgaccggggtgacctcccgttttcgcagcacttcatgaattgcttccagtcctgtatgttccttctcgactcactcgatgctgctggcaccaatgcggatgctgccagtaagatcgagaggtttctgatccaaccgagagtagaggatgcagtgcttggccgtcggaaggctgaaaaggcaatggcttggcgggcagtttttacatcggctgggtttgctccagtgccactcagcaaccttgcagaggcacaagctgactgcctcttgaagcgggtgcaggtccgaggattccatgtggagaagtgtggaatgggtctagcactctactggcagcggggcgagctcgtgtctgtctcggcgtggcggtgctgatcatagcaacctcatccgtcaaccatcgtcgtcgtcgcgcctacactattcgcaggcatgtttaactccggtaatatgcgttttatcttgcaaacattgcaaagaaactattgtcatggttgttccacgcctctgattgctttactgctgtttttggagtattagctaggcctaatgaatgttgcaatcttggtgtgggtgtccccctacaatgtaacatgttggtactagggtctcaacgctgttcgtgctctcttcttggttagccggaggctactttggcatatttgtggcaatggtgttcgttattttactaggtaaatcagatgaagactgacatatgaactgaaatggttgggcattttttttctttcttggcttcatatccatggttgatgtatggatttctaaagcgtggatcatggatcatgctgatgctgttgctgcattagagacttgcatcatgcgatgcagaatcagtgctctgaaatttcgattgaggcatctggtgatgagatgaggcgtcctcagtttaaattgcagctaccattagagttatttttttacatatataaaccgccgttataagaattgaagctgatttgcgtgtgatagaggaaacacttttggccgtggaacattctgtatgcctggcacttaatacaagctagatgactttggaacggaaggcatatggcatggtgaacacctgtgtttctgttttaagaaacggagaatttgaagtttgcaaaccgtactggcttnttttgccaaacaactgagtccgatatatggaatattgggggtttacaggtcatgctgttctctttccacgcaacacaccaggctaaaaatatatagcacggtgagacgacgatatgctattttgttccgacctgtaataaactgcctatatggtttgaaatcttcgtagacaagcttgctgctaggggatgaagtcttttctgtttcaagtagaggacaacatgaattttaggcagaagccatggtggttgtcttcgctgcactctgcccttcctgttttctattgctgaatcatagcggctctctaccggtgtgcaaattcacaatagtgcctgcgtcatacgcaagaattcgttgttcgcaagtggcacttgagaacgccggtcaagctcaaacagctggaaattgtatggttttgtcgacacacacgtatatatgatagtctgtgtccctgtgtgtatagcgactcccggctt

SEQ ID NO: 1307 - DNA, 1456 bp, Zea mays
ggtaatatatccacgccaaggtccggcaccttttctcctcgcgccagagccacgcacgctagtgtcagtggcacgcaggcagccgcgcgcaccgaggggagaccagagctagcggcgaggccaagggcaagggcaagggcgcggacggcaatggcgagagctggaggcggcggtccgttcttcccggtccgcggcgcggcgctggtggtcgtgctgctaggcatcgtcgcgggcgcggcgagggcgcagctgcggctgaactactacggcagctcgtgccccagcgcggagtccacggtgcgctccgtcatctcgcagcgcctccagcagagcttcgccgtggggcccggcacgctccgcctcttcttccacgactgcttcgtcaggggatgcgacgcgtcggtgatgctgatggcgccgaacggggacgacgagagccacagcggcgcggacgccacgctgtcgccggacgccgtggacgccatcaacaaggcgaaggcggccgtggaggcgctccccgggtgcgccggcaaggtctcgtgcgcggacatcctcgccatggccgcacgtgacgtcgtctccctgctgggcggtccgagctacggcgtggagctggggcggctggacggcaagacgttcaacagggccatcgtgaagcacgtcctcccgggccccggcttcaacctggaccagctcaacgccctcttcgcgcagaacggcctcacgcagacggacatgatcgcgctctcaggcgcgcacacgatcggggtgacgcactgcgacaagttcgtgcggcggatctacacgttcaagcagcggctggcgtggaacccgccgatgaacctggacttcctgcgctcgctgcggcgggtgtgccccctcagctacagccccacggcgttcgccatgctggacgtcaccacgcccagggtcttcgacaacgcctacttcaacaacctccgctacaacaagggcctgctcgcctccgaccaggtgctcttcaccgaccgccgctcccgacccaccgtcaacctcttcgccgccaacgccaccgccttccacgaggcattcgtcgccgccatggccaagctcggcaggatcggcctcaagaccggcgccgacggcgagatacgccgcgtctgcaccgccgtcaactaagcctgcattggctgcttgctgcttgcgtgcgtgggtttcacttcttctttctcttgtttatatacgtacgtttgtcggatggattttgttggtagccatgagatgacatccttgctctgagctagcggacctgccccgactggatgatagagattgatccagatgttcttctagtagattctaattctttatggatgtttcccattgacacgcggttacgcgctcttcaaccgtaacgcagctcaagaacttcctctacctctagaaaaaaaaaagggcggccgccaccgcggtggag

SEQ ID NO: 1308 - DNA, 2899 bp, Zea mays
tgtagctagctactccatctccggcgtgacgcactggcactggcagtgccgacgcagcagcccatagcgcggcgccacccctgccctgcttttttttttgtttgcccgctttccccatggccagcgcgcgcgcgcgcgtcgtttgtaaccagcagcaagcagaggctcagagcagcggccgtcctctcctatatatatccacgccaaggtccggcaccttttctcctcgcgccagagccacgcacgctagtgtcagtggcacgcagggcagccgcgcgcaccgaggggaggccagagctagcggcgaggccaagggcgcgggcgcgggcgcggacggcaatggcgagagctggaggcggcggtccggtccgcggcgcggcgctggtggtcgtgctgctaggcatcgtcgtgggcgcggcgagggctcagctgcggcagaactactacggcagctcgtgccccagcgcggagtccacggtgcgctccgtcatctcgcagcgcctccagcagagcttcgccgtggggcccggcacgctccgcctcttcttccacgactgcttcgtcaggggatgcgacgcgtcggtgatgctgatggcgccgaacggggacgacgagagccacagcggcgcggacgccacgctgtcgccggacgccgtggacgccgcctccgtggcgctggcggccccggacgcgctcgacgagagccacagcggcgcggacgccacgctgtcgccggacgccgtggacgccatcaacaaggcgaaggcggccgtggaggcgctccccgggtgcgccggcaaggtctcgtgcgcggacatcctcgccatggccgcacgtgacgtcgtctccctggtaaaaaagaaaaaaacctcctttcggcgcctctctatctctttggcctcttgttgctaccggtttcaccgcgtcacgtagcgcagcggggcactgggcacgccacgccggtgtcagtgtcagcggccaggcacgcacgggcccacgcctaggctgcgtcgtgctgctcggtccagttcaccgtcccgtgtactgtgcttgaccctcccgtagagactagagagaaagaatggagatggagaggcccaccatttgggttggggcgccggtactgttccaagcctgcgtgccagtgaacttttttccctcggagtcacaggttttgggccccttcggcagcaacggctttggcttcggacagcgcagaagctggctttttacgcggcacgggtcgttgtctcgttgagacagtgacatgacatgagggattgagagagagcacggtgttgttgttggctgccctgcccgtgacgcggtgtcccggtcttgcattgcaaagaagagatttttgcatcattttcatgctttgtttttggtgtgtgcagctgggcggtccgagctacggcgtggagctggggcggctggacggcaagacgttcaacagggccatcgtgaagcacgtcctcccgggccccggcttcaacctggaccagctcaacgccctcttcgcgcagaacggcctcacgcagacggacatgatcgcgctctcaggtcagcctcactgcctgtactctactctactctgcgctcctctcggccacagcactgtcagctctagttcgtcgagatgaatgaaacgcgacagcctaggctgtggctgtcaaattaacgaccgtgcctcctcgctctcgttactgttctcctctttggtcactgtgacaaggtaggtaggtagctcgatcgcagtacaaaaaaacaaagcatcttttgtctgtggctcacgtgactttatctttatcctcccctctgcctttgcggcaccgagacaaagtggttcgctgttctatgctgcacctgcacccgctctgatgttttcaaaaaaaaaaaagaagagccagacaaagtggttcattttctgaggacgttgatttgattcatataaacaactaacaaaaggttcctggtgaacttttcgaggggtttttttagtttgttgcctagctaggctctcatgttttggttctggtttttgtctttgattcggtgttgggaatgataaaagaacgacgtttgtagtacgtacatgggaacaggagggagcacctttgtctgaatgttcttggttcctgtcagatcctactacgtagtgtttagcagcagtaaaaataaacctctcgattcagattcccaaattaaacaagcaaccgcaaatctttgcaggcgcgcacacgatcggggtgacgcactgcgacaagttcgtgcggcggatctacacgttcaagcagcggctggcgtggaacccgccgatgaacctggacttcctgcgctcgctgcggcgggtgtgccccctcagctacagccccacggcgttcgccatgctggacgtcaccacgcccagggtcttcgacaacgcctacttcaacaacctccgctacaacaagggcctgctcgcctccgaccaggtgctcttcaccgaccgccgctcccgacccaccgtcaacctcttcgccgccaacgccaccgccttctacgaggcattcgtcgccgccatggccaagctcggcaggatcggcctcaagaccggcgccgacggcgagatacgccgcgtctgcaccgccgtcaactaagcctgcattggctgcttgctgcttgcgtgcgtgggtttcacttatttcacttcttctttctcttgtttatatacgtacgtttgtcggatggattttggtagccatgagatgacatccttgctctgagctagcggacctgccccgattggatgatatagattgatccagatgttcttctaaaaaaaaaaaaaaaattatgggtgtttcccattgacacgcggttacgcgcgcttcaaccgtaacgcagctcaagaactcct

SEQ ID NO: 1309 - DNA, 1328 bp, Zea mays
ctcctcgcgccagagccacgcacgctagtgtcagtggcacgcagggcagccgcgcgcaccgaggggaggccagagctagcggcgaggccaagggcgcgggcgcgggcgcggacggcaatggcgagagctggaggcggcggtccggtccgcggcgcggcgctggtggtcgtgctgctaggcatcgtcgtgggcgcggcgagggctcagctgcggcagaactactacggcagctcgtgccccagcgcggagtccacggtgcgctccgtcatctcgcagcgcctccagcagagcttcgccgtggggcccggcacgctccgcctcttcttccacgactgcttcgtcaggggatgcgacgcgtcggtgatgctgatggcgccgaacggggacgacgagagccacagcggcgcggacgccacgctgtcgccggacgccgtggacgccatcaacaaggcgaaggcggccgtggaggcgctccccgggtgcgccggcaaggtctcgtgcgcggacatcctcgccatggccgcacgtgacgtcgtctccctgctgggcggtccgagctacggcgtggagctggggcggctggacggcaagacgttcaacagggccatcgtgaagcacgtcctcccgggccccggcttcaacctggaccagctcaacgccctcttcgcgcagaacggcctcacgcagacggacatgatcgcgctctcaggcgcgcacacgatcggggtgacgcactgcgacaagttcgtgcggcggatctacacgttcaagcagcggctggcgtggaacccgccgatgaacctggacttcctgcgctcgctgcggcgggtgtgccccctcagctacagccccacggcgttcgccatgctggacgtcaccacgcccagggtcttcgacaacgcctacttcaacaacctccgctacaacaagggcctgctcgcctccgaccaggtgctcttcaccgaccgccgctcccgacccaccgtcaacctcttcgccgccaacgccaccgccttctacgaggcattcgtcgccgccatggccaagctcggcaggatcggcctcaagaccggcgccgacggcgagatacgccgcgtctgcaccgccgtcaactaagcctgcattggctgcttgctgcttgcgtgcgtgggtttcacttatttcacttcttctttctcttgtttatatacgtacgtttgtcggatggattttggtagccatgagatgacatccttgctctgagctagcggacctgccccgattggatgatatagattgatccagatgttcttctaaaaaaaaaaaaaaaaaaaaaaaaaaaaaaaaaa

SEQ ID NO: 1310 - DNA, 2006 bp, Zea mays
  misc_feature (499)..(499): n is a, c, g, or t
gctccgcccagtcgccgtgcgcgcgaggcggggacgagcacggtgtgccgttgtgcgccgtgcgttgcacagtgtcggccaatcatgagccccgcctccgaggcttttctggctgctggcttccctttccgtcgcagagcagacgtgtgcagtcactgcgcgccatcgccatcacttcattcagtgccctctgtggctctgtgtctctatcaatctctctgtgtgctttccagctttctggtgtcgtacggcttctcgacctctttcttttatttcgggcctccagccctccaggtacaagcttgactcagctttccctgctccgttcttctttgccttgcccgttctcgccgcctgtgctgttcctgtgcgcatcatacggaatgaggggatcgtcgcagggggatgatgggcctaagctacgacgcggacagcgggagacgcctgctggctcgctacgccaaggcgaaagccgaggccggtccaagtgggacgacgncgcagcggtggctctcctcctcccgtgcgcacgacgacgacgaaccggcgccggagctcctgcgcggacgaccgcctcctgctgccgtcggcatcgcagaaggcgcgacactcgtggagcgccgcggacggcggcgccgccctgcccgcggcgctggggctcggcgcgcgggacgacgcgggtgcggaggcggagaccaagagggtggactccgttctggcgtacgggcagccgccccggtgcccctcgctgcgggacgtcggcacggagatgacgccggccgggagcaaagagccatccagggccaacaccccacgcgcaaccctaccggccacgccgccgtccacggcggggcgcgcgatccacgcaccgctgcgcccaccggatttgtctacggtcgacggtggatcgccaccaggcctagcggcagcggaccgcgacgagacggcgcccggtgcgccgacgacgacggccgtgtcgcccgcggcgacgtgggacgccgccgagcgcgccaagcacatggccaggtgaccgccatcactcgctagctgccggctaccgaataccaacgcgcgctttctcctccgcacgttgctgaaccatgtggaggggcaaaacggcggcaacaaacggtcaaacgccactgccacggtagcagactagcagtgccggtgcatgcaccggagtggtgtgttgcctttgctttgcctgttgcctcactcacagactcactgatgagcagctcgtactgtactgtacatgctctgcgtgctgacgaggtcgctggcgctctcttctcgcaggtatcggcgcgaggagatgaaaatacaggcctgggaaaaccggcgacggcaaaaggcggagctgcaaatgaaggtggccgaggtacgagtagtcatggccatatgtttcatcagcctagaaaaaaagtttggacctgtggaagtcaaccacgcaccagatacggacctttcgatccgaacaatggaaggaaattgaaatgctcatcgctggggcaggccaaggcggagaggatgaagctacgggcgcaggagaagacggcgagcaagctggcctcggcgcaggcggctgcgagggagaagcgcgcgcaggcggaggccaagctgaaccggcgcgccgcgcgggtcgacagggcggacgcgctcaggcggaccggccacctgccgtcctcctcctccgtgttctcgctcaagctgccgctgatgtgcagatgagagccgaccgaggggggtgtggcacagcagttcacacggatgctgttcagagtttcagtcaactgtcctgttagaattggtcgggacgctgctcgcgtccttgtgtttcagccgagcggtttgcgatgcacacaggcacatggcacttagaattgtagacatttgtttttttatctgcacaaatcagtgaagaacaaaaatattttatatttactctattggtccaaataaaaggataactaccgtttaaagcggttcacgcttgaacaaat

SEQ ID NO: 1311 - DNA, 3357 bp, Zea mays
  misc_feature (254)..(254): n is a, c, g, or t
  misc_feature (3339)..(3339): n is a, c, g, or t
atttttggagcagtgggcgtggatttgagtgctcgctctgcactaatttttacatagtgtggtagctgctttggcggggtcggtgctgggcagacgcagtagctggctgcgcgagcgtgggtgtctacaggacagtagctgatagagtgctgcgcgggtgctgggcgtgggtcccacagggcacagtggcgaggtgatgcgcgtggggcgggagaactagacgggacatgaagggtgaagacattgtagcatcngacgcctactttaggttcttagtagagtagtatagattaaaaaattagatgaccagaagtttgtttgaaatatttgttttacactattggccaccgtaaaacttgcatgaagaaaaattcttcttttataggggcatcaagaagattccactcagtgtgagaaagacaacagaagaaataaaaaatacactatcatttggtttcaactttcaagccacctaattttgcttacattattccatcaattaggctaaaaagcgtgtctaccgtaattgaccacgtatccgttttttttggcacctgatggtaaaacaccacacattttgtgagcacgcaaccaaaattcaccctccccgttttgcacatgagagctagtttagcaacctcaattttctaatgatccatttaaatatagatatcgaagatgttagaattgaattatatctaatactaaatctgtctaatattgaaaatgagtttcaatacaaatatgttgtttggaagtacaaggatttgcaattccaaccaatatctagagtcttgactctgaattgtagagacactttttagttaatgtccagttccaaaaaaagttgagctttaattctagctctaaattcaccagccaattaaacagcagaattcagaattccggattccaattctccatttcagtcttaaatatctacatcaaaacaggatataagggtttctatttttctaagaagaaataaactaattttcttaaaaaaatgaaaattagggttgccataaataatctaaaacataataaaaccgtccggcgctccgcccccgcccgcaaccaagcaaaaactacacgtcttgtccaaaacccaaagaacaaagcccctttcccctccccggattgccctcttcttccattttgtcgaacacctcccccgatcgcgggactccggtcatggcggaaaactccgacgcggctgcggccgtaactgcacggctactggagcttgcggccgacaacgactccacggcgctcggggacctcctcgcggtacacccgtcgcttgccgacgagcccgcgccgtggtactccccggcgcgcggcgcggagcctatgaccccgctcatggtcgcggcggcgtacgggtccgtggcctgcatcgatgtcctactctcgccgccccacctgaccgatcccaaccgcgcctcaccgtcgtccctctccaccgcgctccacctcgcagccgccggcggcgcctccgctgcgccggctgcggtatcccgtctcctagctgctggcgccgaccccacgctgctcgaccatctccatcgccggccgtccgacctcgtcgccctcccacccaactcgctcccgcttaagaaccacctcctctccctcctcggagggcgcaaggagtggccgccggatccctccctccccgacatcaagaacggtgcctacgcctccgacgacttccgtatgtactccttcaaggtgcgcgcgtgctcgcgcgcctactcccacgactggacggagtgccccttcgtccatcccggcgagaacgcgcggcggcgggacccgcgcaagtaccactacagctgcgtgccctgcccggagttcaagaagggggctggatgccggaggggcgacatgtgcgagtacgcgcacggcgtgttcgagagctggctccacccggcgcagtacaggacgcggctgtgcaaggacggcctcgcctgcgcgcggcgcgtctgcttcttcgcgcacacgcctgaggagctccgtccactgtacgtgtcgtctgcggggtcgcgcagcgcgatgggaatggggctgccgtcgccgggtgcgtcgttcacgccgccgctctcgccttctggcgggggaagcggtgtggccggcgcgtggccgcagcccaacgtgcccgcgctgtgcctccccgggagcgcggggaaccttcagctgagccggctgcgcactttgatgagcgcgcgcagcatggcagtggacgagctgctcgcctcggcggattacgacgggctcgtcgggtcgccagcctctctgcggtcggcgaggggaaagacgctcgtgccgtccaatcttgacgatctgttctcggcggagatggcgggcgccgcggcatctcactcgcctcggtacgcagaccagggcggctctgctttctcgccgacgcgtaaggccgccatgctgaaccagttccagcagcagcagagcttgctgtctcctcgggccacggttgtccctgagccggtgtctccgatgagctccaggttgctctcggcccttgcgcagcgggagaagatgcagcagcaaacgctgagaagtatgagctctcgtgacctgggctccggcgcctccgtcctggttggctcaccggttacctctagctggtccaaatggggaatccccccgagcacaccagattggggtgctgacgccgaggagcttggccgcctcaagcgatcctcgtcctttgagctccggagtggtgccaacggtgatgagccggacctctcatgggtcaatacccttgtgaaggagccaacgccggagaagccatccatcaacgggacagccgcaaaggagtctattgcttctttgagccaggctgcaagtcatgagggtatcggcggtgaggacgacactgccggggtcatcggtggctggcttgaacagctccagctggatgagatggtagtctagaacaaacacaaacataaatcaaataagaaaggtgccattttttccctgtgatccaccatttgcttcaccaacttactacatctaccaaccttcataccttgctggtaattactggtgatacattcttttggagttggttagtgtaggtgttgagatttccatcaccatttagggtccaccacaagtgagaaattaaggaatggaaacctagccaattttatggaatttccacatcccatgcttcatgtgaaggagcagtagggtgacttgtcgttgcttcaaactcttctaaggcctgcaatggtattgtactacgtaggattctggccgatggctaaatcccatggtccatcatctggggcaaatgacttcgtttcnctgcataactcattcgtc

SEQ ID NO: 1312 - DNA, 3069 bp, Zea mays
ccggccgcggatcccgcgcctagcaaaaacctactcgttttgccccaaaacccaaagccgaagtacgtttcccctccctcgcttgccttccctcttctgccattccgccgaacaccttccccaatcgtgcgcctccggccatgggggaagcctccgacgcggcggtagccgtatctgcgcggctcctggagctggcggccgaagacgactctgcagcgctcggtgacctccttgcggcacacccgtcgcttgctgacgagcccgcgccgtggtactccccggcgcgcggcgcggagcctatgaccccgctcatggtcgcggcggcgtacgggtccgtggcctgcatcgatgtcctactctctccgccccaccagaccgaccccaaccgcgcctcaccgtcgtccctctccaccgcgcttcatcttgcagccggcggcggcgcctccgctgcgccggctgcggtatcccgtctcctagctgctggcgccgaccccacgttggtcgaccacctccatcgccgaccgtccgacgtcgtcaccctcccacccaactcgctcccgctcaagaaccaccttctctctctcctcggagggcgcaaggagtggccgccggatccctccctccccgacatcaagaatggtgcctacgcctccgacgacttccgcatgtactccttcaaggtgcgcgcgtgctcgcgcgcctactcccacgactggaccgagtgccccttcgtccaccccggcgagaacgcgcggcggcgggacccgcgcatgtaccactacagctgcgtgccgtgccctgagttcaagaaaggggcggggtgccggaggggcgacatgtgcgagtacgcgcacggggtgttcgagagctggcttcacccggcgcagtatcggacgcgtctgtgcaaggacggcgtcggctgcgcgaggcgcgtctgcttcttcgcgcacacgcctgaggagctccggccactctacgtgtcgtcggcagggtcgcgcagcgcgatggagatggcagcggcgatgggcatgggactgtcttcgccgggtgcgtcgttcacgccgccgctctcaccttgcgccggcggaagcggcgtggccggcgcgtggccgcagcccaacgtgcccgcgctgtgcctccccgggagcgcggggaaccttcacctgagccggttgcgtacttcgctgagcgcgcgcagcatggcagtggacgagctgctcgcctcagcggattacgacgggctcgtcggatcgccagcctctgtgcggtcggcgaggggaaagacgctcgcgccatccaatcttgatgatctgttctcggcggagatggcgggcgccgcggcatctcactcgcctcggtacgcagaccagggcggctctgctttctcgccgacgcgtaaggccgccatgctgaaccagttccagcagcagcagagcttgctgtctcctcgggccacggctatccctgagccagcgtctccgatgagctccaggctgctcgcggcccttgcgcagcgagagaagatgcagcagcagacgctgagaagcatgagctctcgtgaccttgcctctggcgcctccgtcctggttgggtcaccggttacctctagctggtccaaatggggaatccccccgagcacaccagattggggtgctgacgacgaggaacttggccgcctcaagcgatcctcgtcctttgagctccggagcggtgccaacggagatgagccggacctctcatgggtcaatacccttgtgaaggagccgacgccggagaagccatccatcaacgggacaactgcaaaggagaccattgcttctttgagtgaggccgcgagtcatgaggacatcggcggcgaggacgacacagccggggtcatcggtggctggcttgaacagctccagctggatgagatggtagtctagaacaaacatgggcataaatcaaaggtgccattttttttgtttttttttgctgtgattcaccagttgcttctacagctaactacatctaccaaccttcatacctcgctggtaattactggtgatacattctgttggagttggttagtgtaggtgttgagatttgcaccaccatttagaattccccgcaagtgagagaaatgaaggaaatggaaaccaatccaactatatggaatttcaggtttcggtaggtggacattgtgtttctccttgtactttccacatccatatcctttgctcatcattccaaaggtgatttcctcgcccattgtgaattatgtatgttggtgatatcatctcctaagccccatcctctgcttctaatggctcatgattggtgtaaaacaccctactgttgttgtactactcaggattcgtgactgatgttgaatgccctactgttgtgttgtactcactactcacgatccaatggtccatgattgctttaattgacttcattgttgctggaccaccaaaactaagcgatgcatcatcacttcactgcataactcattcgttaaatggtatcaccttgttttaaattgcatggcctgtgtctgtccatttgctgctttgatgatcgcctgattggttctggcagcaactgttttctgttgaagctgcagctcgcgtctctgctgctgttctgtttgtgtttgacattttggatggatgctagtcatggctaatgcagagtggtaatctcatgccggcataagattcgatgtgtgctgtgaatctgtgatgtttaatgtgttccgaggtggctcaacatggtgcgtacaatagtgatgtttattgtgctccaggtgagtgcgacctggcctctggtggagcttcgttcttgtcaggataaaacaactagggcgttggctcggtatggccgcctcatgtcttggcttctgtttggcctaagtgacactggacagtgctgactcgtacagtgacctggattttaaaaaaaaagagaaagctggatctgatggttcaatgtatcgttccaattcaatgcattacttaattagagcatcttcgagagtttctaaatttcactataaattattatcatttagggctagttagcaac

SEQ ID NO: 1313 - DNA, 808 bp, Zea mays
aggcaggcaggcaggcggggcaaaggtagtgctagtagtactagtgcttcgcgagagaccgatcggctccggtcggtcagatataagcaaaggcagcggcggtggcggcggccagccgagccgtgcgccggcgggtaggcggcggcgccaccaccaccagcagcagcagatcgggacgcgcgtcatggcctggtggcgcgcgagggtggtcgcgtccgtgcgccgcgcctggctcgccgtcgccgtcgccgccgcgcgcgcgcgcgtccgcaagggcgagtgtggcggcgtcctgagcctccaccgggacgtgcagacctgcgggtaccaggacgtgcaggtgatgtggaacatgctgagctcggagaaggaggccgcggccggcgcgctgccgaagccgccgcggcggaagcgaccgtcgtcggtctggaggctgccgctctggcccgtccggtcgccccgcgccgccccggggtgaggcggcggcagcagcagcatcgccgacggaatggtactcctggttggtttcccatgggcgagtaggaggacatcgtcctgaccatggcacgtcgtcgtccacctcccaggcgaggcctaccaagatcgtgagtgtgagactcccatcccaggcctgaatggatcgcgtgtaggtagtataagggcttgccgctttcctgcctactgtacagtttggtttgggtatgtacagcgcgctactcctgtatcctatatatggcttgtgccatctggtgcttcattctcatatgaagttctgagcttaggttgcccagagcttggtgcgctgctt

SEQ ID NO: 1314 - DNA, 1673 bp, Zea mays
cggacgcgtgggtgagcagccagccgtggaggaagagatgtacccataccgcatgagcaacgtgatgatcgggtacctgaacctggccacgctcctggcctcgctccccatcatcggggcggggctgtggctggcaaggggtagctcctcctcctcctccaccacgtgctcgtcgatcctgcagacgccgctcctcgccgtgggcttcgcggcgctgctggtctcgctcgccggcttcgtgggcgcctgcttccacgtggcctgggcgctgcggctgtacctcgccgccgtcgcactgctcgtcgccttcctcctcggcctcaccgcgttcggcttcgcggtcatccgcgggcggcggcggcgcgcaggtgtacggccggccgtaccgggagtaccgcgtcacggactactcggcgtggctccagaagcgcatgcaggacgacaggtactggcgccccgccctcgcctgcgtcgtcgggtccaaggcctgccccaagatccagaactggacgcccatggactacctccagcacgatctcacgccaatacagtccggctgctgcaagccgccgacggcgtgccagtacagcggaggcatgccagtcggggcgcaggacgaggactgctaccggtggaacaacgccccggacatcctctgctaccggtgcgactcgtgcagggccggcgtgatggagcaggtgcgccaggactggcacaagatctttgtgctcgacgtcgccgtgctcgccgctctcgtctgcatctgctcatgcgggtgctgcgccttcaggaacgctcgccgctcccggtcccagtacccatacggggtaaaccaaacgtccaagataaacccacgctgggactactggtggcgatgatggggtggtagaagagaacagatctactaggctagctgtagcttctcaatgcctgtatgatattttgatccagtcttctgtggaaaaagataaaataacacttgggatctgtatgtgttattagcccctgtggtactctgtctgtttccaggtctgcagagtgtagtgtagtttctgtagatatttgagttaagaggagactaagccatgaagtaaaagagatgcctagttttttcccccttcaatatggtagccagcattgtatcatgtagaattttaatccaggacagaagtggttccatgtatatgggggaaaccaaaccacaccagaagctatcagctatgcctgttctactgttggcgtggcttccttatgatgtgattacactggattcctttacactgaagtcaaatcgggggcaggctattcagcaatgtttcagaaacatgttcactggaattccgacaataacccatttttggcacataatacaaaatacagagagagagagagagagagaatctcatgcaggcataatcactcacggtgatcatatattattggcattgattgtcgcagaactggtatcaggtatggtacagcaatttgttttcaatccgagtggcacagtcccaatcacaaagtgaataaaaggtgccaaatgcttattggacggttggaccagatgtgtcaccagttctgaaataatctgtgttttgaaaaagccatgtatcctgtgatccatgtccatttaaaaagggtctagcaaggaacatgctggaaagaatggctgt

SEQ ID NO: 1315 - DNA, 863 bp, Zea mays
cattgggtacctcgaggccggccgggactactatcatcatttcaacctctctccctcggcctcgccggcggcacagcgcagcgcttccactgttgggtgtggtggatttcctccgcccccgaacgatcgatcttttgcatggcagcagcggctagctccaaggggcgggcgatcgctgggagcttcgtcagccgcgtcctggccggcaaggccgcctccccgaggagggccgtgcacgcctcgtcgtacgacaagaacccggaggagcaggtgcgcccggcgttcgtgccggacgatgtgatcggcggcgcggggagccccgacaagtactggagcccccaccccaagaccggcgtgttcggcccggcggcggtggacaccaaccagctgggcgtcgccgctgacgctgccgccgcgaatgcggctgcagcaggaggcacggtgctggaccagaaggtgtggttccgcccgctcgaggacgtcgagaagccgccccccgtcgcctgaaccgcgccacgcccacgcgacgcgacgctgccagcccacactgctgatacaagggcggcggccgggagggagagtcctggcaacgtcatgctcgtgcctgtaataagaacaagcaggagatgtgtgtgcctgtgatgtaccggtgtcgttatcagcgttatacaagtacttgcggttcataagataaaaaaaaaaaaaaaccaacttcctttattccgtgaccgcgactcaaatcaatccctatagcacaccactcaggcgcccacatgagtgtgcagtgcggccaaacaactactactatcggagcagtacaagaaatcatcaagcagagtagctctcttccgacccgattcccg

SEQ ID NO: 1316 - DNA, 879 bp, Zea mays
  misc_feature (862)..(862): n is a, c, g, or t
cattgggacctcgggccgccccgcgcccggccggccggcactatcatcatttcaacctctctcccctcgactgttgggtgtggtggatttcctccgctcccgccgaacggtcgatcttttgcatggcagcagcggcggctagctccaaggggcgggcgatcgctgggagcttcgtcagccgcgtcctggccggcaaggccgcctccccgaggagggccgtgcacgcctcgtcgtacgacaagaacccggaggagcaggtgcgcccggcgttcgtgccggacgatgtgatcggccgcggcgcggggagccccgacaagtactggagcccccaccccaagaccggcgtgttcggcccggcggcggtggaccccaaccagctgggcgtcgccgctgacgctgcagcagcaggaggcacggttctggaccagaaggtgtggttccgcccgctcgaggacgtcgagaagccgccccccgtcgcctgaaccgcgccacgcccacgcgacgcgacgctgccagcccacactgctgatacaagggcggcggccgggagggagagtcctggcaacgtcatgctcgtgcctgtaataagaacaagcaggagatgtgtgtgcctgtgatgtaccggtgtcgttatcagcgttatacaagtacttgcggttcatatgatcgataaccactagaacatgagtgtgcagtacgttcaaacaactactacaatcagaccacctccaagaaatcatcaagcagagtagctctcttccgaccgatttctgaactgacagcaccctgctcaactgggtacccaagtagtaattagcaatttgcgtctccaccacatactggcaggtggcagttaagcttntaacccccaacaaacac

SEQ ID NO: 1317 - DNA, 1581 bp, Zea mays
ccacgaacaattctagaagagggtccgtttatctacggaattttattatcgcctagggaaatttccagctcatgctcatggatggctcgacgaaacatacaataacgtgattgaataacgtgatttccagctcatgctccatctgtatctctccgctgcctcctaggctgctagtcaaaccgtgcaccgtccagtgtcccccgccacgaattgaataacgtgattccttaaaataagacacgacggcgaaacatacaatgctgcattatacgtgcgccactttagcccacgaccagagcaatttttttcagctttttaccagcgctagaaatgacacatgcatagcaccgtttctagtggggtggggggtaaaaaccgcacaatgataagtggtagtaggagtaaacatgatcagattcagatcagacggcccaacgttgatggaggtcccaaggcgaggcgcggtctctctcttgggacagcgatgccgctggccgttggtagggtactagaggtggacgcacagctggccgttccgatcagaagccgcagaggttgcccgtcagtgctgctccccaatagccaatagcaatagcaatagcaatagcaggcgctgtacgacggtgtgccggcaccggctagctcgggcgctataaaatgggggcagccggtgggtgtggtgactactatcatcatttcaacctctctccctcggcctcgccggcggcacagcgcagcgcttccactgttgggtgtggtggatttcctccgcccccgaacgatcgatcttttgcatggcagcagcggctagctccaaggggcgggcgatcgctgggagcttcgtcagccgcgtcctggccggcaaggccgcctccccgaggtactgggacgacggcaacacgaacgcggtttcgccccgtggttcattctctttcggtttgctcgtctgtgctagtagaactactgtgtttttttttaggatgcgcgttcttgttaagttggtccaatccaagttcctgtggtagttgcagcagagcagagcgatttgcttgcttgcttcttagctctgtggatgactctgattctcaatgtgtgtgctgctgctggtggcaagattttgctcggcagaaaatctactggaatttgccaactgtaggaggaggagctactattatcttctctcccatggtctacgactacgactctacgtagagtcgtagacatggcaactgtctgctttgggaccatcaccagcttgtttaatccactttcctagttcttttcgggcgttttgcgagtaccacacacagtagattttgattttctgcccacttcaaactgtcaaatctgcaagactcgcatggtagccgcggagagagagagaggaagtgcacatcctcaaactggaggcacgcaggacgtgcacgtcctcaaaagcccagccacgccggggcctgatgggtctggtactctggtgcgcggcagttgtcgtccatccaccctctgctctgccaactgccatggctcgatgacggtggggtcgggaccaggcgtggtacggtaagctatggagtgcgacgg

SEQ ID NO: 1318 - DNA, 2901 bp, Zea mays
ccccgacccatcagtagagggcggcggctgcctcctcttcctacccgcgtccgagctcgcccccttcctcgccaccttgggaggcgacgagcatcaccaggacaccaggttgcctatattttcttccccttcttgaaaatggatcatagttctgacgaagatacagaaatcagtgattctgagattgatgattatgaaggaaaaatttatgcaagactgatgtcaggagatttaaaattaaataagaatggagaaaattacatttgtcccttctgtagcagcaagaagaagaattacagtaaaagtagcctggttcaacatgcctcaggagtcagtgcagcacctaatcgggaggcaaaagaaaaagcagtccatcgcgccctcttcaaatatttgaagaatggtcttgctaaatcacctgaaccagggtcacatgcaactcctgtggagccacaacctcttcagaaccgagacgagaagtttgtgtggccctggatgggtgtcctagttaatgtgcctactgaatggaaggatgggcgccaaattggagaaagtggaaatcgtctgaaggagcaactatcacacttttgcccactgagggtcatcccgttatggacttttagaggtcatacaggaaatgctattgttgagtttggaaaggactggaatggtttcagaaatgcgcgtacctttgaaagtcactttgcggcaggaggattcggtaagaaggactggattggaaaaaagaatcaaggatccgagctctatggatggcttgcgcgggctgaagattacaattctccaggaataatagcggaccacttgagaaaaaatggcgacttgaaatctgtcaatgatcttgcaaaggaaggagcgcgtaaaaatgacaggcttgttgctaatttagctaaccaaattgaggtgaaaaataggtatttacaggaactagaatgcaaatacagtgagacaactgcatcacttgagaagatgatggggcaaagggaacaacttctccagtcatacaatgaagaaattagcaagatgcagcagctagctcgcaggcattctcagaagatcattgatgagaatcaaaagttgcgttctgaccttgaggcaaaaatgaatgatcttgatgtgagatccaagcaactcgatgagattgcagcaaaaagcgattatgacagaaggagccttgagcaggagaagcaaaagaatgctatcaaatcgagtcatcttaaattggcaacattagagcagcagaaagctgatgagaatgtgctgaagcttgtggaagaacaaaaaagggagaaacatgctgcgttaaagaagattctgatgttggaacaacaattggatgcaaaacaaaagcttgaattagaaatacagcagttgaagggcaaactaaaagtgatggagcatatgccaggtgatgaagattcagcgtcaaagaataaaattaatgagctgagtgaggcattgcaagaaaagatagatgaactggatggaatggagtcacttaaccaaactctggttatcaaagaaagcaaaagcaacattgaactgcaagaagctcgcaaagagctagaaaatggcctgcttgatctttcaggtgggcagacacatataggaatcaagagaatgggagagcttgatctaaaagcattttcaaaggcatgccaaaaggagcgtacagaaaatgcagaagttactgctgcctttctttgttcaaagtgggaggctgaaataaaaaatcctgactggcacccttttagggtcgtcacaattgatggaaaggagatggcaataatcgaggatgatgcaaagcttcgagcactcaaagaagaacatggagaagaaatctatgcaatggtgacaaaggcgctgcttgaaaccaacgagtacaaatcaaaaggcagctaccctgtgggggagctatggaacttcaaagaaaaccggaaggtgactctgaaggaagctgtccagtttgtcctgagacagtggcgaacaaacaggaggaagcgataagctctcggccacccaatgctcttggctttttttcccaccacctggtccgaaagccatgagttcgagagctagtaacctggaaacagtagtattaattcgtgataaaatcaacagggcgatacagccctgtggatctgttccttgttggatataagctggcactcctattgcagtgtcagcatcagtggactcgaacgccattatggcgttatccttgtgccacctttgtaacaagtagttcgttcttgttcttgaaccgtgtgttgtagttggcccttggccgcatgctaccggctctgtacggctgtgcctacaaagttgcggtggaacatgcagactcataataaagcatgcttgggctcttgtgataaaaaaaaaaaaaaaaaaaaaaaaaaaaaaaaaaaaaaaaaaaaaaaaaaaaaaaaaaaaaaactttcctttcgttcgcgtccgaacaaatcccgtgctccccggggggaaaaccctccccacctccggcggcggcggcggccctggcaaccgggtgtcttctccggcgagtctcccccctagaaacaaaaaaatatggatgtccctgttgatgaccctggggaaaacctcactggaagtcctagtacccttggcaatgaggaaaaagccactacttatgctaatgtgcaagatcagcccaaggaaaaaccaaaaaagctttacgaggaacccaaagacccaatgcaagacgagttgggtaaccaaggccatgtgaccataaacaatgaaaatgtgggaggccaaaacaaaggggaccaagctacccccacagagcacggcaaggaagctggggtgaaccaccatgatgctacagttcctgatgacaaaaaatggcctgggtggcct

SEQ ID NO: 1319 - DNA, 1941 bp, Zea mays
taccggtccggaattcccgggtcgacccacgcgtttgctcagggttctccttcttgacctcggtccacttcaaggaggtgtccaacacgctgggcgccaagtggaaggctctgggcgccgaggagaagcagccctatgaggatcgataccgccaggagaaggaggcctacctgcaggtggttggccaggagaagcgcgaggccgaggcgatgaagcttctcgaggagcagcagatgcagtggaccgccaaggagctgctggatcagtacctcaagttcaggcaggaggccgaggagggtgactgcaagaaggggaggaagaagaagagcaagaaggataaggacccctccaagcccaagcagcccatgtcggcctacttcgtgtactcgcaggagaggcgtgccacgctggtcgcggagaagaagaatgtacctgagattggcaagatcaccggggaagaatggaagaacatgacagaaggtcagagggctccctatgaggaggtcgcgaggaagcagaaggaagagtaccacaagcagatggaggtgtacaagcagaagaaggctgaggaagctgctagtcttgagaaggaagagcaggagcataagaaaatcatgaagcatgaggctctccagctgctcaagaagaaggagaaggcagataatatcatcaagaaaaccaaagaaaagcgccagaagaagaaacaggagaacgctgatcccaaccggcccaagaggccagcctcttcctttcttcttttcagcaaggaagagaggaaacagctgatcgaggaacgcccgggcatcaataactcaaccctgaacgcgctcatcacggtgaagtggaaggaactgagcggcgaggagaggcaggcctggaatgcaaaggccgcgcctgccatggctgcgtacaagaaggagatggaggagtacactaaggcccaaagctcatctgcttgacagaataactaattcctgcgagtgagctttggttacaaggatcctcatctctgaatcctggtgtggtagattacttcgtgtgatctttagctttgtgtgaccttattagtcgcagcaatcagtgtaatggcggttcatatggtttagtggcagtttatattgttgccacgggcccaggaattgagtaatctttcagttctgacaaaaaaaaaaaaaaagagccccgtgcgaggggccgagggggcagccatgggatattagacccctctactcagtcggcatctgccgtgatgatggagatggacaccggcaatgtctgtttgacacgaaatgtttcatcgccaaaattatcaaatactgaattaatttgaacgctcaatctagtcttaaatcgtttttttgtttgtttgttactaaagcccaacgcgtcgttgccaccgcgcaccgtctcgtcgtagcaggtaaggtctgtatgattcaagagaaaaggcaggaaacgaggcacggagctcacagtgatcgctgggagaattcaatttacaccacccttaaataaatacgatctagacatttcatcaatataatatgccccgaaggttgagtttttatagactcacaaaaaagagaggagaaaaaaaatcaagtgagaaaacacttgccccgcaggtcgagattttagatttagctttactgatcttctatgttgcaaacgaaataaattattttggaataaagctcaccaatcacttatggaaatctctcataatttttgtttcctatgaaccttgaagaaaaaagtccatagttttcaagtctgctttcttcagcgtcacgagccattctggtgctggtccactcatgacatgacgagaggatgaatctgcatccatccaattcgaacggccgcctgaagcctgataatgtcatgaaaatgctaatcatttggcaaagtacgacgctaatcagcacttttcatgaccag

SEQ ID NO: 1320 - DNA, 1421 bp, Zea mays
gcacgagaccattacctagaacatcctaatcgaaaagctcctccctctatccacttgcaacggtcgagaggaagcggaggtccatccgctcattcccgcccgtcccgcaaccacccaccgcggccgcggtgccatggcatccgccgccggcgccgccttgtgcccatgctctttctccaccgtactctcctcctccccctcaactcccttccgtcccgcaaggacgacgcctcgcccttctctccgcccgctgccgcgccgcgccaggctaccgctgcggccgggccactcgcgagtcggatcgtgtctgcaggtactgaggtgcctcccgaaatgcgactcggggaagccggacggaggaggagatgctgggttatcgggtcggaaggcggcccggccagcgggtcagggaggacccaggcggcccgcgcagttcggcgcgtcgtcgtgcgggctcgcattcacgacggtggtgggggtgataatgctccaggcatcgcagcaggcgcttgccgccacgcagttcgctggcctgcagcctgcggacgtgctgggggatctcggggacgtcagtacaggttttgcttcagctttcctgttgatcttcttttctgagctaggggacagaacgttcttcattgcggcactgttagcagctagaagttctggagctgtcatttttctaggcacatttggagctcttgcggtaatgaccattatatctgtagttcttggtcgagcattccactatgttgatggcatcattccgttcagctttggtggtactgatttcccagttgatgacattgctgcggcatgtctcttggtttattatggggttactacattacttgatgcagcctcaggtgatgatgaaaagatcaatgaggagcaagaggagattgcagttcttggtggctctttgctgggaacattcctgtctgaaaagattatagcatacattggagggagcctattcttggcctttgctgcgattaccatagttgagatagtgacttgaaaagggagttccagcttccacaatttataaaaagtactgatcttttgtcagggcaatgaacaatcagcttgatcgtaatggtagtacattgatgtgttaccgaacatgattgtccacaggaacttcattgttcgcatgggacgtcctaggcttgcgtagagtgttttgtttctggtgatgagaatttctgcttctttatccaagaacaatgtttttgtcatcatcatgatttgtagtggaaacactgatagtcaggttggtcggaagatgggactgggaggaaaactatgaattccatgtagcttttgaacttcctcttacattatttacaagtatatgaatcagtcttttcgcaaaaaaaaaaaaaaaatttatggggaagacttccccggtttaaaat

SEQ ID NO: 1321 - DNA, 4633 bp, Zea mays
acgggaaaagaaggaaaaaaaagcctcgtccagtcgtcccagtcccgaccccttccgcctccgggactcctgcctacgtcataccatcgggcagccgaaccctcgattggccgccgccgccgtaagagagaccgacgtcctccttccactgccgagcgacacctcgaatttctctctcatcgtcatcccttctcccctttattcgcgtcgcgcatctgggagatccagccagcgtgatttgtgttatcggtagctttggatttgtttgtgacccggcgctaacccaacccatccggtggtggattcagcttcttggataccttggtggcggatgttctgctcgtagcaacttgtctcccagaatttttttgggggctagacgctacccctgccatggaatcaggcgataccaaatttgatgcatcacagtatgctttctttggcaacaatgccgtggaggaggttgaactaggtggattggatgatgatgatgatgctgcatttattgagcacgaagatgaagaaaaccctctttatgggagggataatatgttggaggagggtgtaggttcatttgctgacattgatgatcttgctggaactttctcgaagctgaccagaatagtcaatggaccaaagcaaccagtagtagttagtcatagtggatcaatttctagacaaagttctaatgcagagtgggtgcaagagtctgaacttccatattggcctacacagcctgtattggacactgatcacgggctggataaaaagaattggtggtcccaaccaccccattcagtccacttcattgactatagactgcagaggacatcgtcatccccacagcaagatgctcagcataatcctgttgaacctattcttgaagcaaagccatctcctttacatagaacatcaacgtacccacaacaagaacctcagtacagtaatactgaaccaattcctgtgcccaagtcatcattcatttcatgtcctccatctggtgcagcatctcattcttcacctagtcagccacatcatgtgaacatgccatctcctcccactgcattccagttgcatatgtcttctgcacaaaatgatctactccttccccagttccatcatggaggtacgcctccagggcctccatttggtagacagaatcatgttttaaataatggatcgatgcatggaaagggtcccaggtttatgccaggtttgatgcctcatcaattgcaatgtcccaatggactgatgccacctcagatgcagccacctcatcaacatggaatgctgccaatacaacagtccccaccacagttctcacaactacatgcacggatgattggtccccatcattccccaccacaaagcatgcagatgtttggtcctcaacatccttcttcacaagtgatgagtagatttgatgcaaactttgctatgcctgacttgagtgatccaagagcaagatcaatgttgcaacatgaaaggctgggacagcgttatcctcaccaaggttatgagctcaataatattaggatagataatggatggtcacggttcagatccaagtacatgtgtactgaagaaatcgagaacattgcaaggatgcagcaggctgccacacacatcaatgacccgtatattgatgattactaccatcaagcttgtttagcaaaaaaatcagcaggggctcaactaaagcaccacttttgtccaaccttgattagagatccatcttcacgtgcacgcagtaaggatgagccacatgcatatctacaggttgatgctcttgggaggcttccattttcttctatccgcaggcctcgtccgcttcttgatgttgaacaagcctctgcaccaagtgataatgctgaaaaatctgtgtcaaagcctcttgaccaagagcccatgcttgctgctaggatcacaattgaagacggactttgcctactgcttgatgttgatgatattgatcgtctgctgcaatttagccagcagcaagatggtggtttgcaactgagaaacagaagacaggggctcctcgagcagcttgcagaatcactgcaattagttgatctccttgcaccaaataagaattcacctgtgtctccgtatgatgatttggtgtttcttcgcatagtcactctatcaaagggccagaagctactttcccattaccttgagcttctgacatcaggcagtgagcttgcaaggatagcttgcatggcagtcttccggcatctaagatccatatttggaaatatgccctctgatatcagtgcagtggagacaatgaatagacttgcaaaagctgtatccgcacatattgttcagatggatttgagtgatctcagtgcttgccttgctgctgttgtgtgttcatcattgcaaccacctcttcgacctctgggatccccagcaggtgattgggcttctgtcatcataaagtatgtattggacagagcaacagttctactcactgatcaccatgtggcttctaactacagcatgcggaatcgatctctatggcaggcatcattcgacgccttttttgggctgcttacacagtactgcatgagtaagtttgatcgtgtggttcatactgcccaattgcaacctgctgctgcaaccgttataaccagggaaatgccagtagagcttctgcgtgccagcctccctcataccaatgaggctcaacgcaagcaattgctcagttttgctcaacgcactgtgcctgttggtacccacagttctcatgggtcttggtagtggaagcatcgagttcttattagaactgagtactcgctaaaaatggctctttaggggacctgttatgcttcccctgaaagaagagagggttaaacttgtcactagtactatgaatatcaaaaaacaagagtaaagatggttggagcatcaaaatggtaatactcaacatcaaattttgtgtcactcaaacatgtttgcatggattacttttgtagggtagtcagatgtctgcgtcaattttgtcaatacctgtgttggttattgcaaaatggttcctgtgggtctgttgctcttaagaggaatccgcaattggtctgtagcggttacttgaagacactgtttaattgctcttcaaggtggttcttttcaaggagtagttgccttggcctcaagatgtggaagttggcatagccacaacacgtcgttaagttcttcaggaacaatgcggttgctatggaagttgtaaaatggtagtattattgttttgcgacggccttttgccttttgagaactacaactgatgttgcccatttctctatgcttgatgtgcagaaagtggataaagcttgcatgcatccttactgaattgtgacatttatttggatagataggcgctcctttctttaaagcactgattttgtacggaaactctgatatagaaaatctttgggtgcctgctgaaatgatgggctaggacgatttgtaaaaaaaaaaaaaaaagtgaaatgaaacctaaactgatagatgagctgggctgacgtattacgagtatatgaattttagactcataacatataatataagtagtttaatattttcacggtcgaaattctaaccatgatagattggaccaaaagtctaagaacaaggagggaagatcattagtaaagataatatcaaactgtggactttgcttaggttcgggcacggtagtggacaaatagagagagaaagtatggcgggggacacatttcttgtgagcaaatagaattgctttacttttttaattaagttcaactttgaacttagagaaattttgtaaaaaaatataccctcccatggaagggtggttttagtttttaggctagttgagtagttttgattaaggttttattagtttattactctaaactaaatcaattatttgtaggatacttcatggaataaaacactggaataaaatattggatcctctcccctctttcttgttgcttcataagagtgaatccattttttaggacatgacttgaattgagcatggtcacctgacctgttcgaaaaaacccgaccaatgcgatgtgtgggcatgggccatagtttttgatctgcaacaatccatggatcaggtatgactatgatttttgatccaaaacccgacccaacccgaaaaaactcgatccaaagccaaaaaaactgaccctcctgaaaaaacccgaccaatgcgataggtgggcatgagcatagtttttgacccgcaacaattcatgggctaggtatgggctatgattgttgatccaaaatctgacccaacccgaaaaaacccgactgttggggacttgttctcaaatgctatgaattaagaacaaggcaacataaaatattaaatattaatgtccttcgtccgctgaagcattatctcccaagaatttaatgaacttcggacgaagaccatgagtagaatatcactaaggtcgcaccttcgtgattagacttacaaaataatacgaagtaatatataaagcatgaaacattaaagatagatatatcagaaatagataacatcattcacctattttattatgtgaatctaaaatgtcagaacataatgtttaggtacacttatacctttgacagttaataatcc

SEQ ID NO: 1322 - DNA, 1948 bp, Zea mays
atttagagagctgttggagatgagtttttaggttaactatctaaattattgatttaaggagtattttagagaactactgtagttgctctaagtaatgtagaagagaaggaatatgtcatgtcagaaattaatgtcaagaggtcacactgtaacaagtgcagacctggatggtttggcaagggaacaagggtgcctaccatagtacacctaccaattccctctaaattacacgatcttggtcgtcctcagccaaagttttcgcggccattagagctccacgtgtccacttaaccgattcaccaactccaccttcgcgctaagctccccgcctcccgctcgtccccggtggcttcatcacttcatctccctccccctattaatacagctcagcagcttcactgccatttcgcactctcgaccccaaacgcaagcacaagcaaaacacaaagaagctcaagaaagctgaggcaagcccagaagaagaaaaaaaaaactagaaggagagatgggaagaagcgaaggcagcacaagcccagcggctgggggagccgcctgcgcgtgcgcggtctgcggcggcgccgcggtggtgtactgcgcggcggacgctgcggcgctctgcagcccctgcgacaccgctgtgcacgctgcgaacctgctggcgtcgcgccacgagcgcgtgcccctttccatggtgactgctgcatccggcgtgtacgacgacgacctcttcgcgcccgacgacatcgacgcggcgtcgtcgtgggcgtcggcgcctgcgcaggggcagggaagcccccagaacgggagctcgtcggcgagcttcaccaccggcgacagcggcgcggagggcaggggcctgttcgacctgctgtccgacgtcgacttcgctgcctgtgtcacgggcggcggcggctacctgccggacggcgtggcgcccgtcgtccatcacggcgctgcacctctgtgggcgcagcccggtctggccgccgccgcatggacggccacgtggtcgcccgctgtcgtcgtcccgggcgccgccgtggtcgccgcggcggcggcggagcgggaggcgagggtgcagaggtaccgcgagaagcgcgagaggcgcaagttccagaagaccatccgctacgcgtcccgcaaggcctatgccgaggcgcggcccaggatcaagggccgctttgtcaagcgcgccgccggcacctcctcctcctcctcctcgggtgccggcacatcggacagcatcgacgctgctgccaagttctggctctccttctccgacgacgccagggacggcttcttcgtggacgccggggcctacggggtcgtgccaagcttctagaaagtttgtgccttgaaaatttaggggtcacactcgcatcacagcgggcagcgcttctgggcttctggcggtggcgttcgcccagtttgaagcaagttaagcaaccgcccttctcgtttgtgtcgtgtcgtctcgtcattcatgtgagcagcatccgtggtgaaattccgccatcgctatttttaaatgatggcgcggaatttcgatgggtcatcaccagttggtgaacgaactaggggatttattgtgtcttgtaagatacaactttactgggttgtctatcaaattctgcgttggctcatcgtcatcgctttactggggctaacaatatagttgtggtggaaatctgccatccatgcttccatagcaagctcttagatgatcggaataaaaggggattttgatgggccaatcaggaagtgggtttggttaatctatatatggagcatatagcttatgcagctgttcatccacatggtttcagtgttttgactttctatccaagttgattaattccatatatggtggtcccaataatcttatgccactaaaaaaaaaaaaaaaaaaaaaaaaaaaaaaaaaaaaaaaaaaaaaaagggcggccgc

SEQ ID NO: 1323 - DNA, 2516 bp, Zea mays
ggccggggcccccggaccctattaaaccattgggtacctcgaggccggccgggccgccgtcgtcgtctagctcccatccgacctcctgcattccccactagtcccaactcccaaccaccgccagccgtccgctctccgcaagcgcgaccttccggccagatccgccccgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtgggacgccatcagtgctctgtctggggttcggtctgttcttcggctgcagatctggaagggtttcgtgggatccgtcgctacgatctgtcccagtcagagcacctgcatcatctcgggtcgggccatggagactctgctcatctcggaggagcgcaaccaccagctccaccacttctcgggtcgccggaagaaggcgttagcagcgtcgcctcagtccacgcgcagctaccatgcgggcaactgccgggcgttccactccggcatcaccgtcggcatcctgccgtccccgcccgcgcagagggttgcactgacccgctcctctcctgagcccaagacaccgaaacatcagcttcaccatgggaaaaagcgcagccgagcaatctctataaacctttcgacgtcccctccctctcgccctgagctctgggctggcccggggttctgcaattcgccgcctcccagctccctcccgatccccaagttctcactccaccagaagcgcagtgtctcacttgaatttccacctgctgaccggtcagacgacgaagaggtgcccgtgcatgccaagtcggcaccttcatcgccgactgcaggctcaggtgttaccttcttcagtggtactgatgctaccattgccaccgagaatctgaggaggatccttaacctcaaaattgaggataactgaatggcggttgggtagttctgtgtacatagtttaactacaactgacctttgtagtatgtatagggtaaccggggataaccactgtgtacctggcggtggttccttctgcagcagtactgtaggcggttagcaagcacagcgaggagtttaggaagtttggaaatgcagtgagaaggatgttgtggtaatggagatttggtggatttgcatatcactgcagtttcagagtcacctttgttccttgtaccttgtagttgcctattagtagtccaatactccatttagatgttatagtatttgcatcttccctgcccatcattaaccagtagccacagccttcatatcataatccttgtcatgtagttcatctcaggcagggcattgtaggctagctagtactgttcaagttctgtcatatatgtagtcttctgtaggattgctgcatcccttgaaacttgcattctgtatcacattgcatcctgctgactcacctcccttcataacatctccctgtgttatgcaaagcgcacaaggatctcccctctggcacttctgttttttggaatgaagatgctcagaggagttgttatgaagtcccgatccaatgttctttgtcctccatgtctgtactgactttagctatgcatctcctttgtcaccccagtcccattgcatgtgccatccaatccgtttcgaaccattcatctcaaaattgcatttagtggtggttttcccttcgtcttattatcttttgtgcctcatgatcctggagcatgcccaggattctagtctcctccatgtattctcataaaggacttcacgtatcagagatctgcgaatgctcaaccctgaatatggtttgcttgtccgatgccacttcgcctcatccatacctggagttcagaattggcgaagcacctatcacttagctatctgtttcatagtcagtattgtgtcagactgttgtttttgtgcaatatttgattggctactagtctgtttgtgttactgttcaagtttatggtagtgatcatatatggcggccggagtgttccacgccgatgctgtggcattctgttgctttcaagtaaaactagtcaatgttatgtaccttcatgttattttttggtcctgtttctgtgacatgtttgaagttccatgttatcgcactgtatttgctcccaagatcttttttgtttggtccgcttttctagtggtcctaatcatcgtgtgacaaatggttgttactatacttaagggtctcctttttaaggataaatatcaacgttccgaattgcgatgcttggtggcccctgcatactttgtgcggggaagatggctatggttggtacttgttgagatgattgtggagcctgtttgagaacctgtagttgattagtgttgtggagataaaaataccaatatgcttgtcagtaactcaacatctgttgctttgttcttttcactgaaaggggctgcagttgattcctcctgtgccgac

SEQ ID NO: 1324 - DNA, 1377 bp, Zea mays
cccacgcgtccggattcctgtaatggaaaccatgttcgatgcggattcagaaccaaaaaatcgtaagcttcaagaatttgacactaaggcaaatagaaacatgggaatgattgacgaagaatcagatgatgacgatgattatcaagttcctgaagctaatatagaggaagacgtgaacaaatctcatcatgatatcaagcgcacagatgagcctacagaaaaaattgatttatcttgttttttgagtattcttcatcgtgatcccgaggagaaaagtcgcaattgttggacagtacctgatagcaagatcttcaaagttcgtagcaaaaacttcccacaagacaaatcaaagatacctgcagcaagttatctcatggagcttgcagccattgactggtttaaggacaccaaacgtatggataatgttgccaggcagaagggttgtgttgctcaggttgctgctgatcgagggatgcatacatttgttgtcaacatacaaattcctggatcaactcagtacagcttggtcatgtattttgtcacaaataccttgagaaagggatccttactacaacgcttttttgatggcgatgacgaattccgcaatagcagactaaagcttataccatccgtccctaagggctcctggatagtgcgacagagtgttggaagcaccccttgtttgttgggaaaggctgttgattgtagttatgttcgaggtcctgcgtacttggaggtggacgttgacattgggtcttcggcggtagcaaatggagttttgggtattgtgtttggtgtggtgacgacgttagtagttgatatggccttcctaatacaggccaacacatacgaggagctaccagagcaggtgataggcgcagctcggttggctcatgttgaaccggccacagcagtagttcctgatcttagcaacacatcaaacgacagtagcaacagcaacaatgacaacaacaacaacaacaacaacaatgggtcctcagaggatgatttgtccaagaaaacaaactaattttattttaatctagtatcagagtgttgtgttgaacatctctttaattaatcttctagctagtcactcagtggaatccagagagccaataatatatgcttctctttgtaccagctttcttgtttatatattagatccaagtattatatttgtagctagaggcaccaatatgaatagtaaccgtggttatcctcaacttgtttgccgactaggaccgggagatggtttgtttgttttaagcttttactttttacaagacatgcctatctttattttccctttgcctttatctttgaactgctgctactcaagttgacaaggaaagcatgcatgcagtttggattagc

SEQ ID NO: 1325 - DNA, 3765 bp, Zea mays
aaaaatagatatatcatagaggattagctaaagacaccagattacagaattacgacgccactgacgtagatggacggacggagccgttacttaacggcgccatgtcctccaaggctctgagcccagtatttagccgcttcggacggggtgggagagagagaagggaaagcattctccaatatccacctcctcctcgcccccctctctctctctaaaagaactgaaaagataagggggaaatcctcaagtgctcgttacataaaccctaacctcgttggattcgcagcaaaagcccaccaattggaagccctccgatgttccagctgcatgctggagctgagccgtgctcggtttgacgaaattttgcatcccttctgtgcttggaccacccgattgaggctgtttctccgagggggcgtgccagcggtttcgcggcccaggtcctcacctgtgctatccggcgccggatccgggtttgttccggtgagaggtcgggcttttggtggggtctgtacagcttggagctcaatttgccggcctgagttggagtcgcgactgcggtggcggtgattgaggtagtcgcgtcgatttggcacgcgttctcgatctgagtgaggttcttgttgatttattatagcacttctgagtctctgacgcatgcggccatgcaggtttgcttaaccgcatgccatttctgtgattctgtcatttttctctgctcgctcatccgtgttcgtacttcttaccaccgatgttcgttctctcttcaggtagtcgcgtcgatttgacacgcgtttcttcctgccatttgggtgagccagcctttcctggcaatcttggcgggcgtttcgtcttgctgcgtggcagaaaggtgtgacctttgtgccgtgcgatgcatcccaaggcacgaatccacgccgacccggtgcgcgaggtcgaccactttgactgcctgccggattcgctcgtcctgctgatcctgaacaaggtcgaggacgtgcgatcgctcggccggtgctacgccgtgtccaagcggctttgtgggcttgtcccccttgtccatgatgtgtatgtcaagattgaccgcgtcgtggcggtcgacggcgacgctgaggacgcgctcaacctgtcatcgccgaagcctcggaacatcttctcgcacttcctgaagctgatgctcttcaccatcatcaagcctttccacaacatgcgcaaccctaatggtactgggaggtcattgttcccgcagctctcgcaccactcgccagcgcaggtgctcaggaacttcacgcacatcaggaatcttcggatcgagctcccttctggggatgtgggtactgaggagggagttctcctgaaatggcgagcagagtatgggagcacacttcagagttgtgtgatcctggggggtacccgggttgaccgcaagcctgttggtggagagcatgagcagtctttggaggataatggaagcatgccagagtctttctataccaatggtgggctgaaacttcgtgtcgtctggacaatcagctctctaattgcggcatcaacgaggcactatcttctccgctcaatcatcaatgaccattccacacttctgagcttggtactgacagatgccgatggccaaggcacattgtgcatgggagcagagcagctgaaggagttcagagagaaccagttgtcggcctcagcatgttccaacaggactcaggtcccagcctgcaacatgaagctcaagtatgctccatatcttgaactgcctggtggtatggcgttgcaaggcgccactttggtggctatcaaaccctcacctgacggaagcaatggaagccaccctaaccgtaaagaagccgacgcatttgtctttggagcatttgatgggccatttaaggctgctgtgaaggctttgatgaagaggcgcacttaccttctggagatgaatggcttctagaaatcttgtggtatcgagcttgttggtgctatgcatggcatatttagctaagcttttcatctttgtaatatccaagaaagcaccatctctagttgctgcttttagtctgctgttttagctctttgtacagtgttaacatttgattatataaaaatcgtatcaagttctctagtgtaatagcgaatcgctccatagttcaccatcctggcccctggtgtaatatccaagaaatcatatcagtttcgtaggtgtaagttgaaagtagccttggaaaaggagagccagtttatgccttcaggtacataacattcattttgggattgtgaaatgaaagagactgatctgatgccgacaattcctggagtccagtttgtgattggttttgattcttgtgtttcttagaatgtttctaataattaaggattgcaggttacagttatgaccatgaccttgtgaggctgctttcctgtagttgacttcgcaaatgggttatctctatcctactgctagtaaaatagcttgagattccaaatgtagttatcatcggtcaatgatctctatcctcgatgttaatgacatgttaaagacttcattccaataaattagtttttttattgtggggatccaataaaatagtttgttaatatcattgacatgcgatttggatcacgatctagttcattaagacgcatcgataatttcgcaattggaatttcttactgaaatgctttagagggcgtccacttctcttatgtctcatccattcttataagattacacaattatcttttcatgaacaatcgcctttaagatctttggaagggtcactaataagcttgcccagtaaggaattctgttactctgcattttctagtagcagaatttagctggcatgagtactttcttgaggtaacctagtcacgggttttggaaatatttcaatagagcatgtctggagtgcaggttccttgaaaagaaatcgaatcctacatcaacgcgtgaagttatcaagttgcaaatattttgcttgatgggaatattctgttgctaatactggtcgacatgtatggattaagaactactttattttaaatacaagatggacaactaatgcatgatctcatatggctacagtatggcatggtttctttcattgctactatcttcacttctttagagtgtttttcctgccgatctgtgagcttccggtgggcaaaaaaactgctcctcaggtggaactggttttgttagcctgattgcatcaccttgcagatttctttttgtagggtagcctacctaaagaaagggtttccaaaggtttagcttctcaggactgaagtggtgatttccagaagccctgacctaaaagacacacccttaatgctcatttgtttctatcctattgccttgctatcctacgttagtctgggatgtcacttggtaaggcagtggggaattctgcagaccgattttttggcagattaggttggttttactctcctgaggaaccttttctggggttgtgcgctgaacactgatgttaaaatcatagccacttgcagtgaaatctgtacgggatggatgatatcggttgacccgcataatagtgcaggctcatgtgcagaccagtcaatcaaaaaacacttctgacaagtacatgacacacacacacactccatctaagctgcttctgtttgatcatatccactcagcctcttcatatcaaaatatatgataattgcatccgagcgcagctgagcagagctaatccgatcaaagtcagtactattttatttatcttatccaag

SEQ ID NO: 1326 - DNA, 2142 bp, Zea mays
ttgggtacctcgaggccggccgggaagggaaaagcattccaacgctgcatctgcactgcacggtacctcctcctcctcatcctcctctatctctaagaatttaaaagagaagaagggggaagtcctcgactgctcgttccataaaccctaacctcgttggattcgcggcaaaaatcctcccaattcggaaccctccgatgttccagctacctgcgggagctgagccgtgctcggtttggcgaaattttgcacccctcttgtgctaggaccacccggttcaagctgttcctcggaaggatcaggtcttcaccggtgctctccggcgccggatccaggtttgttccggcgagaggtcgggctcttggtgggggccagcccagcttcgagctcaatttgccggcctgagatggaatcgcgactgcggtgccggtgccggtggctcagctagtcgcgtcgagtcgacgcgcgattcctgccatttgggtgggccagcctttcctggcaatctcggggggcgtttcgcctcgctgcgtggcagaaaggtgtgacgtgtgatgcatcccaaggctcgaatccacgccgacccggtgcgcgaggtcgaccacttcgactgcctgccggattcgctcgtcctgctcatcctgaacaaggtcgaggacgtgcggtcgctcggccggtgctacgccgtgtccaagcggctctgtgggctcgtttccctcgtccatgatgtgtatgtcaagattgaccgcgtcgttgcggtcgacggcgacgccgagggcacgctcaacctgtcctcgccgaagcctcggagcatcttctcgcacttcctgaagctgatgctcttcacaatcatcaagccgttccacaacatgcgcagccctaatggtactgcgaggccattgttcccgcagctctcgcagcactcaccggcacaggtgctcaggaacttcacgcacgtcaggaaccttcggatcgagctcccctctggggatgtgggtactgaggagggagttctcctgaaatggcgagcagagtatgggagcacacttgagaattgtgtgatcctggggggtacccgggttgaccgcaagcctgttggtggagagcatgagccagctttggaggacaatggaagcatgccagagtctttctataccaatggtgggctgaaacttcgtgtcgtctggacaatcagctctctaatcgcggcatcaacaaggcactatcttctccgctcaatcatcaatggccatcccacactacagagcttggtactgacagatgctgatggccaaggcacattgtgcatgggggcaaagcagctggaggagttcagagagaaccagttgtcgacctcggcatgttccaacaggactcaggtcccagcctgcaacatgaagctcaagtatgctccatatgttgaactgcctggtggtatggcgttgcaaggcgctactttggtggctatcaaaccctcacctgagggaagcaatggaagccaccctaaccgcaaggaagccgaaggattcgtctttggagcattcgatgggccatttaaagctgctgtgaaggcgctgatgaagagacgcacttaccttctggagatgaatggcttctaggaatcttggtatctagcttgttggtgctatgcatggtacatttagctgagtgtctcatatgtgtaatattcaagaaggcaccatctctagttttgatgcttgctgtctgctgttttagctatttgtacagtgttaacatttggttagataaagatcatatcaagtcctctagcgcaatagtgaatctctctacagttcactattctggcccatgatgtcctgtgtgatatggaagactgaagcatcctactgttaactcttttcaagtgaaacagccttgtgaccatctaatgtgtcagcactgggattgagatattcagatgctctcaccagtggacacaagttattatatatataatgtacatttttctcctctttcagtttcatgcacaaagtctcgaaaatttttctcctctttcagtggaagttgaaggtaaccttggaaaaggagccagattatgccttcatgcacatgtcattcatttttggattgtgaaatgaaaaaggctcatctgatgctgac

SEQ ID NO: 1327 - DNA, 1978 bp, Zea mays
  misc_feature (1961)..(1961): n is a, c, g, or t
gcacgagaccattacctagaacatcctaatcggagaagggaaagcattctccaatatccacctcctcctcgcccccctctctctctctaaaagaactgaaaagataagggggaaatcctcaagtgctcgttacataaaccctaacctcgttggattcgcagcaaaagcccaccaattggaagccctccgatgttccagctgcatgctggagctgagccgtgctcggtttgacgaaattttgcatcccttctgtgcttggaccacccgattgaggctgtttctccgagggggcgtgccagcggtttcgcggcccaggtcctcacctgtgctatccggcgccggatccgggtttgttccggtgagaggtcgggcttttggtggggtctgtacagcttggagctcaatttgccggcctgagttggagtcgcgactgcggtggcggtgattgaggtagtcgcgtcgatttggcacgcgtttcctgccatttgggtgagccagcctttcctggcaatcttggcgggcgtttcgtcttgctgcgtggcagaaaggtgtgacctttgtgccgtgcgatgcatcccaaggcacgaatccacgccgacccagtgcgcgaggtcgaccactttgactgcctgccggattcgctcgtcctgctgatcctgaacaaggtcgaggacgtgcgatcgctcggccggtgctacgccgtgtccaagcggctttgtgggcttgtcccccttgtccatgatgtgtatgtcaagattgaccgcgtcgtggcggtcgacggcgacgctgaggacgcgctcaacctgtcatcgccgaagcctcggaacatcttctcgcacttcctgaagctgatgctcttcaccatcatcaagcctttccacaacatgcgcaaccctaatggtactgggaggtcattgttcccgcagctctcgcaccactcgccagcgcaggtgctcaggaacttcacgcacatcaggaatcttcggatcgagctcccctctggggatgtgggtactgaggagggagttctcctgaaatggcgggcagagtatgggagcacacttcagagttgtgtgatcctggggggtacccgggttgaccgcaagcctgttggtggagagcatgagcagtctttggaggataatggaagcatgccagagtctttctataccaacggtgggctgaaacttcgtgtcgtctggacaatcagctctctaattgcggcatcaacgaggcactatcttctccgctcaatcatcaatgaccatcccacacttctgagcttggtactgacagatgccgatggccaaggcacattgtgcatgggggcagagcagctgaaggaattcagagagaaccagttgtcggcatcagcatgttccaacaggactcaggtcccagcctgcaacatgaagctcaagtatgctccatatcttgaactgcctggtggtatggcgttgcaaggcgccactttggtggctatcaaaccctcacctgacggaagcaatggaagccaccctaaccgtaaagaagctgacgcatttgtctttggagcatttgatgggccatttaaggctgctgtgaaggctttgatgaagaggcgcacttaccttctggagatgaatggcttctagaaatcttgtgttcgcggtggtatcgagcttgttggtgctatgcatggcacatttagctaagcttttcacctgtgtaatatccaagaaggcaccatctctagttgctgcttttagtctgctgttttagctctttgtacagtgttaacatttggttatataaaaatcgtatcaagttctctagtgtaatagtgaatctctccatagttcaccatcctggcccctggtgtaatatccaagaaatcatatcaggtacataacattcattttgggattgtgaattgaaagagactgatctgatgccgacaaaaaaaaaaaaaaaaaaaaaangaaaaaaaaaaaaaaaa

SEQ ID NO: 1328 - DNA, 1819 bp, Zea mays
aaaggaaaaagcattccaacgctgcatctgcactgcacggtacctcctcctccgcatcctcctctatctctaagaatttaaaagagaaggaggaggaaagtcctcgactgttcgttccataaaccctaacctcgttggattcgcggcaaaaatcatcctaattcggaaccctccgatgttccagctacctgcgggagctgaaccgtgctcggtttggcgaaattttgcacccctcttgtgctaggaggaccacccggttcaagctgttcctcggaaggatcaggtcttcaccggtgctctccggcgccggatccaggtttgttccggcgagaggtcgggctcttggtgggggccagcccagcttcgggcccactttgccggcctgagatggaatcgcgactgcggtgccggtgctgcactgcacggtagtcgcgtcgagtcgacgcgcgattcctgccatttgggtgggccagcctttcctggcaatctcggggggcgtttcgcctcgctgcgtggcagaaaggtgtgacgtgtgatgcatcccaaggctcgaatccacgccgacccggtgcgcgaggtcgaccacttcgactgcctgccggattcgctcgtcctgctcatcctgaacaaggtcgaggacgtgcggtcgctcggccggtgctacgccgtgtccaagcggctctgtgggctcgtttccctcgtccatgatgtgtatgtcaagattgaccgcgtcgttgcggtcgacggcgacgccgagggcacgctcaacctgtcctcgccgaagcctcggagcatcttctcgcacttcctgaggctgatgctcttcacaatcatcaagccgttccacaacatgcgcagccctaatggtactgcgaggccattgttcccgcagctctcgcagcactcaccggcacaggtgctcaggaacttcacgcacgtcaggaaccttcggatcgagctcccctctggggatgtgggtactgaggagggagttctcctgaaatggcgagcagagtatgggagcacacttgagaattgtgtgatcctggggggtacccgggttgaccgcaagcctgttggtggagagcatgagccagctttggaggacaatggaagcatgccagagtctttctataccaatggtgggctgaaacttcgtgtcgtctggacaatcagctctctaatcgcggcatcaacaaggcactatcttctccgctcaatcatcaatggccatcccacactacagagcttggtactgacagatgctgatggccaaggcacattgtgcatgggggcaaagcagctggaggagttcagagagaaccagttgtcggcctcggcatgttccaacaggactcaggtcccagcctgcaacatgaagctcaagtacgctccatatgttgaactgcctggtggtatggcgttgcaaggcgctactttggtggctatcaaaccctcacctgagggaagcaatggaagccaccctaaccgcaaggaagccgaaggattcgtctttggagcattcgatgggccatttaaagctgctgtgaagacgctgatgaagagacgcacttaccttctggagatgaatggcttctaggaatcttgtccatcttggtatcgagcttgttggtgctatgcatggtacatttagctgagtgtctcatctgtgtaatattcaagaaggcaccatctctagttgatgcttgctgtctgctgttttagctctttgtacagtgttaacatttggttatataaagatcatatcaagtcctctagtgtaatagtgaatcttatctctctacagttcaccttcaaa

SEQ ID NO: 1329 - DNA, 1893 bp, Zea mays
cgaggccggccgggccgggagtccagtattaaaagctccctcgggcccggccgggccgggaaggaaaaagcattccaacgctgcatctgcactgcacggtacctcatcctcctctatctctaagaatttaaaagagaaggaggaggaaagtcctcgactgctcgttccataaaccctaacctcgttggattctcggcaaaaatcctcccaattcggaaccctccgatgttccagctacctgcgggagctgagccgtgctcggtttggcgaaattttgcacccctcttgtgctaggaccacccggttcaagctgttcctcgctcctcggaaggatcaggtcttcaccggtgctctccggcgccggatccaggtttgtttcggcgagaggtcgggctcttggcgggggccagcccagcttcgagctcaatttgccggcctgagatggaatcgcgactgcggtgccggtgccggtggctcagctagtcgcgtcgagtcgacgcgcgattcctgccatttgggtgggccagcctttcctggcaatctcggggggcgtttcgcctcgctgcgtggcagaaaggtgtgacgtgtgatgcatcccaaggcacgaatccacgccgacccggtgcgcgaggtcgaccacttcgactgcctgccggattcgctcgtcctgctcatcctgaacaaggtcgaggacgtgcggtcgctcggccggtgctacgccgtgtccaagcggctctgtgggctcgtttccctcgtccatgatgtgtatgtcaagattgaccgcgtcgttgcggtcgacggcgacgccgagggcacgctcaacctgtcctcgccgaagcctcggagcatcttctcgcacttcctgaagctgatgctcttcacaatcatcaagccgttccacaacatgcgcagccctaatggtactgcgaggccattgttcccgcagctctcgcagcactcaccggcacaggtgctcaggaacttcacgcacgtcaggaaccttcggatcgagctcccctctggggatgtgggtactgaggagggagttctcctgaaatggcgagcagagtatgggagcacacttgagaattgtgtgatcctggggggtacccgggttgaccgcaagcctgttggtggagagcatgagccagctttggaggacaatggaagcatgccagagtctttctataccaatggtgggctgagacttcgtgtcgtctggacaatcagctctctaatcgcggcatcaacaaggcactatcttctccgctcaatcatcaatggccatcccacactacagagcttggtactgacagatgctgatggccaaggcacattgtgcatgggggcaaagcagctggaggagttcagagagaaccagttgtcgacctcggcatgttccaacaggactcaggtcccagcctgcaacatgaagctcaagtatgctccatatgttgaactgcctggtggtatggcgttgcaaggcgctactttggtggctatcaaaccctcacctgagggaagcaatggaagccaccctaaccgcaaggaagccgaaggattcgtctttggagcattcgatgggccatttaaagctgctgtgaaggcgctgatgaagagacgcacttaccttctggagatgaatggcttctaggaatcttggtatctagcttgttggtgctatgcatggtacatttagctgagtgtctcatatgtgtaatattcaagaaggcaccatctctagttttgatgcttgctgtctgctgttttagctatttgtacagtgttaacatttggttagataaagatcatatcaagtcctctagcgcaatagtgaatctctctacagttcaccgaaaaaaaaaaaaaaaaggcccctagggccctcgagct

SEQ ID NO: 1330 - DNA, 1812 bp, Zea mays
gcacgagaccattacctagaacatcctaatcaaaaaaccaaccaacgcaccagccacaagtgacaagtccaatcaccaacaggccgcgtgcgggcagcggccggccactgcaccatgtcgtccagcagggaggtgatggtgctcagcgacagcgaggtgcagtccgccccgccaacgccgcgaccaccgccgccggtgtcggccccgccatcgcagatacactcaccgtcgcccgcccgctcgccgctcgccagcccggtcaggaaggcggtggcgggcgtcaaggcgggctgcctggaggaggaggtgggcggccacgtcacgcggctcgcggacccgcgcgacgcctggctgcccgtcaccgagtccaggagcggcaacgcctactacgccgcgttccacagcctcagctccggcatcgggttccaggcgctcgtgctccccacggccttcgcctccctcggatggacgtgggcgatcatctgcctgacgctggcgttcgggtggcagctctacacgctgtggctgctcgtcaggctccacgagcctgtcgcgggcgccacccgctacagccggtacatgcacctcgccaccaccgtgcttcggcgacagatgggccaatatcctggcgctgctcccggtgacgtacctgtcggcggggatctgcacggcgctcatcatcgtcggcggcggcagcatgaagatgctgttcggcatcgcgtacggcgggtcgtgcctggcgcggccgctcaccgccgtggagtggtacctcgtcttcgtgtgcgcggccgtggtgctgtcccagctccccaacctcaactccatcgccggcgtgtctctggtggccgccgtcgccgccgtcgcctactgcaccatgatctgggccgtgtccgtggccaggggtagggtagccggcgtctcctacgaccccgtccacaaggcccccgacgacgtggacgccgcactcggcgtcctgaatggccttggcatcattgccttcgccttcaggggccacaatgtggtgctggagatccagggcacgatgccgtcgactctgaaacacccgtctcatgtgcccatgtggaagggcgttaaggtagcatacgccatcattgcgctctgcctgtaccccatcgccatcggtggcttttgggcatacggcaaccagatacctcccaatggcatcctgagcgccctgtacaagttccacagccgcgacgcgtccaggcttgtgctgggggtcaccacactgctggtcatcatcaactgcctgaccacgttccagatctacgccatgccggtgtacgacaacatggaggccgggtacgtgcacaagaagaaccggccgtgcccgtgtggatgcgctcgggcttccgcgccttcttcggcgcggtcaacctcctcgtcgccgtcgcgatgccgttcctgtcggagctcgccggcctcttcggagggatctcgctgccggtcaccctggcctacccgtgcttcatgtgggtggcgatcaagaagccgcggaagggcaccgccacgtggaacgtcaactgggcgctgggaatccttggcatgaggcataaggccttgtcctcatagtcgggaacctgtggggtctcgtggagaaaggcatgcgtgtcaagttcttcaagcctgccgatttccagtgataaaaagatgcagatttgtcactcagttggattcgtaatcgtaatgcaatgcttttagatatgttgatttcttcctcaggaatgtataatgttgtgtacatattagcaatttgcaagaagcaacgtcgtctgaaaaaaaaaaaaaaaa

SEQ ID NO: 1331 - DNA, 1855 bp, Zea mays
gccggccggtccgggaccaacgagccacccatggtttcgtatcaggaaaagctttctttatatatattcgggcattgcgttatcgtgtagctttgcagaacagagaaggagaagggggagctgtaatcctacctaagaagcggcgatggggcggtcaggaggcggcgacggggacggcgacggcgaccggctcctcctcggcaagcccttggagtcgtcgtcgtcgtgcagctcgtccgacgagagcctggtcaagagaaccggcacggtatggacggcgatggcgcacatcatcacggcggtgatcgggtccggcgtgctgtccctggcgtggagcgtggcgcagctggggtgggtgggcgggcctgcggcgatggtgttcttcgccggcgtcaccgcggtgcagtccaccctcatcgccgactgctacatctgccaccacccggagcgaggaggcgtcgtcaggaaccgctcctacgtcgacgccgtgcgcatctacctgggcgacaagagccatttgttttgcggcttcttcctcaacctgagcttgtttggcaccggtgtggtgtacacgctcacttccgccactagcatgagggcgatccggaaggccaattgctaccacagggaaggccacgacgcgccgtgctcggtgggaggagacggctactacatgctgctcttcggcctcgcgcaggtgctgctgtcgcagatacccaacttccacgagatggcggggctctccatcttcgccgccgtcatgtcctgcttctacgccttcgtcggcgtcggcctcggcgtcgccaaagtcatcgcaaacggggtgatcatgggcggcatcggaggcatcccgctggtgtccacgacgcagaaggtgtggcgagtctcgcaggccctcggggacatcttgttcgcctaccctttctcgttggtgctgctggaaatagaggacacgctgaggtcgccgccgccggagagcgagacgatgaaaaaggcgacgagagcgagcatcgctatcaccaccctcttctacctctgctgcgggtgctttggctacgcgtcgttcggcgacggcaccccgggcaacctcctcaccggcttcggcttctacgagccctactggctcatcgacctcgccaacctcgccatcgttctccacctcctcggcggctaccaggtgtacacgcagccggtgttcgcgttcgcggaccgcaagttcggcggcggggccacgatcgtcgaggcgccgctgctgccggtgccgggcgcgcgccgcgtgaacgtgttcaggttgtgcttccgcacggcgtacgtggcggcgaccacggcgatggccgtctggttcccctacttcaaccagatcatcgggctgctcggctccttcaccttctggccgctcgccgtctacttccccgtcgagatgtacctcacgaggaacaaggtggcgccgtggaccaaccagtggctcgccatccatgcgttcagcctcgtctgcctgctcatcagcgcgttcgcctccgtcggctctgcggttggcgtgttcgggtcggagacgagctgattcaaactctgcaaatgcaattgccggccacttttcggacatgcatgttctgtgcatatactgcgcttgtacatttagcgttatacctagtactgggacggtcaggccgggccccgagcctcgtgcttaggctcaaacgggtctgggcccagaaggtccaaatttttttggatcataccgtgtcagcctaaagagtagaaatagtggtttagccaggctctaaaacacttcctatctttgttgggccatgccgacccatatatttaaattatataaaattcaaatattacaacg

SEQ ID NO: 1332 - DNA, 731 bp, Zea mays
ggtacccccgggtccggccgggacgggataacgggaggacgacatcacacagccatcgccggccggaagctctcagctctgagcagaaggaggcgggtcgtcacaccacacggtcacacccgtcagcatgagcgaccgcaggtacgggtactcgtacccgccgccccaggggtactacaacaacggaccgccggtgatggcgccgccgccgtaccagtacgcagctcctccaccgccgaggagggagccgagcttccttgaaggatgtctcgccgctctgtgctgctgctgcctcatagacgagtgctgctgcgacccgtcggtcatattcgtgagctgatccggccgcagtccgcagcacatgcatgccaccgtcccagcccaagagacatgtcgcatgcatccgtgtgtcggtgtgtgttcgcatgcacttcgcgcctctgttggtgatagatgatgtttttttttccagcctatatgtgtgtacgttgaagtacaagcggtgagttgtgcattcagatatcggggttagagacttagaaagttgttggacatggcccgatccagaattccagatgctgattatggatccggcgcatgtttactgcatatgcacttgtttaagcgcaacgcgacaggatgtatatgtgtgtgtacgaaatcgttgaataacgaaggcaacagacactaatagtaagtttggtttgaaaaaaaaaaaaaaaaaagcggcc

SEQ ID NO: 1333 - DNA, 3685 bp, Zea mays
ctgatgatgtatgcatctttgagattttgttgcacttgtagactgacagtaagagatagagcaccaggttttgtccacttgtaccactgtcataatatttgtgtttcttttatgcttatccaataaacaaaggagaagagaagcaatcttatctcacggttgagtgtccatgcgtaacttgacttggaaatctgattctgaagacggcggattagtctagtttgctatggaagcacagagctgcatggtcagctggatggattatgactgagctggccttcaatacctttcctggatcagtgactcatcatcatacaataaatatatatacatgcaatgcaattaaatatatatacactgcaggcagagtagctacgctgctcttgacttgtaccgttcgttgttgttacatactacatactacgtatttcactggctagaaacaagctaagaataccgtaccctacgtactggctactgatacataaacaagtacctgaatggttggagagcatatgacagcgcaccaacttcgtagtatatactgtataagataaacaacctgcatctgcacacattttaaatttcagaccacaaacgaaacagatgtgataactcaaggaccagggtgcgggcgtcggctggcgaaggcgcggcggacggtggcggcgatgatcatccttttcctatatgtatgaaatgaagggatacaaccaattacgcttacctacaatcgaactaatcaatcaaacattatattattttctttactttcttgctttaggagtagcagtaatttaaacttagaattattcttcctcgacctatttcttcttctctaagcgactatacgatatctagggacgttctaaatggcctgccgttcccggagcatctcttagaactcttttcccgacggggtctctcccgagaggtgtgaaaagtctgagccctgcgcacggaccgtttggtgtgacgtagagatgagacactcctatagcgagatcgcagaccattcggccccacacagcaaatcatccacgcttccgctgagagtaccgccaggaggtacatctctagtgtttggcttcgaatgggagtcaacaaagggtttaagaggtgtttcgatgcattggagctaacagttagctgttaaaattagctgaagataacgaaacattctagcaaatagttcagctattagctaattttagcgaattatctactcgttagctatctatttgttaactgactaattccatagcaattttttttagctaacttaatattaccctagtcataaaataaatagtaaataaactctggaagccaaatttgaacagacatggcaagggaagcaagcaaagcatgcgacgtggcaggcccctatgtttgtctggtgggcaggcctgcagggcagtgctgtctgtcgcctaccccgcatacagtacatggacacttggaaaaggagagcgctgtcagtgcgggtacatgtacccctcatgcacacctatcctcctccctagctagtccctaccttgctactactactacactagtagatgctgatgcagatttcatccatctcacattagatgtgtttgatttggtgttactactttaatcatagtagttgtactagcagctacatcatcaaaattgtcataaaactaataaatacctattaaaaatacaaaaaaatactttactattttatagactaatatattaagtaaatgcagcaactcaatgaccaataataaaatatgtgaagctgaaacaaatcactatcaatttaatttaatttattttagaagagaacagtattggtaagttaactatccatacaagtccagataaacttggtagcagagtcaaataaaaaccgagtttctctgtgattggccggggagttgcttcttcaaggagctcacgctactactacttccctactgtgggacccacccagcaaaaaaaattgtgggccgcacgagggaaccgccggcagtaagtattatctggcccctgccttgatcttcagtgaaggggcgccgtgtggtctcttccgttatccatactactaactctaaccattcacgtattggtgagatggttggttagttaacaggaccacgagacgagagcacaaaggatcctacagctaactaccacttcccctgtccctacttccagcgcgaaggctgctgcttgcaagctacctctcctccccttgacacatcatcatggtggtcatctcaattttcagctttccttctgacgattgtacccctgtctcattcacagggccaggccagctcgccgtgggggcatctccgtcattctgctgctaccccagggtggctttcctgccagcccattcactctcgtggcaccgtgcctctgcctggtgatcacaactccacgtcacacacctcacagagctgcaacagcggctgccgccacccccgcccggccttcctgtcatgtatgtatgcatccctctgcttggtttcttgcctgttcattcatcatcgccctgctggtggttttccattcatcatcgatcttcctgcgtctctgaactttttctgctgtgtctgttggccgggagcagaggttgctacacgtatatattctgaagaagagatcgagatgaccagcgtgtggaagaccaaggttctgcctggcctcaacaagatctttgacaaggatggcaagaaggctgcagctgcaggcttcttgaagtccttcaacaaggaggagattgacaaggagattgaggacaagaagacagagctggagcccaaggtcgtggaggcctacgaagcatctcctcctgaggtcaaggctctgttcaaggataagaagccagtcaaggtcagcaagaagaactcggctgcagtcaccaagttcctcgatgagctggctaagattgacttccctggagccaaggtggtgagcgaggcggtggccaagtccggcacctcgcccctgcttccggcgatcaccttcatcttggacaaggtcgcaccgtttatccccaaggaggagcccaaggcggagccggcggcggaggccacctcccgggaagtcgccgtggaggagaagaaggaggaggccgagccagctgcagcgacggaggcggcaccggcgccggcagagacaccgtcggaggcggcggtggtagaggagaagaaggaagaagagaagaaggaagaggaggataagccggctgccgaagaggcggcgccgccagcagaagcagcagctgctgctgaggagaagtgatcctgttgacggatcgagcatgcaaagctctccctcctcgctcccttgcttgcttgcttgcttgctgctggtaaattaaattaagttgccgtgatacttaagcgtagccgcacggagtgaaaagttattaagtaaaagcagacaaacacttggcatgcatggacattaatttgttattctttgtaccgtcgtcgtctcgatgaaccgcgtgtacatttgtagtgtggggttttctttgttttcgatttgggggtggtcattacaagaatgtgtaattatttatgttcatatgtatgtttgttgatgatggacggacatatttaagaagacaactcttttgtgtatatatatttcttgttattttcaaaggattaaagtggataatcccattgttatt

SEQ ID NO: 1334 - DNA, 2839 bp, Zea mays
cagcctcctctcctgttctcctgtctggccacgacaaccccggttcgtcttcatcgtcctcccagctcgttctgtgatctcgccggctccaatgacatgccttccataatcttccttctgacagttgtacccctgggccattcattatatattgctctcatggcaccgtggctcctgcactgcagctgcatcaccatcattcataggctgccttcctgcctgctgatctcgcacctcaaacccacacacagcagcatgtatgtatgcatccttgcctggtcgtttctcttccacccttcgtttccctgcagcatgctggctctccattactcatctcctcctcctgctgcatgtatggactttgtctgatgcttctcgatcttttgctgctgtgtttaatttgttggccggatcagcagaggttgagatagatggccagtctgtggaagaccaaggttctgcctggcctcgacaagatcttcgacaaggatggcaagaaggctgcccctgcaggcttcttcaagtccttcaacaaggtccgtatatatcacgtataacctatctatctatcttctacctgcaggagctacttcagatacgaaacctagctacaagcctgccgctcacttgatttcctcgctccgtatatgtttttgtcataatatatatagtatgagtttgttaataatcgagcctttcttatttaagctaacttgatttctatctatatacataaaaactgcaggaggagattggcaaggagattgaggagaagaaggcagaactggagcccaaggttgcggaggcttatgaagcatctcctcctgaggtcaaggtaattaattaacttatttatttatttatttttctgattgggcttgcttgctttagaagaactaagcaacgaaaactaggctgacgattgtacccgctgaatgattaattaggctctgttcaaggataagaagccagtcaagatcagcaagaagaactcgactgcagttaccaagttcctcgatgagctggctaagattggtaagcaaagtagagaaaactcttgtctcttcttctcttctctgtcgtatgtacctagctacttttccatgcatgatgtatacagttcctcaactgtttattatttgtcccacgtacgtccagacttccctggagccaaggtggtgagcgaggcggtggccaagtccggcgcctcgcccctgtctccggcgatcaccttcatcttggacaaggtcgcaccgtacatccccaaggaggagcccaaggcggaggacgcggtggctgaggccacttcccgggaagtcgccgtggaggtggaggatgccgagccggctatagctgatgcagcggccgagacaccatcggaggcgaagaagggagaggaggaaaagccggctgccgaggaggcggcgccaccggcagcggctgctactgaggagaagtaatactccgatccacagccatgcctctccctacgtagctgcagcagagtgaaaagtgattcagtcagtcagacatacacacttgcattggcacgcattattcatggacatgtacgttgctgcgccgtgtgtgcgtgtgcgtgtgcgtgtgtgtgggggttctttgttttttattttggggcgattgttacaaatgtgtaattatttatatcgatatgtttgtttcattgatggaccgcatttaataagacaattctttcttgtgtatataagtatttttttccttgcttcgcggcgacgtcatttccaggcccagcacctagctatatgattatattttaggacggagagattacgtagacatgttttgacagacccatcatatacctccggatgtgagatgtagtaggtgtatgttctttttcagcattgaagataatgtatgggtacccatcaatgatcaaggatgattaatcttgctattaatcatcctgcgtgttcttcaccttccttgtgtttcttgtctttcccgtcgatagatgcgatagatgcggcatactcctttatcgctatcgatcgtactgatcaaactgcgctgctattattagttgatggagctggacatgcaagcatctagcaacttgcacttaagtggggttgctttgcttggtctgaattggattatgatctttgcgttggtggctagctcagtcaatcaaacagcctgaagatttcaggccatgtgcatggcaggtacagttgggggaaacagtccaaacaattgagatgagattttagacttgcaagcaattactaccttcgttttcaaatatttgtgacccgctaattcaattttaaactaaacctcgataaataaaaaagaacataggtagtagtacctaacccccttcttatttcctcaccagaaaaagcttcttcttgtttaacaattttttaaaagcctcaaacaggaaaaaccaaacagacaaattcaagattccgaccatgtgaatgacatatgcaaaaggggccttctagcctgcccgacacctaggtagggatgctcctaaaacatccgatttatatgacaaatctaatattttaatatagatatacataaaatttaaagctaatttttagcaatgttattaagaatattatgaagtatttaaataaaaatttaaataactttttatgtgcattattttctttctacaacaaaaaggtgaaaaaacatctgaatccgtattcgaatagacatatgaattttatatcaattattttaaaagatatagaaggaatttaagctttactttttatgaagattaatagcctcaatgctaaaaacaagaatataaatttacatagcaaattatatagtt

SEQ ID NO: 1335 - DNA, 1175 bp, Zea mays
ccctcggggggtacgacgcgggctggtgatcacaactccacgtcacacacctcacagagctgcagcagcatcagctgccacctcctgcctctcctccttccttcctgcctgcataggttgttgctacacgtatatattctgaagaagagatcgagatgaccagcgtgtggaagaccaaggttctgcctggcctcaacaagatctttgacaaggatggcaagaaggctgcagctgcaggcttcttgaagtccttcaacaaggaggagattgacaaggagattgaggacaagaagacagagctggagcccaaggtcgtggaggcctacgaagcatctcctcctgaggtcaaggctctgttcaaggataagaagccagtcaaggtcagcaagaagaactcggctgcagtcaccaagttcctcgatgagctggctaagattgacttccctggagccaaggtggtgagcgaggcggtggccaagtccggcacctcgcccctgcttccggcgatcaccttcatcttggacaaggtcgcaccgtttatccccaaggaggagcccaaggcggagccggcggcggaggccacctcccgggaagtcgccgtggaggagaagaaggaggaggccgagccagctgcagcgacggaggcggcaccggcgccggcagagacaccgtcggaggaggcggtggtagaggagaagaaggaagaagagaagaaggaagaggaggataagccggctgccgaagaggcggcgccgccagcagcagcagctgctgctgaggagaagtgatcctgttgacggatcgagcatgcaaagcgctccctcctcgctcccttgcttgcttgcttgctgctggtaaattaaattaagttgccgtgatacttaagcgtagccgcacggagtgaaaagttattaagtaaaagcagacaaacacttggcatgcatggacattaatttgttattctttgtaccgtcgtcgtctcgatgaaccgcgtgtacatttgtagtgtggggttttctttgttttcgatttgggggtgatcattacaagaatgtgtaattatttatgttcatatgtttgttgatgatggacggacatatttaagaagacaactcttttgtgtatatatattttcttgttattttcaaaggattaaagtggataatccaattgtt

SEQ ID NO: 1336 - DNA, 1065 bp, Zea mays
tcgagtcagctccgccggccccccccgcctggtgatcacaactccacgtcacacacctcacagagctgcagcagcatcagctgccacctcctgcctctcctccttccttcctgcctgcataggttgctacacgtatatattctgaagaagagatcgagatgaccagcgtgtggaagaccaaggttctgcctggcctcaacaagatctttgacaaggatggcaagaaggctgcagctgcaggcttcttgaagtccttcaacaaggaggagtttgacaaggagattgaggacaagaagacagagctggagcccaaggtcgtggaggcctacgaagcatctcctcctgaggtcaaggctctcttcaaggataagaagccagtcaaggtcagcaagaagaactcggctgcagtcaccaagttcctcgatgagctggctaagattgacttccctggagccaaggtggtgagcgaggcggtggccaagtccggcacctcgcccctgcttccggcgatcaccttcatcttggacaaggtcgcaccgtttatccccaaggaggagcccaaggaagagccggcggcggaggccacctcccgggaagtcgccgtggaggagaagaaggaggaggccgagccagctgcagcgacggaggcggcaccggcgccggcagagacaccgtcggaggcggcggtggtagaggagaagaaggaagaagagaagaaggaagaggaggataagccggctgccgaagaggcggcgccgccagcagcagctgctgctgctgctgaggagaagtgatcctgtcgacggatcgagcatgcaaagcgctccctcctcgctcccttgcttgctgctggtaaattaaattaagttgccgtgatacttaagcgtagccgcacggagtgaaaagttattatgtaaattcttacaaacacttggcatgcatggacattaatttgttttttttttccccgttttcctccttttttatccccctttacattttttttgcggactttcttctctgctttttttttttttttcttttttttttgtttttatttttttt

SEQ ID NO: 1337 - DNA, 1173 bp, Zea mays
  misc_feature (37)..(37): n is a, c, g, or t
ccccatgtggctttcctgccgccattcctctgcgcgngcccaccgtgcctctgcctggtgatcacaactccacgtcacacacctcacagagctgcaacagcatcagctgccacctccttccttccttcctgcataggttgctacacgtatatattctgaagaagagatcgagatgaccagcgtgtggaagaccaaggttctgcctggcctcaacaagatctttgacaaggatggcaagaaggctgcagctgcaggcttcttgaagtccttcaacaaggaggagattgacaaggagattgaggacaagaagacagagctggagcccaaggtcgtggaggcctacgaagcatctcctcctgaggtcaaggctctgttcaaggataagaagccagtcaaggtcagcaagaagaactcggctgcagtcaccaagttcctcgatgagctggctaagattgacttccctggagccaaggtggtgagcgaggcggtggccaagtccggcacctcgcccctgcttccggcgatcaccttcatcttggacaaggtcgcaccgtttatccccaaggaggagcccaaggcggagccggcggcggaggccacctcccgggaagtcgccgtggaggagaagaaggaggaggccgagccagctgcagcgacggaggcggcaccggcgccggcagagacaccgtcggaggcggcggtggtagaggagaagaaggaagaagagaagaaggaagaggaggataagccggctgccgaagaggcggcgccgccagcagaagcagcagctgctgctgaggagaagtgatcctgttgacggatcgagcatgcaaagctctccctcctcgctcccttgcttgcttgcttgcttgctgctggtaaattaaattaagttgccgtgatacttaagcgtagccgcacggagtgaaaagttattaagtaaaagcagacaaacacttggcatgcatggacattaatttgttattctttgtaccgtcgtcgtctcgatgaaccgcgtgtacatttgtagtgtggggttttctttgttttcgatttgggggtggtcattacaagaatgtgtaattatttatgttcatatgtatgtttgttgatgatggacggacatatttaagaagacaactcttttgtgtatatatatttcttgttattttc

SEQ ID NO: 1338 - DNA, 667 bp, Zea mays
ataagtctttccgcacagagggtagacgttaactgtcgatgcttagagttcagatcttcctaggcatgtgtgtggacctacaaaatttttgtgatcttgaactttccagcttccttctgcttgtgggcacaaaccctccaattgcaatccgacacctcgcacacaactgtgtaacatcgctcgacatacgaacgtctcaccttgaatgttcttttatgcttcactgagtattcctatagctatcgttcagctcctggtggtgctacgggggtgactgcgggggcgactgcggctggtggctgttgtcctcatcgaccatctcggcgacgtcctactcgagcgagatctcgctgcagtccctcgagatctggaggagattgacaaggagattgaggacaagaagacagagctggagcccaaggtcgtggaggcctacgaagcatctcctcctgaggtcaaggctctgttcaaggataagaagccagtcaaggtcatcaagaagaactcggctgcagtcaccaagttcctcgatgagctggctaagattggccgcacttgaagaaatcttatatcagtttgaggaaaaactccaagctgaaaaagtggaagctgctaggaagcaggaagagttgcaatctgtttgatgcctttgcttgaacatatctgt

SEQ ID NO: 1339 - DNA, 998 bp, Zea mays
cactcctaagggcgattgggaccctcgaggccggccggggcactgcagctgcatcaccatcattcataggctgccttcctgcctgctgatctcgcacctcaaacccacacacagcagcataggttgagatagatggccagtctgtggaagaccaaggttctgcctggcctcaacaagatcttcgacaaggatggcaagaaggctgcagctgcaggcttcttcaagtccttcaacaaggaggagattggcaaggagattgaggagaagaaggcagaactggagcccaaggttgcggaggcttatgaagcatctcctcctgaggtcaaggctctgttcaaggataagaagccagtcaagatcagcaagaagaactcgactgcagttaccaagttcctcgatgagctggctaagattgacttccctggagccaaggtggtgagcgaggcggtggccaagtccggcgcctcgcccctgtctccggcgatcaccttcatcttggacaaggtcgcaccgtacatccccaaggaggagcccaaggcggaggacgcggtggctgaggccacttcccgggaagtcgccgtggaggtggaggatgccgagccggctatagctgatgcagcggccgagacaccatcggaggcgaagaagggagaggaggaaaagccggctgccgaggaggcggcgccaccggcagcggctgctactgaggagaagtaatactccgatccacagccatgcctctccctacgtagctgcagcagagtgaaaagtgattcagtcagtcagacatacacacttgcattggcacgcattattcatggacatgtacgttgctgcgccgtgtgtgcgtgtgcgtgtgcgtgtgtgtgggggttctttgttttttattttggggcgattgttacaaatgtgtaattatttatatcgatatgtttgtttcattgatggaccgcatttaataagacaattctttcttgtgtatataaaaacacaaaacc

SEQ ID NO: 1340 - DNA, 1360 bp, Zea mays
gaccaaatgtccactgcacacacctcacagatcctctgcagccgcagctgccacctccttgggtcctttctgcataggtggcggcacgtacatattctgaagaagagatcgagatgaccagcgtgtggaagaccatcgttctgcctggcctcaacaagatctttgacaaggatggcaagaaggctgcagctgcaggcttcttgaagtccttcgacaaggtctgtaccgcgatcgaatcatctgcaggccggagctgcttcagatgaacctagctagctacaagcctgtcgatcacgcttgatttccttgatcacttgatttctacttcaggaggagattgacaaggagattgaggacaagaagacagagctggagcccaaggtcgtggaggcctacgaagcatctcctcctgaggtcaaggtaattatttatttatctatttatttgatttgggttgctttggacttaagtatagtaactttattatattatggcccggtcctactgcttctgatgattgtacccctgctgaatgattaatcaggctctcttcaaggataagaagccagtcaaggtcagcaagaagaactcggctgcagtcaccaagttcctcgatgagctggctaagattgacttccctggagccaaggtggtgagcgaggcggtggccaagtccggcacctcgcccctgcttccggcgatcaccttcatctggacaaggtcgcaccgtttatccccaaggaggagcccaaggcggagccggtggcggaggccccctcccgggaagtcgccgtggaggagaagaaggaggaggccgagccagctgcagcgacggaggcggcaccggcgccggcagagacaccgtcggaggcggcggtggtagaggagaagaaggaagaagagaagaaggaagaggaggataagccggctgccgaagaggcggcgccaccagcagcggcagcggctgctgctgctgaggagaagtgatcctgttgacggatcgagcatgcaaagcgctccctcctcgctcccttgcttgcttgctgctggtaaattaaattaagttgccgtgatacttaagcgtagccgcacggagtgaaaagttatcaagtaaaagcagacaaacacttggcatgcatggacattaatttgttattctttgtaccgtcgtcgtctcgatgaaccgcgtgtacatttgtagtgtggggttttctttgttttcgatttgggggtgatcattacaagaatgtgtaattatttatgttcatatgtttgttgatgatggacggacatatttaagaagacaactcttttgtgtataaaaaaaaacaaaaaagttctctgcgttgttaccactgct

SEQ ID NO: 1341 - DNA, 1169 bp, Zea mays
ccggccggggctccttcgctccgacttcgccttcacacaccctcacagagcctgcagcagtcttagctgccacctcctgtctctcctccttccttgctgcctgcataggttggtacccgtatatattctgaagaatagatccgagatgaccagcgcgtgcaagaccaaggctctgctctggcctcacaagatctttgacaaggatggcaagaaggctgtaattgcaggcttcttgaagtccttcatcaaggaggagtttgacatggagattgaggacactaacacagagctggagcccaaggtcgtggaggcctactaagcatctcctcctgaggtcaaggctctcttcaaggataagaagccagccaaggccagcaagaagaactcggctgcagtcaccaagttcctcgatgagctggctaatattgactttcctggagccaaggtggtgagcgaggcggtggccaagtccggcacctcgcccctgcttccggcgatcaccttcatcttggacaaggtcgcaccgtttatccccaaggaggagcccaaggaagagccggcggcggaggccacctcccgggaagtcgccgtggaggagaagaaggaggaggccgagccagctgcagcgacggaggcggcaccggcgccggcagagacaccgtcggaggcggcggtggtagaggagaagaaggaagaagagaagaaggaagaggaggataagccggctgccgaagaggcggcgccgccagcagcagctgctgctgctgctgaggagaagtgatcctgtcgacggatcgagcatgcaaagcgctccctcctcgctcccttgcttgctgctggtaaattaaattaagttgccgtgatacttaagcgtagccgcacggagtgaaaagttatcaagtaaaagcagacaaacacttggcatgcatggacattaatttgttattctttgtaccgtcgtcgtctcgatgaaccgcgtgtacatttgtagtgtggggttttctttgtttccgatttgggggtgatcattacaagaatgtgtaattatttatgttcatatgtttgttgatgatggaaggacatatttaagaagacaactcttttgtgtatatatatttcttgttattttcaaaaaaaaaaaaaaaataatccaattgttaatttgttgt

SEQ ID NO: 1342 - DNA, 1995 bp, Zea mays
ctcgaggccggccggcccgggctccgttttcttttcgcccacattcgccgttttgcctcgccatcgcatcgtccgcgcctccctctcatcgttcttccccggtacgactcgacggcgggcgtgggcgctggagttgcggctcggaggccgaggcgccgggtggtgcgttgggtgcgctcggttcgggagatcccggactttgctgctcgcgcggtcagacagggagcgccggaggaggaggaggctgtgcaagtgcaagctgtgctgaactaagggttctggcttcggactctgtgtacgcgccgcggcaggagggagctggagatgtacgggccgccgtcccgaggcggcgcgggagccggcgctgccggagagcagccgagggtttaccaagtttggcgaggaagcaacgagtttttcttgcaaggccggttcatatttggacctgatgtgagatccttgtttctcaccatattccttattcttgcaccagtggtggtcttctgcatatttgtggccagacatcttatcaatgactttcctgatcattggggagtttcagtcatggtcatagtgattgtcttcacaatatacgatttgacactgctccttcttacctctggtagagatcctggtatagtgcctcgtaacacccatcctcctgaacctgaagctattgatatgaacaatgatgctggaaatggtcagacaccacaacagttgcggttgccacggacaaaggatgttatcgtaaatgggaccattgtgaaagtcaagtactgtgacacctgcatgctgtacagaccacctcgatgctcacactgttctatctgtaataactgtgtggagcgctttgatcaccactgcccttgggttgggcagtgcataggattgcgcaattatcggttcttctatatgtttgtattctctacaacattactgtgtctctatgtatttggcttctgctttgtgtacattgtcaagattaaagacgcagagcagtcgacgttctggaaagcaatgttaaagaccccagcatcaatcgttctgatcatatactgcttcatctgtgtgtggtttgtgggtggtctgtctgtcttccatttctatctcatgagcactaaccagacaacctatgagaacttcagataccgctatgatcggcgggacaatccgtacaacagagggactgtgaacaacttcatggagatattctgcacctcagtcgctccttccaaaaacaatttccgagctagggtcccagcagagcaaggtttacagcaagcacgtgcgccagcaaggggtttcatgagcccaaacatgggtaaacctattggggaacttgaattgggcaggaagccaatatcatgggatgaacctcggtcagcagctgatatcagagacttggaggttggtctaggcagcctactggacgagaaggaaggcagggtagcccatgcatccccggacctgagcagagaagcccttcctgagcttgtggaagggagggctggcatgcattcgaggcggtcaagctggggtcacagaagtgggacctcggcctccatggacagccttgctgtgcaaatggggaccgcagattctcactggggctccattagcagtgtccatggtacaaacagtggagctcactagcaagccgctccacgtcttgacgcgtctctttgtgtaaacctgcctgataccaccaactaagaagcaacctttgcgtgctctgtgcgcctgtgcttccgctccacctaggatatacgtctgcagtgctttcttactcagcgccctgggagagcgcatcagttcttctggtgtgcttcccgtttggtgtcctaagcaaaaataatagaggtaccatttaactccttattagttgtttggaccatcactgtatatagatatatattattgcaaattggaattgcctgcagaaaggtttgtcatgtttggcttccgcccttcaaaaaaaaaaaaaaaagaacg

SEQ ID NO: 1343 - DNA, 1001 bp, Zea mays
  misc_feature (926)..(926): n is a, c, g, or t
  misc_feature (929)..(929): n is a, c, g, or t
  misc_feature (936)..(936): n is a, c, g, or t
  misc_feature (938)..(939): n is a, c, g, or t
  misc_feature (941)..(941): n is a, c, g, or t
  misc_feature (944)..(944): n is a, c, g, or t
ccacgcgtccgacccgccgttttcttttcgcccgcatccgccgttttgcctcgccgttctgccgcgccatcgcatcgtccgcgctccctctcatcgttcttcccccggtacggctcgacggcgggcgtgggcgctggagttgcggctcggaggccgaggcgccgggtggtgcgttgggtgcgctcggttcgggagatcccggactttgctgctcgcgcggtcagacagggagcgccggaggaggaggaggctgtgcaagtgcaagctgtgctgaactaagggttctggcttcggactctgtgtacgcgccgcggcaggagggagctggagatgtacgggccgccgtcccgaggcggcgggggagccggcgctgccggagagcagccgagggtttaccaagtttggcatggaagcaacgagtttttcttgcaaggccggttcatatttggacctgatgtgagatccttgtttctcaccatattccttattcttgcaccagtggtggtcttctgcatatttgtggccagacatcttatcaatgactttcctgatcattggggagtttcagtcatggtcatagtgattgtcttcacaatatacgatttgacgctgctccttcttacctctggtagagatcctggtatagtgcctcgtaacacccatcctcctgaacctgaagctattgatatgaacaatgatgctggaaatggtcagacaccacaacagttgcggttgccacggacaaaggatgttatcgtaaatgggaccattgtgaaagtcaaggactgtgacacctgcatgctgtacagaccacctcgatgctcacactgttctatctgtaataactgtgtggagcactttgatcaccactgcccttgggttgggcagtgcataggattgcgcaattatggggggggggtgtgttngtnttctctncnncnttnctgtgtttctgtgtgtggggcttctgctttgtgtccctttctttgtttttcgccccc

SEQ ID NO: 1344 - DNA, 1325 bp, Zea mays
tgcatgcctgcagcgcaattatcggttcttctatatgtttgtattctctacaacattactgtgtctctatgtatttggcttctgctttgtgtacattgtcaagattaaagacgcagagcagtcgacgttctggaaagcaatgttaaagaccccagcatcaatcgttctgatcatatactgcttcatctgtgtgtggtttgtgggtggtctgtctgtcttccatttctatctcatgagcactaaccaggttggtaccctgtcaacttttttaatatagttggttttacccgtaagcatattgctgataattggttattttactcgtaagcatattgctaggaatttgtaattactctcatgtgggagcctctggcattgggtctgcccttttcctatcctttgcagacaacctatgagaacttcagataccgctatgatcggcgggacaatccgtacaacagagggactgtgaacaacttcatggagatattctgcacctcagtcgctccttccaaaaacaatttccgagctagggtcccagcagagcaaggtttacagcaagcacgtgcgccagcaaggggtttcatgagcccaaacatgggtaaacctattggggaacttgaattgggcaggaagccaatatcatgggatgaacctcggtcagcagctgatatcagagacttggaggttggtctaggcagcctactggacgagaaggaaggcagggtagcccatgcatccccggacctgagcagagaagcccttcctgagcttgtggaagggagggctggtacgcattcgaggcgatcaagctggggtcacagaagtgggacctcggcctccatggatagccttgctgcgcaaatggggaccgcagaatcaatggggctccattagcagtgtccatggtacaaccagtggagctcactagcaagccgctccacgtcttgatgcgtctctttgtgtaaacctgcctgataccaccaactaagaagcaacctttgcgtgctctgtgcgcctgtgcttttcactctacctaggatatacgtctgcagcgttttctttactcagcgccctgggagagcgcatcagttcttctgatgtgcttcccgtttggtgtcctaagcaaaaataacagaagtgccatttaactccttattagttgtttcttgtttggaccaaccactgtatatagatatatatcattgcaaattggaattgtctgcagaaaaaatttgtcaaaaaaaaaaaaaaaaaaaaaaaaaaaaaaaaaaaaaaaaaaaatttaggtatgactatggaaaaaaaaaaaaaaaaaagcggcc

SEQ ID NO: 1345 - DNA, 2039 bp, Zea mays
ctcgaggccggccgcgcagtatcacagccgcacagcgcccgctgctacgcacgccgccgtctacccccactcccccagcacgtgcgtgcacgcgcaggtgctcgaggacttctcccccgtttccgcccacatccgccgacctgcctcgccattccgccgcgccttcgcatcgtccgcgcgcccggcccttttcgttctaccccggtacgactcgacggtggtcgtgggcgccgaaggtgcggctccgaggcgccaggtggttcgtttgctgtttgcgcgatcgccggaggagtctgtgcaagctgtgctggctaagggtttgggggttcggattcagtggaggggctgcggcaggagggagctagagatgtacggaccgccgtcccgaggcggcgggggagctggcactgccggagagcagcctagggtttaccaagtttggcgaggaagcaacgagtttttcttgcaaggccggttcatatttggacctgatgtgagatcattgtttctcaccatattcctcattcttgcgccaatggtggtcttctgtatatttgtggccagacatcttatcaatgactttcctgatcattggggagtttcagttatggtcatagtgattgtcttcactgtatacgatttaacattgctgcttcttacctctggtagagatcctggtatagtgcctcgtaacacccatcctcctgaaactgacgctattgaaatgaacaatgatgctggaaatggtcagacaccacaacaattgcggttgccacggacaaaggatgttattgtaaatggggtcattgtgaaggtcaagtactgtgacacctgcatgctgtacagaccacctcgatgctcacactgctctatctgtaataactgtgtggagcgctttgaccaccactgcccttgggttggccaatgcataggattgcgcaattatcggttcttctatatgtttgtattctctacaacattactgtgcctttatgtatttggtttctgctgggtgtacattatcaagattagagacgcagaacagtcgtcgatctggaaagcaatgttgaagactccagcatcaattgttctgatcatatactgcttcatctgtgtgtggtttgtgggtggtctgtctgttttccatttctatctcatgagcaccaaccagacaacctatgagaacttcagatatcgctatgatcggcgggccaacccgtacaacatagggatcttgaacaacttcatggagatattctgcaccgcagtccctccttccaagaacaacttccgagccagggtcccagtagagcaaggtttacagcaatcgcgtgcgccagcaaggggtttcatgagtctaaacatggataaacctgttggggacttcgaattgagtaggaagccagtatcatgggatgaacctcggtcagcagctgatatcagggacttggaggttggtctagggggtctactggacgagaaagaaggcaggatagcccatgcgtccccggatctgagcagagatgcccttcctgagcttgtggaagggagggctggtatgcattcgaggcgatcaagttggggtcacagaagcgggacctcggagtccgtggacagcattgctgtgcagatggggaccggagattctcactggggctccattagcagtgcccatggcacaaccagtggagctcactagcaagctacgccacgtctttgacgcatcttcttgtgaaacctgcctgataccaccaacgaagaagcgacctttgggcgctctctgtgcacatgtgctttcactccactccacctaggatatacgtctgcagtgctttcttactcagttgtcctgagagcgcatcagttctgatggtttgcttcccgtttggtgttttaagcaaaaataacagaagagccccttaactccccctgttgtttggattatccactgtatatatgtatctttgcaaaaaaaaaaagccagcagagaagatttgtcatgtttggctttcgcgaaaaaaaaaaaaaaaaaagcggcc

SEQ ID NO: 1346 - DNA, 4957 bp, Zea mays
ccccactcgctccctcgaggccggccgggacggcagcccgtttccgtccaccggaagtgccggcctttccccactcgctctcgctcccaacctcctcttcttcttcgtcttcggcctccccccggactgagtcccacacgcttcgcattccacccgcccccttttcgcgtgaacgcgccggcgccgcggatcctgccgtcacgaatggaggcgtggccggacgatttccgctgccccatcacgctggaggtcatgacggacccggtcatccttccctccggccacaccttcgagcgccgcagcatccagagctggctcgacggggggcacctcacctgccccgtcaccaacctcccgctgccgccctccccgccgctcatccccaaccacgcgctgcgccgcctcatagccgccgtctcgccttccgcggcggcgtctctcgtccctgcggagggaggggcgcacgcgaggcaagaagcggtgtcggcggcggcggcggcggcggtgccagcccggcccgcgtcgcccgtgccggcgctgctgaggctggccaagtccggcgccgcagggcggaaggaggtgctggagtccggcagcgcggcggtgctgctgcggcacgcggaggccggggacgaggcggcggccagggcgctgctgcacctcagcctggacggtgacgacacgcgcgtgggcctcgtggcggacggcgccgtggacgcgctctccgccgcggtgtcccgcggcggcgcggcggcggcgtccgcggccacggcgctgaccagcctcgccaccgtggacgtgaacaagtgcaccatcggggcgcacccctcggccatcccggcgctggcggggctcctccgccgcggcgggccgcgggagcgccgcgaggccgccacggcgctctacgagctctgcaagctgccggagaaccggcgccgcgcggtgcgcgagggcgcggcgcccgcgctcgccgacttcgccgccgccggctccgcgcgcgccgtcgaggtgctcggcctcctcgcccggtgccgggaggggcggcaggagctgtgccgggtccccggcgtcgtgtccgtgctcacgggcgccgccgggagcggcaacgcgcgcgcaatcgagcaggccctgctcgtcctcaactggatttgctccgagagcaacgagcccccgctcctcgcagtcgacctgcaggctttcgacctctgcgaggctctggtgaacgacgacaactgcaagatcgccaagaacgcggtcgacttggcccggacgctcgagaaagcgtagaattggattgggctgtctcccccaaaacatgagatgagattcgccatgggttttgattcaacacctgctcgattggtcgggtgttggcctcattgtacagaggtagcaacagcaaaggtgaaccttttatctttcttctcttactccgtttcatttccaagttgtagctgcgccgaaaggaggacaaaaaaaaaacagtagaatttagcttatgttcatatggttagaaccagagagagaaaggagtatggttcctgaacttgtcagttagaacttctttccatgtttcagagagtgaccagaccatcatccagtctgagatgttgttcacaatgattcatctgatgatgtagtgaaagtgagaccaaatgatctggagtggctcacgatcaaaagtaggatcgccagtcgttttttttctctcccccttgcttcactgtgctctacagttttacattgagaattggattgtgtgtgtagcgcctatcacctccttatggctcgtgataagaaatcaaaactcctgcctgctcagaaagtcttttgcgcttgatagttgatgcctagtacctcatcatcagatatttgctctgctaggtttgacaattggtgcaatcaaagctcagtgatttgtgccaagttttccacggttggaactaaaaacaaaacgtttaggatgggcgcgtattatatagccagcagagatccgcgtaggaccctcaggatctccctgcatcatcctagagtcttaattactcggtagatcgcggcaactgtcactgcttgttcaaatttggaatggacaaaactttcagcgtgagagtgctcttctgatggaaacatatcatgccgataaggctatctccagcagcttaccgtgcagtctacggtgcacgaccatacgcttgacctgtttgacatagcctgataaagagaggaggttctgcagccagagccaatgcaagtcatggtagttttaacagatactagcgcctttgtgaccgggggccacaaccgcaaggtcaagagaggcgctcctgatgcgggcgggcgggcgcggtgatgaacagtctccccagttttgcgctctttctgttatgagcgtggaggacgttccaacaaatcagtagatcatcacactgactccaatttccctggtgtcacttattttgtcctcaagaggaggtgcgtggttatcgcgcagctttgattatcgttttgttcgactgggacttgagatggtccagtctttttctgttttggctacgccaactaacctgcagtctcctcgacatggaattattagttttggaaccttttgtatcagtaggcggcagtatccggcgcgcggcaaagcagtggggtggggggaagaaggccaggccagggaaggatcgtccgattctcactttgggagatggccaacctgtttgattaatcgtctgctccgatggccgtggtaaataaacagcacaaagcgtctttgttttacgtccgttcccccatgaggccaggccatccatgcaccagtgtacgtgtatccaccattgcctactttactgggatccactgcgtctttcagatggccaaaaccaaaggaagagagaagcagcgagtggacggaaggttctagttgggtggttggccaacaacaacaaggaggcaagaaagaacagaacatctcagactcagagaggaagagagaaaaaaaagagagagagagtagtggtgcgccgagagggacggacggtgggctacttgttgtaccttgggcccccaatcctcgcgctgggaatctcgcggtcttctccccgcgccacttgtcgactcgccgtggagcatcggacggcctagtggcccccccgtttgtttggggctctttagccatgggttcattgcacccttcttccttccgattgcgacctgcgtctgtcttttccctctctctctctctctctgattgatttgatgctcagagtgtttcgtgcagctaattcccttggctactgactactgaggtctcgccgcctaacttgtcaaagaaaggtaggagtttggccgattgatttatctctagaacgctatggcgatcgagcttctgaagctcatgttttttaccggccacgacaggtatagagactgtagaaggaagaagaattcgagcaaacgcctcgatcgaagtggtgcaatgctgccacgaaaggtgacttgccaccctagtcttggagctagacttcgcgaaaagcttttgacgccgttgatgattgggctgctcttcaagccaatggtacacttgatggatgcccccggctcttggtttcgatgcaaaagaggcctttgccaaggagaccctctcccacccggcctgcctatccctcctggtggttgacgtttttcggaccttaattaaatcagacagccaaactgaccgtcccaccgttccgggggatcttggagcagtccttcagtacgcagatgatactcccatcctcttcaaagggactgtctccgcccacacacagtttgcgatgcatcctagatcaattcagcttagctaccgggctccacatcaacttttgccaagagtgtgatggcaccaatgcacttgcggaagaccacaatgcttgctacccaatgtgtccaagtttttttggatgccgacgtgaaggcttcccccagagctacctcggactcccccctctccaactgcaaagttcgcctccatatcttcacccccataaccccattattgccaaagctaacaaatacctggttggctggcaatccagcttcatgaacccgatggggtggctggttctccttaactccatgcttggtgggcaactaaattatatcatgcatgagcatgatgagactctcagaagctgttgtgataaaaactggcaaaaaaacgttgtggttttcctgtggactggtactgatgaagcctctggtgcaaaatgtttggttccctatgaaacgttggcaaaaaaaatcccgtgtgaaggatataagtgtccatgatctactggaacaaggtctttctatacggatctcatgggacagctctccgccttggcgttgaatgagctctcttctataccgaacctagcttctgtcgaaagtctccctcttaaatgactctgatgttccgtgttcgtcgttgctttgccgtcgacccgtctgggcgcctccagtcgaagatcatctattcctggttgtcggcgaaggacaactccaagagcattgtttcacgcttcatctgggaccgtcttgcctcttccctcccaaggtaagattctttggctggctcacgtctcacgatcacctctaaagccgagctaacctccacaagaagaagatcatcccgaatgctacctgtgaggtttgctcccgctgccacgaaactgtatctcacatcctcttccattgtgagttcgtcgacgctttaatttctcggttgctactggtgtcagcgttggagcctccacctgctactccaatcttcaccagcttccttgccccgcatcactcaacagttttgccttccccacatataatgccctatgccgctggcatctatagagacaacacaacaactacgtgtttcgtggttgttggacaccaaaatggagcggacggtccggcccatgggcccggacggtccgcg

SEQ ID NO: 1347 - DNA, 1274 bp, Zea mays
cttcttcttcgtcttcggcctcctccaggactgagtcccacacgcttcgcattccacccgcccccttttcgcgtgtccgtgctcacgggcgccgccgggagcggcaacgcgcgcgcaatcgagcaggccctgctcgtcctcaactggatttgctccgagagcaacgagctggcgctggaagcaatcaagctgcaggctttcgacctctgcgaggctctggtgaacgacgacaactgcaagatcgccaagaacgcggtcgacttggcccggacgctcgagaaagcgtagaattggattgggctgtccccccccaaaacatgagatgagattcgccatgggttttgattcagcacctgctcgattggtcgggtgttggcctcattgtacagaggtagcaacagcaaaggtgaaccttttatcttcttctcttactccgtttcatttccatgttgtagctgcaccgaaaggaggacaaaaaaacagtagaatttagcttatgttcatatggttagaaccagagagagagagagaaaggagtatggttcctgaacttgtcagttagaactgctttccatgtttcagagagtgaccagaccatcatccagtctgagatgttgttcacaatgattcatctgatgatgtagtgaaagttagaccaaatgatctggagtggctcacgatcaaaagtaggatcgccagtcgtttttttctctcccccttgcttcactgtgctctacagttttacattgagaattggattgtgtgtgtagcgcctatcacctccttatggcttgtgataagaaatgaaaactcctgcctgctcagaaagtcttttgcgcttgatagttgatgcctagtacctcatcatcagctatttgctctgctaggtttgacatttggtgcaatcaaagctcagtgatttgtgccaagttttccacggttggaactaaaaacaaaacctttaggatgggcgcgtttatatagccagcagagatccgcgtaggaccctcaggatctcctgcaccatcctagagtcttaattactcggtagatcgcggcaactgtcgctgcttgttcaaatttggaatggacaaaactttcagagtgagagtggtcttctgatggaaacatatcatgacgataaggttatcttcatcagcttactcatctccatatctcatttcaaactcatctctgtaaccgtgcaatctacggtgcacgaccatacgcatgacctgtttgacatagcctgataaagagaggaggttctgcag

SEQ ID NO: 1348 - DNA, 4655 bp, Zea mays
caaaattataatacctaaaaaaatgttgcataacttgaaacccgatttcagaccggtatgagtaattgggtaaacaatgggcaatggtaaaacgagttggactatacatctctgcataacaaaaatatctgcttggcagcattggcctgacgccgtgcactttactaccaatataaacacacacatttttcctatgtgcctcaaagcacaatacaaccagtgaatgtccttgtgagcgctagaccctgatggtcattttacttgttgatatgaagtcaactaatggctccaaacgacgtatggtattcatgagcccctgaagaactcttatagataaaatagtgttgtccatgttagtctaaatcttaatgattgactgtgcatttggtagtaataacaataagtttgcagaattgtaaccatgaagcaacttgttgttgcgtgtctcgctggatgttgagactaacccttcatgttgaaggacaaatatgtagtattcatgccactacattaatctaagtccaaagctcactgcataaaacccctatctgtaatgtgcgtaagatttcccaaataaatcaccacaatagcatacattggccacaaactggatgattgtggttggggattttatctgtatgcttttagaacatctcggcattagggggaggaatgcccatatagtgtaatgcctcaatattctattaaacgcacaaaagccaaactaaacttgtcgtttagtgtgtactcctatgtatatggagtttgccagaaatcgttgaggagtaaccatattggtctgaatgcttctacctgatgtagatgtggatatacccgggattaatatcatatccacatttgacttattggtattgatctattctcggggacgcctgcgaatatggtccattagccttagtcaaagcatatgttctgattgcagattcacgtggtctgtgataactctcctccgattaattcaccctgatggtgatttgcctcactaagaggttcatcttgatgatgaaattcctagcaatgcgcgcaatatcattgtgctgggaatacagaacaatgaaatctttcgttttgggaaatgacggagatcattattaaatgtgggagacaaatatgtcgacacctatcttgccactctagattgcaaatggatccaaaacaaagtcctaggcatgagtgctttaagctctcttatcgggtcattgataaatgcaatcgaggttgaaccaataatcgcaaaatgaaagtcacgagcttgaagtttgggcatttatgggcactattgaaataatgtgtggtgaatgcgatggttcaagtggtcttgtaagagacccatcccacatatgtgttgaataaacactattccgctatgtaatatatctggcaaatggcataaattaaaatatgtagtttataggattctgaagatccgtcatcggacgcgtgggcggacgcgtgggtttgaattataaatatgcaacatataaatctcgtaccgaataacacattcctgacgaatgaactctctcctatgtagagagaatatctcctagatgagattatagttccttgatgggacttttcctgaagaaataaagtctgtgttaaacaccaaagtttgataatccctataaagggataaagacccatatagacccgaaaaggaataagatgaggtaccaaaggacttgaagttcaccgaataagcacatgtgcattccatgagttttactcatggtaatttccactagatgtggaattacggtatcctctaaagccctgatggcagaaacctataaggtttaggtgttactggcaaaatatccccattgtgccagaatgacagactataacgatgtatctgatcgatgaaaaatccctgatggattacgatctttgatggacttttgttacaccatcatagatgttgcaatggatgaacgcctggagcgatgtgtcatatttagaatatgtactattgcaactatattatcccctaagtcctattgaaggacatgttatttgctttgcacaactatgtataaattgtggtgtaagatagaaaatgatagcaccccaacctcatccattctcgttattccagatgaacaatgagacatatatcttgaagaatatgcttgattatgagggataacgactatgacagatgtcatcgtcagggggagcgaatgcttatattgatcacaatcgtgatacaataaatgtcatattctatgccctgaaggcgtgagcttgatgatcaatatgtgaacctttatggaactttctatcaaaaatatatagatcccgtcgatcgaacaccatcaatcaaagtggcttatttatattgatacgtgcacttacctcgtatatcctagaagtgagtataggtaaagttcctgaaatagtcattgcaaggatatgcaatctgtttgctaaatctttatgtgcatatacttccagaagaagatgttttgccttattgatacgattttgcaaggatcagggggagcacatttctaaagttagcccttgtagaagatttgatagaatctagatccgagaggatcgaaatctgtcccgatgacagttgttgtactctttttcccttggtgagttttcttgaagtttctcacatgaggtttttaacgaggcaacaaagtgcaaatgcaatttgtatcaccatgcactctttctccatattttttccactgggtttttcggagttttaacgaggcatgtgttggtcgcggtattcgcccaagggggagtgttaagtaaccctagttatgggttatgtgggcaaatacatgttttgtccctgaggggtctcacatccctatataaggaatctgtacaccccctcataatacagagatcagaaggagaccagaggtccaaccttatatccagtgtctcgtgtgtttcctctgtcgtgcttatgggaagggagacgagttctctacatcttcttgcgcctatactgctgacgggagagaagggagcggatctagtgatccgtggtaacgtagttcttaacaatctcatctccgccgcctctcttccgctttgagcctcctccggtccggtcattagaaccctggcctccgccatgcatcgtgcatgcagccattcagccctcgcgcatgcctaacaaggacgacaagcctgcacgcacaaacttgatcctcgcccaatctgcaccgcacgacttcggtcggacgaacggtcgttagggaacttccaccgcgacttgcgcatacagtgcgcgtatctggagattgttcgaccgagaaaatacatggtgaagcacgcaaacttcggaaaatgagaaagatcgaacgagcaaagacaacatgaacttttgccatccattcgtatccggtatttcaccacacgaattacggcacgtcatatcacctctgagctgccagaagatattaattttgtataacacaaccaactttgttgtgcaattttttccattttgattccacggtcttttcatggacagagaactatttttttctctgctactaacctttcacaaatcttgtgttcaaaatacaatcttagtatttgatgtgtagtttaaacttttttttgggtgcatatagcaatcctctttccatctaagagctagtttggtaactctattttcttaagaggttctcatttttaaaagggaaaatgaactaatttactttgaaaaaaaaatgagaatcctttgaaaaaaattgtgttgacaaactaggcttaattaaaataaaataaaaggagagaacaggcaaccaatctgtgggttggccgttggctaatatgcttgagcttgagttgtgctccacgtcggtgggccgtgggctctcaagctggaccgtcatgaacagaccatctggtcagtcgtcggtgggctggctgctaatttgcccgcaaaacagtttcagcttgggctgcgcttctcggaaccgtttgccaggaccagaccagtggcaaaaacataggggttcgagatcctaaggattttggcaactgttcgctccttttgatcgcaagaaaaaaaaacgtaatgaaagacgtaggaaatctaacattcatgctgattttttttcgttccttcgcgctggatcgaggataatcacgtcgctcgagagagctcatcgcagttcaagcactgcgtagagccgtagacaaaaaaaaaaccctgcaaaaaagacctcgacgcgttggtccggccgcctgccattgcagcaacgagcaagtagtacgaagtactaataatgtggacttgtcttctgccagttgcatacaagatatttcttcaccttcgcatccaagcgcgcggttctaaggccaagttcgctgcagcctgccaccaaatcgattggtttccaggttcgcagtatcttctcgccggctgttgctgtcctaggccggccaatgtaatgtgtctcccccggcggggctcgtgacagtgccggggaccgacggaggtgagggatcgggccaccggccacctgcgtgctgttggctgtctcgcagctttgttgccgggggtacaaacgtacagtaaacatggtagggcagcctctgcgccatggctggcctgttggccgttgtcgcacctataattcactaat

SEQ ID NO: 1349 - DNA, 2880 bp, Zea mays
ctcgagcccacatcccaaccatatacgagacgagccgacgttcccccgggcccccaaggaaaaccatgtgctgtgcccgccaggtgccactaaatcggtagcgccctcgaggccggccggggagctcccagtaacggcaacaaccagcagcagcagcagcagccagtagtaacacagtaaccggcagaggccatggcgagatcaaggcgggaaggggaggccggaggagaggagcggaagctggtcctgggcaagtacgagctgggccgcctgctggggcagggcaccttcgccaaggtgtactacgcgcgggacctgagcgccgccgccggcacgggcagcaccagcgtggccatcaaggtgatcgacaaggcgcggctgcggcgcatggaggggatggtggagcagctgcgccgggagatctccatcatgcggatggtgcgccaccccaacgtggtgggcatccgggaggtgctcgccagccgctcccgcgtcttcgtcgtcatggagtacgcgcgcggcggggagctcttcgccaaggtggcccggggccgcctcaccgaggaccacgcgcggcgctacttccagcagctcgtggccgccgtcggcttctgccaccgccgcggcgtcgcgcaccgggacctcaagcccgagaacctgctgctcgacgaggacggccgcctcaaggtcaccgacttcgggctcgccgcgctgcccgagcagctgcgccacgacggcctgctccacacgcagtgcggcaccccccgcgtacgtcgcgcccgaggtgctcaggaagcgcggctacgacggcgcccgcgccgacctctggtcctgcggcgtcgtgctctacgtcctgctctgcggcttcctcccgttccagcacgacaactgcgccaagatgtaccagaggatcttcaaggccgagtaccaggtgccgccctgggtgtccggcgacgcgcgccgcctcatcgcgcgcctgctcgtcgtcgaccccgccaagcgcgcctctatcccggaggtcatgtgcacgccgtggttcaggaagggcttcgtgccgcccgtcctttcagtttcacccccgatgacgcccaagaaacggctggacggagatgacggcggcggcggtgcgctcttcgacagcagcagcaactctggcgccacctctcctcggtcgtgcaacgcgttccagctcatctcctccatgtcctccgggctcgacctgtcggggctgttcgagaacgaacacaaggccgcgaccgtgttcacggcccgcgcgccggcggccaccgtggtggagaagctcgagtccgcagcgcgcgccctgggattcgagaccaccagggggaagggctggaaggtgaggatggaggctaaggccgggggcacaaacggacggctcgctgtcaccgccgaggtgctcgaggtggccgtggacgtggccgtcgtcgagttcgcgcacgacgccggggacgcgctggacttcaacaagttctgcgctgtggacgtccgtccggggctcgcggaaatcgtctgggcgtggcagggcgacagcccggccgccgtcgttgggaccgcgtgaacctacggccgcccgttcgtcctggcgtccacgcctgttggagccagccttacacggctgcatcggcaccatgtaaagtttccgttgttgcttcgagacagccatggctagttcgttatgagtcgtatgttgtacaggaagagaacaagtgcaaaactgaagagaggtttctgtcgacacgagagccgaatcgagccgggagtgttcgatcggcttgcaaagttttgtagatcatataatcgctattttgtggagatgcgcacatacacaattttgttttggtcgccatatgatttttgcccatctgaatgattgtgccattcgcaattaaatcaaattattactatgtggtttccagagcagctaaggggactgttaataagaatatgcagattcttttggtgtacgttttttttggtgggtggggttcttacttttaagactagtttgagagccacaaaacctaagtagattagagatgctataatcctcttcttaatcagctagaatctcttttttatttacatttgaataaggagaggattctagcttctttaatcctctctggttttgtggctcccaaacgagccttagtatctaggtacgccgatatacggtaagaaattaggaacgagatcctctgacgtgaggagagggcactgccgcgtggcccccgcgtgcgacagggcccgcgtgcagtgaccctactgcccctgcagtacgtcagaggaacctcctccaagaaattacgggacgatgattggatgattatgctggcatccagcggaaattaggagggtgctttcaagccttgttcactcatttccactctatttgaattggatgagataaaaaaaattaagacctcgttcggttacaaggaattaaatccatgtctcaatccatgccccaaaataatccatgactacttaattttttttattcggttaaacccatcatggaatataacccaaaggtttgggaattttttaaactatggaagacatggattctatccatagcccattaggtatggaacaaatccataagatattgcacaagtttacattagaatccatggatcaaaagaataactagctttgaaagtcacatggatttattgatggatttaatcccaccatgggattgagtgtgagatatggattcacccaatccatacccggattaaatccatggtgggattatatcccatgtaaccgaacaaggccgtacgcgtcgtccaatcccggtggcaggacgggcccatcagtcagcgcatcaaatcgtgagcgtaagctggt

SEQ ID NO: 1350 - DNA, 3685 bp, Zea mays
  misc_feature (786)..(786): n is a, c, g, or t
  misc_feature (843)..(843): n is a, c, g, or t
ctcacttttgattgttttatcggtagtgaagtccattccgcaagcctatgttaataaagacgtgtgtaagtgtgttagttaacttccaattattgaggaacatatttacttatgaaaaaattcttagtaatggtcaatgtaacaaaaaaaagtaaggccacatttgtttcattggaattgaattctattataataattataatttagataaaactaattaagttcatatatttatatatataatatatttgtatattatcctaaattatatgagagatagttatatattatatttatattatagcgaagcaagtataagagtgtgttataagttgtacatcggaaaaatagcatgtaaatttatagaatcaatttttatctcttacctcatgaatttgagatattcttatatgataactttggaaagtgtggaatgtcatattctaaaaaaatagcctattgcattagtaaaattccaattcctcaagataaagaaaacaaacgggacataaaagtaattctacgagaattttgcgtgaatcaatgtatttttagaaaaaaaaaacaaaaaaatatagagagaaatcacattccaaattggttcttaatgggagggcagattcttggcacatgatactaggaaacagtctttcccgtctaattgctctccctaaacaaacctaatctcgctggcaatgaggacattccactactagacgagaactctagacctgctgccggccaaggttgccatggtacaacaacgttgaaggttgaacgctgaangggcgcaggaaatggcccaatcacccggcagcagatccgcccgaatcttcggtgctncaacctcgccggcaacaaccgctcccgacgcgtcatgggcccttcctcgctcccgcctccactccgtagctcccacctcacccccgctcctcgcaggctcgaccccacccgttcggtccgcgtgcccgcctcacgttggtccgccgcgcgcgcaccacaccacagtaccacaccacaccacaccgctacatacaaataagcgagcccccccgcgcccggccggggcaaatcccgtgtgccgcagtggccgagcccacattcgaaccaaagtccccccgggcccccccaaggaaaaccatgtgccgcgcccgccacgttcccacgcgccactaaatcagcagcgcccggccgcccggagctgccagtagcggcaacagcaaaacaagaagcagccagccaccaggcactagtaaacagtaagcagcagagagcatggcgagatcagggcgggaagcggagcccggagaggaggaacggaagctggtgctgggcaagtacgagctgggccgcctgctggggcagggcaccttcgccaaggtttactacgcgagggacctgagcgccggcgccggcacgggccacagctgcagcgtagccatcaaggtgatcgacaaggcgcggctgcggcgcacggaggggatggtggagcagctgcgccgggagatctccatcatgcggatggtgcggcaccccaacgtggtgggcatccgggaggtgctcgccagccgctcccgcgtcttcgtcgtcatggagtacgcgcgcggcggggagctcttcgccaaggtggcccggggccgcctcgacgaggaccacgcgcgccgctacttccagcagctggtcgccgccgtcggcttctgccaccgccgcggcgtcgcgcaccgggacctcaagcccgagaacctgctgctggacgaggcggggcggctcaaggtcaccgacttcgggctggccgcgctgcccgagcagctgcgccacgacggcctgctccacacgcagtgcggcacccccgcgtacgtcgcgcccgaggtgctcaggaagcgcggctacgacggcgcccgcgccgacctctggtcctgcggcgtcgtgctctacgtcctcctctgcggcttcctcccgttccagcacgacaactacgtcaagttgtaccagaagatcttcaaggccgactaccaggtgccgccctgggtctccggcgacgcgcgccgcctcatcgcgcgcctgctcgtcgtcgaccccgccaagcgcgcctccatcgccgagatcatgtgcacgccgtggttcaggaagggcttcgtgccgcccgtcctttcgcccccggtgacgcccaagaaacagcagctggacgaaggcgctgccctcttcgacaacgacgacgacgacaacagcaacagcaaccactctggcgccacctcccctcggtcgtgcaacgcgttccagctcatctcgtccatgtcctccgggttcgacctgtcggggctgttcgagagcgagcagaagaccgcgaccgtgttcacggcccgcgcgccggcggccaccgtggtggagaagctggagtccgtggcgcgcgccctaggattcgaggtcaccagggggaaaggctggaaggtgaggatggaggccaaggccgagggcacgaacggacggctcgcggccaccgccgaggtgctcgaggtggccgtggacgtgaccgtggtcgagttcgtgcacgacgccggggacgcgctggactttaacaagttctgcgccgtcgacgtccgcccggggctcacggagatcgtctgggcgtggcagggcgacagccccgccgccgccgtcggcaccgcgtgaacaagcgtccccgtctgtcacgtggaagttgtagcaactttgcgtaggagttaaacacggctgcactggcaccagctttttatagcatgtaaagtttcaagttctcgtcgttgcttcgagactgccatggtggctagttcgttgtgtgccatatgctgtacaggaaggaaagagtcgaatcgagccggggagttttcgatcgacttgccaagttttgtacgatcataacctgtattttctggagatgtgtgcatacaaaattttgcccgtgatcaaatttagttttggtccccatatattttttcccatcaggatgattctaccaattaaatcaattattactatgtcattttcacaggatctaggttgttcttaatcagcaatggatattcatacaagtcttcgatgttcaatgagctaggtggaaatttcggtgttacaaaagtaattacacgataggattttttttttgctaatgtgacaaggtatttaataggaggaagataaaagctatcttaagtaagatactgctttcacatgatatcttaggttatgacacacacaaaatattactgaggtctatttttatagacaacaccaattaaataattaaaacatataaatatgataaagggagtgtatcttgtatcaatatcatacttttttatcttatgtggtatttttggatattggagtatatgatacttgggaccgagaatagtcttaaggtccatacaattatttgatatttttctcagaatctttttcctgcgaagttgatcattgtagtggttcctcctgtgtcctatttgaaattggttatggccctgtctttgtttttggttttttttgctcgattagttaagatgcacaactcattatgtcgagtaatatatagtagtcaaatggcctttcgccctttgccaacccacaagtgaaattattgttgcactttttttttggctgggacctaataattgtgcttgcgtgtactattgacaaggaaaaagagagc

SEQ ID NO: 1351 - DNA, 2017 bp, Zea mays
acctcgaggccggccggggatgcgtttcaccagcactaaagcaccggatcccatcagaactccgaagttaagcgtgcttgggcgagagtagtactaggatgggtgacctcccgtggggtccctggcgcccggccgggcaaatcccgtgtgccgcactgggccgagcccacattcgaaccaaagtccccccgggcccccacaaggaaaaccatgtgccgcgcccgccacgttcccacgcgccactaaatcagcagcgcccggccgcccggagctgcctgccagtagcagcaacagcaaaacaagaagcagccgtaagcagcagagagcatggcgagatcagggcgggaagcggatcccggagaggaggaacggaagctggtgctgggcaagtacgagctgggccgcctgctggggcagggcaccttcgccaaggtttactacgcgagggacctgagcgccggcgccggcacgggccacagctgcagcgtagccatcaaggtgatcgacaaggcgcggctgcggcgtacggaggggatggtggagcagctgcgccgggagatctccatcatgcggatggtgcggcaccccaacgtggtgggcatccgggaggtgctcgccagccgctcccgcgtcttcgtcgtcatggagtacgcgcgcggcggggagctcttcgccaaggtggcccggggccgcctcgacgaggaccacgcgcgccgctacttccagcagctggtcgccgccgtcggcttctgccaccgccgcggcgtcgcgcaccgggacctcaagcccgagaacctgctgctggacgaggcggggcggctcaaggtcaccgacttcgggctggccgcgctgcccgagcagctgcgccacgacggcctgctccacacgcagtgcggcacccccgcgtacgtcgcgcccgaggtgctcaggaagcgcggctacgacggcgcccgcgccgacctctggtcctgcggcgtcgtgctctacgtcctcctctgcggcttcctcccgttccagcacgacaactacgtcaagttgtaccagaagatcttcaaggccgactaccaggtgccgccctgggtctccggcgacgcgcgccgcctcatcgcgcgcctgctcgtcgtcgaccccgccaagcgcgcctccatcgccgagatcatgtgcacgccgtggttcaggaagggcttcgtgccgcccgtcctttcgcccccggtgacgcccaagaaacagcagctggacgaaggcgctgccctcttcgacaacgacgacgacgacaacagcaacagcaaccactctggcgccacctcccctcggtcgtgcaacgcgttccagctcatctcgtccatgtcctccgggttcgacctgtcggggctgttcgagagcgagcagaagaccgcgaccgtgttcacggcccgcgcgccggcggccaccgtggtggagaagctggagtccgtggcgcgcgccctaggattcgaggtcaccagggggaaaggctggaaggtgaggatggaggccaaggccgagggcacgaacggacggctcgcggccaccgccgaggtgctcgaggtggccgtggacgtgaccgtggtcgagttcgtgcacgacgccggggacgcgctggactttaacaagttctgcgccgtcgacgtccgcccggggctcacggagatcgtctgggcgtggcagggcgacagccccgccgccgccgtcggcaccgcgtgaacaagcgtccccgtctgtcacgtggaagttgtagcaactttgcgtaggagttaaacacggctgcactggcaccagctttttatagcatgtaaagtttcaagttctcgtcgttgcttcgagactgccatggtggctagttcgttgtgtgccatatgctgtacaggaaggaaagagtcgaatcgagccggggagttttcgatcgacttgccaagttttgtacgatcataacctgtattttctggagatgtgtgcatacaaaattttgcccgtgatcaaatttagttttggtccccat

SEQ ID NO: 1352 - DNA, 1400 bp, Zea mays
ctcgacaaagaaaaattgatggtccttgccaaagacaaattgatcctttcactagaagaagaggtgaaatgtcttgcacctcgactagatcagcttgaacaacataatcatctagtgactgctttacaccagtggtgttgagtatcatgaagggcaaaattataatcatgccttgaactctggcaaacttttcgtggcacaagaaagtacaaaccagtcctactcaccgcaaatcaaatacacgaaactaaactttaaggttgatacattctttgctgttggatctcccttgggtgtcttcctttccctgcgtaatgtccgtattggtattggcaaaggacaagactattggcaagataagaacgtaattgaagagatgccatgctgccggcagatgttcaatatttttcatccttttgaccctgtagcatacaggtgggcttttatacagagttgaaccacttgtatgtgaagattatctaaagaagcgtcctgtaattgttccctaccatagaggcggaaagaggatacatgttggagtgcaggagttcagagaagatatttctgcacgttctcaagccattgcctgtcaattgaagtcactgaaggtcaaagcagtagctgctttgctagcattgagcagaaatgacacagaagaggatggtgagagtgctaatgaggaaggaagatcgtatggttccattatgatggaaaggttgaccggctcaccagatggtcgaattgatcatgtgcttcaggagaaaacatttcagcatccatatctatctgctttgggagctcataccaactattggcgagatcatgatactgctctcttcattctcaaacatttgtatcgtgatatacccgaggatcctccaagcgatgtcattgaaaggatgcctattaaactattttatgagagagatccagttgaggaagaaacgcctgtgacgttttcagatcatgcagcaattaaggaattctgcagaaaggtgaaagcttactcaagaaaaatggaggatgatgccaactgccaagcctcgtgatggatttttagtctctcgttacggcctcacacgttcctgggcaagcagaagcaagatgcagacatgggaaggaagaacgaatcgtgatcccaagaaaagaatccacgagatgcagttccacgcttcacgccagaatcagagcacttggagaatgttgtacggagtagagtcggttgccttgctcgttcctacatttataatgcagtgttgtacatagaacgtccgactgtagttttgtgcatcttgaacgtaatgttatgctgcctgctttaaatgctacagaatatatttttgctttgcaaaaaaaaaaacacaaaaaaacccacgcgtctgactagttctcgaacccga

SEQ ID NO: 1353 - DNA, 2054 bp, Zea mays
ttgaacaagctgtacatgaaatttctgaagagaaatcctggttacagtggaaaggtttgcggttcaatagttctatgacccgttcacaatgttctttataatttgctgttatgctgataattagacaagaaatcttttgccttattctattttacaggtttcattcgaccccccctccgtagggagtgttctgtcgtatgatatactttgtcatcaagaatcccttttggccccatttccaacagagtatctgaacatggaaacatctgatcgaagtcaaggagcaaagtcagccaatgaagttgctctgcatgattcaggtgcaaaggatcatgatacttatactctagggcattcttgtactggtaatgaaaacagtgccgttgatgaaggtagcaccagaactgacatgtcacatatggacagcattgtcccatcatgtgtgctcgaggattcattaaataacccagaaactggtgtgccacgtggggcagttgttgctgagcaaaatgaaaaagaaaataggattgagaatcatcagacggtgtatactgaggaaggaacaacttcaggtgtaagcacaaaagatgctgaagcatcacacatttcaagatctgctgaggatgtccatgaagaggtccttgacaaagaaaaaatgatcatttcactagaagaagaggtgaaacgtcttaaagctaaactagatcagcttgaacagcataagcatctagtgactgagagcaccagtggtgttgagtatcatggaggcaaaaatggcaatcatgccttgaactttggcgaacttttcactgcacaaggaagtataaaccagccctactcaccacaaatcaaatacacaaaacttaactttaaggttgacacattctttgctgttggatctcccctgggtgtcttcctttccctgcgtaatgtccgtattggtattggcaaagggcgagattattggaaagataagaacataattgaagagatgccatgctgccggcagatgttcaatatttttcatccttttgatcctgtagcatacagagttgaaccacttgtatgtgaagattatcaaaagaagcgtcctgtaattgttccctaccatagaggcggaaagaggatacatgttggagtgcaggagttcacagaagatatttctgcacgttctcaagccattgcctgtcaattgaagtcactgaaggtcaaagcagtagctgctttgctagcattgagcagaaatgacacagaagaggatggtgagagtgctaatgaggaaggaagatcgtatggttccattatgatggaaaggttgaccggctcaccagatggtcgaattgatcatgtgcttcaggagaaaacatttcagcattcatacctatctgctctgggagctcataccaactattggcgagatcatgacactgctctcttcattctcaaacatttgtatcgtgatatacctgaggatcctccaagcgatgtcgttgaaaggatgcatattaaactgttttatgagagagatccggttgaggaagaaacgcccgtgacattttcagaccatgcagcaattaaggagttctgcagaaaggtgagagcctactcaacaaaaatggaggatgatgccaactgctaagcctcttgatggtgtcatttcctgatggaaaccatgttacatccccacgttcctcgccaagaaggaagatgcaggcatgggaagggagaacgattccacaaaatcgtgatcccaggataagaatcctaagaaatgtagttccacgcttgacaccagaatcaggacacttgagaaacgttgtacagagtcggttccccatgttgcttcacttgttcccgtcgtcaatgcagtgctgtacagagaacgtcctgctgtacctttctgtatatgtaatcttgcgtgctgtgcatacagaatatgatggatttagtttcaaacgacagcggacagcgaaaaaaaaaaaaaaaaaacccgcggccaaaaaaaaaaaaaaaaaaaaaaaaaaaaaaaaaaaaaaaaaaaactcgaaaggggg

SEQ ID NO: 1354 - DNA, 1285 bp, Zea mays
  misc_feature (574)..(574): n is a, c, g, or t
  misc_feature (692)..(692): n is a, c, g, or t
ggcatctagtgactgaaacgccgtggtgttgagtatcatgaagggcaaaattttaatcatgccttgaactctggcaaacttttcgtggcacaagaaagtacaaaccagtcctactcaccgcaaatcaaatacacgaaactaaactttaaggttgatacattctttgctgttggatctcccttgggtgtcttcctttccctgcgtaatgtccgtattggtattggcaaaggacaagactattggcaagataagaacgtaattgaagagatgccatgctgccggcagatgttcaatatttttcatccttttgaccctgtagcatacagaattgaaccacttgtatgtgaagattatctaaagaagcgtcctgtaattgttccctaccatagaggcggaaagaggatacatgttggagtgcaggagttcagagaagatatttcggcacgttctcaaagccattgcccgtcaattgaggtcactgaaggtcaaagcagtagctgctatactagcattgagcagaaatgacacagaagaggatggtgagagtgctaatgagaaagaaaaatcatatggnttccattatgatggaaaggttgaccagttcaccgaatggtcgaattgatcatgtgcttcaggagaaaacatctcagcatccatatctatctgctttgggagctcataccaactatggncgagatcatgatactgctctcttcattctcaaacatttgtatcgtgatatccccgaggatcctccaagcgatgtcattgaaaggatgcctattaaactattttatgagagagatccagttgaggaagaaacgcctgtgacgttttcagatcatgcagcaattaaggaattctgcagaaaggtgaaagcttactcaagaaaaacggaggatgatgccaactgccaagcctcgtgatggggttgttttctgatgaaaaaccatgttacggcctcacacgttcctgggcaagcagaagcaagatgcagacatgggaaggaagaacgaatcgtgatcccaagaaaagaatccacgagatgcagttccacgcttcacgccagaatcagagcacttggagaatgttgtacggagtagagtcggttgccttgctcgttcctacatttataatgcagtgttgtacatagaacgtccgactgtagttttgtgcatcttgaacgtaatgttatgctgcctgctttaaatgctacagaatatatttttgcttttgcatccctagtgtgcgtcaattgcaaagtggttagctcctacttttttag

SEQ ID NO: 1355 - DNA, 1468 bp, Zea mays
  misc_feature (1424)..(1424): n is a, c, g, or t
  misc_feature (1449)..(1449): n is a, c, g, or t
cctcgaggccggccgggtttcagatagaggcgattgggtgcctcgaccccggccggaatacaacgaagcagcatatctattctcccaaattcccacacaacaagaacccaaggaggagggggtcctcccctcccggattcaagcttctctcttggtttcctctgcagttgcgattctgcagagcgcagaataatactacggtaatgggttccaagaagatgtatgtttgctccctgcctttgatgccacacgtcgtcttcggattcgtcagctccctactggcgtcagctcccaactggcagtcctataaagtggatgatccgaatgcgccgagaatgattcttctcgttattttctacgcgaacgtcatcttgctggctgaaattaagaacgtcaggatctacatcgagacggcaactgccgtggtgatatcttacgtgtcactacttaaaatcagctggagctacatctggctcgttctcttccccattgtggcgatcggcttcatcgttgctctgtgcaaggagctcagtcacgaggacgaggccggtggatcacattcacaggagcagagcaatgaaggtgaaggtgaaggcgaagctactacgtcttcatgggaaaaggtagaggggctggaggcagtagcggtggtgccgtactgggcgcttctcatcatgggcctcttgcatcctgacaagttcgccgtctcccaattcctcctcttcttcagtttcatgctgggggcactgaccatgatgatgactcggctggtggagacggggcgggccactgcccaccgcggcatcgtgccggcgtccgagctgctttggaaagcctcgctcgtggtgctgctggtggcggtgcacgcagtggcggcagagctgctgggagagaacgcgttactcctgtgcatgccggaaatcctgccggtgctgctgtggctcagcgttcgccttgacactgctgacgacaggatcaagctggtcctggacagtaatctgctccccgcagcaccacctgcagtcctcgccatgctagcgacgggcgagcccctgctctactggtgcagaaaggcgttggtgtcttgtgttgtttcggcgcttcttaccttctacgtttatttcatgctgtgccagtggccgggaggacaacgcaatcgcacgctcacaggtgcctctttgcagcacgcggtcatccacctcaagtcttgggcaaaggttttgctcaaagcggtggttgtgctgctaatatttgtatgctttcgttccaactagttctactgcaagaaccggtggtctcatcatcagccgaccaaatcttcatcgactatatgtaaaaaagatccaccagttcataatttgactgcgaaatgaatagtttcactatcaaaaaaaaaaaaaaaaaactcgaggggaaaaaaaaanaaaaaaaaaaaaaaaaaaaaaaaanccgaaaaaaaaaaaaaaaa

SEQ ID NO: 1356 - DNA, 1375 bp, Zea mays
gcacgagaccattacctagaacatcctactcgacttttcccaccaacacctccaaacctcctctctatttccaatttccacgccgccgccaacatgaccacctcagccgccgcctccgccaccgccgcgttgtccaccccatcctccgtcaatccccatcgatcgtcttctgcgctcaggctcccagcgtccctccgccgatcccatcccaacagattcttatcgtcgtcaccctcgcgctctccactcgtgccggtctccgccatggcctctcccgccgccgccggtgagacgtcctccaggaagaaactcatcatattcgatgcggaggacgacctcgcggcgtcactggccaagtacacgtctgagctgtcggcgaagttcgcggctgagaggggcgccttcaccgtcgtgctctccggcggctccctcgtcaaggccctcaggaaactagcggagccgccgtacctagaggcggtggattggagtaaatggcatgtgttctgggtggatgagagggtggtgcccaaggatcacgcggatagcaactacaggctcgcctcagatcagttcctctctaaggtgccgattcctgctgaccaagttcatgccatcaatgacgaactgtcatccgagggggctgcaggggactacgaaactcgtttaaagcagcttgttaagaacggtgtgatcgaactgtcgccggtgtccgggttccccaagtttgaccttatgcttatggggatggggcctgatggccacgttgcctcactcttccctggccaccctgttgtcaatgaataccagaagtgggtcacctttgtcaaggactccccgaagccgccgccggagagaataacgttcactttcccagtgatcaactcgtccgcacacatcgcacttgtggtcaccggtgctggcaaagctggtgctgtgcataaagcactttcagaagggcaaagtacatcagatttgctgcctgtcgagatggtttctcttcagaacggagagctcgtttggttcactgacaagccagcggtgtcaatgttgtcgagcatctgaagcccacgattgtataaatttgaagcttcaatttgatgggattcatacacgattgggtcttgttcggttgcatggtgattggaggggattagggatgattaaatctctttctattcaattttaaatggtaagagacttaatctcctctaattctcctcaatctagttttaaccgaacaagtccttgatggaaatctattcggttcgacatagaactccgagtgaatagattcggcatagaactctgaggtgtcgttgtcgaggaagtttgtcttggattccattttctacccactaataattatttagacccg

SEQ ID NO: 1357 - DNA, 1389 bp, Zea mays
atcgctgactctggagggtgtggtatatgttgttgatagtggattttccaagcagaaatgttataatccgatttcggacatagagagtttagttgtcgcaccaatatccaaggcatctgcaagacaacgagcaggcagagctggaagggtgcgacccgggaagtgctttaggatctatacagaggaatattatcttaatgaaatgcacgccgaaggaattccagaaatgcaaaggtccaacctggtctcctgcctaatacaggtaaaagccctaggcatagacaacatcctgggctttgattggccagccccgcctccgccccgcgcccggattcgggctcttgaagttctattctccctaggtatcctcgatgaagatgccaaattaacagtacccattggcttccaagttgctgagatccctctggaccccatgatttcgaaaatgatcttgtcagcaaatgattttggatgctctgatgagatattgaccatagcatcatttctgtctgttcaatctgtatgggtttctgtgaggggagtgaagaaggaatttgatgaagcaaagcttcgatttgctgctgctgagggagatcatgtaacattcctgaatatctacaaaggatttcaccagtctggaaaatctagccaatggtgttacaagaactttttgaattaccaagcactgaagaaagttgtcgacattaggggacaacttctcaggatagtgaagagttttggtatacaactgaaatcatgtgacagagatatgcaggcagttagaaaggccattattgctggttcatttactaatgcatgtcatctggaggaatacagccaaaacggaatgtataaaacaattaggacattacaagaagtttatattcatccatcttcagttctctttagggtcaatccaaagtgggttgtctaccagtctctcgtctcaactgacaagcattatatgcggaacgttattgccattgagccatcatggcttacggaagctgcaccacatttttatcagttccgagcattcaatcctgctccccactaacattactgtgggcaggactgcacgtcgttttgtaattttagagaacttaactttcctagggccacaattttgttgaagaaaaggattgccaatatttgtatatgctaagcacttgtggcattattctattccagtgatgatgggacggccaaaatcacacttgtcggtttatcccaaaatcacagtagcgagaaatctgtaacttgtacaacctcttgaatttgcccacattttgttcttgtcagtttatgggaggatgcagtttattggactatataaaaaaaaaaaaaaaaaaaaaaaaaaaaaaaaattaaaaaaaaaaaaaaaaaggt

SEQ ID NO: 1358 - DNA, 2744 bp, Zea mays
gcacgagaccattacctagaacatcctaatcgaaaaattatcgatcccagccccaggccatggcgacgaggtggaggaggtcgctgctctgggtcgccgtcgtccagttcctgaccctgtgcgtcgccgagcatctcgtagtggaagcatacaaaaagtcctacattgtgtatctgggatcacatgcatatggccgtgatgcgtcggcggaggagcatgctcgcgcaacccagtctcaccaccacctcctggcatcgatcctcggcggcgacgaccaccaccaccatgagacggcgcggcagtccatcttctactcctacaccaagagcagcatcaatggcttcgcggcgcacctggaggagtcggtcgcgcagcagatcgcggagcaccctgaggtggtggcggtgctggagagcaagatgctcaagctgcacaccacgcggtcctgggacttcatggacctggagcgcgacggtcacgtcctccctggctccatctggaaccacgctaggttcggacaggacgtcatcatcgccagtctcgacagcggagtgtggcccgagtcccacagcttccaagacgacggcggccaagtgccagctcgctggaagggctcctgtcaagacaccgttaagtacggtgtcgcctgcaaccgcaaactcatcggcgctaggttcttcaacaaagacatgctctttagcaacccagccgtggtgaacgccaactggacgcgcgacaccgagggccacggcacccacacgctctccaccgccgccggtggctttgtgccccgtgccagtctcttcggctatgccactggcacagccaaaggcggcgcgccgcgtgcgcgcgtcgccgcttataaggtttgctggtcgggagagtgcgccgccgccgacgtccttgcgggcttcgagtccgccatccatgacggcgccgacgtcatttccgtctccttcggtcaggacgcgcccctcgccgatgacgtcaagtcactcttccacgagcctgtcatgctcggctcgctccacgccgccatccacggtgtctccgtcatctgctccgccggcaactccggcccgtacgatgacaccgtcgtcaatgccgcgccatgggtcaccacagtcgccgccaccaccgtcgacagagacttccccaacgttctcaccctcggcaatagcgtgcgccttaggggaacgagcctcgagtctactacgctgcactccagcatgctctacccgatgatcgacgccgcgcgcgccgcgcgcaccacctctaacccgtacgacgcggccagctgcgggctcggcaccctcgaccctgctgccatcaggggcaagatcgtcgtgtgtcgccgcggcggcggaggcggaggcgacgtctcccgagtcagcaaggggatggccgtgctcgaggccgggggagccgggatgatcctcgccaacgacaggatggacggtgacgacatcgtcgcagacccgcacgtcctcccggccaccatgatcacctacagcgaggccgtctctctgtacggctacatggagtccaccagcaaccccgtcgccaacatctcacccgccaagacggaggtgggcgtcaagaactcgccgtccgtggcgggcttctcctcccgcgggcccagcgggactctgccgtacgtgctcaagcccgacatcgccgcgccgggggtcgacatcctggccgccttcaccgagtacgtcggccccacggagctcgcctccgacaagcgccgctccgagtacgccatcctgtccggcacgtccatggcctgcccacacgtctccggcgtcatcgctctcctcaaggcggcgcgccccgagtggagccccgccgcgatgcgctccgcgatcatgaccacggcgcgcacccaggacaacacgggagcgcccatgcgcgaccacgacggcaaggaggccaacgccttcgcctacggcgccggcaacgtgcaccccaaccgcgccgtcgacccgggcctcgtgtacgacgccggccccgacgactacttcaccttcctctgcgccatgggcatctccgcggcagacatgaagcggctcagcgccggcaagttcgcgtgcccagctaatagcgctaaggaggcgcccgccatggaggacctcaactacccgtccatcgtggtgccgtcgctgcgcggcacgcagacggtgacgcgacggctgaagaacgtcggccgtccggccaagtacctcgcgtcctggcgcgcgccggttgggatcaccatggaggtgaagccgagggtgcttgagttcagcaaggtcggtgaggaaaaggagttcaaggtgacggtgacgtcgcagcaggacaagctcgggatgggctacgtctttgggaggctcgtctggacagacgggacccactatgtcagaagccccgtcgtcgtcaacgccctcgcatgatctatccagttcgtgctaactagagtacactacctactactactacttgagggccttgtggatttttgtgacatcttagataagtagtaaggctctaaaatatatttttatttcttcttgttattattagtaaagaaatgagataggtttttttttgcttagctaaaagacatatcatctataataaattttggctctttgcatgggaacttgaattaatggtaaaaaactgcatataatataatgaagggaaaagggcacttctagtttcaaaaaaaaaaagaaaaaaaaaaaaaaaatgtcaatgta

SEQ ID NO: 1359 - DNA, 3146 bp, Zea mays
  misc_feature (991)..(991): n is a, c, g, or t
accggatggtggtggatggagggcttgccatatccgataccagattattatggtcagcgtttggggatgatgttatgtggtttctaggatcacaagtattattcgctggatggggctgcgatggttagaggcgttggctagggttagagggcgacaactagggttagggacgctggggagaccgaacataaggcttcacccatggtcgacaagggagaagggattttcttctaatctcttgcttaccttcaattgatacggtccttctctttatatagggagggttacttgacctctaagcactagatctaatattatctttaattctaatcttaatcaaactagccttatctttatctaacctacctgagagaggccctgacactttatataacggagtatacgtaatattttggatcaacacattgatcacgtgtagtaccacgcatatattactcctaaatttgatgctaaaactcttttgtaaggtatgtagctacttactatatattaaagcagccatgcatgtatcgaaggatgtctttaaccatcaagctcacttggatgctacattaacactatcatattgtctacatgtgatgaaaatatattatattatcacttttaaaaacatataagtctataatttcgaaatctttcaaaatttacaaaaagtgataaccgcaaaaagaaactacaccaagaaaaaaaatacaacagaaataaaacagtgtgccttacgttttcaaattcaatcattggcatttcagatgaatttgatagcaaattgcaacacacattccggctgattggccaggcgggcgagcggcgcctgccttgggcgagcctggatggtgggaaacgatatttcctcgcgtatccacacatgcagcttggatatatatttttacctatgctgcatctgtgggtgcagagtcaatatggctttacacagttaaccaaacaagggatattgcttggtcaacgcacncggtcagtctggatggactcgtgcgttcagtctggatggacgtgtacagtataccaatcaggtggattgtgtagatttggttgcaccaagagtccaagccgctgatccttcgtcagtcccgattaaatctctcgctagtcaaaattgaacaaaagcagcagatttaatcccctccgattcagatgcaaccaaatagggcccgggtgggcttttgctgtttttgacaaggaacaggagtaggatgtgttcttatattgaaataaaatgggatatgatcaatgcacaggcctccaataatagtaacatgatttaagttgcatggcgggccgaccaatcaactcgactacatcacgcaatgaacgccagaaactaaaattcctaactgcatgtccaatacccctttggttttatctaccaagtatccctacatgattgtttaacagccaaacggaccgttgcctacttttcatcccaaaacaacatatgggtgacaaacacgaaaaaagggctacagtactgctacctatacaaaaactcctgtggtcaagaaaccagatatacaagactttacacagcggagaggtgttcgcccgactaggattttcctgctcgttgcggtttcatgctcgctctccgggctacatcccacggcttgtgtggcacgccgatgccttgctgcgaggcgaagaacgactcgtatcctggggagtcgaaggcaaagccagtgtgctttgatgactcccgtgggagcatcgagatcatgtagcttctcgcttcctctgggcttaggtggctggtctctggtagtggcaccctgctgtactcgtgtggctcatccttgtgttgctcctgtattatttggtagtcgtaggggaagagccacctttggatcctgagaacacagggtcagagatggttgacatggtcaggcaaaaaagctgaacttgtcgtaataattccacagaaatcaggtatcttacgatagatataggaaatccccaaacagggcgatgatcggaacaagtccgattgtcagatagaagaaaaaggtgctcatcagaacataaatcacaaaatacacattttcctgtctgtcaaatgacgtcattattgcagagtatatgaaaataaacataaaccaggccactatactgcccgccacacttatgtaatgccacctcgttatagagttgcatgccatgagaaggcggagattcacagtcaccacgacacaagtaaatgccatggtgctaacatcccataggccaagaatcttgccagatgaaccctgaccatgccgacttgcagctgcagtgaagtagaagaacactattgactgatagaaggcaaagaaaccccacactgcaatcactctccacttgaagaatgaattcctgatgccttccttgtaaagctgtgggtatttttttgacagtgacgcgctaacatccttatcaaacaatccaactataattacaggtagcgcagtaaaaataacgttatatagagactgaaaccagtcatcataaaaccgctggccagaaaaaccagtttgaaaagtgaaccagaactgagttagtgtaaatgtcagattcttgtagaagaagtatgtgataaccttgcacagtctcaagtaagaccatcgtccatgtacaagaagcaaatcagtaagaaaacgaaactgtgcaatggcaaagtcactagccataacagcttgcattccttcttggccactgatgccaatcccaacatgagcagcttgaatcatactcacatcattagcaccgtcaccaatgctgagagttattttctgagcgcccttcctaactaaacttgtaacctgtgccttttgcagcggagaaactcggcagcatacaactgagtggcaacttagactcaatccaagaagatcaacacgaagagttgggtccagtgcatacatcaggcatctaccatcaataatgagagccaacttcctttcaggggtgctaattaaagaatgccgggctgcctcgtgaaatcttttcagattctgttttactgaatcgttaataacacgtgcaatttccacagggtcaccccggtcttcagcctccctaatagcgcctgtctctgaactaatgatgaactgtttggtgtcattgtttaccaagct

SEQ ID NO: 1360 - DNA, 1115 bp, Zea mays
cattgggtacctcgaggccggccggctggccacacgctatcggctatcctctcccctctatccttttcttcacttcgctccgtccccccacactgtcactgccagcctccccttcgcttcgcttagctcgccgtcaccatggcgacctccaccttctctccgcgccccgccaccctcaagcccctgcgggcacgcgccaagcccgccggcctccagctccacctcctccccttcccgcgcctccgcgtcgcctgcgccaccgccgccggggaggcgccgcccgttgagcagcgggacgaggtggagccggcctctgccgcggcatccaacgggactgccgttaaggtcgaggcgtccgccgcgaagcccgagtccccgcccgcgcccgcgccggtcccggccttccgcgacgccaggtgggtcaacggcacctgggacctcaccaagttcgacaagggcggcggcgtcgactgggacgccgtcatcgacgccgaggccaggagaaggaaatggctcgaagactacccggaggcgacgagcacagacgatgccgtcgtcttcgacacctccattatcccgtggtgggcatggatgaagcggttccaccttcctgaagccgagaagctaaacggtcgggccgccatggttggcttcttcatggcctacttcgtggacagcttgacgggcgtgggcctcgtcgaccagatgggcaacttcttctgcaagacgctgctgttcgtcgccgtcgccggcgtgctgctggtcaggaagaacgaggacgtggagtcgctcaagaagctcatcgacgagactacgttctacgacaggcagtggcaggctacctggcaagatgaccccaccgaggggccaaagaattagttccgcgttgggggtgccaacgcagaatgctcgcttcttgtggtgtgtcttgcctatttcttcggcccctttttgtttcaccgtttagtcaggcttggaggaactttttgatgatcgtcataatctatctatctacgtgatcttgtgcaaaaacaaaaagtagatatggactcactttctgtgctggagataataatcaccttgcagttccaaaaaaaagtcgacgcggccgcgat

SEQ ID NO: 1361 - DNA, 1108 bp, Zea mays
ctggccacacgctatcggctatcctctcccctctatccttttcttcacttcgctccgtcccccacacactgtcactgccagcctccccttcgcttcgcttagctcgccgtcaccatggcgacctccaccttctctccgcgccccgccaccctcaagcccctgcgggcacgcgccaagcccgccggcctccagctccacctcctccccttcccgcgcctccgcgtcgcctgcgccaccgccgccggggaggcgccgcccgttgagcagcgggacgaggtggagccggcctccgccgcggcatccaacgggactgccgtcaaggtcgaggcgcccgccgcgaagcccgagtccccgcccgcgcccgcgcccgcgcccgcgccggtcccggccttccgcgacgccaggtgggtcaacggcacctgggacctcaccaagttcgacaagggcggcggcgtcgactgggacgccgtcatcgacgccgaggccaggagaaggaaatggctcgaagactacccggaggcgacgagcacagacgatgccgtcgtcttcgacacctccattatcccgtggtgggcatggatgaagcggttccaccttcctgaagccgagaagctaaacggtcgcgccgccatggttggcttcttcatggcctacttcgtggacagcttgacgggcgtgggcctcgtcgaccagatgggcaacttcttctgcaagacgctgctgttcgtcgccgtcgccggcgtgctgctggtcaggaagaacgaggacgtggagtcgctcaagaagctcatcgacgagactacgttttacgataggcagtggcaggctacctggcaagatgaccccaccgaggggccaaagaattagttccgcgttgggggtgccaacgcagaatgctcgcttcttgtggtgtgtcttgcctatttcttcggcccctttttgtttcaccgtttagtcaggcttggaggaactttttgatgatcgtcataatctatctatctacgtgatcttgtgcaaaaacaaaagatatggactcactttctgtgctggagataataagcacgccgcagtttccctggtttaaaaaaaaaggccccccccccccccc

SEQ ID NO: 1362 - DNA, 3219 bp, Zea mays
gttaatggaaaatgggttcagcctcgattccgaaaagaaaattggtatatgtgtgcatcctccactctgcatcagcatccattttagttctcatctgttttgaccccccggtcggtgcaaatatatgttggtcatgcatgcagtgctgctgtggctgctggtggcggtgagcgtgaagctggggcggccgcacctggcgcggagagccgtggagctgatggagcagcggctggccaaggacgacttccccgagtactacgacggcaaggccgggcggtacgtggggaagcaggcgcgcaagttccagacgtggtccgtggccggctacctggtggccaagatgctcctggacgacccctctcacctgcgaatcgtggcgctggagggcgacagccactccagggcccccttcctcaagcgctccaactcgtgcccatgacccccaggccccagcacagcacaggccgcatgcattacctttccacgcaccagtttgcccacaccgagactacgagagtaaaaagtttcgtttcgatgcagtgcattcttcttactacataagtatgtataatcaagcggtagtagtgtgatgtgctaccaagaggaggatgacagggacaggataccgagtatgtatgtactgtctccatttgccagatcagatgccactaaactggttaacattttggaatgtcaggggctcacggctagcaatgcgtctggtagctgaggaaatgtaaaaactccatgtgctgatatactgtttcttagacctgacggcatgcggtcctggtgctgataaaaagctattgatattcaccatcttcatgttagcttctgtagctgctggagaagtacacgctggacaggaccggccctgccgccctggtggctacttctccagctggaccccggcctggccctgctggccacacgctatcggctatcctctcccctctatccttttcttcactccccccacacactgtcactgccagcctccccttcgcttcgcttagctcgccgtcaccatggcgacctccaccttctctccgcgccccgccaccctcaagcccctgcgggcacgcgccaagcccgccggcctccagctccacctcctccccttcccgcgcctccgcgtcgcctgcgccaccgccgccggggaggcgccgcccgttgagcagcgggacgaggtggagccggcctccgccgcggcatccaacgggactgccgttaaggtcgaggcgtccgccgcgaagcccgagtccccgcccgcgcccgcgccggtcccggacttccgcgatcccggccttccgcgacgccaggtgggtcaacggcacctgggacctcaccaagttcgacaagggcggcggcgtcgactgggacgccgtcatcgacgccggtgagggctcctccttcctagtatctctatcctatgtggaaccaggattggattcacatgctggagcgggaattgctgcctgtctgtcatagtgccatcgccatgctaatatgctatcctagattggtggatggctgcggcgtgcgccaccaacctgattttttctgtggttgtagagctttgaaaagtctggtggttcaagatgaatttccagtttaggattaggagaaattaagaaggaatttgacttgctatagatttaaacccacccacccgatcccccgagatgttagctggctggttgggactggggagacgaatacaagagggaagatgagtgaactggctagaaaaacagagtcctgcatgtacaggacacgcaacgcatgtgtaaactcagacatttgttgctttgctacgatgagtgacagatagacaggcaactgatgccaatagctccatctttgtttgattccagaggccaggagaaggaaatggctcgaagactacccggaggcgacgagcacagacgatgccgtcgtcttcgacacctccattatcccgtggtgggcatggatgaagcggttccaccttcctgaagccgagaagctaaacggttctctcaccaagcgcctctctccttttgtcctgtcattttaagctaactgctgcatatgacgggttgctttgaacagcggttggatacgatgtgttcggttccacttcaaaccctagttcttctcgtctgatgcgtgcaggtcgcgccgccatggttggcttcttcatggcctacttcgtggacagcttgacgggcgtgggcctcgtcgaccagatgggcaacttcttctgcaagacgctgctgttcgtcgccgtcgccggcgtgctgctggtcaggaagaacgaggacgtggagtcgctcaagaagctcatcgacgagactacgttctacgacaggcagtggcaggctacctggcaagatgaccccaccgaggggccaaagaattagttcggcgttgggggtgcaaacgcagaatgctcgcttcttgtggtgtgtcttgcctctttcttcggcccctttttgtttcaccgtttagtcaggcttggaggaactttttgatgaacgtcataatctatctaccgtgatcttgtgcaaaaacaaaaggtatgggagtactttctgtgctagagataataatcatgttgcagtttcactggtttatgctttctgtcaacacgcgtcaaggtgctcgtcgaagaagactttgagcaaatcgcaaataatttgatgtcagacatggaattcgctcacatatcgatcaaataaatgccatgtcaaggtactcgtcgaagaagattagtctgaaaccaacctgtgagacacaaagcgaaaaggcatgcctgttgatggttaacttttcacgtactactacttgctttgatctggcatggaattcaagtcaggcatgacacgactgaataaattacatccaatgacgagatttcatttcatcgtaccagagaaaaaacaataacttggcaagtatttttggacgatcgttttgcaagcaacaggaaagatcactagtataaagacaacagctacaaaaaaaaaactaaattaggtgtacaaactactgggcaagacatgcttttgtggcaacagcataacctaactaaacattgagatgattacgattttgcataaggttggtagagattagaggggtgaatggcagtgcaagtcaaagcaaaactattgggttaggaaatcaaaattaagagtaaacttggtaagcatctgattcaattcaagaagc

SEQ ID NO: 1363 - DNA, 1037 bp, Zea mays
gccggccgggctgcggcgcactctcacactctcctctcctgtctatccactttccactccttcactgccctccgtctccctcccctcccccctttgctcgccatggccatggcgacctccaccttctccccgcgtcccgccagcctcaggcccctgcgggcgggcggcaagcccgtcggactcctccccttcccgcgccgcctcgcctgtgccaccgccgccggggaggcgccgcccgtggagcagcgggacaaggcggagccggcccccgccgcggcctccaacggggccgccgtcaagtacgaggccccgccgccgcccgcgccagcgccggtcccggccttccgggacgccaggtgggtcaacggcacctgggacctcgccaagttcgacaagggcagcggcgtcgactgggacgccgtcatcgacgccgaggccaggagaaggagatggctcgaagactatccggaggcgactaacacagacgaggctgtcgtcttcgacacttccattattccatggtgggcttggatgaaacgcttccaccttcccgaagccgagaagctaaatggtcgcgccgccatggtcggcttcttcatggcctacttcgtggacagcttgacgggcgcgggcctcgtcgaccagatgggcaacttcttctgcaagacgctgctgttcgccgccgtcgcaggcgtgctgctggtcaggaaaaacgaggacgtcgagtcgctgaagaagctcgtcgacgagaccacgttctatgacaggcagtggcaggcgacctggcaagatgactccgctgggggaccaaacaactagttcagcgttggggtacaaaaaaattagcttatctatttcctcggccttcttgttttccctgtgtagtgagaacttttttttgtttttgtttttgacaaacgcaatgatctacgtcatgttgtaagattgtatgaaaaataattctgcagtttcagtttttttttaaaaaaaccgataatattcagacatggtaatttattcacatatcgacaaaaaaa

SEQ ID NO: 1364 - DNA, 2268 bp, Zea mays
ttattggtaaaaatataaagacatttaatatcataaatactatagttttgtgcacgaggcccgttcgtgctttttttgtcgttgtttagcacccagttcacgcaagagcgcggcaagttcatacatttgcccatttctgttcttttttacagccatgatacatatcagagaccattaacatgagccaaactgaaaaaaggctccagatttttacatggcaccaacccggcatgctcctgctccttcctatgtacattgggaccaaccaacgggccaagctttcaagcggcagcaaccatggcaatattgcttagttctcccaatgatgcgaactgctgccgccgctaccggaggactgcgccgacggcgagaacaggctgttgagccactgcaaggatggcggcaaccgcctgccactctcttcagcttcagctagctcggcgttgcccggagagcttgccctaccatcacccccgccgttgtcactgccttcacgatccgcatcgacactgacgaaaccaccgtcgccgccgctgcatgagctcttgtcgtcggtggccggcagctggaaccggcagacagggcaggagctgtgcatctcgagccacggcacgatgcaattgccgtggaacctgtgcctgcagggcatctcgcgggcgcgctcgccggccgcgtagtcctccaggcagaccgggcagctggccgcgtcgtcgccatcgttgccgccggcgatttccacggtcggcattgcctccacggcctccttcttggccggcggcgttccgtgccgcgccgcatcgttctcggcgagctgctgtaccaaggcgtcgaggctggggccgaggaagtagtcgcccagcgccacgccatgctcgccgccagctgcgccgatgaagaggctccggccgaacggggtcagctggtcgccttcgagggcgacgccggcagcggactccagccgctgcagctggcggtcccggagctcgtgcaggagccgcaggaacgcggtgacgcgccgccggcgcagcgagaactcggggtcgttccagtcgtagacgtcgctggcggcctcctgctgccgccggttgcggcggcgacgggcggagctgtcgaccgtgctgaggatagcgtgcgcccagatggagctcgggcggtcggcgccggggtgcacctgagccaccgcgccgtcgccgtcaccgtcgtcggtcgcggccccgcgggcggtctccatctcctcgaggaagccgctgtggcagaacgggcacttcatctccacctcgccctccgcggggctaacggccgcggcgcacatgtggcaccagtaccttccggcgcccgcctgctccgccattgctgctgagcttctagcgctttaatttccccgccaatgcagctactctagtaattgtttgttggggggtgggggaactcagctgcgacaaacaaatcgacaaggaaagatcagagtgctgacgctacaatccatcgtggatgtgcatgacgtcccactgaatgcagcaatcatctggcacggcagatcgaaccatttgcgtgctcttgtgatggagcagacagaccagacgcggcttcgtcgaaagctcgtgtaaatcaaaagactaggagcaaggccaaccaccaggcatccaacgcgcgattcaatcaggaaaacaacttacagatggatccacagatagcaggcacatacgctcccaatctggcggcgataagatacgagtaggcgcacagaacagatggatccacaagctgagtctcagcttttggatctcagcaaagcaaggggaaagcatgaaacgaagcaagcaagcaaccaaccaaccaaccaatcaatcaatcaccttgggcagggcggggcggggcggaggcagggcatgtgggtggggacggggaggaagggggagcagcgaggccagaggggccggctgtctccgcctgctttatactagtactatcaatctccgcggcagcggcggcatcctcctccctgcatcgaccatggcctcggcccggcacacatgtttaggggcagtgattaggaggggccctgcctgctcaattattgcgctggacttctaattttaagttttcccccacctgatttcctcctcgccctcgaacgctcgctcggctcggctaataaaagtttcagcggtggtggcagtttcgctttccggccagcccagaaatagatggtccccaaaaggaagagaaaaacggggaaaagggaggcgcttggtgcctcgctgatca

SEQ ID NO: 1365 - DNA, 1711 bp, Zea mays
gggtccgattaggacgtgtagtcgtcctgattcagtttcttcgtcgagtccaaggatataggccccccctcgtcacgcaagaggcaagttcatatacttgccaatttttgttctttttatagccatgacaactatatcagagagaacgttacatgagccaaattgacacactgaaaaaaaggctccaaattttcatgccggcatgctcctgctcttcctatgtacattggcaccaatgggctcaagcagcaacaatcatccatccttatattgcattattgctcaattctcccaatgatgcgaactgccgctgccgctaccggaggactgcgccgatggcgagaacaggctgttgagccactgcaaggatggcggcaaccggctgccgttctcttcggcttcggctggctccgcattgcctggaatacttgccctaccatcaccgccgccgttgtcattgccttcaccatccgcatcgacactgacaaaaccaccgtcgccgctgctgcatgagcccttgtcgtcggtggccggcagctggaaccggcagacagggcaggagctgtgcatctcgagccacggaacgatgcaattggagtggaacctgtgcctgcagggcatctcccgagcgcgctcgccggccgcgtagtcctccaggcagacggggcagctggccgtgtcgtcatcgttgccattgccaccggcgatttccacggtcggcattgcctccacggcctccttcttggccggcggcgtcccgtgccgtcccgcgtcgttctcggcgagctgctgcaccagagcgtcgaggctggggccgaggaagtagtcgcccagcgccacgccatgctcgccgccgccagctgcgccgatgaagaggctccggccgaaaggggtcagctggtcgccttcgagggcgaccccggcagcagcctccagccgctgcagctggcggtcccggagctcgtgcaggagccgcaggaacgcggtgacgcgacgccggcgcagggcgaactcggggtcgttcccgtcgtagacgtcgccggcggcctccgtctgccgccggttgcggcggcggcggacggagctgtcgaccgtgctgaggatagcgtgcgcccagatggagctcgggcggtcggcgccggggtacacttgagccaccgcgccgtcaccgtcgccgtcatcggccgcgggcgtgccgcggacggtctccatctcctcaaggaagccgctgtggcaatgcgggcacttcacctccgcctcgccctccgcggggctcacgaccgcggcgcacatgtggcaccagtaccttccggcgcctgcctgctccgccatttctgctgagcttcttgcgctttccccgccaatgcagctactctaattgtctgtgcggagattcagctgcttgggcgcagcagggcagggcagggccgggcgggggcagcgcatgtggggggaggaaggggggaggagcagcgaggccagaggggccggcggtctccgcccgctttatattatcaatctccgcagctacggcggcatcctcctccgtgcatcgattgtgacctcggcccggcacacatgtgtttagggcagtgattaggaggggcctgccgccgcctgctcaattattgcgctggacttctaattttaagcttcctccacctgatttcccctcgctctcgagcgctcgctttccggccagcccagaaat

SEQ ID NO: 1366 - DNA, 1589 bp, Zea mays
tggtatttttcagagatactatagttttgttaataagaaccaaaattgagtagtaaagacgatgattagcacccagttcacgcaagagcgcggcaagttcatacatttgcccatttctgttcttttttacagccatgatacatatcagagaccattaacatgagccaaactgaaaaaaggctccagatttttacatggcaccaacccggcatgctcctgctccttcctatgtacattgggaccaaccaacgggccaagctttcaagcggcagcaaccatggcaatattgcttagttctcccaatgatgcgaactgctgccgccgctaccggaggactgcgccgacggcgagaacaggctgttgagccactgcaaggatggcggcaaccgcctgccactctcttcagcttcagctagctcggcgttgcccggagagcttgccctaccatcacccccgccgttgtcactgccttcacgatccgcatcgacactgacgaaaccaccgtcgccgccgctgcatgagctcttgtcgtcggtggccggcagctggaaccggcagacagggcaggagctgtgcatctcgagccacggcacgatgcaattgccgtggaacctgtgcctgcagggcatctcgcgggcgcgctcgccggccgcgtagtcctccaggcagaccgggcagctggccgcgtcgtcgccatcgttgccgccggcgatttccacggtcggcattgcctccacggcctccttcttggccggcggcgttccgtgccgcgccgcatcgttctcggcgagctgctgtaccaaggcgtcgaggctggggccgaggaagtagtcgcccagcgccacgccatgctcgccgccagctgcgccgatgaagaggctccggccgaacggggtcagctggtcgccttcgagggcgacgccggcagcggactccagccgctgcagctggcggtcccggagctcgtgcaggagccgcaggaacgcggtgacgcgccgccggcgcagcgagaactcggggtcgttccagtcgtagacgtcgctggcggcctcctgctgccgccggttgcggcggcgacgggcggagctgtcgaccgtgctgaggatagcgtgcgcccagatggagctcgggcggtcggcgccggggtgcacctgagccaccgcgccgtcgccgtcgccgtcaccgtcgtcggtcgcggccccgcgggcggtctccatctcctcgaggaagccgctgtggcagaacgggcacttcatctccacctcgccctccgcggggctaacggccgcggcgcacatgtggcaccagtaccttccgacgcccgcctgctccgccattgctgctgagcttctagcgctttaatttccccgccaatgcagctactctagtaattgtttgttggggggtgggggaactcagcttgggcagggcggggcggggcggaggcagggcatgtgggtggggacggggaggaagggggagcagcgaggccagaggggccggctgtctccgcctgctttatactagtgattaggccagagcagcggcagcatcctcctccctgcatcgatcatggcctcggcccggct

SEQ ID NO: 1367 - DNA, 905 bp, Zea mays
  misc_feature (891)..(891): n is a, c, g, or t
agtgcgtcgaggctggggcggaggaagtagtcgcccagcgccacgccatgctcgccgccgccagctgcgccgatgaagaggctccggccgaaaggggtcagctggtcgccttcgagggcgaccccggcagcagcctccagccgctgcagctggcggtcccggagctcgtgcaggagccgcaggaacgcggtgacgcgacgccggcgcagggcgaactcggggtcgttcccgtcgtagacgtcgccggcggcctccgtctgccgccggttgcggcggcggcggacggagctgtcgaccgtgctgaggatagcgtgcgcccagatggagctcgggcggtcggcgccggggtacacttgagccaccgcgccgtcaccgtcgccgtcatcggccgcgggcgtgccgcggacggtctccatctcctcaaggaagccgctgtggcaatgcgggcacttcacctccgcctcgccctccgcggggctcacgaccgcggcgcacatgtggcaccagtaccttccggcgcctgcctgctccgccatttctgctgagcttcttgcgctttccccgccaatgcagctactctaattgtctgtgcggagattcagcttgggcgcagcagggcagggcagggcagggcagggccgggcgggggcagcgcatgtgggggaggaggaagggggaggagcagcgaggccagaggggccggcggtctccgcccgctttatattatcaatctccgcagctacggcggcatcctcctccgtgcatcgattgtgacctcggcccggcacacatgtgtttagggcagtgattaggaggggcctgccgcctgcctgctcaattattgcgctggacttctaattttaagcttcctccacctgatttcccctcgtntcgagcgtcgctaa

SEQ ID NO: 1368 - DNA, 3199 bp, Zea mays
ggccgcgggaattcgattttagatctagagcagcagcagctaccgcagcccctgccatggcgccgagctccccgtcacccgccgcgcccacgcgcgcctccggccgggagcgcgccgccatggccgaggagatccaccagaaccaggaggaggaggaggaggtcgcggcggcgtcctccgccaagcgcagccgcaaggcggcgtcttccgggaagaagcccaagccgccccccaagcaggccaagccggccgtggcggggaggaagaagaagggggaggccgagatgacggagcccgtggtggacgacgtgtgcgccgaggagcccgacgaggaggagttggccatgggcgaggaggaggcggaggccgaggagcaggccatgcaggaggtggtggccgcggtcgcggccgggtcgcccgggaagaagagggtggggagaaggagcgccgccgccgccgctggcgaccacgtgcccgagttcatcggcagccccgttgccgcggccgaggcgcgcagcaactggcccaagcgctacggccgcagcactgccgcaaagaaaccggaggaggacgatgagctcaaggccaggtgccactaccggagcgctaaggtggacaacgtcgtctactgcctcggggatgacgtctatgtcaaggctggagaaaacgaggctgattacattggtcgcattactgaattttttgagggcactgatcgatgccactattttacttgccgttggttcttccgtgcagaggacacggtcatcaattcgttggtgtcgattaatgttgatggccacaagcatgaccctagacgtgtttttctttccgaggaaaagaatgacaatgtgcttgattgcatcatctccaaggtcaagatagtccatgttgatccaaatatggatccaaaagctaaggcccaactgatagaacattgtgacctatactatgacatgtcttactctgttgcatattctacatttgctaatatctcgtctgaaaatgggcagtcaggcagtgataccgcttcgggtatttcttctgatgatgcgggtctggagacgtcatctagtatgccagcgaggacagcaacccttcttgacctgtattcgggctgtgggggcatgtccactggtctttgcttgggtgctgctctttctggcctgaaacttgaaactcgatgggctgttgatctcaacagttttgcgtgccaaagtttaaaatacaatcatccacagactgaggtgcgaaatgagaaagccgatgagtttcttgccctccttaaggaatgggcagtcctatgcgaaaaatatgtccatcaagacgtggattcgaatttagcaggctcagaggatcaagcggatgctgacagccctcttgacaaggacgaatttgttgtacagaagcttgtcgggatacgctatggtggcactgcccggcgaatcggcgcagattttaaggtccagtgggaaggatacggccctgacgaggatacatgggaaccgattgataacttgagtgactgcccgcagaaaattagagattttgtacaagaagggcacaaaagaaagattctcccactgcctggtgatgttgatgtcatttgtggaggcccaccatgccaaggtatcagtgggtttaatcggtacagaaaccgtgatgagccactcaaagatgagaaaaacaaacaaatggtgactttcatggatattgtggcgtacttgaagcccaagtatgttctcatggaaaatgtggtggacatactcaaatttgcggatggttacctaggaaaatatgctttgagctgccttgttgctatgaagtaccaagcgcggcttggaatgatggtggctggttgctatggtctgccacagttcaggatgcgtgtgttcctctggggtgctctttcttccatggtgctccctaagtatcctctgcccacctatgatgttgtagtacgtggaggagcccctaatgccttttcgcaatgtatggttgcatatgacgagacacaaaaaccatccctgaagaaagccttgcttcttggcgatgcaatttcagatttaccaaaggttcaaaatcaccagcctaacgatgtgatggagtatggtggttcccccaagaccgaattccagcgctacattcgactcagtcgtaaagacatgttggattggtccttcggtgagggggctggtccagatgaaggcaagctcttggatcaccagcctttacggcttaacaacgatgattatgagcgggttcaacagattcctgtcaagaagggagccaacttccgcgacctaaagggcgtgagggttggagcaaacaatattgttgagtgggatccagaaatcgagcgtgtgaaactttcatctgggaaaccactggttcctgactatgcaatgtcattcatcaagggcaaatcactcaagccgtttgggcgcctgtggtgggacgagacagttcctacagttgtaaccagagcagagcctcacaaccaggttataattcatccgactcaagcaagggtcctcactatccgggagaacgcaaggttacagggcttccccgattactaccgattgtttggcccgatcaaggagaagtacattcaagtcgggaacgcagtggctgtccctgttgcccgggcactgggctactgtctggggcaagcctacctgggtgaatctgaggggagtgaccctctgtaccagctgcctccaagtttcacctctgttggaggacgcactgcggggcaggcgagggcctctcctgttggcacccctgcaggggaggtagttgagcagtaaaaggatgacagatctgagctgagctgggcaacatccagcggcaggagcatttctggttcggatttcgattcgagcccatccagtagcatgtttaccaataaataatcattggtcgtgctgattcttatggttggagatgaatgtatgtagggtgtactcgagctcgagtgcttgttgtactgtagggtgaggtttctcatccattggcctgcctatctgtggtggaccgtcctcctcagattggcaatgtgcttatttaaggtttcgtcatgtacctgtattctacaatccactattgtttccaaagacagcatttgatccttgttcaaaactgtaaaaaaaaaaaaacagtgcccgaaaagccgcaaaaaaaaaaaaaaaaaaaa

SEQ ID NO: 1369 - DNA, 3332 bp, Zea mays
cttgcatgcctgcagaaggctccgcgccgtaaaaaattggacgttcccgctccctccatctttttggttcgggtttcgttttcccactgccgctcccgcctcctctctgccctgtttccacatttgaccgatcctcttcgattcgatttctacacccccagagcttgccaaaccccgccccccccaacccgagtgtgcagctagagcagcagcagctaccgcatcccttgccatggcgccaagctccccgtcatccgctaggcccacgcgcgcctccggccggaagcgctccgccatggccgaggagatccaccagaaccaggaggaggaggaggaggttgtggctgcgtccaccgccaagcgcagacgcaaggcggcgtcttccgggaagaagcccaagccgacgcccaagcaggccaaaccggccgtggcggggatgaagaagaagggggagaccgagaagacggagcccgttgtggacgacgtgtgcgccgaggagcccgacgaggaggagttggccatgggcgaggaggaggcggaggccgaggagcaggccatgcaggaggtggtggccgcggtcgcggccgggtcgcccggtaagaagagggtggggagaaggagcgccgccgcctcgggcgaccacgtgcccgagttcatcggcagccccgttgctgcggccgaggcgcacagcaactggcccaagcgctacgagcgcagcactgccgcaaataaaccggaggaggacgatgagctcaaggccaggtgccactaccggagcgctaaggtggacaacattgtctactgcctcggggatgacgtttatgtcaaggctggagaaaatgaggctgattacattggtcgcattactgaattttttgagggcactgatcgatgccactattttacttgccgttggtttttccgtgcagaggacacggtcatcaattcgttggtgtcgattaatgttgatggccacaagcatgaccctagacgtgtttttctttccgaggaaaagaatgacaatgtgcttgattgcatcatctccaaggtcaagatagtccatgttgatccaaatatggatccaaaagctaaggcccaactgatagaacattgtgacctatactatgacatgtcttactctgttgcatattctacatttgctaatatctcatcagaaaatgggcagtcaggcagtgaaaccgcttcgggtatttcttctgatgatgcgggtttggagacgtcatctaatatgccagagaggacagcaacccttcttgacttgtattcgggctgtgggggcatgtccactggtctttgcttgggtgctgctctttctggcctgaaacttgaaactcgatgggctgttgatcttaacagttttgcgtgccaaagtttaaaatacaatcatccacagactgaggtgcgaaatgagaaagctgatgagtttcttgctctccttaaggaatgggcagtcttatgtgaaaaatatgttcatcaagacgtggattcgaatttagcaggttcagaggatcaagaggatgctgacactcttgacaaggatgaatttgttgtacagaagcttattggaatacgctatgatggcactggaaggaaaaaaggcgtatattttaaggtccaatgggaaggatatggtcctgaagaggatacatgggaacctattgataacctgagtgactgtccgctgaaaattagagaatttgtacaagaagggcgcaaaagaaaaattctcccgcttcctggtgatgttgatgtcatttgtggaggcccaccatgtcaaggtataagtgggtttaatcggttcaggaaccgtgatgagccacttaaagatgagaaaaacaagcaaatggtgactttcatggatattgtggcatacttgaagcccaagtatgttctcatggaaaatgttgtggacatactgaaatttgctgatggctacctaggaaaatatgctttgagctgcctagttgctatgaagtaccaagcacgccttggaatgatggtggcaggctgctatggtctgccacagttcaggatgcgtgtgttcctctggggtgctctttcttccatggtgctccctaagtatcctctgcctacatatgacgttgtagtacgtggaggagcacctaatgccttttcgcaatgtatggttgcatatgatgagacacaaaggccatccctgaagaaagctttgcttcttggtgatgcattttcagatttaccaaaggtcgaaaaccatcaacctaacgatgtaatggagtatggtggttcccccaagacagagttccagcgctacattcgacttggtcgtaaagacatgttggattggtcgtttggtgaggaggctggtccagatgaaggcaagctcttggatcaccagcccttacggcttaacaatgatgattatgagcgggttaagcaaattcctgtcaagaagggagccaacttccgtgacctaaagggtgtcaaggttggagcaaataatgttgttgagtgggatccagaagtcgaacgtgtgtacctttcgtctgggaaaccactggttcctgactatgcgatgtcattcatcaagggcaaatcactcaagccattcgggcgcctgtggtgggacgagacggttcctacagttgtgaccagagcagagcctcataaccaggttatattgcatccgactcaagcaagagtcttgactatccgggagaacgcaaggttacagggcttccccgattactaccgattgtttggaccgatcaaggagaagtatattcaagtcgggaacgcagtggcagtccctgttgcacgggcactgggctactgtctgggtcaagcctacctgggtgaatctgacgggagtcagcctctgtaccagctgcctgcaagttttacctctgtggggcgaaccgcggttcaggcgaatgccgtttctgttggcactcctgcgggggaggtagtcgagcagtaaaaggatagcggagcaaccctggttggtattttgattcgagcccatccagtagcatgtttaccaataaataatcattggtcgtgctgattcttatggttggagatgaatgtatgtagggtgtactcgagctcgagtgcttgttgtactgtaggttgaggtttctcatccattggcctgcctatttgtggatgacgtttcatttcagattagcaatgtgcttatttaaggtttcgtcatgtacctgtattctacaatccactattgtttccaaagacagcatttgatccttgaaaaaaactgtaaaaaaaaaaaaacagtgcccgaaaagccgcaaaaaaaaaaaaaaaaaaaa

SEQ ID NO: 1370 - DNA, 3206 bp, Zea mays
agagcagcagcagctaccgcagcccctgccatggcgccgagctccccgtcacccgccgcgcctacacgcgtctctgggcggaagcgcgccgccaaggccgaggagatccaccagaacaaggaggaggaggaggaggtcgcggcggcgtcctccgccaagcgcagccgcaaggcggcatcttccgggaagaagcccaagtcgccccccaagcaggccaagccggggaggaagaagaagggggatgccgagatgaaggagcccgtggaggacgacgtgtgcgccgaggagcccgacgaggaggagttggccatgggcgaggaggaggccgaggagcaggccatgcaggaggaggtggttgcggtcgcggcggggtcacccgggaagaagagggtggggagaaggaacgccgccgccgccgctggcgaccacgagccggagttcatcggcagccctgttgccgcggacgaggcgcgcagcaactggcccaagcgctacggccgcagcactgccgcaaagaaaccggatgaggaggaagagctcaaggccagatgtcactaccggagcgctaaggtggacaacgtcgtctactgcctcggggatgacgtctatgtcaaggctggagaaaacgaggcagattacattggccgcattactgaattttttgaggggactgaccagtgtcactattttacttgccgttggttcttccgagcagaggacacggttatcaattctttggtgtccataagtgtggatggccacaagcatgaccctagacgtgtttttctttctgaggaaaagaacgacaatgtgcttgattgcattatctccaaggtcaagatagtccatgttgatccaaatatggatccaaaagccaaggctcagctgatagagacttgcgacctttactatgacatgtcttactctgttgcatattctacatttgctaatatctcgtctgaaaatgggcagtcaggcagtgataccgcttcgggtatttcttctgatgatgtggatctggagacgtcatctagtatgccaacgaggacagcaacccttcttgatctgtattctggctgtgggggcatgtctactggtctttgcttgggtgcagctctttctggcttgaaacttgaaactcgatgggctgttgatttcaacagttttgcgtgccaaagtttaaaatataatcatccacagactgaggtgcgaaatgagaaagccgatgagtttcttgccctccttaaggaatgggcagttctatgcaaaaaatatgtccaagatgtggattcaaatttagcaagctcagaggatcaagcggatgaagacagccctcttgacaaggacgaatttgttgtagagaagcttgtcgggatatgttatggtggcagtgacagggaaaatggcatctattttaaggtccagtgggaaggatacggccctgaggaggatacatgggaaccgattgataacttgagtgactgcccgcagaaaattagagaatttgtacaagaagggcacaaaagaaagattctcccactgcctggtgatgttgatgtcatttgtggaggcccaccatgccaaggtatcagtgggtttaatcggtacagaaaccgtgatgagccactcaaagatgagaaaaacaaacaaatggtgactttcatggatattgtggcgtacttgaagcccaagtatgttctcatggaaaatgtggtggacatactcaaatttgcggatggttacctaggaaaatatgctttgagctgccttgttgctatgaagtaccaagcgcggcttggaatgatggtggctggttgctatggtctgccacagttcaggatgcgtgtgttcctctggggtgctctttcttccatggtgctccctaagtatcctctgcccacctatgatgttgtagtacgtggaggagcccctaatgccttttcgcaatgtatggttgcatatgacgagacacaaaaaccatccctgaaaaaagccttgcttcttggcgatgcaatttcagatttaccaaaggttcaaaatcaccagcctaacgatgtgatggagtatggtggttcccccaagaccgaattccagcgctacattcgactcagtcgtaaagacatgttggattggtccttcggtgagggggctggtccagatgaaggcaagctcttggatcaccagcctttacggcttaacaacgatgattatgagcgggttcaacagattcctgtcaagaagggagccaacttccgcgacctaaagggcgtgagggttggagcaaacaatattgttgagtgggatccagaaatcgagcgtgtgaaactttcatctgggaaaccactggttcctgactatgcaatgtcattcatcaagggcaaatcactcaagccgtttgggcgcctgtggtgggacgagacagttcctacagttgtaaccagagcagagcctcacaaccaggttataattcatccgactcaagcaagggtcctcactatccgggagaacgcaaggttacagggcttccccgattactaccgattgtttggcccgatcaaggagaagtacattcaagtcgggaacgcagtggctgtccctgttgcccgggcactgggctactgtctggggcaagcctacctgggtgaatctgaggggagtgaccctctgtaccagctgcctccaagtttcacctctgttggaggacgcactgcggggcaggcgagggcctctcctgttggcacccctgcaggggaggtagttgagcagtaaaaggatgacagatctgagctgagctgggcaacatccagcggcaggagcatttctggttcggttcgattcgggctcacgagcgcattgtgctgattcgcagggtgcactcgagctcgagtgcggagttgttgtaatgtaggttgaggtttcaaaacatccatccatccatcggccccgcctatttgtggatggtgtttctcgtgccattttagttcagctgtattgatgcttcgtcatgtatgtgtattgtaccattcgttcttgttacctactggtaaggcaacatttaatccatgttcaacgcgagcaaattttcatccactttaggtactgagatgctcaagtagttcagtcatcaggtactgtaacatttacaacctattattttgcctggtattatctaaaaacgatttgctgaaaaaaaaaaaaaaaaaaaa

SEQ ID NO: 1371 - DNA, 1074 bp, Zea mays
ctgagccctacgggcacctctccgttcaggagcaaagccaaaaacatcatccccctcgccaagaaagaaggcagacgaaggcaaaccctagccaacgcgtacgcctcgccccccgcgcctcctcccccagatccggccgatccgtcgttgccatggcgctgcgagctctcgccggcaagctgagggtcctcccttcacgagcggcggcctctcgctccttcgcctcccagatggagaagaaatgcagcaagtgtgctcttgaagagcaggctggatccttctctcaatggttggatgaaaggaagaggcgtgatatggaagagcttgcaaggttcagaaggaagagctacgtgcacaatgtgctagttcttgctggtagtgttggctttgtggcattcacgttgtcatgcgttgctgatgttatagcagatgaaatgaactagggagaaggggaggggagcacggcggcagcaaatgctccatggttggttcttttggcacctatcaattacacaatataaaccaccttccaatcaattacaagagacacagtaacagagatgaggtgatataacacatgtgactctaacttgcttttattttgtgaagctaacttgtgaatttgatgcatgtcaaactaaccacaggaaagtgaaacaaaggaaaattgtttcaaaatgtgaaacaaacttgtaagtaacacaggagaaaatgacacacaaaatgccccaagtagcatgtcaaacataaagggcaaaaattataacctagcacaccagccacaaaacttcaaaaatgctactgcaccacagctctagcaaaagtgccttaccatacacatctactgcacctaaccatgaagaaacgaaaaatcatcatcattttgagttctggccctgcagaagaaaacaggcagaattctacaaggactgaaactccaggccagagaacatcagcaggcaacaaatttcaattccagaattttcttacaagcagaagagtattcaccatatcacatagtggcagaagaattaaagttcaaagttccacctgacttgcacagaactaccgacg

SEQ ID NO: 1372 - DNA, 3116 bp, Zea mays
ctgaaccgagtcggctcactgagtctatgtcaagccaagctttcctttgcagctcgttgagtgggagagccataccaaaccgagctcagcttgatttgttttcagctctaaccaaacaccctctaaccgttctctaagaccgattttaggtcctttgggaaggctcagcttgatttgttttcagctctaaccaaacaccctctaaccgttctctaagaccgattttaggtcctttgggaaggctgtggcttgcttaaaatggctctggtcttttacaagagcagtttcttcagaggagcctatgtctttttataaatcgttcgataaaacaactcttcattttttatttagtatatgagacaaggtaccaagatattgatctcattttagatcggtgtgaagagcaatacattataataaaaatatcatagtgaacaaaacattttatggaacaatattaggaaagtatttatacccacaattcatatatgggtcatacttcattcggtagcatgatggctgctgtcacaccgtcggcccctgcacaaaacgcacaacctattcgtttacctttaattcgtaaagttgttgccacaatccgaacttttccagcattgttcgcggttccagttctcataatttggccaaatcaccccaaaccgaaagatataagaatgcactcgaaatatagtgaagtctaaactcaaaacaatacagtgaagtcacatgtgcacaagaccacaactcgggagttccaaaaaaacagagatcgttgcagtcttgcagatataagttgaatcttgaatgtaccacacacacaatcacgcccacaaacctttgaactcctcttcttatttatacgtggtgggaattactcaacaagaaatcgtaaagtcgccctactgcacagctagctaatcgctaaaactctactactctccacaagataatcacaatgacacacacttcagttcagatcccagaacggcgcgatactcacacatgtctccaccgatctgctactgctaccactaaactctaccaacccctcgtgtctaactctaacctggattacgcctccaacacgcgcgacgatcacagccaggcgactaggcgagcaacgcggcggtgagggccgcgccggcgccggccaccctccacacgcctggcccgcccgcgccacccgctgcggcgctgcggtggccgtgcgatcctcctgcggccgtcctcgcgccaacgccggcggcggctcccgcaccgaccccgccgaggaacgggcgaccggagcggcctcttcccgaccggccgccacctgttcctgacccgccgccgcgtcctcctcctcctccgccaccgcctcctcctcctccgcgaccgccaccgccgccgccgcggcaggatgcaccctggaagtgggtggccacgcatagcagcgtcagcgctagtgcgcagagcagcctcgtcccgtgtctcatcgccgtcgccgatgcggtagctgcgcggggcggcgatgtggagatggggaaagcgcccgtcacgaggccagctgggagagtcgtccttttgcccgtttcggtaggacaggcggcgagagagttttttagcgccatgacgctacgcggcccacggatctacaagttgtcaagttcggtttcgacttcgctagatacgtggacaagtccagcacttcggtttcagttttgattttttttttcacgacttgtaaaacttactacaaataactggtttattatttagttttgaaatctaataaatatgtaccaaattatcttaaaagtacttttacaaaaatataaatatattaagagtttgtgtgtatcgtaacaacaaaatattgggtgagaactatattttaaagcttgtatcggtgttataaacgtcttgtattttgaaatagaagagtacaaacaacttcggtcttatttatttactctccagattatataatccaacttaaataagttaaaagaaaaaacataagttactaggtggattatataatctagatatctagattttaataatccataagcagattattaaatatttatataatctataaattggattatataatcctataaggaaataaaaaggccttctttccatggtatatcttctctattgctataaattatcaattttcaccatcgtggtcagcactttaaaaaaagcttcttaaatttcttagtaatcaacacgtggtgcttacgcttgctggtgttggattaatgtgggcttgaccaaattaatattcaataaagtctatgctaatgttcgttttaatgctacggtgtactaataatttagtaccatactcgaaggtcaagaggcaaatcaatcaacttaaataagtagaccattgacgcgccgccggccgagccggtccgtggtcgaggctgtggcccgtggtaaatcggactttggtccaaatatctctttctaacgcttcacatttttcctggagtgatgatcatccatttcctgtcttatgactagtaatgaacatctcttatgtcacgtcagtttctggctcgctgtaatggttgtcagtttatgactcttatggcgatcgttatgtctgttcccctccctctatgcgtgcataaatacagaggagatggacgcttttctggtcacacgaacagtctctcaaacgcgttgcactcaacccattctcgttacaccttctgcgagcataaagggagagtgggggagcagacctccgaaatcgtcgactgcagagctacacttgcacgggtgtgcgtgcgctcaggtttttggagagcgtactcgtgactgcgcgcttcgttcgctcgaccagcgctgatcaggttcttcgtcgtcggcgccgttcgagggactgcactgcgtacatctgcctgcatcgactgcgtacgactacatcgaacatacacacgagatgtctcgtgcgaatggagccactaatgccttcagcatcggtccctccgcagggtacactctgttcttcgtatttgtgcatgttttacttttgtttactgtttatgtgtgtagtgatacacacatgcacatacatgtcgtcacatacatcatacaggtttctggataaataa

SEQ ID NO: 1373 - DNA, 3343 bp, Zea mays
tgtctaaatattgctgattagagcaagactgaaagtggcatggagaatggaaattatcataaccatatcttggtgcatctggaaatgtagaaataattggatattcaatgatgtaccacccacggtgaaagcctgcaatgagatgttcaagaccgagatgagctacatatgtcaccgggttaagcccggtattggacacaaaattagaagttggatacaacattttgtaacatagttacactctttccccttcccctcgctttgtaaatctgtacatacaatctccaatcaataaaaaatattgtagtcacgccctacggtacatacaatctccaatcaataaaaagaacattggacgcaagatcttctttaataagaactaaaaatatatcgttaagtgtgatacaccataagttaatgtctattgatatcttaatattgagataaacatagtcaaacaaaattcacgtcatttttattttattttataacattaatgtctattgataaacatagtgatacacgattttctattggcaacatatggagatctgcacgtggttcgtcagagagcgagcgatgttgtatgcggggtttgacctggttggcgtcgcaatcgctctgcaatactatatagtgccatcatattggtattagtattagttaggactctaaaccaatgtcatgaatatgatggtttcaatcaaatatgtgatcaccaaggttaaggcacgttgaactagtacatccattcatgcacgtgcccaactgtagattgaagaacaaaaaggaaccaatccacgttgtacttattctcacacaggacgtcctaggtcgtcgatacactttgcatttgcgccgtcaaaggcaacagtaattcaccaaacatgatgggttctatttttttctatgtgtcgatttacgatttctgatgaactcacacttttgacattgatcatgccatattgtctagagaatggttgaatatgaggaggaatgcatgatggaaagatgtggctttattatatatataagtgtgctacttactagttcagaaatatctccactgctaatatatttattgagtttcatatttaggtttccctttaatagctctttgagattttggagaaaaacaaatcaatgattgatttcattgaatttacttgagataagtggacgatgcacgtatcggcacaacagttttattttagttgctagtttgtacaaagatcagttatggtggatatagtttagtgtattgagaccagagttttaaatagacggctataaccttcgctatagcccgtcatagttgttttctcaagggagagatgtgtgatatagcctcatttagcccgctatagcctgttatatcccgatatagtctgttatttgcacttttgagaagcacgccgccaaaccccttagctcgctatttaaaaccatgattgagaccaaaactcgacaaattcttttaatacactaaaattaattaaggtgatggttgcgactactccaatccaccatttttagttgtgctccaccaactccaccattgagttgctccaccatcgaagtttttagagttttcaaactgtttggcttatagggggacttggtgggtggggaatggtttattgtgggtcgaccacgcgtgcttcttgttcgacacgggtgacatgaggagacgatgctttctggaggcgacaacgttgttgattttgttgtctgctcgggattcgtgacccgacacttcttgatcatcgggaccacgatcattgcgacttatatgatattgaggcatctcgagctccatgctaagctgcatggcatccttaacaaccgaagtcaatgtatgcaaggaataaaatgagtttaaagataaaattgtgtgcataggaaagcaaaaaaaaagaaagagagatgtaatgttattttctctcatggctctaaactccaggtttacatatgaaaacaagttttgtggagtacccgtgtttatgttccatcaaaatggtatagttcaccccaacttcacattttttttcaaggaactgagttcttagagttaatatcgtttgacaactaaggctctgtttgcgatagctccagctctaggaaatttggtggagttagtggagcaggtgattaggtactctagaaaatcgtagagttggagttgtaagcctttaaaagacatttatagataagtcatttcatttattatttagattaaaaatatttttaaaactatttaaattgatattataaactacaggtccacactggagttagaacctggagccatcctaaacaccccctagatcgtggagcaggcgtggagtgaagcggtcccaaacaccttgttgctgttttgggcgattcacccaataataaacacaacaaattgtggatgtccaaatttcttcataacggcaataaacgaccgatgggatgttctaacacccacaccttttgtcaaataatcacacctgttgtgtaactggagtggaggatataatgaaaagactatcgaacctacaaatggatcgagtcaccatcgatgtgcacattaaagtaagaaggcaaggttgcatcttctccatgctcataaaaatctcctcatgtaggtggcaaataagttgatatacgagagaagtctaggactgttgtaagacgagattcattggtgtagattacatgaggaacacatgattgtaggcaaacattgaagagctacttcgacgcacgatgcatgaatgatacatagtatctagatgctggcaggtagccaacatggttgtgagggatgccaaccttagaggtacaatgaagacaccacattagtcatctagatatgagtgttaagaacaatcaaaccttagtgtgattctcatacaaacatatatgtaccaacatcaatatggtccaaccaattcacgattccttatatcctattcattttggcttgacacttcctctcatttacttcaatctctatcttcaaaaaagatcacttatccttatatgacttctatctggcttgatatgtcccttgactaaatgcaataacttgcttctccatttgatcagcctttccttaagccatacatcttgagtgtgcattgaatttgttgatgtctaattatcaatgtttgaggttgatcctttatgcatatttctatcatgaacattccatgtatatgagacattttcatatcaatccttgtctcttggttattttcaatcatgattgatttttctactttcctaatcaacactttgcaaactgattagtcctttaagagtgttgttatccaaatcaccaaaatccacaaaa

SEQ ID NO: 1374 - DNA, 4027 bp, Zea mays
  misc_feature (3612)..(3612): n is a, c, g, or t
  misc_feature (3703)..(3704): n is a, c, g, or t
  misc_feature (3899)..(3900): n is a, c, g, or t
  misc_feature (3913)..(3913): n is a, c, g, or t
aaatcatgacaaagaaatgttttgcaccttggtctgctagaaactggagtagcagccactttggacttcttgcatggtagcagcagaaggacgccatgcacaaatccaagcatgcaaactccataggtggaggccatggttgctttactcccctcacaagctttgcaaaaccaggaccaaaacgagcaatgcactcctccatcaaagccacttgttcctgctcccattggtactgcttcatttgatactcttcaagctccaacttagaatccacaacacggccatgcccatggaagtaatttgcaggctgccatccctggaagcaatttgcagtctcctcatcatgggtgatcaacaagccatccttcttaagcaggcgacagaagtcctatcattccacacaagcataaacactcggacaccttctatcagcacactcctcttgagcaactccccaaaggtaacattaccaccaagttttggactgttcgtgtccctgagcaaggtaatctcggtgtccacgatccagctcatgatgtaaattaattcctgagtcttgcctgcagcatcaaggttatccttccagcatctgtgcggctcatacttcttgccaccagtgagcggtatcctggaaacgaagttggccggcacatattgtctgtgctgcatttcatcaagcatcacctgggcatctacctcatcagtagtgaatgatacgccagctaattgaaaggtgcccgcactgcatgcacttggtagcagcaactgatctcttgacggtgaagcgttgcatgccctactgcagtcgaaatcgttggcagaggagcattcgacgtcgccacccacacggcttgccgcgccctccgaggaggcggaccggtgcctggtcaacgtttgcgggctgctgatgtcgtcctgtccagctggccacgacaatggaactcgccagatactcggaaggtcgtcgtcgttgatagagtcgctgccaccgtccacaagtggcccgctcggcagagagcagcggcctgatggtgcgagaggaggcaacaagctcgtgttcggagcgcggaccgagcatctgcagcgtggaggatggcgttcacgggggtgtgcatggacggttgctcgatgtcgaattcggaggtggggaggacgtcgttggtgctgttctggtcctcgtcgagtggagcgttgaagtctacgcgcacgaagacgcgcttccccttgaggtcggcctctgtgaggttctcggcgatcttcgccatggtggccatgcccggcgtgccgcgcgtggaggacgcctgctggcactgcgacgcgacgtggactgtgagcgcgcgtcgcctgcggcgagcaccagcgaccgcaccggctgccactccgtggcgaggtgccagccatagtgcaccctggcgatttcgacggtgagccccaaggtcgaacaggggatgggcctatcgaagttggtgtcgttgggcgtgaggtgagacagcgcaacgccgccgctgccatggacggagctgtctgagctatatgcagtgtcggtggcaatgacctcgccgatgccgtggttgtcgagcacctcgttggggttagtggaggtgacgagcgcttggtagaggcaaagggcgtggcgccgtcgacgatcccagctgcgcacgcatcagcggcgagcacgcgcgccgtgagcacgagttctcgccccgcatcggccccccagttgtcggcgatgatgggctcctcgaagcgctgctcatcggagtcgtcgcctctgccgaagagaccaccccggtcgtcagcgaccacgcccagccactcgtgggtcgcaacaacctgagcgtcgagctccgcgctcaaggtcgtggaaggtgcagtggccgccgctacttccgtgtcgtggatcgacgccgaatgatgcgccactgtcgactcccgaccgtgccaccgcgcttcctgagcagcgagacggtcactaatctcgcgaaggatcttcaactgttcctccatggcggactgtaggttgggctccatggacccctggccccgggtcccttgttatcaattgttagcgacccacttgtattgctcagaagtaatagagttcacagagtattagagaggagaacgagaacgaaaacaggagaaagaggagaaggcttggggaagaagatgctaacataattctctctggatgttttcccccaaaatcaccagatgcttacagcttttaaaccacacaccacggtcacacatggcccacacatagcccagcatgttacaatgtactccacacagcccacactcgtccactgcatccgagctctcctcctgattgtcaccctgattatcggttgtgacatctcggtacctgacagctccgtattgggtggggtgaaccgtacgtatatatacttctcatggtcaagccaagcctgatggttactagctactacgagcacagtccaaaaaagcatgtcggcatgggcacggacgggagcggcaggttttgcctcgtcagccaccatgaagccatagcgacctgctcattcctcaaacgacctgtgccaccacgccgagcttcaacgtccacaacgagctctacaaaatgttccaacagcacaaagcacgacgtcaaacacctggatgcaaaacctgtgtgaacccgctgctgcctcggcctgagctatttccactgacgcaaggcaacgacgatgatctccgcacaatacttatttttcacagctaacaatgtgtctatttccgtgattttgtggttgaattaacgtaggtctgacctaaattaatattcaatgatagtcaatgttaaagactaactttaatgctatagtatactagtattttagtaccataccggaagttcaagagacaattcaatcaatttaaataggtggactatttgtgcatctattgagaagctaagaaaaggatgaaggactgtcatgcgcgcgccgtcggccgggccgtggtagatcggaccttggtccggacgtcactgatggcgtcagtttctggctagctgtaacggtagctttgatagcgactgttattgtccgttggccttcctctatgcgtgtatatatacataggaggtgagactgtttccggtaacgacaacacgtacaaataccgaacactctcagacacattgaccttctgcgagcacagcataggaggtgagactgtttccggtaacgacaacacgtacaaataccgaacactctcagacacattgaccttctgcgagcacagagagtgtgggagagcaggcctccgaaatcgtcgtccgcagagctacacttgcacgggtgtgcgggcgatcaggtttttggggagcgtacttgcgaatgctcgctccgtccgctcgaccaacactaatccatttcttcgtcgtctgcgtctttcgtgtgaccacactacgtacatctgtctgcatcgactgtgtacgactacaccgaatatacatacgagatgtctcatgtgagcgaagccactgatgccttgagcatcggtccctccgcggggtacattttgttcttagtaattgtgcatgttttactattgtttactgcttatgtgattagtgatacatanatgcacaaacatgtcgtcacatacatcactctggttttctggattaaaataaaattgaaaatgcatatttctctttctcctcttttggttnntaggaaacaatggaatgagtgaaggcatcatccttgcaggttatattgtgctcatattgttttgtaactaatctcctaggaatttctctttattgctttaactacattattgctacaatgtccattgttcctaaactggcatatagtttcttaggcctcaaacaaatattttaagatttgttcaggccccagatnntgattttcagatncaacgactggaaacagtatgcatcattaaatgtgtaaactttgattgtttaagaaaggacatgggaagaagttttgattttatacctcaaaactagaatagactccacaacggt

SEQ ID NO: 1375 - DNA, 1095 bp, Zea mays
cgagaggttaagctttgcccacgtcagcggggtgccatggttggtaaccaagagtgcggcgcccggccggggtcctcattcttcaaccgccacacaaacccctcgcttactgcacctttgcagcaccgctctctcgatcgaatcccaaggaacgaagacgacgacgatggcgtcgtctgcctgcttgctccaagcttccacggccttcgctccacgcttctccctcccgtcccgaccccagcccccgctacacctgcgtctccgcggctcccccaaccgtcgccgtggcatctcactcactgcttcctccgccgcgtccccggaagtcgagaaagagtcctcgccctcgtcctcgccgcaggaatctctgtctgctgtcgcggacagtgtgaaggtgctcaaggtggcagccaagacgaggaaagtacctgccccggaaattctctcggcgctgtccaagatcaagaaggcaaaactcgacacgtcggcattctttgagacactcggtggtaccgagtctccaggcaggacgtggatgcttatcttcactgcaaagggtcggctggagaaagggcagtatttcccagtgacagcagtccaacgcttcgatgctgcggggaaacgcatcgagaatggcatatatttgggccccatcgggtgcttgaccttcgaagggaggctgtcatggaaaaagaaaatactcgcgttcatcttcgagcgggttcgcgtcaaggtcggaccgtttggtcccctggaaatcagcctcggaagcggtgacggtggtagggagcccagcacgaaggaccccttcttcgtttggttctacgttgacgaagagatcgctgttgcgcaaggcagaggcgggggcgtagcttactggtgccgatgtcagcgtgtcccctgaggatccagacatcctcatctcgcttccatgatcactgtacaatatcagggtaatgttgagtctctagtttgtagggttcttgttcatctttgtactatctgctttgtctccgaaaacgagaaaaaaaaggcaattggaggtgtaaataatgaaatgctatttgttgataactcaaaaaaaaaaaaaaaaaa

SEQ ID NO: 1376 - DNA, 956 bp, Zea mays
  misc_feature (901)..(901): n is a, c, g, or t
cattgggaccctcgaggccggccgggccccgacgtttgcagccccgctctctcgatcgaatcccaaggaacgaagacgacgacgatggcgtcgtctgcctggttgctccaagcttccacggccttcgctccacgcttctccctcccgtcccgaccccagcccccgctacacctgcgtctccgcggcccccccaaccgtcgccgtggcgtctcactcactgcttcctccgccgcgtccccagaagtcgagaaggagtcctcgccctcgccctcgccctccccgcaggaatctctgtctgctgtcgcggacagtgtgaaggtgctcaaggtggcagccaagacgaggaaagtacctgctccggaaattctctcggcgctgtccaagatcaagaaggcaaaactcgacacgtcggctttctttgagacactcggtggtaccgagtctccaggcaggacgtggatgcttatcttcactgcaaagggtcggctggagaaagggcagtatttcccagtgacagcggtccaacgcttcgatgctgcggggaaacgcatcgagaatggcatatatttgggccccattgggtgcttgaccttcgaagggaggctgtcatggaaaaagagaatacttgcgttcatcttcgagcgggttcgcgtcaaggtcggaccgtttggtcccctggaaatcagcctcggaagcggtgacggtggtagggagcccagcacgaaggaccccttcttcgtttggttctatgttgacgaagagatcgctgttgcgcaaggcagaggcgggggcgtagcttactggtgccgatgtcagcgtgtcccctgaagatcagacatcctcagctcgcttccatgatcactgtacaatatcagggtaatgttgagtctctagtttgtanggttcttggtcatctttgtactatctgctttgtctccgaaaaaaaaaaaaaaaaa

SEQ ID NO: 1377 - DNA, 1055 bp, Zea mays
ggtaccctcatcgttcttcaaccgccacacaaacccctcgcttactgcacatttgcagccccgctctctcgatcgaatcccaaggaacgaagacgacgacgatggcgtcgtctgcctggttgctccaagcttccacggccttcgctccacgcttctccctcccgtcccgaccccagcccccgctacacctgcgtctccgcggcccccccaaccgtcgccgtggcgtctcactcactgcttcctccgccgcgtccccagaagtcgagaaggagtcctcgccctcgccctcgccctccccgcaggaatctctgtctgctgtcgcggacagtgtgaaggtgctcaaggtggcagccaagacgaggaaagtacctgctccggaaattctctcggcgctgtccaagatcaagaaggcaaaactcgacacgtcggcgttctttgagacactcggtggtaccgagtctccaggcaggacgtggatgcttatcttcactgcaaagtgtctgtatatgtagggtcggctggagaaagggcagtatttcccagtgacagcagtccaacgcttcgatgctgcggggaaacgcatcgagaatggcatatatttgggccccatcgggtgcttgaccttcgaagggaggctgtcatggaaaaagaaaatactcgcgttcgtcttcgagcgggttcgcgtcaaggtcggaccgtttggtcccctggaaatcagcctcggaagcggtgacggtggtagggagcccagcacgaaggaccccttcttcgtttggttctacgttgacgaggagatcgctgttgcgcaaggcagaggcgggggcgtagcttactggtgccgatgtcagcgtgtcccctgaagatccagacatcctcatctcgcttcaatgatcactgtacaatatcaggataaatggataatgttgagtctctagtttgtagggttcatgttcatctttgtactatctgctttgtctccgaaaacgagaaaaaaaggcaattggaggtgtaaataatgaaatgctatttgttgataactaaaaaaaaaaaaaaaa

SEQ ID NO: 1378 - DNA, 1831 bp, Zea mays
gcacgagaccattacctagaacatcctaatcgaaaaaaattttcattccaaccttatctcctcctgtccgcccggcgcgccgtgattgtccagccatcctcaggcagcttcgagttccacgacgagagcaccggcagccgcacacgcgtttgtctcctcgccggaccttcccggcaccgccgccggctctccctcacggtccactacactccacagcaccgccgtcgcacaacgacatggcctcctccgctacctatctcatgctcgccagcgcccacgctcccctcgctcctctcataaggccaccgccgatggcccttgtcgcgagaaccgccgcaacctccatcactaggcgcgaaagagccagtgtccctctgttagtcaaccccgctgcgtgccggccgggactgcggcgccgtggctgggcccatatctgcagagactcgtccctccagggcccttcgggcgccgattctcctgctcaggagcaagaggatctgaagaagagcgaggcggtgtcagaggctgcggctcggattgccggaggcactggcgggacgttaagcgactggagcacgtcggtgctcatcttcgggatctgggcgggactcatgtactacgtcttcctgctcgcgcctaaccagacaccataccgagacacatacttcttgcagaaacttttaaatctgaagggcgacgatggctttcgaatgaatgatgttcttgtttctctatggtacattatgggcctctggccactagtctacagtatgttgctccttcctactggtagaagttccaaaagcaagattcctgtgtggccattcctggttctttcatgcatcggaggagcatatgctttgattccttactttgtcttatggaagcctcctccacctcccattgacgaagatgaaattggacaatggccattaaaatttctcgagtcaaagttaactgcaggactagtgtttgccctgggcattggactgatcatatatgctggcaaagctggtggcgacgattggaaggaattcattcgatacttcagggagagcaagtttatccatgccacctgccttgattttactttgctatcagccttctcaccattttgggtctataacgacatgacagcaaggcgatggaaaaatggttcatggcttctgccgcttgcactgataccttttgtggggccctcactgtatcttctactgcgcccatcactttcttccttgctggaagcatctgcttcagcatctgatgagttcaaaaaataattggtatctaactcagaactgatggagaatttggttgtgagcacatgacatgggtagagaaatggttatctggcaactgcatttgttagcccaaatgctatgtcaattgctgatttggaggaaatccacaattttgcatgccacctccctgttcaaaatgaaaggacccaatgagatcctgacaatgaagatattgtcagtattatcatcacctgggtgcctcacaaattttgtcagtgttatatttatgtgtaatccacaattttttaatcactgatgaagcagtgtaagtatgcaacaaactactaggatattatacttgtatacataggtggttcagagtatagaatattttgctcctgttacagtggaacgtaataagccaaagtagtatcactacacctttgaagcacgaatttcttcgtgtgtcgccctccctcccgtgctaataatgcagtgtatgtatgcaacaaactactaggatattatatttgtataaatggagatgaaatccaatagaaaatcgttggagcacaaaaaaaaaaaaaaaa

SEQ ID NO: 1379 - DNA, 1948 bp, Zea mays
ggtgaattggactggcattatcacaaaacaaaccggtgtagattcaggctggatttgagcctgtttagcagcgctatccgcttggcccaattcgtctactgctcctccagctcctccgctgcgccgccggtcgccgcccgacaccgccgaagaagagcagacgccgagtccaggacgtcgccgcggggctcggggaacgcggtgttgccatcgcgaggaaggtcggaagttcgctgttcgcccgccggatcggcaccgtcgccaccgcccatggcaaccgtcgcccccgtcgtctccgacctcgtcgacttcctcaacgcgtcgcccaccgcctttcacgccgttgacgaggcgaagcggcggctgaaggcggcggggttcgtgcagctgtcggagcgggaggagtgggcgggtctcgagcccgggcgcaagtacttcttcacacgcaaccactccactattgtcgcttttgccatcggcgcaaaatacgttgctggcaatgggttccacatcatcggtgcacacactgacagcccttgcctgaagctcaagcctgtctccaaggtaaccaaaggaggttaccttgaggttggggttcaaacgtatggtggtgggttgtggtacacatggtttgaccgtgatcttactgtagctggtagagtgattatacgggagaagaaggatggcgtggtctcttatgcacacaagcttgtacgggtacaggaaccaattatgcggatacctactttggctattcacctggacaggactatctcctcagaaggtctcaaggttaacaatcagagtcatcttgttccagtgctggctacatgtatcaagaatgaaatgcagaaatttgtagcagataatggcccaaagcaggcatccgagaatgcgaacacaaagcatcatccattactattgcagttgattgctaaagaggctaactgtgagcctggtgagatatgtgactttgaactgcaattatgtgatactcaaccaagtgttgtagcaggtgccacgaaagagttcatcttttcaggaaggcttgacaatctttgcatgtcattttgttcattgaaggctctaatagattccagttctgttgaacactctcttgatcatgaatctggtgtgcgaatggtagctctatttgaccatgaagaagttgggtctgattctgctcagggagctggttcccctgccatgttggatgctttatcaagaattactgggtcttttaactcttcaggttccaagttgctagaaaaagctattcagaggagcttcctggtctctgctgacatggcacatgctttacatcccaactatatggacaagcatgaggagaaccaccagcctaaattgcatggaggacttgtgatcaagcacaatgccaatcaacgatatgctacaaatgctgtgacagcatttatttttcgagaaattgctgagagacaccagctacctatacaggattttgttgttcgcaatgacatggcttgtggttcaacaattggcccaatacttgctagtggtgttggtattcgcactgttgatattggagcaccccaattatcaatgcacagcatcagagaaatgtgtgccgctgacgatattagctactcatatgagcatttcaaggcatattttgaagaatttactgaattggatggcaaggtcaaggtggattactaaggcatatagcacaataggttagctttgttacaagctgtacttttatacaaattcgataagcaagtggagaacaaatttgggagaatgtgctagttgtgtttgcattgccatacgatgttctaaattgtatctttttatcgaacccaagtacccacatgtttgaaattcttttggtgaatgacttcctatcaagaaaatgaactagcctataaaatggctccgacatgcagcctcacaaagggctgtgttt

SEQ ID NO: 1380 - DNA, 1134 bp, Zea mays
cattgggtacctccaggccgagccaccacttcctagcttcccttcccctcggctgccctcaaaaccccctcaaaatcctccgaaccccgccgccgacgagcgagctatggcgctggcgcggcggctgctccgccttactccctacctcggcacgctctcgctcccaccccccaactcgcatctcctccggaatcgcacctatatctctgacatgcgccgctctgccttcgtcgaccgcttgctccgttccgtacgctccgagatctccttcctcgataactccgccccgccaccgccaccaccgcctcctaagccattcaccattgaggaccgcccgggcgagcagtgggcccgcctgcgccgcgtgttccctgcggccgagggggaggaagaggaggtcagggtggacgccacgttggtcgacggcgcgctccctccctcccgctcgggcgcggacacgggcggcccgcccagaatgcatatcagtgttaaggttgaggtctccaaggccgcgcggcctggagtggcgctcaccttcgagtgctccgcgtggcctgacgagatggaggtgcggagggtctttcccgtccgccgcggcgggcctgccccagtgcagcagtacgtcggccgccaattcagtgagttggatgaggaaatgcaaagtgccgtacaagactacctggagaaaattggagtgaatgatgaccttgctgcatttttgcacgcctacatggaaaacaaggagcacactgaactgatcagatggctgaaaaacgttgagtgccatatcaagaagtgaacattctagtcgggttaatactttgtcctacagcacttgcagatgcagcttttgatcgcaatcttggaactttactaggccccatttaaatccttagaattgattaagctcatattgttgtatgagaaatatcacgcctacatggaaaacagggatcatactgaacttatcagatgactgaaaaacgtagtgccatatcaaaaaaaattgcattctagttgtgttaaagaaaaaaaaaaaaaaaaaaaaaaaaaaaaaaaaaaaaaaaaaaaaaaaaaaaaaaaaaaaaaaaaaaaaaaaaaaaaaaaaaaaaaggggcggccgttttaaaggat

SEQ ID NO: 1381 - DNA, 3841 bp, Zea mays
  misc_feature (708)..(708): n is a, c, g, or t
  misc_feature (951)..(951): n is a, c, g, or t
  misc_feature (3076)..(3076): n is a, c, g, or t
actaggaaaggggctgggtcaggcgtcgtctccaactaagagcgactcgctggttcgccaagctcgtcgactacggggatgggttgtgtcgtcacaacggacgagatcggacctgtcgggtgggccgacatcgcaacaatgacgagcggggcaagggtggcaagaaggggacattgtcgcacgttaggagggggtgacatgcaacatcgagaatatggcattagtgcggacttgctcaagcagtatcgtcaggaagaatggattcagacagatagatgagagaactaggccgtggaggaggacgggagtcgggagaactgagccgatccgacgaggaggctcaggataggactgtttttacccacctaaaactttaatttttctatacttaatcataagtgaacattatatataagagattataaaaattgagaggaagtcctactttacctctcctttgggcccaccctacttcgcgacgcgacaatagatattgtgcgtctagatgtgagcgagacggctatcgctgtgctcttagccaccgtcaaggatgccacttggctgcacctagacactcccatcgctgagttcacgtcggcttccatctagagaacgcaaatgggccgaggagtcggtgtgagcgtcgattttgaagaggtagccatcagttatggcagcgggctagcgttcctgaggagtggtggtggntgtagcctgactcctgtacaagattgagctttatgatgtgcgcagacaacacacacaactttaccagaataggatctcgcactgggctttgctgaactcactcgtttggaatggataggctgtggcaatagatcgtgtatgtgatcatgcaaaatactattttatactatataatgcattgtttacatattgaagttaaatagggtttagggtatgtaatagaaggtgtgataaaaagtctgntggagactgccttacggcaacaaaatccatgatatgttcaacccaagaggcaaaagcgactatgcttccccgagtgtgactgttgtgcaaccagtccttaggtacagacgtgcaagcggtccattagatcatgattcaaccatagatgcaactatggtttgttaaggttttatttataaaactatacgagctagtgacagaagagtttaaatattaaatctatatatatatatatatgcttctatacttatatatataatctattaagaacctaatgtgggtacctggtgataccacgacttcatcctccgcgttgacactctggacccacctattacaccacacaaaaaatagtgcagagcgagcacttgaatccatgcactcttgttttagaaatttagaattaacaaccaaacaacatgtaaattagtgtttagaaataaacaataattatatttgagttacttatagctaagaaataaacaaatgtttagaaataaccacgagacaccacttcctagcttcccttcccctcggctgccctcaaaaccccctcaaaatcctccgaaccccgccgccgacgagcgagctatggcgctggcgcggcggctgctccgccttactccctacctcggcacgctctcgctcccaccccccaactcgcatctcctccggaatcgcacctatatctctgacatgcgccgctctgccttcgtcgaccgcttgctccgttccgtacgctccgagatctccttcctcgataactccgccccgccaccgccaccaccgcctcctaagccattcaccattgaggaccgcccgggcgagcagtgggcccgcctgcgccgcgtgttccctgcggccgagggggaggaagaggaggtcagggtggacgccacgttggtcgacggcgcgctccctccctcccgctcgggcgcggacacgggcggcccgcccagaatgcatatcagtgttaaggttgaggtctccaaggccgcgcggcctggagtggcgctcaccttcgagtgctccgcgtggcctgacgagatggaggtgcggagggtctttcccgtccgccgcggcgggcctgccccagtgcagcagtacgtcggccgccaattcaggtgatactgtacgatgagaattcatgaacatctccaaattttgactaacttttggaagctatgttaatcacaattgctggttagactatctgcaattcagcacccgttcctccacatgttcctttaccggtgataccgtagaggaatagagagaaaatctgcagtacctgtcccggtaaaacaccctaaaacataggcaaaattgcttatttgggtcctttatgttccacttgccaaaatacctcactaaagttgtcaataactaaaataccccacaatacgggtgttcatcaccgtcacttttttgccaccaaataagattacggttttgctatagtaccattttatccctgcacaatgctaagcactctattaacagagcattactgcagtattttgagcattgaagatacactagctgttgatttagaccatgtattggatggacatatttctagaaaagatgttggcatggtttaacctaaatttgaacatagttttcaaaggtatgacaatatatagcatggaagcaaaaaaattcaccgaaattccaatatgggtttagcctaaatttgaacatgtttatttacgagagtcacaatatatatcatggaagcaataagttttacccctacgttcagccatacattcaaccattcagttcagccatacattcaaccattcagccatacgttctcacattattcaagtcttacacaatgtgattaaaaaggtccaagcataatgtaagacattcaagtcttacatcacacgactgaaataggtccaaaatgttatgataaaagaagtagcagcaaggctagacggtagttttcatttttagagtcagtttcttgtgcctacgggtaattggggctgctactacatgtttaaggctttatgtcaacatttttcagaaatatgtacatccaatacatggcctaattcaacaactagtgcatcttcaatgctcggatactgtagtaatgctcggctaacanagtacttaatgatgtggagcaggggtaaaacgggtactgtagcaaggttgtgcccatatttggtgcaaataaatgatggtcgggtaatctggcgaggaacactcgtattgtgtggtaatagctattgacaacattagtggggtattttggcgagcgacaatgtatagagacccaaataagcactttcaccaaacatctttcattatctcctcgcatacaacttggctcaccgtcgatcatgcataaaaaataaatgcacttttacattaggcatgatagttggatgtatatgtattgttttaaaggtgatgcctaggcgtctaggcgccaaaattatctgggcattggtgccgccttgctccaggggctcatggcgttcgtcttggtgctctaggcatctgtcttggtgctctaggtgtccgtcttcaagcgccttgagcctcaaatttctgcatcgtgcgccaggcacggttggccatcaaatttcatgcatccctgccttgctgcgcgggaagataaggaagggaggaagagataagggaagattagggaagagaagggaaagtcagagaggttttggcggtgacacctttctcttcgtggacggtgacttcatcggcgtcatggcaccaaggatttgatggtcgacgtctgtgttttcaagtcgtccgactaatcgcgattagtcgcgattagtcgggctagtcggttagcagagctcgattaggcagccgactcgactagagtacctggtcgccctggtcg

SEQ ID NO: 1382 - DNA, 1505 bp, Zea mays
attttcccttgggtagcgccgggccggccgggaacttgttcagggagttccactccactctcccataatgaggataggggcaggggcgaacatggctgcgtgctcctccgttccctgctccttccccgcgaagcctgaccctcaccgccgaagccccagcggcatcttaagctctcatctccctcggctccctgctacccagtttcgtcggcttcgatcactctctgccgccgcctcgccgccggcgagtcgcctccgcccacgagcctccgtgtccacgtcgcccgccccgtctaaggactacgagttcactgacgggaacggagaggtggagctgagactggacatccaaaagctcggcatagcgagttcaaaagatgttttcgttgatgtcgatgacacatccctactcatcagagccaagtctgacgggacactgaggactttgatgaacgtccaaacactgtttgataggattaagtcttccgagaccatatggttcatcgatgaggaccagttggtggtgaatctgaagaaagtagagcaagagttgaaatggcctgatgtagatgaatcctgggaatccctcacttctgggatcacccagctactgacagggatcagtgtgcacatcgttggtgattccacgcacattaatgaggcagttgctaaagagatagccgagggcatcgggtaccttccggtttgcactagtgagctgctagagagcgccactgagaagtcgattgatacatgggtggcttctgaaggagtggactcggtagctgaagcagaatctgttgtcctggaaagccttagcagccatgtccgcactgtagttgcaactctggggggcaagcaaggagcagctagcagattcgacaagtggcagtaccttcactctgggttcacggtttggctatcggtgtccgacgcaagtgacgaggctagtgcgagagaggaagcccgaaggagcgtgagcagtggaagcgtttcttacgcgaaggcggacgtggtggtgaagctcggcggatgggacccggagtacacgcgggctgttgcgcagggctgcctcgtcgcactcaagcagctcaccttagcagacaagaagctagcagggaagaagagcctctacatcaggcttggttgcagaggcgattggcccaacatcgagcctccaggctgggaccctgaatccgacgccccaccgaccaatatctgaaacaatcctccgcccagttgtattctaggagaattctctgcatcaccattccggactagttttttcagtgtaataaataagagaggaacttgtcatctgtctgttgatgcataaaatgaactcgactaacgtttagtggggtaccacgggtgcagaataaacacacgactggcagcgagagccaaactcaaaaacattgtatacatcatatattattctatatgacccccatccttttccccactaatataaatgcattatattagaaatttatttatctctg

SEQ ID NO: 1383 - DNA, 1931 bp, Zea mays
tgcagccgcagggccctaggtcgccgccacgacactaacaaatatattgtgctccatggccttgaacgtggcgatggtgtcacccgccggcccgatcaccccatcatcgggcgccgcggtggggaggaatgtcgtcggctagagaacagtgtgtctgcccgcgctcgcgtccatgggttggcgctgccatgtttggcgccttcgtggccacctccttcacgggcgtcgtgatctgggcgttggcgcaccgtgcaagggccatgaagcggtagaccgcactggtatgggctcctttgggatggaccggaaccagaaggcctccgtgttgtgggactgggagaacttgccgcccgtagccgtaggcgcgagcgggagcgagaaccccaggatggctgctgcgcctcaggctttgcattctgcctgtggcaccatctcttccagctcagagatggggtatggctcatccaagagctccgtatccgcgtcggctgatgattcttcacccaaggccaaggggaaaagcatggagctcaacttcgcacctgacaaagtgcctgacaagaacactgattcagggaaggttgacgacgccaggacctctccgtcgtcgccggtgattgccatcagcagtgcagagcccgtgcttagcctgaagcttggcaagagaacgtatttcgaagatgtctgtggagggcagagcgtcaagagtttgccgtcggatacgagtgcagtgactcctcctcctgcttctccgaagaagacgaaggtgactccaaacaagaaatcttactgtcaggttgaaggctgcaaggttgatctctcttctgctaaagagtaccatcggaagcacagagtctgtgaacctcattctaaggctcccaaggtggttgttgctggtctggagcggcgcttttgtcaacagtgtagccggttccatggattagctgagtttgaccagaagaagaaaagctgccgcaggcgcctcaatgatcacaatgcccgcagacggaaaccacaacctgaagcactttcttttgggtcatcaaggctgtcggcaatgttctatggcacaagacaccacacaagccttctgtttggtcaaggtccttatggtcaaatgagaagttgtgcaagttcttcatgggataacccaggaggcggcttcaaatttgcagagacaaaaggtccctggttaagagctggtggtgttgatgggttgcatcaatcaagtcagcaggtgtggaacaactttatgccgcatggtgtccatcaagattttgatgggttcacagctttcaaaggaaccaatgcaaaggtccttcatcaaggcgttgaagcttctgcggtcgcctccaaccagaacggagccccacaaccggaccttcatcgtgctctctctcttctgtcaaacagctgggctggtgccggtaccgaccagcacccgacggcccagctgcgccaccatgctgccctgagcagcagcctcgccgccagctccgtctccgtggcgcaggcctcgccagcagggctgtggcaggacggcggcggcggcgcggccctgagccaccacgactatgcccacgcacaggcacggttccaggctatcgacgcgctgggcggcgccggcgccgccgccgccgttgcagcgggtcaggagcttctccagctcccgcgtccgccgtccccgtacgacgacggctcctcgtcccgctacgacctgatgcgctgatccttctccctttgggcttctggtggagcgcggggttttgatttttgaacgaactctggatggaactcggagttttgaacgaactgctgtatgcttgctatcaaggtctgctggctcgggctcggacgctcgtgggatcgccagcagctccgtgtgcttgaataaatccacagttttttttgtgtgacgctagctatttatt

SEQ ID NO: 1384 - DNA, 7954 bp, Zea mays
  misc_feature (1643)..(1643): n is a, c, g, or t
  misc_feature (1755)..(1755): n is a, c, g, or t
ggctctgtactacagtccgctatataaagcgtaacatattccttccgttgccggtctgtttcacaacacaaatacatattgatagttggagcaactctaaacgtgtgtttggtttaagtaatgagctagtctatcatcttcttactactcacttttttgtctggtttgtgaaatagaatgagttgatccatcatcatcatctcatttctcataattagttagtactaatataaaaaatgaggttatcccacctaagagactctttatattctttataattgatataaatagagattttttttaaaaaatactctccaacaacttatctaagtcactatccaattgtagccatattctatttcaggtttctcgttagtcaaatataagttcctcgttagtcaaatatagaaacgtgaatgactctctagagtgtgaacaaatatagaaaagttgttgggaattgaaaagatattaaaaatgatttttatataaatgaatctaaataataatttatagagtgaaatttagaatgacttttggagatgctctaattatgtgttatatagagaaaaaagatataatagttggattagagcaactccaagagtctagatataaccttagctaaatttggagtcttatgaggacttaaaaaatagataatttattaaacgatagggtaaaccattaaactctctaaatattatctataaatattcaaaacacttctcaattggcgtgaataagatatatgtgaataagatacatgtgtttgttttaaaatataattctacatttcacgtgtctctcttttttactgctgacatgagataggaacaccaatatactattagtagattttttttgtccacgagccgtgatatggatgaacttttagaaaagtgctagcttatgagctataatgctagtaaaccaaccaaccaaacaaccagccaacaggagcgagcatttacacttttgctgatacgcttgcaaaaaataatcgaacccatgtgctcttcggctcttcctctacgtcgcggttaattccctccccactggggcatgccatatccatcgatgcacaagaggacggcgaggcattggagcggccggaggacgacgagaaccgaacgacagggcgctggaccggtgctagggctggagaggggcgacggtaggagagaatagccaggcgggcagaatcggtaaaaaatacctgggcctgtttggttgtcggtatgagtgggtctggctcgtatctagggaatctggctcttggtagccttgctgagagtatgatccctacgtttggttgactgtatgaacttagtttggccattcaagatgatgtttggttgcttgcatgaatgcttggtgcatgaacttaaaagctataaagtttattatattttcatatgatgatgttgcaatagtctataatatagcataccaagccttaatccatttttaaataaattaaatttatttaatagacactaattacatgttaatacgtcattaggaaagactaatggttgcatcggtagagcctggctctggagaaacgactaattcctacgtatctcgggagccaggcccaagggagattttgtatctcgcgagctagactgaagaggctnatcaggcaacaaacagaaaaaaaactacatcttgtgagtttgaccagatcatatacagacaaccaaacacactctagtgatctcgacggggtgacaagcaggatacagtagngagcaagaaagagagtatgttggatcagattttgatcctacatttcttttttgcatatactaattaatttagctaggcttttaatgttcttagaatgaatataatgcgtggtagttaatatagaggggtaggaacacaaaagattgtgatatagagtaagtagttttgctgactagactgtaaatagaggtatatcattaaatacgtttctgcttctaaaaagtatttttcggtgaaaaattagcttttctgcagtacacatctgaaagcagtttagactttctttatatggcaaataaaaactaaactatgattaaaaataattaagttttataataaataaaataaaattacttttacgtcccctggccaggccactgtgcagagtacagtgcagactatgtggatatcagtagtgtcgttccaggccattccaatacttcagcaaaattacttctggttccaggccattccaatacttcagtagtgtcgttccaaatgtgggaacacacgtacacgatccggcacgaaaaggagcagctggaacaaggcgagaggcagctgtggttggttgccgcagccgcagcagcagtaacaacagttcacttgcggccagaggcacgtgccttctgccttggttgttgtgggcttgtggctagccgtgcagaatacagagcgaaagagagagatggctaatattgggaatcttgttatctgttctccttttcaagctgctctccctaggcttttgggtttgtgaggcgttggctcccttccccactgcttcctccccccactgccggtcgctgtgcaagagctgccacgagacagcagattccccatcatccaaagcgaggtgagattcttgctgaaagatcggacggagggagtagaatcgcggggggcgtggctgtggttgccagtcgccatgccatcatgtgtgtagtagggtccagccgccggagaccggagttgctgatgacgacttggcgatgctgtggtttccaggctgagggggaggagaggaagcaggaatagcctaacaggggtatagatctcaggaagctccatgcgggtgagcttgtgcccaagcctgtgtcccggtgcgcgaggctgagcttcttgcccgttgcccgtggcgcccccgagctcaccgatgcgccgccgccgccacggcttgagctccatggctgtccagcgcgctggtgcggattgacaggcaggttgtcctgcccgttcttttttctggtgagtggtgagtgctttggccttttgctgcacttggttggcgttcttatggtttttttttggccccttgcctttcttggtgctagactagagtatgatggtggagccgctgttctgttcttgccatgattgacgatttctctgttaaaagttcaactgctctccggaacattccatccgcttccgttctgatatcagtatcaccttgcgcacttctctgtgaatttgatgacgatgatgatgcatacttgagtgcccagacatgctcctgcaaatccgtccagttcctgcagcttccacgacccgaactctttcagttcttaacctttttctctctaccattttgttgcttcagcgaggtagctgcttgggcagacaagtaggagcagcggctcaaacttcggatctcggcatgggctcctttgggatggactggaaccagaaggcctccgtgttgtgggactgggagaacttgccgcccgtagccgtaggcgcgagcgggagcgagaaccccaggatggctgctgcgcctcaggctttgcattctgcctgtggcaccatctcttccagctcagagatggggtgtggctcatccaagagctccgtgtccgcgtcggctgatgattcttcacccaaggccaaggggaaaagcatggagctcaacttcgcacctgacaaagtgcctgacaagaacactgattcagggaaggttgacgacgccaggacctctccgtcgtcgccggtgattgccatcagcagtgcagagcccgtgcttagcctgaagcttggcaagagaacgtatctcgaagatgtctgtggagggcagagcgtcaagagtttgccgtcggatacgagtgcagtgactcctcctcctgcttctccgaagaagacgaaggtgactccaaacaagaaatcttactgtcaggttgaaggctgcaaggttgatctctcttctgctaaagagtaccatcggaagcacagagtctgtgaacctcattctaaggctcccaaggtggttgttgctggtctggagcggcgcttttgtcaacagtgtagccggtgagtactttagcctgtatataaattaaaccgagcctcgcgtttctgtggagaaacatgttttctgctcgtttgcttggatcaatgtcttggtatccttgagtaaagaagggaaagtgttctgctatattgataatctaatttcttgcaggttccatggattagctgagtttgaccagaagaagaaaagctgccgcaggcgcctcaatgatcacaatgcccgcagacggaaaccacaacctgaagcactttcttttgggtcatcaaggctgtcggcaatgttctatggtagtgataagctgttggttgccttgtcattttgtgaaggcaatgcattatttgttattttttattctagtaactattatgtttaagaatctttactttttcatgcatgctctcaactggatgccacaataacttaggagcacaaagctgcaatattttatctgtgaagttagtctgcttgtttattcacaattcagtgtcatgatttttaaggtgtgattcattttttttatgatatgatatgtcatgattactctggcagtactggtaattgatgaacatctgagggagtgccattttgttttgtatagaatatagatgggacaaaggagttaccaattaagttgtaattgttccttggaggggcacatttgctctgttcttttcagtttagaatctaacacatgattcggttttgtccgccatggttgtgttccacattacacttcaggaaaacccactttacatttgcacaaacaaattgatgctttggagatactaggaagatgagtaagcattagttcaaagttattaagtccatgccatgaccactatattttcagcactttgtagtttgtacgaaagtagcttcaatgttaacactgtgcaaataatctgttccaatgctgaatctgttagctttatcactgaatttatcttgcctctattaaacagacacaagacaacacacaagccttctgtttggtcaaggtccttatggtcaaatgagaagttgtgcaagttcttcatgggataaccctggaggtggcttcaaatttgcagagacaaaaggtccctggttaagagctggtggtgttgatgggttgcatcaaccaagtcagcaggtgtggaacaactttatgccacatggtgtccatcaagattttgatgggttcacagctttcaaaggaaccaatgcaaaggtccttcatcaaggtaatttttcatctctacttctgaactgaaggccagtcacctgcacgaaaactgtttctcctgaaattccaaaccatggaaaattcgtagataggtgcacctattgttattttaggagcctttcataaaatttatcttttagatgattcttctgtctctgtgttagtgtacattgtttgataccacatgatttgaagtgtagggctttaattatcctttcatatgagtttgcatcacactagtatatggcatgtttctgaatttgcatttgcaatccaaaaacctttctttggaagggatgagatcagtctgaaaatggatgtaacatgatgccctctcaggctcacgtatccgtgttatatacgctaggaaaagcccctagcgtggcaaatacatcttggagcataagacacgagagatatacataaacaaagtatctacttacagtacaaggaaacaacaaaccagtggatacataaacaaagtatctacttacagtacaaggaaacaacaaaccagtggagtcacatctaccttgccttgagaagcaatccaatctaccataacaaccatgtgctccaacaatcagtgcctgactgctatgccatgtttttatcttggtcagttaatgagcaccagtcacaatttcctagtaacatccgagtaatctatttcttatctttgtactaccttattgcaacatgattgcgcctttttactcgaggcttgaacacgctagtgtattggaagtgccgagtcagaaaagacctgcagtctcaactgaaactcgcccgcttcgctaaattgtcaacatcagtagctgccacctaaaccttgattcagctctttcataacatgtccaaaggatacaacacgctaagccaagttctcagaatcagacccacttcaccataattgggacctagggcagtttgtgttgatctctgtgtaaggtgtggggtttatatcaaggttggttcccaaatttggcgtattgcaaaatagatggcactatggcacccatggctggttctgaaatttgccacgttgtgaagtagattgcaaccgtcaatttccccccttttttctcgtgttgctggggaaatcagtaagtagctaattagtgtcattcttctagacaacatgcttcagttccagattctaggaacacctgaactgactgattgatttttgtttgctgcttctgctcgaaacatgtggcaagcagaggcaccgagtcagactgttattattcagtaaatgatctgatcatataattgatttcactattgatgatatgctccgcatgatttttttgaccctgctatgctatacttatatttaccatgaaactatacaagatcagctgaatttcacacagctaaacatatactacctattaatgctatcttcaacagtttacctatactcatatccatattcaaactatatccatattcaaacttcactctgcgaacagtgtttttggttaaactgctgccctttacgtgttttttcattcattcattcaggcgttgaagcttctgcggtcgcctccaaccagaacggcgccccacaaccggaccttcatcgtgctctctctcttctgtcaaacagctgggctggtggtggtaccggtaccggtaccgaccagcacccgacggcccagctgcgccacgctgccctgagcagcagcctcgccgccagctccgtctccgtggcgcaggcctcgccagcagggctgtggcaggacggcggcgcggccctgggccaccacgactacgcccacgcgttccaggctatcaacacgccgggcggcggcggcgccgccgctcccattgcagtgggtcaggagctgcttcagctcccgcgtccgccgtccctgtacgacgacggctcctcgtcccgctacgacctgatgcgctgaaccttggggcttctggtggagcgcggggtttcgatttttgaacgaactctggatggaactcggagttttgaacgaactgctgtatgcttgctatcaaggtctgctggctcgggctcggacgctcgtgggatcgccagcagctccgtgtgcttgaataaatccacagtttttttttgtgtgacgctagctatttatttatttcacttgtgtaatgtgatgcgaggatgcgactccctcatttgcttcggaagagcggtgacatgctttaccgccgcaggcatgcatgtactccaatcaccgattggatttgcctctaccaaatgcaacatcccatgtcgagagatttttgccattatcaaacatggggcgttaggcttcgttcaaaacggaggttcgttcaaaacggaggtgagtgtagagattcgacgatttgaaaatccatactacgtgtagacgctgatatggactcaaaatctctcttagtcgcttcggacagccattaaacctggcgcaatcttttcctcctgttctctcgtaacagctagaaccttcccaccgctagctgtggggcacgtgtctatagtgtacaacagaaacagccgattcacgtcatgtgtgaacgcaaaaaaaaaaaaaaaaatctccaccatgtgaaagtgtagttgtaaaacttatttaataattttaatataaataatattttgcattctaggtactcatacatttttttattgtaaacac

SEQ ID NO: 1385 - DNA, 4851 bp, Zea mays
  misc_feature (2475)..(2475): n is a, c, g, or t
caccgtcttcgaagcttctcttctcctcctcctccctaccggctacccttctctccttccctcgccggtcgccaccccctcaccacgagacgcacagccggcagcgaatctcctcaccagcccagacgccgcagcgcagcgccgagccctagtccgccggtccagcgaggcagaaagttgataccgctttggcgtctcccctatggaacatcttccctcaacactagcatggatctgcagtgcgtagcatgagtttgcatgcacgtttggcttttgttcgtcattgaggctggtgcacttctataatgggttcacgatcaaagaacgaagatgacaaggctcttgtcttgtgccaggaaagaaaacgatttgttagagaagctcttgacgggagatgtgcttttgcagctactcatttcgcttatattcagtcactgaggcacactggatttgctctgagaaaattcgtagagcctgaagtgccgacagattcgtcactgttcacatcaacatctgccactccagagcctcctacaatcatgcagaaaccgatgaccatatctccatccctttcacatcatgctagtgactctttctccccagttccctcaccattatcttcaggacgtttccatgtcaatcatatgaaagctgggggcaattcagtgacaactgttaaggagaaggtgattgaacctgtgaccgcaactctcgaaacatcatcccctgtgcgtggacaagctatccatgacctggatgacagttcaacgtttgaagctccccctggaacaccaccatgggactactttggccttttccaacctgttgagagccagatgtcattccatgatgacaaggaacttggtcatgactttgagaatgatgatgatatcaggcgtcttcgggagaaagagggaatcccagaacttgaagaggaactggagaagtctcctgcttatcctgattatctaaagcggcgcctaggacaggagaaacctccagatctcaaagatgttgagaaatctcctatgaatggtggagaggatgatcttgcattgtcagaagatgattttgacaatccaacatctgaatctttagtgcggatgttcaagaatcgcaatgatacacccgttgcacatattgcaacagatcattcatccacatcgcttcctaaagatgacttagtttcagaaacgattgattctcagcctgaaagaccaaaagatgacagagcagttgattctcagactgaaagactaaaagatgtcacgccagatgatcctcagactgaaaaaccaaaagatcatgccggagttgattctcctactgaaaaaacaaaagatcatcctggagttgattctcctgctgaaaaaccaaaacatgacatgagggtactggacattagcatgtatgaaagtgacgaaacgcctgttacaagtcctccgaaagaaatttcatcttcaactgctgcgtttcaagttaatgggaaattcaagaaacctttacatgatgtaaggaatgtggcgagggatttaaactcttgcattaaggagattgagatcttgtttatcaaggcatctgattctgggaaagaagtcccaaggatgcttgaagcagacaaagtcaatttccgccctttactaccagaagaaaaaggttgtattttagtaggtttctttacattactgttccataattcacgcattgggagttttgattcaaaaagaaagatggaaagtagaaaggttttgggctgcgtgcacatcattatatggaattttcctatttatttgttacttgttagcaacttagcattgctgtagcttcagctagtgtccattattttttgtcactccatctattaatctgttatattgtacttactattggagttatcttgatactttggtgcagcgccgggatcaacagcatcaggcttttttgcaacattatttgcttgttgcagagaggaagtccctcttcctcaacgtaagttattttactcttaactttaataactacattttgttccttcccctcatacggcacaagttcctataaatgattgtagcacaatgtattgttagtctgacactatgcaatttttgtttagttccacttattttttggtacttatggagcgtataagtttggtcattgattgtaataatatgttagttgtgtagtagtatcatatacttagatgctggaggcacttttggaaacaatagtattctcattgccgtgtgatcactttttgtactgcagtataatatggttgaagttgaaatagctaggtagctaatgcagatttggaggtagtgtgttagcctatacctttcgccacgagtagtcaacatgctttgctaatgcttgctctgtggctgcggctgcggctgcatttattgtgtaactgttgcagagacttgcggcagctgcagccacaacaatcagtaccgatcaggcttagtagcncttttattatagcccaccatgactttgaaatgcggacgcgtggcgagacgcgtggggtgatacagctcctcctcaggccgaagtgaagtaccttacctggcatagatcaatgtcttcactttcttcatcatctagaattcctcttgggacaacatcgaaggaagacactgacggtctcaatggaaatatctttggtggtgtatacatgaattcaggcagtcatgcctccacactggacaggttgtatgcatgggagagaaagctttatgatgaagtcaaggtaaatttctttctcccttttctgtgttacctggctgctttatgacttctattatgtgtgacacagtgacagtgtgacgatatatagcaagaaagatttgcttcttttatgcagttattcaactctgaagaatattagcttacttgtaatgggattattttttttctgctctgatctcaattatttccccttttggtgtcatcttgttgggtttcaactctagcctaccctaacttgcttgggactaaaagactatgttgatgttgatgtctgatctcaattcttgtaaaaagtccactttgaagatgactagaagatggaacaaatagatcatactaatacccaaaatgtatgtactgaggttctgcctcattgatatggttgcagcagcaaaagggcctctagcgtaatggttaaggcttccgagtagcacctccagatcccgggttcgatctccctcggggtgaatttctggcttggtttaaatatcccctcgctatgccccgcccgctcccgagttacgttctgcgcgccaccctccggctggaccgttgtagagtgggcggtaacggcccgctattgatggggggctggggttcgggaattttatcggccagaaccatgtttcagtatctttttaatataataccgggagagcggtctttcattcctcgggcgaggtttttttatatggttgcaggttgcagcacaacgcttcagttgtgctgtaacctcacatggcaatgtagcgggtattacccatttatcctatagtaaaatgcttaaacaaatgtttaacttaaatgtatctagttacaataatataattgatgtatattggggaaccatataccttttgttgtacgttggcaaaatatgttgatttcacagttttcctccattcctattccttcaggcaagcagtgtagtgcgcgggcaatatgatgagaaatgtaggcagctaagacaccaggaatccagaggagaaagccaaatgagtattgacaaaacccgtgctgttgtgaaggatttgcactccagaattttagtggccattcagagaatcgacatgatttcgaagaacatagaggatcttagagacaaagagcttcaaccacaactagaggaattaattggaagtttgactcgcatgtgggcaacaatgcttgagtgtcaccggcatcaacacgatatcattaaactagtatccagcactcgcaacatgaagacctcaattcggtcagaatcacagttccaagcaactctactccttcaggttgagctgaacacattatgttcaaactttcagaaatggatagcatcccccaaagcatatttgcagagcctaaattcatggctactcaagtgtgtgaaggcactacaaaggaagaggaagagttccaggaaaaagaacatcaaagctgatccaataacaaagtatgctgttgcgcccatatttaaaacctgtgagagctggataaatttgttggatgatttaccaacggatttggaggatgctattaaggaccttgctgctgatataaaccgttacgtgccacatcaagagaagcaacgaggcggttcaaagctaactctctcgttgtcccgtagtggaaggtcaaacggcgagatgggtgaagtccacaggagttatacccctatggatttacaatcaagtttggagacatttctagggaagcttgaaatgttctctgatgtttcattgcagaagtacatgaagctcaaagaggatattgatgaggcgaaggagaggtatgaggaggcgcaggcagcccagcggatttaatttctggcacagaacataactagtcatgtagagatgtcatctagtgtcggtgtatgcttgttgaaataataggcataaattacttttgccattttgtaagttgcaagataagcctaggaacaaaattgtagagtacatgctaaaatatgccgctgaactgcggttgtaaatgtgaggtggtgataattgaagtcgaagttgcgggggatataaggtgtacattcatcttggggctatatcaatacatgaggtttctttttcttcaaaaaaaaaaaaaaaaacaccaaaa

SEQ ID NO: 1386 - DNA, 1715 bp, Zea mays
  misc_feature (23)..(23): n is a, c, g, or t
cacttgcatcagctacagacgtngtctctctctcctccacttcaacaaacacttgatctcgcgcgaatgcgcgatccctctatttataccccgcttctctcacattccgtcttcaacaactctggcgagcagcagtgaacgtacttacgtcttcccccagctagctagctatctaccttggtggtggcgattggtatatagattaaacatggcgcctcaaagcctggatctcgggctgagtctcggcctgggcgtggcggcattccagcccagcttctgccacccggccggcaatgacgcggcggagcgggaggccagcccgaccgcggacgagagggagcggaggtgctcgcccgccggcagcccgacgtcgagcggcagcgggaagcgcgtcgcggcggagaggtcggccggcagcggcagcggcgacgaggacgacgacgggggcgctcgcaagaagctgcggctgtccaaggaccaggccgccgtgctcgaggagtgcttcaaaacgcaccacaccctcactccggtaagggcgtaactaaggcttcatccttcgatccgacgtcgccgttcctcgccgcctgtcggtcggctgatttgatcttggcggtggccggtgggtgggtgggtggctcaccaaggttctgtccgtctcggcgctgcagaagcagaaggcagcgctggccagccgcctgggcctccgggcgcggcaggtggaggtgtggttccagaaccggcgcgcccggaccaagctgaagcagacggaggtcgactgcgagtacctcaggcgctggtgcgagcagctcgccgaggagaaccggcgcctgggcaaggaggtcgccgagctcagggcgctgagcgccgcgcccgcgccagcggcccctctcaccgccctcacaatgtgcctctcctgcaggcgcgtctcctcttcatcctgctcatcctcgccgcctaacacgcacgcgcatgccgctgcagctggcactggcaggagcgtggcggcggcggcggcgacgacgttgcccgcccaccggcagttcttgtgcgggttcagagacggcggggcggccgccgccgcagtgtacgggacctcatcggctctcgcaaaggccctcagggcggccagataggcgcagtcgtcgtcactagctctctccgctgatctggacttgctctgctcaccggagctccggcgatcgagcgatgccacggaagtgcgtggccccaagttgcaactaattgcaactgcagagcaagtgttgtagctgaatcatctttagttttttttcctccgtatctttagagcggaatgccgcatgcaaatgttctttagaatcgatttcatgtgggtgtatgattgtactcatgctgtggaaattaataacggtttgtagatgaggtaacgagcatgagcatatgtgcatgtggcgtggttgatggttccttccattgcatccatccgatatggtagctagctgatctgctggtgctagtaacgaccaacaaccgtgcgtggatggaccagccgatgtcatgtggagtccgaatgatttggcaggcagatgcgcagtggtggggatgtgggtcctcctgccaatcattgctgccacggtaggtgcctgtgtcttctcttctactaccactccttggggcttgggcccaggtggaagtggggcgtgacgtgagtgaggagggtgaccttccaggctgca

SEQ ID NO: 1387 - DNA, 5450 bp, Zea mays
  misc_feature (3714)..(3714): n is a, c, g, or t
  misc_feature (3865)..(3865): n is a, c, g, or t
  misc_feature (4011)..(4011): n is a, c, g, or t
  misc_feature (4089)..(4089): n is a, c, g, or t
gagctcggtacctctggtctcgatccctctatttataccccgcctcccgcacattccttcttcaccaactccggcggccggtgcagcagctagcagtggacgtacttatacgtcttcccccagcttacctctaccttaggtagcatagtggtgcggccgcttggtttaaactagacacatggcgcctcaaagcttggatcttgggctgagtctcggcctgggcgtggcggcgttccagcccagcagcttctgccaccccggcaatgccgtcgtcgtccccgcggcggcggagcgggaggccagcccggccgcggcggaggagagggagcggaggtgctcgcccgccggcagcccggtgtcgagcggcagcggcagcgggaataagcgcgccgcggcggagaggtcggccggcgccggcgccggtagcggcgacgaggacgacgacggtgccgcacgcaagaagctgcggctgtccaaagaccaggccgccgtgctcgaggagtgcttcaagacgcaccacaccctcactccggtaaggctggcttcattaatcattacctcgctcggaccacgggacggatcaggcgaggagagaggaatataactacagatcgatcggcatgcatggctgatgtttcattaatcattatcccgtgcagaagcagaaggtggcgctggccagcagcctgggcctccggccgcggcaggtggaggtgtggttccagaaccggcgcgcccggaccaagctgaagcagacggaggtggactgcgagtacctcaagcgctggtgcgagcagctcgccgaggagaaccgccgcctgggcaaggaggtcgccgagctcagggcgctcagcgccgcgccggcggccccgctcaccaccctcacgatgtgcctctcctgccggcgcgtcgcctcctcgtccccgccgtcgtcgtcgtcgtcgcccaacatccccggcgccgcagctgccagtggcgggagcatggcctctccggcggcggcggcggcgacgttgcccgcccacaggcagttcttctgcgggttcagagacgccggggcggcggccgcggcgtacgggacagcctcgtcggggctcgcgaagccggtcagggctgccagataggcttagtgcagtggaaatgcatgggtccgtttaagttacaactgcaaagcaagtgttgtggctgaaactgaaactgaaagctgaatttttttatgtatctttagaggggaaggaatgcatgcatgcaatgcaaatcttttttattaaacaaggttaattaggatcggtcgatgagctgagctccctctccctgagcatggatgtgtaagtatacataatccatgcatggatgcatgtggaaaactggaaattaattaacactattagatgagctaactctctgtatatatacactcgaactcgacagacacacatgcatgtatccagcgaaaaccatctgttgctttttccggtgctgatgattgcgttcggacagtactgttgtttcgtctgaaagcagttcaagttcaggttcagaccgtacagtagtacgccatagttagcttttcaccatgctgtccatgcatgcatgcatgcatgcagtctttcaggaaatttttggcatgccgaagctaagctagaacgagagctggtcatgctgcatagtgcacactatgcactgaactgaacctgaacgccagcgctggccatgctgcacactgcacagaacgcgagggtggccatgctgcgcgcccctcactcatcattccatgaaccaccgaatatatttgcaggtgtgtagcagtagcaagcagcgggacactgctgcagacgtgtacgtcgtgcgtggctgtggccacgacgcggcagctgcaggccggtaacatgccatggcatggcattgccagcctgccagacaggagcttgccggctgcgcccctcgtgcagcgcagtgggcgggcgggcatcagcacactagctagtagtctagtacgaccgaccgaccgttgtaaattccgtcgcacgtggacgccgtttccggtgtccgatccagtccaggccggtccagccatggcgatggacgaccagagagctagctagctactggagcgggatcgaccgacgacgacggatcagggaggagaatcagataccagctagggcgcacgagcgcgcatgcgacgacgacgacgacgaagctgccctgaaactgaccaaggcaaacgattattaatttatttttgttttcatgacatgttatcgaaatacgtacgatatataaaaaaacggcaagttggtcgcattataaataacgcgctatatatattgggtgtctccttgtcgtttattaggtttaggggccacgcaacgcatgtcggcatgtgcgtgtatgtattagtcttcaataaccatcatcgtcttcattctgctctgggacattggagtatacgtagatctcgtttgggacggttttgtttctgctgcaacaaattatagaacgattattaattgtttcaacaacactttattgtttgataatatatcctgttaaagttgtgaagagggacggagagagcacacagtgcagcggtatagatcgatcgaggacgatgaaacactagaatatatagtgtgggcgtgggcgagcgtggtgacagggaggcgaatgttgactggcactagacaaaagatcaaaaaaaaaaatgccgccgctgaccggcgcttgcacgtgtgggcgacatgcccgtacgccgggcctggctggcgccttgggattccacgacgcaacggcaacgcccacgtggtacgccaccaccctcctcctcgatctctcgctcgtctcctcgtcgtcgtctcttggcccgtccgacggtccagtccatggacggatatatattgcgttgccgccgtacgtacgtgttggcgtgttagtttaacactacaatgactagtagtagatcagaataaactagagctagggctttagtatttgatcacggccggccatgttttccgtcgtccatgcatgcatgcattggccttggcctggccgcctacgcatactttgccgctaggccgccctagctggctggctggctagcttgcctatgcggcactatagagtaggactaggagtagcttgcttcccgcgcccggccggcgtgtgcctgtttccgtttcgtagcgacgaggcacgtacgagtagataggaccccagcatcgcatacgccatgcgccatattggcctcgtgactcgtgcaccgtgtgacgacccggcggatttgccgcgcgcgcctgtcggagagatctcggatgccttgttgttgtgtggctctctagctgctacggtgctagctagggagtagtagtagtgtgcagcagcagtggctgcttggcaatggcaacgtgcgcgcgcgcggcaggaacggaacggtccggccggagcgtcgtatacgtgcacattgccatgaattataataatacagcgccgtcgtctctaatggtaaccacatctgatgaatcacgcacaaaactctccaatattactagtgcaagcaccattattacgcattaattacattgctttggtatatcaccatcgatcacagtgtaataatatgcttaaggccaagttgctagctagctagtgcatgaccttaattagcaagcaaattattgggtccaacatgcaagagaggcagagcagcantacgtacacagacggaacaaatgattaatcaggcatcatgtaacctcccacgtacacaattattgtcgggatacgcatatataccaccgcgttgcatacgctacgctacgccaggccagcatacatgatacatactgcactcatcatcatngatgatggatgatgatccatcagggggtcagggacggccgagaccgagcgcgacgaaatgattaccgccagaggcaccaccaccgggggtggccatgcatgcatgcatgtgccccgcctggaacatgcaattattcagagcggcanctgttaccgaccgatccatcgatccagctgcctaattacacgctctgcaattattattaacccatcatcatcatcatnaacttgatctcgctcaccggccggcggccgcccatgccctgcattgcatgcagcagtggttttcacatcacgcctatccctgtttgcttgggtttttcagacttctggccaccaaaagctgttgcggactgctaaacacctccagctttttagcctgtttctataagaatcaattcggtaaaaaccatttaaaaaacaataagagcacggaatcgatcgagtcgccacgatagtaggaatccatcgctttctatatcctgaactcttcggaccacttcatcttcctccataagtaatctccatgatactcagatttttcttacagtcacattctctccacggtcagattctcagaaaaactgctcagaaaaaaagccaaactaaacgacctgttttggaggcggccgccatcgtacagtactactactcattttcttctcctcattattgttattgggatgggatcgaataatcagatggtgacgagatatatatgcagcgacgtacggatgtatggatcggtcggtctcaggtcgatcgatatccgtctgcatgcacaacgacaaccccaggcccagagcatggttcgttccatcgtccatgcttccagcaatccaccatctggtagtagctagctttagctcccgttaggttactgctgcatctgcaattctgcatatggccggatggatatgcctggaccggccggtcggtcacgactcgtgactcattcatggtggcaaccgaaagctaacggacgccaagctggccctcacgttgcgctgccggtactgccggcccctcctgctgctgccatcgtctccgcagtccgcatatatacaggcatgccagtgccaccaccaccggccacgcactagctagctacctatagttaggagcatgtatagtagcctagtacgtaggtctagtcatgccaagctagcaactggcatgtcatgaacctttgtgtcgtatagccacgttgtccacaccgacgatatgatatcggtgttgtttttttttttctggcttattgtatatatactggtacaatgcacacgtattgccgagttataggattatcgtgtgccaggcttagaaccgtgtcagggccttgggggctatccctttaggtgcatcaagacataagggccttggggggcttattccattaggccccatggcatgagggcctcggaagcttataccattaggtgtccccgacacaagggtcctcgggacttatctcattagggacctcatcgcctcgatggcttatctagctagatgtctccgaacatgagggccccaagacttatcccgttatgtgggacctatgtcgcaaagggtcctaagggatt

SEQ ID NO: 1388 - DNA, 1656 bp, Zea mays
  misc_feature (400)..(400): n is a, c, g, or t
accaactccggcggccggtgcagcagctagcagtggacgtacttatacgtcttcccccagcttacctctaccttaggtagcatagtggtgcggccgcttggtttaaactagacacatggcgcctcaaagcttggatcttgggctgagtctcggcctgggcgtggcggcgttccagcccagcagcttctgccaccccggcaatgccgtcgtcgtccccgcggcggcggagcgggaggccagcccggccgcggcggaggagagggagcggaggtgctcgcccgccggcagcccggtgtcgagcggcagcggcagcgggaataagcgcgccgcggcggagaggtcggccggcgccggcgccggtagcggcgacgaggacgacgacggtgccgcacgcaagaangctgcggctgtccaaagaccaggccgccgtgctcgaggagtgcttcaagacgcaccacacgctcactccgaagcagaaggtggcgctggccagcagcctgggcctccggccgcggcaggtggaggtgtggttccagaaccggcgcgcccggaccaagctgaagcagacggaggtggactgcgagtacctcaagcgctggtgcgagcagctcgccgaggagaaccgccgcctgggcaaggaggtcgccgagctcagggcgctcagcgccgcgccggcggccccgctcaccaccctcacgatgtgcctctcctgccggcgcgtcgcctcctcgtccccgtcgtcgtcgtcgtcgcccaggcctagcatccccggcgccgcagctgccagtggcgggagcatggcctctccggcggcggcggcgacgttgcccgcccacaggcagttcttctgcgggttcagagacgccggggcggcggccgcggcgtacgggacagcctcggcggggctcgcgaagcctgtcagggctgccagataggcttagttggcgtcgatgccatggaaatgcatgggtccgtttaagttacaactgcaaagcaagtgttgtggctgaaactgaaactgaaagctgaaagctgaaatttttttatgtatctttagagggaaaggaatgcatgcatgcaatgcaaatgtcttctttttaacaaggttaattaggatcggtcgatgagctgagctccctctccgaccctgagcatggatgtgtaagtatccatgcatggatgcatgtggaaaactggaaattaattaacactattagatgaggcaaccctctgtatatatacactcgaactcgacagagacacacatgcatgtatccagcgaaaaccatctgttgctttttccggtgctgatgattgcgttcggacagtactgttgtttcgtctgaaagcagttcaagttcaggttcagaccgtacagtagtacgccatagttagcttttcaccatgctgtccatgcatgcatgcatgctgtctttgaggaaaaattttggcatgccgaagttaagctagaacgagagctggtcatgctgcatagtgcacactgcactgaactgaactgaaactgaacgccagcgctggtggccatgctgcacactgcacagaacgcgagggtggccatgctgcgcgcgcctcactcatcattccatgaaccaccgaatatatttgcaggtgtgtagcagtagcaagcagtagcag

SEQ ID NO: 1389 - DNA, 1504 bp, Zea mays
agattggaatccaattccagggctacacatgcatccatggaattcatgacttgcacgcatgtggcggcgaggcaagtggcaacgtgagcggcggtacggcacaaggccacgacaggccaaaagagaggagacggagcaatggaattggaaggccacgagaggagtctgagctcgccgctttagcgagcgcaagcagagcctgccaaaaggctagagaaaaaaaaatccgccttctcctcccagtcgcaggccaggctcagcctcccctctcccctcctcggcatcttcgccgccggcgatctatctctctcacaatggcggcgcccatgtcagccatcgactcagcgtggcagctcctgatcgccaacttcaccgagttccagctcgccaccgtcgtcaccttcctgctccacgagaccgtcttcttcctctccggcctcccctccctcctcttcgagcgcttcggactcttcgccaagtacaagatccagaagaagagcaacacctctgcttaccaaaacagatgtgtcttgcgcctcattctctaccatgtatgtgtgaacctgcctgtcatgattttctcgtatcctgccttcaaattcatgggtctcaggagctctcttcctttgccacattggtcggttgttgtatctcaagttcttttctactttgtccttgaggattttatattctattgggggcacagggcattgcatacgaaatggctatacaaacacgttcacagcgtccaccatgagtacgccacaccctttggtttaacatcggaatatgcccacccagctgaaattttgttcctgggattcgccacagttgttggtcctgctcttactggccctcatctcttcaccctgtggctgtggatggtgttgagggttttggagacagttgaagctcacagcggctatcacttcccatggagcccatcaaatttcctgccgctgtatggcggctcggacttccatgactaccatcaccgtgtgctgtacacaaagtcagggaactatgcctcaacatttgtttacatggactggttgttcggcacggacaaggattatcgcaaggcaaagaccattgaggagaaagaagggaaaaatctgtagattgtggaagctgctcagcaagactggcgatagagtttcactcatggaaggagatatggatgcaccctagaaacagtcagtttatctcctgaccatcgatactataggttgagatattgatttcctgtgtttgctatgatcaagaatgaggccctggtggccctggtctgtcatgaactgaatttgatgatttgtcatctcctcctggtggtttgctttgcgtttctttcgtgactcgacgggatgtatacatatggaatggcctggcagcagtaataaccatctgaattgagtcgtcaaaaaaaaaaaaaaaaactttgcaccctggaaactttcctctgcatgcttgtgtatttgttgtctccgggccgggcccggtaccc

SEQ ID NO: 1390 - DNA, 1149 bp, Zea mays
ggaccctcgaggcctgcgcgcgaaaagagacaaacgccacattccgccacctcctctcccaaaggctcgccctccccggctcccctcgtatcttcgccgtcggcgatcaaaatggcggtgcccatgtccgccatcgagtccgcgtggcagctcctgatcgccaacttcaccgagttccagctcgccaccgtcatcaccttcctgctccacgagaccgtcttctttctctctggccttccctccctcctcttcgagcgcttcggactcttcgccaaatacaagatccagaagaggagcaacacctctgcttaccaaaacagatgtgtcttgcgtcttattctgtaccatgtctctgtgaacctgcctgtcatgattttgtcgtaccctgccttcaaattcatgggtcttaggagctctcttcctctaccacattggacggttgttgtatctcaagttcttttctactttgtccttgaggattttatattctactgggggcacagggcactgcatacgaaatggctatacaaacatgttcacagcgtccaccacgagtacgccacaccctttggtttaacttccgaatatgcccacccagctgaaattttgttcctgggattcgccacagttgttggtcctgctcttactggccctcatctgttcaccctgtggctgtggatggtgttgagggtattggagactgttgaagctcacagcggctatcacttcccatggagcccatcaaatttcctgccactgtacggtggctcggacttccatgactaccatcaccgagtgctgtacacaaagtcagggaactatgcctcgacatttgtttacatggactggttgttccggacggacaatggttatcgcaaggcaaagagaccattgaggagcaagaagtgaagaagaagaagaatctgtaaagtgttgaagctgctcatcaacaggactggcgatagagttgcgcctcatcatggaaggagagaagatggatgcagtcagttattgcctgacgaccaatactataggctcctgagatgttgatttccctgtgttttctatgatcaagaacgaggtcctggcgaccttggtctgtcatgaactgaatttgataaaaaaattgtcacaaaaaaaaaaaaaaaa

SEQ ID NO: 1391 - DNA, 1148 bp, Zea mays
ggccgggggaaaaacctcgaggccccgccggccaggccactaaaactcggatagatctcagtgcagtgcttccctgttccctccatcaaggaacagcaaagatccagtgcagagagagaagccccatggcactctgaacaagaaaagaaaagaaagagctagagaaagagagatctcagtcagccagtctctcacaacacaatgccggcaaccaccaagccgatcttgctcccaagggcgtgggcagcagcgccactcctcctcctgctgctgctcgtcctgcacgggagaggaggccactgcgtcggcatggaggcggcggagctggagatggactcggaggcgcaccggcggctgctgtgggaggcgagcacggggcggaggtacatcagctacgacgccctgcggggcgacgtggtgccgtgctccaggaccggggtgccctactacaactgccggatctcgaccaccgccaacccctacacccggggctgcgagagcatcaccaggtgcagggacgcggatccctaggctcttgctttgcttgctccatcgccttgcaaagggaagtggggctgctcctcgctccttcgacgctgcagggcggtgttgctgcaaatgcttactaaatgaagtgtattttattctggcttcttcttttttctttcttcctcttttttttttcttggtcgtccttcctcctttgccgggatatttagtaagtgtagtaatgaagcactaatactaatggatgaatctcgtgtgcaagatgttgaaaaaaaaaagcacccatttcccccctgacttcattgagctttcagattcttcaaaaaaaatgtttttggggaatatgcaactgatgaggtgatattttttttaagaaaattaaccaatacatagctcagttcgtctccccaatgcgctgtgttgaatgagccacctcaggaaatatgcctgcctttcagcatgcctggtctggtgctgaaaatgctgtgcattcaaccaaccatccgtaggcctcacatcgtcacatggatgcaccgacaagctgcaaaagtgtttttttttaagaaaagttcagactgccagagagcgcgcacagttgggaccctgaggccctgacaagaaattgactcttgtctgctgca

SEQ ID NO: 1392 - DNA, 944 bp, Zea mays
  misc_feature (1)..(1): n is a, c, g, or t
natgatatccaaagcttgtgccaggcaggcatcgtgaccacatgagctgccaaaaccccatgattacatggcacctgaggaattgccgcttctcagttcagataagaaaacaatttcagaaaagtcccagttagtacaaaccattcggtcgtggtaaaagtaacatttgaagaaacctcatcctctccccatttgagatattccctcgctcgctcagcaagacgcagcggctgctgtcaacaactggctgtccggcaccgcatttaagcttcaccctcccctccggcctcctccactaaaactcggatagatctcagtgcagtgcttccctgttctctccatcaagaaacagcaaagatccagtgcagagagagagaagcgccatggcactctgaacaagaaaagaaaagaaagaggtagagagagatctcactcagccagtctctcacaacacaatgccggcaaccaccaagccgatcttgctcccaagggcgtgggcagcagcgccactcctcctcctcctgctgctcgtcctgcacgggagaggaggccactgcgtcggcatggaggcggcggagctggagatggactcggaggcgcaccggcggctgctgtgggaggcgaccacggggcggaggtacatcagctacgacgccctgcggggcgacgtggtgccgtgctccaggaccggggtgccctactacaactgccggatctcgaccaccgtcaacccctacacccggggctgcgagagcatcaccaggtgcagggacgcggatccctaggctcttgctttgcttgctccatcgcattgctgcaaatgcttactaaatgaaaggtattttattctgtcttcttttttctgggacatccttcctctttgccgggatattttagtaagggcaggaaggaaccactaataactaaggatgaatcttcgggtc

SEQ ID NO: 1393 - DNA, 764 bp, Zea mays
gaggaattgccgcttctttgaactttcgataagaaaacaatttcagaaaagtcccagttagtacaaaccattcggtcatggtaaaagtaacatttgaaggaaacctcatcctctccccatttgagatattccctcgctcgctcagcaggacgtagcggctgctgtcaacaactggctgtccggcaccgcatttaagcttcaccctcccctctggcctcctccactaaaactcggatagatcttagtgcagtgcttccctgttccctccatcaagaaacagcaaagatccagtgcagagagacagaagcgccatggcactctgaacaagaaaagaaaagaaagagctagagagagatctcactcagccagtctctcacaacacaataccggcaaccaccaagctgatcttgctcccaagggcgtgggcagcagcgccactcctgctgctgctgctcgtcctgcacgggagaggaggccacggcgtcgggatggaggcggcggagctggagatggactcggaggcgcaccgacggctgctgtgggaggcgaccacggggcggaggtacatcagctacgacgccctgcggggcgacgtggtgccgtgctccaggaccgggtggtggcgatgcagcggaggagatcccgggcacatggcccgctccggcaaacctcgaggcgggcggcggcgacgcagtggaggagagcctgggcgcatggtccgctctggattcggggggaggagcgatggtttcggcctttcaagt

SEQ ID NO: 1394 - DNA, 2683 bp, Zea mays
cggtaacatcttgggtgggccttgtagtgcttttgtggtctacgagaggcccatattccttgatgggcttctgggctcaaagtcatacaccgaagcgccaaccgaaatttgtacaattgtactcacgaggaagtggacctgtccgggagatcgagagctgcgtcaccacagtacctgacgcagtaggcgggtgcgaagaacgccggcgacgagctgagctgacgacgagatacggcgggcaccgccgatgtcacgcagaagattatattccccgggggctcgatggcatcgctcgtcacaccgggcgtgtctcttagctcttccgttaccggtcgccgtcacctccggccggttgacaccgctggcttctgcagcactgcaagcactccatttccacggtgctcgacagcatctataaatatcggcctggcaggtcagcttgttcgcacacgagaaggccagggagacgtcttgcttctccttcgctcgtctacctgcttcctagttgttccatcatccatggcgcgcttcgcctccgctgtcctcttcgccgctgtcctgctcatggtaatgatcgatcgaacaacctgctggtcaatgcacgtaaggtagaggaagacgtacgcattcacgaatttccctctcccctcgccctcgggttcgcttgtgcttgtgcaggctggacggctgacccatgcggggccgtcgacggccgaggtgctttggcggcgcgcagtcctgccgggctccgccgtgccgaacgccgtcctccggctcctacgcccctgtcggttctcctctccctttgttgattctattttctaggtacgattttttcaagcaccaacgaatgcatagtgcagatagccacttcgtaagcgaagccaatgccgaggacaccgggcgatccaacgctccgttcaactaccaaaactacaagcgctcctctgcgactgcgacctcacctccaggtgaccgcagtgaagcagggctcgctggtggcagcggcgcgagagatgacacgccgttcagctacagctacagggcgccgagccaacaaggggtacccgccagcggcggcgcgagagacgacacgccgttcagctacagttacagggcgccgagccaacaagaggtaccggccagcggcggcgcgagagacgacacgccgttcagctacagttacagggcgccgagccaacaagaggtaccggccagcggcggcgcgagagacgacacgccgttcagctacagctacagagcgccgagccaaggggtaccggccagcggcgtctcgagagacgacacgacattcagctacgacgactacaaggcgcggagccaagcggtcgccggcagcggccccagagacgatcagttcagctacgattactccgcctacgaagcgcccagcgagcaccaccactcggaggtccgcgcgacggcgcgaagcggcggtgcgggcacgccgacgcctcacacggcggtgttctttcacgaggaagcggtgcgcgtgggcgagcgcctgacgctccacttccaggccgcggcgccggccgcgctgggcttcctgccgcgccgcgccgccgactccatcccgttcacgacggcggcgctgccggccgtcctcgcgctcttcggcgtcgccccaggttcgtccagggccgccgccatggcggagacgctgcgcacctgcgagcggccgccgcccgccggggaggccggggccaggttctgcgccacgtcgctggaggccctggtggagcgcgccgtggcggcgctgggaacgcgcgacatccgggcggtgacctctgcgcttccccgcgcggggctgccgccgcaggcgtacgccgtccgcgccgtgcggcgcgtcggcggcggccccagcttcgtggcgtgccacgacgaggcgtacccttacaccgtgtaccggtgccacgacacggggcccgccagggcgtacctggtggagatggagggcgcccgcggcggcggcgcgatcaccgtggccaccgtgtgccacaccgacacgtcccggtggaacccggagcacgtctcgttcaagctcctcggcaccaagcccggcggcgcgcccgtctgccacctgatgccgtacgggcatatcatctgggccaagaacgtgaaaccctcgccggcgtgaggagcggagcaccacacaccattaatccgctggagaagaactattatgtgttatgttcagggcttggctgtctgatctgctcttgtttgtgctatgctgtgctgtgctatgctaggtcactagatcagcgtctgcaataaaatggactgcttttgtgcagttctgctacatgaaaatactcaattgtgaagccatcagaattcagatcatatatggtgtccctcttctctttgccaaccatgacataagtacgaaggctgcaggcctcctgcctgcgtagtgtcgcaggattttaccgtccctttgtgaaggaaggatttcagcactattgtggcctaagtgagttaacaaagagaagagggacaccgtgtttaattagggagaagaataagaagtatcctttgctcttttaaaggtcaagcttaccaacacatcattgttgcaacttggtggtttttgtaagattttttgagcttggatgtgatactagtggagttggatttagtggcgttttgatgcaaa

SEQ ID NO: 1395 - DNA, 1414 bp, Zea mays
  misc_feature (33)..(33): n is a, c, g, or t
  misc_feature (74)..(74): n is a, c, g, or t
  misc_feature (79)..(79): n is a, c, g, or t
  misc_feature (97)..(97): n is a, c, g, or t
  misc_feature (99)..(99): n is a, c, g, or t
  misc_feature (117)..(117): n is a, c, g, or t
  misc_feature (220)..(220): n is a, c, g, or t
  misc_feature (245)..(245): n is a, c, g, or t
  misc_feature (252)..(252): n is a, c, g, or t
  misc_feature (272)..(272): n is a, c, g, or t
  misc_feature (284)..(284): n is a, c, g, or t
  misc_feature (369)..(369): n is a, c, g, or t
  misc_feature (443)..(443): n is a, c, g, or t
  misc_feature (456)..(456): n is a, c, g, or t
  misc_feature (489)..(489): n is a, c, g, or t
ttttttttttttttttgacagtaacatcacatnttttatttcaaacttcactaagtaaacattacaattgcagngtaanaaactgccgctgctaagngngcttctcttgtctctcanatcaatagcagcagcaggcgggcagctgctgcttactcatgcagccaaacactacactattattaggtaacattaacattatttttaaaataaacttacttanatttaaaatgatttaagtcatcaanaaacganataagttgctttggaacggngggacggagganaaaacaacttggactccattcctgtccatattgagggcactgtcaagtgacatgatatccaaagcttgtgccaggcaggcatcgngaccacatgagctgccaaaaccccatgatggcacggcacctgaggaatagccgcttctctgaactttcgataanaaaacaatttcanaaaagttccagttagtacaaaccattcggtcgnggtaaaagtaacatttgaaggaaacctcatcctctccccatttgagatattccctcgctcgctcagcagcaggacgcagcggctgctgtcaacaacaactggctgtccgacaccgcatttaagcttcaccctcccctccggcctcctccactaaaactcggatagatctcagtgcagtgcttccctgttccttccatcaagaaacagcaaagatccagtgcagagagagagagagagagaaagccccatggcactctgaacaagaaaagaaaagagagagatctcagtcagccagtctctcacaacacaatgccggcaaccaccaagccgatcttgctcccaagggcgtgggcagcagcgccactcctcctcctcctgctgctcgtcctgcacgggagaggaggccactgcgtcggcatggaggcggcggagctggagatggactcggaggcgcaccggcggctgctgtgggaggcgaccacggggcggaggtacatcagctacgacgccctgcggggcgacgtggtgccgtgctccaggaccggggtgccctactacaactgccggatctcgaccaccgccaacccctacacccggggctgcgagagcatcaccaggtgcagggacgcggatccctaggctcttgctttgcttgctccgtcgccttgcaaagggaagtgggtgtggggctgctgctcctcgctccttcgacgctgcagggcggtgttgctgcaaatgcttactaaatgaagtgtattttattctgtgttcttttttttcccttcctctttttttttcttggtcgtccttcctcctttgccgggatatttagtaagtgtagtaatgaagcactaatactaatggatgaatctcgtgtgcaagaaaaaaaaaaaaaatgctacagattaccggagagacttcattg

SEQ ID NO: 1396 - DNA, 1089 bp, Zea mays
accctccgatcctgccgggggaatagccgcttctctgaactttcgataagaaaacaatttcagaaaagttccagttagtacaaaccattcggtcgtggtaaaagtaacatttgaaggaaacctcatcctctccccatttgagatattccctcgctcgctcagcagcaggaggcagcggctgctgtcaacaacaactggctgtccgacaccgcatctaagcttcaccctcccctcggcccgccggcactaaaactcggatagatctcagtgcagtgcttccctgttccctccatcaagaaacagcaaagatccagtgcagagagagagagaagcgccatggcactctgaacaagaaaagaaagagctagagagatctcagtcagccagtctctcacaacacaatgccggcaaccaccaagccgatcttgctcccaagggcgtgggcagcagcgccactcctcctcctgctgctgctcgtcctgcacgggagaggaggccactgcgtcggcatggaggcggcggagctggagatggactcggaggcgcaccggcggctgctgtgggaggcgaccacggggcggaggtacatcagctacgacgccctgcggggcgacgtggtgccgtgctccaggaccggggtgccctactacaactgccggatctcgaccaccgccaacccctacacccggggctgcgagagcatcaccaggtgcagggacgcggatccctaggctcttgctttgcttgctccgtcgccttgcaaagggaagtgggtgtggggctgctgctcctcgctccttcgacgctgcagggcggtgttgctgcaaatgcttactaaatgaagtgtattttattctgtcttcttcttttttctttcttcctctttttttttcttggtcgtccttcctcctttgccgggatatttagtaagtgtagtaatgaagcactaatactaatggatgaatctcgtgtgcaagatggcgggcagcaatgctacagattaccggagagacttcattgagctttcagattcttcaaaaaaaatgtttttggggaatatgcaactgatgaggtgatattttttttaag

SEQ ID NO: 1397 - DNA, 504 bp, Zea mays
agcacacgagaaggccagggagacgtcttgcttctccttcgctcgtctacctgcttcctagttgttccatcatccatggcgcgcttcgcctccgctgtcctcttcgccgctgtcctgctcatggctggacggctgacccatgcggggccgtcgacggccgaggtgctttggcggcgcgcagtcctgccgggctccgccgtgccgaacgccgtcctccggctcctacgcccctatagccacttcgtaagcgaagccaatgccgaggacaccgggcgatccaacgctccgttcaactaccaaaactacaagcgctcctctgcgactgcgacctcacctccaggtgaccgcagtgaagcagggctcgctggtggcagcggcgcgagagatgacacgccgttcagctacagctacagggcgccgagccaacaaggggtaccggccagcggcggcgcgagagacgacacgccgttcagctacagttacagggcgccgagccaacaagag

SEQ ID NO: 1398 - DNA, 903 bp, Zea mays
  misc_feature (27)..(27): n is a, c, g, or t
actataggttattctggtacgcctccnggtgccggttcggaattattcccggtctgacgagctactagctgtggccgccctagtaaacgaaaatgcattctgcgacagcaatacagaatcttgatcaacttactagctactttcttggcagttttacagtgcaagaaaaaaaaaagaattgcctctttgcaccaagcatcctacgttaatcacatgaattccatccttgcccgatgatacaactcaaaaaataaattctacataaaaagatagtggctacatacaattgatgtacacgaacgccacttaaaaaacgagaaacaaactatttctcaataccctgctgcaagtactgaatcaagtcataccctgcggtagtccacttgttgtaagcatcagcacatgttcgtaccatgaagttagcggcctcacgttcattcatctctggatgaaaccgcttccgaagattattgataggatctcccctgctaaagcaaggaaggccactgtccaccattaggttgactgtacttaaaatcccattcatatgcctccttgctgctaggtatcctttgacacacaacctgagaaattggttccatgtatcactcttcatagttccagatggatccagcaattgagtcatctcgtggcttagcttgaaatgtgcactctcaaaccccatgttacctccaggtgaaatctccaaaataaaaccaaaatcaatgtgaactaatctcccatggctatcaaagagaagattgccattatgccgatccttcggttgaaggagtaagctagcagcagctggtcccgcgctgctgctcgtgcacatttctcgagcagtttcaaaagaaggtgacctacaggccataatcttgctgaaatatctctataacccct

SEQ ID NO: 1399 - DNA, 1574 bp, Zea mays
gctggtcaacgtatgtacatatctttcggtccctcgaggcgggccaaaacagctgcgagtcagccgatcctgatccctagccggaggtgggaggtcaccgtcaccgcgcctcgccgccggggcgtcacaatggcctaccgccggaagcctcagccccatccccagccccagcccacgccctcgttggagcaccactacccgtcgtccgtgggccccgcctcacccgactccctcgccgcgcaggccatgcgcgcctccgccgcacaccgcgatgcctcctccctcacctccgcctactccgcctcagcctcgctggcggcctctcgccggagccaccacgagccctccgtgtccacaccgtccctggatagttcaggctatgaatacacgtccatgaagaacctcaacgaggccaagtatggattctggggcacacttgcgcggaaggcaaagtcatttctcgatgaggactgctccccggagcagtacaaatcgccaagagatgatgtgcatgttggtgtccagcttccacattcaaaacaattgccaggagagacgtggaaacctgagacacctccatctcagaagagatctgagtctataacttcctcccttacctatattggaggcacaataaaaaatgcacttgaagaaggtcggaccattgtagagaataaaacggctgacattattcaggagacgcgtaaactgaacataagaagaaaaggagctggtctaaatacacaaggagaagctggccacaaaattgctcaaagacaccttcctcaaaatccacttgaccatgaaactcagttgaaggcatctcgcgacgttgcaaatgccatggctgcaaaagcaaagttgctattgcgggagctgaaaactgtgaaggcagatttagcttttgcaaaggaacgatgtgctcagcttgaagaagagaataaaatgttgcgtgagagttatgacaagggtgataatccagaagatgatgatctgatccgcctccagttggaaacactactagctgagaaagcacggcttgcgcatgagaactcagtatatgcacgagaaaacagattcctgcgggaaatagttgagtatcaccagctcactatgcaggatgtcatatatgtagacgaaggcatcgaagaggtcaccgaggtgtaccctacacaagtactacctcgcactgggtcgagcgtcagtcgtgcagccactgcagctacaccgaaatctgctccgacgtcaacataatcttgccctgtcgtacaagcttctacaaatacactttttcgcggtcatctctgagcaatagatcaaagcgcccacctccaaccttcacggaagagtaaggtggttgtttggttgtgacgggaccacatagtttatgctgctactgttcaatgtaaacaaggattcactgttgttatgcctgtttgttgtcgtgactgagctgtggcgaaatatgaatgaacagtagcttctgactttctatatatattgtctcttaaccgtatttatggtcagagactcatggttatattatagtctcttaattgtctcttatacttggc

SEQ ID NO: 1400 - DNA, 1589 bp, Zea mays
cattgggtacctcgaggccgcccgccgggcccattgggtccctcgaggccggccgggaggatgaaatggctgcgccccagcacgtccgcgccgctcccctcgcacgcgcgctccgcgctaccgccaccgccaccgccaccgccaccgcctccgtccccgtacccgttcccgtccccgccggcatcaagtctcaggggacttcccgccgcgcactgctcggcctatcggagcctcagctccgccagcttgccatcgatctcggccagcaaagctaccggggcaagcagctgcacgacctcctctacaaatcaagagccaagcaaatccaagaattcaaccacgtgcccaaggcgttccgggaggcgttgcttggcgctgggtggagtgttggccggtcgccagtgcaccacgccgtcacagcctcggatggcactaccaagatacttctcaagttggaggataaccggttgatcgagacagtggggattcctgtcgatgatgacaacaaaggctcttctaggctcactgcctgtgtttcatcacaggtcggctgcccccttcgttgctcattttgtgccacggggaagggagggtttgcaaggaaccttcaaccacatgagattgttgaacaggtgttggccatcgaggagacgttcaaacacagggtgacaaatgttgtgttcatggggatgggtgagcccatgatgaacctcaagtcagttctagaagcacaccaatgcttcaataaggaactaaaaattgggcaaaggatgatgacaatatctacagttggtgttccaaatacaataaaaatgctagcatctcacaagcttcagtcaacgctggcagtcagtctgcatgccccaaatcagaagctgcgggagacgattgttcctagcgccaagtcttaccccttgggagcactaatggatgactgcaagagttacttccttgaaactgggcgcagggtatccttcgagtacactctgctagctgggattaacgatgaaaaggagcatgccgaagagctagcagaactacttcgtatgtgtggaggtggttaccatgtgaacctgattccctataacccaattgaaggctccgagtacaagagaccttacagaaaagtggtccaagcctttgttgatgctttagaagcacgcaagataaccgttagcgttcgacggacccgtgggcttgacgctaacgcagcctgtgggcagctgaggaatgagtttcagaagaatccactacttgagattgaaccgtcaccctccacagagcggaccctcgtagctgcttaattgaaacacctatcaggttgatgcagcatgttcaagcatacggaatcgtcatttaatttatggggacattaggtgttgtaaagtgacagcaagttatgcataacgctagagaattttggaacgttctgtccgtgcccatctgatgtcatgagtggcaattacggaattaccacacttgtctcagatattataaacccatctttgttacagaaagtcaccagaaatgaactcctactgtccatggcctgttgcattcacaacaaaaaaaaaaaaaaaaaagcggcc

SEQ ID NO: 1401 - DNA, 3362 bp, Zea mays
aaggcagcaaacatgtgtcgctagatatgttgcttcagtgctccattttgaatgtttgaatccatagtatgaaataatgtcaattttattttgtttgactaggataaggatcacctctatttcctttttctttccccaaaaatagtgatgctttggctttctttttaccatcttctatggtatgactgaactaatgtatccttatatctcgtaaaggatgcaaatgccatggctgcaaaagcaaacttgctattgcgggagctaaaaatgtgaaggcagatttagcttttacaaaggaatattgtgctcaacttgaaggagagaggaaaatattgtgtgagagttatgacaagagcgataatccagaagatgatgatctggtaaatattgtttcctttgaaaaaacaagatactaaatatattctttagtctgttgactgcagttcccttgcccaccactgcatgtccaacatcacatactttgcccacggtaagtgaaatgctcaactatgttctttgcccacagtaagtgaaatgcagctctttacatttccggacaagtatcaagacaaaatttggcaaacgtgctcaggaggagtcgtttctgcatcttggaacttagaggacacgaggagcacgctgagccgcttcgtgatcatcatatggctgtttgtagccctgatcatccaatccagctacattgcgagcctaacctccatcttcaccgtgcaacacatttattctcatttctatcagctaatataacaatgagtaaaatttctatattctagaattcatgggctcgttgaccactcttaaagtgtggttttcttcatctgaaatcatttgcctcttattcctccccgataaaaattgcagtagacatatcacgttgagctttctagcaaggaatttgcatatgataaagaaaagagtctgtggtgttccacaaaaaaaacaatgtgttcactgttgtcttggaggccatgtctactgaaaagttattttcattctttgacctgctttcttgtcgtttatgctttctttcatgttggttccttatttgggattccaaatattagctgtgaactctgttaagttgatgagacttggagatccacttagacgcttaccattatgtttggcatgacagttgaagacgattgtaagccactccacttcacatccgaactcgtgatctactaagctcaccatcataagatgtgatagtttgctggacatgcatctctaaatgtctacccgacccatttgtgatatattctatgggtttgtaggtccaagcatgtttttatgttgccaccaatctaaatttgtagttgcttctatcatagagttaaactacttgagaaagtattggaatctagtttgcacctcttgattatgtgtgttcttgatctaacatgtagcttttgtgatatattttttttttttttttttgcaagtattgtactatcatatatagaagtctgtatgatattaaaggttgtaatatagtggtcctgttgcaacgccgagcactcacagatatagaaataaaagttaccacagagtacatgcaagcatcgcagtttcatctcaattctcaacatcgaatcacaaccgatgatggtgaaattcagcaatcggcaatgcatccagcgcgtacgcgtctactcccgtgcgagtttggcggcgtccgacaagaactggccaaacgcagcgcgcgatgagccgccgcccctccgggccatggtcgcggcattcctatgcgcggccacccgcgtcctgagctggttgccttcctcggactcctccaacaccaaccttaccttggcctccacctcctcagcactgaccagcccctgctgccatccaaccatttccacgccgaccatggcttcctccaccatgaacagcttgttcattttctgctccgcgtacatcggccagcaaagcatcggcacgccagccgtgataccttccagcaccgagttccacccacagtgcgtcacgaacgcctgtcgccctatggttgagcacttccacctgcggcgcccagtgcttgacgaccaggccgcggtctcttgtggcctcgaggaacccgtccggcagaagggcgtcgaggtcggtgtccgcacggggatcgaacagcctctcggtgtcaccgcgcagcggggctcgcaccacccacaggaaacggtggccggatctctgcaggccgacggcaacctccctgagctgctcttccgagtgggtggccgcgcctatgctcccgaagcagagcaacaccacgctgcgctctggttgcccgtcgagccacgccaggcattcgtgcttctcttttgcctctgcgccggcaccggcgaccagtggcccgacgcagtacaccggaggcgtcctgcgtgctctgccgctgctaggaggaaccagctgtgggtcccggagagctcccaccgcccgagcttccagcgacgcgaacgtgttcaccaagatgccgtcggggtcctccgctccccttcgcatcgcgttcatcatcgcggtgtatatctcgctctccgggtccagcatctggcgcacgaggtgtgacgccggaatgggaggcacgccggagaagttgacgggggcgtctccgagctccttgaagcttggttggccttccgcgcggatccaaggaagctggaggaacacggcgagcgcggaggcgttggcggcgcagaaggtgtaggccgggagcccaagctccttggtgacgtcgagcgcgtcgacggaaagcgcgtccacgatcaccgcgtggacgcttcggggaggcagggagcagaggaactcacggaggcggtcgttgtagcgtttcagtatctggaagtaccagaggaacggctccccgtcgtctgtgacagtgggaggattctggatccgaaggagcctgtggaaggcgacggacggcttggcggaggcgacgcggtcgacggcgtctgccaaggcggcgtcttggtccaaggtgaggtcgatgagcgcgaccgcaacagcgtaaccctcctctaggaacatgtcggcgagctgcatcatcgggacgaaatggctgacggataggccggggtacagaacgaccgtcttctccatgaagtcttgcttgcggagccggaggtaagagcttccgcgggagagagaagtctacctgacaggttgagtggtgccgtggtgtatcgtggaggtggagtggcctacggactgccgtccatctattttcgtttgcaagacagatattttagaggaggcagatgaccataaggctcccgcacataatttcttccttacgttgtacaagcgcatttaaggtctatttggttcgtggctaactgtgt

SEQ ID NO: 1402 - DNA, 2310 bp, Zea mays
ggccggccgggccgggatcgaacccacttgccactcacttccgcctgaactttgccctgccttctctcgacgactcccctgtccccgccgccgccgccgccgcaaatccccttccgcgtctgtctggcctctggggcttctaggttagcgcgtgccaccaccatggccgaggaggtccaggctccactttccgccaccatggccgaggaggtgcaggctccactttccgccaccatggcgaaggaggcccagtcgccgccgtccgcaaccatagcggaggcgacggcgccgccgcagctcgtattgtttaactcctttacgaagagggaggagccattccagccccgggtagaggggaaggtagggatgtacgtctgtggcgtcactccctacgactttagccacatcggccacgcgcgtgcctacgtcgccttcgacgtcctctacaggtaccttaaattcttggggtatgaagttgaatatgtccgtaatttcacggatattgatgacaagattattaagcgtgccaatgaacgcggtgaaacagtaacaagcttgagtagccagtttatcaatgaatttcttcttgacatgactgagctccagtgcttgcctcctacctgcgagccacgggtaacagaacacattgagcatattataaagttgataacacagataatggacaatggcaaagcctatgctattgaaggagatgtttacttttcagttgaaagttttcctgaatatctcagtttatctggaagaaaatttgatcaaaatcaggcaggtgcacgggttgcttttgatacaagaaagcacaatcctgcagacttcgcactctggaaagctgcaaaggagggtgaacctttttgggatagcccttggggccgtggaagaccaggctggcatattgaatgcagcgcaatgagtgctcactatttaggacatgtattcgatattcatggtggggggaaagatttgatttttcctcatcatgagaatgagcttgcacaaagccgcgcagcttatcctgagagcgaggtcaagtgctggatgcacaatggctttgttaacaaggatgataaaaaaatggcaaaatcagataataactttttcacgattagagatatcactgctctttaccatccaatggctttaagatttttcttgatgcgcacacattatagatcagatgttaaccattctgatcaagcgcttgagattgcatctgatcgtgtctactacatttatcagactttatatgactgtgaggaagtgttagctacatatcgtgaagagggtacctctctcccagtgccgtctgaggagcaaaatctgattggaaagcaccattcagcagtcttgaatcatttgtcgaaactgcagcttaaaaccacagatctgctggaccgttgcttcatggagctgctaaaggccataaacagcagtctgaatgatttgaagaaactgcagcaaaaaatagaacagcaaaagaagaaacagcaacagcagaagaagcagcagcaacagaagcaacagcaattgcaaaaacagccagatggtgttgggcaagctctgattgcactggaaaccgaacttaaaaacaaactgtctatacttggtctgatgccatcttcatctttggcagaggtactgaagcaattgaaggacaaagcactaaagagagcggggctcgactgaagaaaaattgcaagagcagattgagcagagaaacgttgcaaggaagaataaacagtttgagatatctgatggaatcaggaaaaaccttgctaccaagggcatcgccctgatggatgaaccttctggtacagtgtggagaccatgcgaaccagagggatctgaagagtcatgattatacgccgcacccactcaacaaatgatggtaaaatgagatttttgcctgagggcagctacacattttgaactaacaaaatcaccatctctggatgcagtattcttcactcaggggtaggggtccaggttgactcgccagtcgccagttgaaacttgcatttctggttgtgtaagaagcaatggaccccatatatatatactttactccttgcgaggtttgagttttggttttggatataagacttggcaattccatttcaatgaaacagatgaaattttgcttggtactcttcgcgtgtgttagtggtttagttttgttgtgcaccggtggtgcttgagatgaagtcattgctttattttaaggtaatgaaaactgttctagcagaatttggttagccccctcgggtcatgaaaatgtcatctttttggatgttg

SEQ ID NO: 1403 - DNA, 1763 bp, Zea mays
  misc_feature (1746)..(1746): n is a, c, g, or t
agggtttgcttgcgtacgccgcggcgagtcgctagccgtctcaaaaagcagaaggagtcctcctccctggtcacatctgactgaggagggccgagggtttttagaggaaggaacccgtccgcgaccgatggcgatggcgttgtcgccggggacggtgcctttgggagtgctgctgcggcgggaggtcaccaaggagcggatggagcggccggacgtgctgtgcggcgaggccaacctcagccgcaagggcgaggacttcacgctgctccgcgccgacgcaggccagcgcatccccggcgacccgtccacctccttctccgtcttcgcgatttttgatgggcacaacggatcaggagctgccatatacgcaagggagaatctgttgaaaaacgtcttgcgtgccattcctacatgtttctgcagggaggagtggcttgccgtgctcccacgtgcgcttgttgcagcgttcgtcaagactgataaagattttcaggcagtggatgaaacttctggcacaactgtgacatttgtgataatagacgagtgggttgtgactgtagcatctgtcggtgattcacgttgcatactagaatctgccgatggctcaatctactttttatcagctgatcatcgctttgactccaacccagatgaggtcaagcgcgtgacagcatgtgggagcaaagttgggaaaatggatattgtcggtggaccagaggttggtcctctaagatgttggccaggtggtttgtgtctatctagatccataggggatcttgatgttggtgaatgcatcattgctgttcctcatgttaagcaagtgaagctttctaatgctggaggcagaattatcattgcaagcgatggtgtgtgggatgatttgacttgtgaaatggctcttgattgttcccgtgggttctcatcagatgtagctgccaatcgaattgttaatgaagcaacccggcctcgtggaatcagggatgatactacttgcatcgtaatcgacattctaccaccagaaaatatagtcccgagtcctcgtaagagaccccgcaggattacattcaataatgtgtttcgcaaaagacatctagacgtcccccccgaaacaaatagatcagaatatgctgaaccggatgtggtggaagaaatatttgaagatggctctccgatgctttctaaaaggctaactaccggatatacacttgagaaaacttttgcaccctccagttgtgcagtttgtctggtacggttgaaatctggacagggaatttcagtgcatgataacccattgcaatatgagaaactacaaggttggcagggtcctttcctgtgcccgagctgtcatgaaaagaaagaagcaatggaagggaaacgccggccaaaaggatcttcatcaaacgtctttggtcacatgtgctaggcctgcctaccactaaagattcttttattgattgttagctggaaataatagtcagcccataacaattcattggctagaattgaccgtttcagttgagtaagacggaatattcttgacaaacagcctggagatttattcatcagtttgagtagagcataggaaaacccatcttattttttcgaaggactacggctgtgtccgcatctaggcatttcactgtacagactcttgcttgtatagagatcttctaaatgatcattagtcttcctgtaaaaaaaaaaaaaaaaaaaaaaaaaaaaaaaaaaaaaaaaaaaaaaaaaaangaaaaaaaaaaaaaaaa

SEQ ID NO: 1404 - DNA, 888 bp, Zea mays
ttttttttttttttttctttttttttttttttttttttttttttttttttttttttttttctacaacaggagatcatcatataagtaaacagtgcattacacgaatgtctagaacccagctgaaacaacatgctgaaacaaaatggtcacggcaaagcagtatgcacgctaccaacattcaacagagaatgaaaaaaaacacttatttacaccagaagagagatggtaggtcgacatcaggccatctctgaccgctcagcagttaacagagactcaagctcctctctcctcttctctagctcctccagatccttggccgcttgctcctgtgatgttgctttatgctgcctagaacgttttaaaacaccaagacatagtatacctgcgattatgtagacagctccacacacaagaagcatgtaggtagcgatctcctggatcaaaatcagctcgctcctctcaacatttgggtacgccttggtcatgatagcaacaaagatctgcagcattccccttgccggcaagtactcaaatatcttccagagcctgatgacgggtgcccactcggtctcgagaacggcgacgaagacggagaacaccaccgcgtagcaccggaacacgccgccgatgatgtcagcgccgccgcggaaggagtagaccgcggagaggacgttggcggcgacgcagagcagcgcggcggcggccgtgacgacgccgaagaagcggcacacgatgaggaacgggtccctggagccggcgcgccgccggggccgcagcggcgatgcctcggccccaccgttcgccatttcccgcctgctgggtcgggtgaatcgaatcgaggagtgcagagtagagacacacaggatcgggatgctggatcccggccgg

SEQ ID NO: 1405 - DNA, 1247 bp, Zea mays
tcgagccggccgggccgggagttccctcgacgatcccccagtcccctcccctcacggctgcatgcccgcatccggattccggtccatccggcagccagacgctgccgccgtaaattccccttccgcgtctgtctggccggtggccgctgtggttttgtaggctagtgcgtgccgtcctcggacctctcctctcgtcctccaccaccatgactgaggcccagtctccactatccgccaccatggcgaaggaggcccagtcgtcgccgtccgccaccgtagcgcaggcgacggctctgccgcagctcgtattattcaactccttgacgaagagggaggagcccttccagccccgggtggaggggaaggtagggatgtacgtctgtggcgtcactccctacgactttagccacatcggccacgcgcgtgcctacgtcgccttcgacgtcctctacaggtacctgaaattcttggggtatgaagttgaatatgtccgtaatttcacggatatcgacgacaagattattaagcgtgctaatgaacgcgtgtgctctaaattgtgtagagtaaggattttgttctagaattgggtgctctctggactccggtcgtacttgctgcacacatgttggtgattgctcaatcagtgctcgcgattgggaaatatattgtctagtagctttgtctcattgtagtgttgtagtagtaggttgtgtgttgttggtcaagctcagttttggatgttcaacctagctggatccgggccatgtttaaactctattagttgctagttgcctctggtacctacatctaaataaatgtttgatggactaattgttgctgcaactgatcaagcatttgaattctgcccatgttgtatttttcattggcatgaattcttttgatgtactctatccatcccaaaataaatcaactttagagctgttttaagtttaatcaactttataaagaatagtaccaacacctatgacaccataagtacatatactaagaaagtatgttttcatggtgtattcaattatactaatttggtgtaaaatgttattcatctttatatagattggcccacttaagatagtttgactttggatgattctagaatgtgattcattttgggctggagggaggacatgcaacatgccatgccaatatgtgatcctttgtaactcaggaacactttaagcaagctaatagcgtgttagtactacagttatgtggtgctgttttga

SEQ ID NO: 1406 - DNA, 2261 bp, Zea mays
cattgggtccctcgaggccggccggggacgatcccccagtcccctcccctcacggctgcatgcccgcatccggattccggtccatccggcagccagacgctgccgccgtaaattccccttccgcgtctgtctggccggtggccgctgtggttttgtaggctagcgcgtgccgtcctcggacctctcccctcgtcctccaccaccatgactgaggcccagtctccactatccgccaccatggcgaaggaggcccagtcgtcgccgtccgccaccgtagcgcaggcgacggctctgccgcagctcgtattattcaactccttgacgaagagggaggagcccttccagccccgggtggaggggaaggtagggatgtacgtctgtggcgtcactccctacgactttagccacatcggccacgcgcgtgcctacgtcgccttcgacgtcctctacaggtacctgaaattcttggggtatgaagttgaatatgtccgtaatttcacggatatcgacgacaagattattaagcgtgcaaatgaacgcggtgaaacagttacaagtttgagtagccggtttatcaatgaatttcttcttgatatgactgagctccagtgtttacctcctacctgtgagccacgtgtaacagagcacattgagcatattatagagttgataaccaagataatggagaatgacaaagcctatgctatggaaggagatgtttacttttcagtcgaaagttttcctgaatatctcagtttatctggaagaaaattcgatcaaaatcaggcaggggcacgggttgcttttgatacacgaaagcgtaatcctgcagactttgcactctggaaggctgcaaaggagggcgaacctttttgggatagcccttggggccgtggaagaccgggatggcatattgaatgcagcgcaatgagtgctcactatttaggacatctattcgatattcatggtggggggaaagatttgatttttcctcatcatgagaatgagcttgcacaaagccgagctgcttatcctgagagtgaggtgaagtgctggatgcataatggctttgttaacaaggatgataaaaaaatggcaaaatcagataataactttttcacgattagagatatcactgctctttaccatccattggctttaagatttttcttgatgcgcactcattatagatcagatgtgaaccattctgatcaagcacttgagattgcatctgatcgtgtctattacatttttcagactctatatgactgcgaggaagtattagctacatatcgtgaagagggtatttctctctcagtgccgttcgaggagcaaaatctgattgataagcaccattcagaattcttgaaatatatgtcgaatgatcttaaaaccacagatgttctggatcgttgcttcatggagctgctgaaggccataaacagcagtctgaatgatttgaagaaactgcaacagaaaatagaacagcaaaagaagaaacagcaacagcagaagaagcagcaacagaagcaacagcaattgcaaaaacagccagaacattatattcaagctctgattgcactggaaatagaacttaaaaataaactgtctatacttggtctgatgccatcttcatctttggcagaggtactgaagcaattgaaggacaaagcactaaagagagcggggctgactgaagaaaaattgcaagagcagattgagcagagaaacgttgcaaggaagaataaacagtttgagatatctgatggaatcaggaaaaaccttgctaccaagggcatcgccctgatggatgaaccttctggtacagtgtggagaccatgcgaaccagaggggccgcacccactcaacaaatgatggtaaaatgagatttttgcctgagggcagctacacattttgaactaacaaaatcaccatctctggatgcagtattcttcactcaggggtagggggtccaggttgactcgccagtcgccagttgaaacttgcatttctggttgtgtaagaagcaatggaccccatatatatactttactccttgcgaggtttgagttttggttttggatataagacttggcaattccatttcaatgaaacagatgaaattttgcttggtaaaaaaacaccacgttagtggtttagtttgttgtgcaccggtggtgcttgagatgaagtcattgctttattttaaggtaatgaaaactgttctagcagaatttggttaaaaaaaaaaaaaaaaaaaa

SEQ ID NO: 1407 - DNA, 2244 bp, Zea mays
ggaaaccgtgtttcgacgggccgccgcgggccgggccggcccccatcgaacccacttgccactcacttccacctgaactttgccctgccttctctcgacgactcccctgtccccgccgccgccgccgccgcaaatccccttccgcgtctgtctggcctctggggcttctaggttagcgcgtgcgaccaccatggccgaggaggtccaggctccactttccgccaccatggcgaaggaggcccagtcgccgccgtccgcaaccatagcggaggcgacggcgccgccgcagctcttattatttaactcctttacgaagagggaggagccattccagccccgggtagaggggaaggtagggatgtacgtctgtggcgtcactccctacgactttagccacatcggccacgcgcgtgcctacgtcgccttcgacgtcctctacaggtaccttaaattcttggggtatgaagttgaatatgtccgtaatttcacggatattgatgacaagattattaagcgtgccaatgaacgcggtgaaacagtaacaagcttgagtagccagtttatcaatgaatttcttcttgacatgactgagctccagtgcttgcctcctacctgcgagccacgggtaacagaacacattgagcatattataaagttgataacacagataatggagaatggcaaagcctatgctattgaaggagatgtttacttttcagttgaaagttttcctgaatatctcagtttatctggaagaaaatttgatcaaaatcaggcaggtgcacgggttgcttttgatacaagaaagcgtaatcctgcagacttcgcactctggaaagctgcaaaggagggtgaacctttttgggatagcccttggggccgtggaagaccaggctggcatattgaatgcagcgcaatgagtgctcactatttaggacatgtattcgatattcatggtggggggaaagatttgatttttcctcatcatgagaatgagcttgcacaaagccgcgcagcttatcctgagagcgaggtcaagtgctggatgcacaatggctttgttaacaaggatgataaaaaaatggcaaaatcagataataactttttcacgattagagatatcactgctctttaccatccaatggctttaagatttttcttgatgcgcacacattatagatcagatgttaaccattctgatcaagcgcttgagattgcatctgatcgtgtctactacatttatcagactctatatgactgtgaggaagtgttagctacatatcgtgaagagggtacctctctcccagtgccgtctgaggagcaaaatctgattggtaagcaccattcagaattcttgaaacatatgtcgaatgatcttaaaaccacagatgttctggaccgttgcttcatggagctgctaaaggccataaacagcagtctgaatgatttgaagaaactgcagcaaaaaatagaacagcaaaagaagaaacagcaacagcagaagaagcagcaacagcagaagcagcagcaacagaagcaacagcaattgcaaaaacagccagaagattatattcaagctctgattgcactggaaacagaacttaaaaacaaattgtctatacttggtctgatgccatcttcatctttggcagaggtactgaagcaattgaaggacaaatcattaaagcgagcagggctgactgaagaacaattgcaagagcagattgagcagagaaatgtcgcaaggaagaataagcagtttgagatatctgatggaatcaggaaaaaccttgctaccaaaggcatcgccctgatggacgagccttctggtacagtatggagaccatgcgaaccagagcggtctgaagagtcatgattagctcactgactcaacaagtgatggtggtgtaaaatgagatttttgcctgagggcagttatcacattttgaagactaacaaaaatcgccatctctggatgtggtattctacagggtaggggttccaggttgactcaccagttaaaacatgcatttctggttgtataacaagcaatgaaccccgtatatatacttgacagtttgactcctttggaggtttgatttttagttttggataagacattggtactctttgcttgtgttggtggttcaggctctgtttggttcctttagttactgaagtttagtcgcttaggcaaaaaaaaaaaaaaaaaaaaaaaaaaaaaaaaaaaaaaagggcggccgc

SEQ ID NO: 1408 - DNA, 2885 bp, Zea mays
ttcaacaagtgatggagacataaatgacttctcgattagaataggattgcatcaaggattagttttgagctcttgcctttttgccttggtgatatcccttggtatatgctttttgtgtggacgatgtagtgctagttgataaaagacaggcaggagtaggggcaaatctagggggtttatcggggttagctgacaccgataaaattgatagcttgatcatttaattgtaggttttcttccttttttggtgttggaccttttatatcaagcaccacaaataactcatgcgcaacactccaatttttccggcacatagccttcaaatgcaaacacattctcttctagtaatcattatttgtcctatcaaaatgaggtgacttgccaacatgattagttgcaatcgtttatatcgtttgttgacagtggcctgagctttgataccgcttgaaaggacctagatgtctagaggggggtgaatagcctataaaattatcctactatagcgagcaaagctttattaataaaaagatgctaaaacaactactttgcactagcactaattaaccaagtgcatagcaatggttgtggaattattgcacaagatagtgaggttctccgaaattgtttttggagtgtgataattttaataagagtagttcttttgtgaagtttacttactccatagtatggctagctgaattaacaaagaaatgttgcgtgagagttatgacaagggtgataatccagaagatgatgatctgatccgcctccagttggaaacactactagctgagaaagcacggcttgcgcatgagaactcagtatatgcacgagaaaacagattcctgcgggaaatagttgagtatcaccagctcactatgcaggatgtcatatatgtagacgaaggcatcgaagaggtcaccgaggtgtaccctacacaagtactacctcgcactgggtcgagcgtcagtcgtgcagccactgcagctacaccgaaatctgctccgacgtcaacataatcttgccctgtcgtacaagcttctccaaatacactttttcgcggtcatctctgagcaatagatcaaagcgcccacctccaaccttcacggaagagtaaggtggttgtttggttgtgacgggaccacatagtttatgctgctactgttcaatgtaaacaaggattcactgttgttatgcctgtttgttgtcgtgactgagctgtggcgaaatatgaatgaacagtagcttctgactttctatatatattgtctcttaaccgtatttatggtcagagactcatggttatattatagtctcttaattgtctcttatacttggcaaaaaaaaaaaaaaaatctaagaagtggtattggacgacaaatagtcatgggaatgcattgttgtcagctactaatgtgttaaaaagaatggaagtaaaatgatttcatgtttgaccaattaatatcaatatttatattttcaaataggtttcaaaatgtttcatgattactttagtgatacttattacatatcataaataatgggatttttataaatatttagttaaactaggattgcttgacttttttggagagtgagatttatattgtttttggatgggagtttgtatttggttcagaaataattagggccaggatgtgatggggatgaggtttctaatctttcatcatgcgaagataactcttgatttggtctgccatttttgtaatgtgaagataactatcgaatgcgagggtgtcacatcattttgtaatgtgaagataactatcgaatatgagggcgtcacaaactgataacaacaatggttaaaaactagtttgatctaaaaaaaaccgatgtgatggctactgaatatagtctaaagtatgcccaagaagtcctatttgcatccctaaggattcataacaagttacaagacccaagttgcctaatagacagcgggacaacactgtgatagaatctggatgcaaacttctttcgattattaactctgactttggtcgaattttgacatggagccattgccattagttaggttattgaattattttacatccatagttagatcgtcaacatggagcatgtatgtgttttctgtatctgtatttttacaggtagctcctggagtccgagatagcctcaaacttaacatgaattgggtatccgacttagcttggatgtctttgctggcctcgtaaggaggtgtctaagagggagtatcttcaaaggctttcttgtgtgttccctatctctttggggtgtgccccaacttgggtcagggttctaagggtgaatatcaggtctatgacgacaatgcagctctaggcaaatatagtggcaacctgttgtaatgattttatgccttgcccatatgatcttatggtcaaactagatccatttgaaagattatcaaataacatttctgtcttgtacttatgaacatatgaataaagtggtgtcgagctatcgacgaaccaaatgcttaattttcatggatttgtactataagataagtcttgttcattccatgtccatactccatgattatcattgttgtttctaagcatattttaaataacgatattaggtagcaactgcgagggggaaggtattccccgggtcacatggcactgttatgcttcgtggaccgaccgtaaggcgcccaatgggccttagccgggtgcaaccgaaggcaaccgaaggagatgtacacatgggcacgaaggttcccaagatcatgccctgcgcatgcagcgtacgcacaggcctcacgaaggccaactaaccgccggaatcatgctcctacgaaaagtgtagactcacactccacaatcatcttcatcctatgtaatcctcaacctcca

SEQ ID NO: 1409 - DNA, 1075 bp, Zea mays
actcctctcgcattcgccgtgacgagacgagcgtacgtccgtcgtccagagtgcagacggcaatgcagacccccgcgcgcctctccgccccatcctcgccgctcgtctcctccgcgccaccgatacctgcacggccacaacgcgtcgctttcccctccctccgccgccgtgatctcctcctcctgccggcggcgctgaccctcccgatggtgcgcgccccgttgcctgcctcggcgcgagggctgttccgcatgcccccgccgcggctggtgaaccgttactttctggtgcgcgcgggcgagtccgtgtacgaggggcagggcctcctccgcaccaacccggtcgccaagacctccgtcgacagcggcctctcccccgtggggctccgccagacggcgcgcgccgcgctcgagctccagcgcctcggcgcctgcgaggacgactgctggatatggccgtccatcactcagagagcttaccaggcggccgagatcattgccgcggccaacggcgtcaaccgcagtcgcatcgtgccggagtacagcttcttggatgcacgcggattgggtgcatttgagtggaagagcttagacaccttacccgaggtgtacgcgtcagataatatttctccagacttgaagcctcctcctatcagggatggtactccaaatgagagcgttgcagatgtatttgtgcgggtgacacaactcatgtcaatactagagacccagtactcaggggaaactgttgtcattgtttcgccagattctgacaacttgtcaattcttcaagctggattgatcgggcttgaccttcggaggcatagcagcttgttttttcagcctggtgaggtccggccagttgatccctcaagcatacctgaatacaagcaacctccttctactgtttttaagtgtgcaaatccaccgagttgtaaagagtagttcacttcctgaccttacacttcatattttctgtgcgtgtatgagtataaatgtataatcatgacaaacgtcttggaccttggtgataattgtatatagctgaaattaatgagtcaaaaaaaaaaaaaaaa

SEQ ID NO: 1410 - DNA, 5098 bp, Zea mays
  misc_feature (1060)..(1060): n is a, c, g, or t
  misc_feature (4305)..(4305): n is a, c, g, or t
ttgtgcatctagatataggtcgtatgtagatattttatgaaaactaaaaatattttgtaatttgttaaaatagagaaaaataccatacatgaatcaagatggaacaagcctgttattaggtctaataaaatcattctgtactaatggtcggccttgtagtacagtaggtcatattaagtatattattttattttattttaacaacgtgccatggtataacggccttgtagtaccaaagctatccaacgaaaaaactggatgagaaataaatttggacggacaaatcagcgacataaacgaaaaatctggacaacaaaaaaaacagtgacaaagacaaaaagtattaaaaaaactcccactgtggggcttgaacccatgaccataaggttaagagtcttgcactccaccgactaagctagagggctttgcggttacaaaactgagctcggcgccatagatcatgccgccgagctcggtgccacatcagcgctacgacgtctgtttatgccagcgcaacacgtatctcggcgccataggctatgccgttgaactgtgttaactcggcgccatagcctatggcgccgagcaaagggttcaaaaatgacattaaatttttttagggtctaaacgtgatttttttttcgaggatgggccaaaatacaaaaaattcggtttatacagtagcagcgcagctgctctatgcgtacgctctgctgctcgttgttgctccgtgcaatgcaatgctgaatgctcattggcaggagatggcaagggaatcaaagctgtcaggtttgactggtatcttcatccatgccaggtgcagcaagtgaacaggacggcaggactaggagtcactgaaccagctagagcaagaccgtcctctgagtctgaggagatattggcttatttgcccctgcattattccagttttgcacatagtattctatatcaaagtatttaaacatttgagtcgacaaaccatgcaacatcttcaccggattgacgatttttctctttccctaaaaacctcggatagggattgagaaaactgaactcgaantcgaagctatccataaaaattgctgcagcagattaaaaataatccaccccgattattagatgagacccaggtgtcaatggaagtaaacttttctcgcttttctctccctcctcttcttcccctctctctctctagacttcccgacctaggtcctctttaaatgtgggaattttgttttgtttactacgttatcattacgttttttacctataaaaatgaactaattcctgtctgaaattcttcttaaagagaccctaacacggtggaagcgtgtcctgcctgcctcggcggccaacaaaaggacgaagtggtttgttttacgtacgttctacatacggaacaataattgaagcaaataaaagtagaggggattagttcgaaggaaagtcaagctgctcttattatggcattaaaaaaatcataaccttattctagcgtctggcttcaaattcaatacccactgcaagtgtgctaaaaagcagaaacatggttggtacgcctcaattcaaactctatggtgcggacgagcacacgagaccatgtggtggagagtgcccctggctgaaagtcttcaaagtaatgagttttattcgttctcacatttgttttaggattagttatggaattttcgtctaggagtacttcgtgacctggtattacagaagcggaatatgattgacaagacttgtacaacacgttttatagagaaaaaaaatacaacaatgctctcaatagattttgtatatcatgtgcgaagttgataataattgacttagtgcaaacaataaacgactaaatatatggatggagggagtagtgatcaatagacgattaatttatggattgaagactattgagttttcagagttaaaagctaggcactggatgccacctggatatgggcgatgcagaataaatgctgatgtcgttgtttgtttctagggttacatacaaaggaactgttggagtcatatgtcgagatgatcaaggatgtatcattgctgcaagtgctttggtggtaccgaatctaaaaccttggaagcaatggcttgtgtggaggcagtagccaactagccattgccgaagactggaatacaaataatgacagtagcttcagactgtctaataaatgtcatcaagaatattaaggaaatgcctaggtgcccttatatgatgattcttcaagatataaatgtgagggcgagatcatttgcttgtgtgcaatttgcacatgagggtagggaatctaatagagaagctcattagcttgctaaccatgcttgtagtcctgttcctggccgtaatgtaaatgttgccaattttagttaatattttttatacctttctctcagaaaaagttaggatccaaacaaactataatgttgaggctttaccacgagctatttaggaggtgtttatgatgactccagattatagattcagtgtagagctgtagtttataatatcaatttaaataattttaaaaatatttgtaatctaaataataaacaaaataatttttttcttaaagcatacagcttcagctccacgattttctagagcatctaatgacctgctccactaactcaatcaaattttctagagctggacctatcctaaatagggccttagattgcagattttgagaaactaagaaaagctagattttattatagcctacaagctagaccaaacaaaatccatggggacccaagtaattaactcttgtaccaaatcaaacatatcctaaattcaccctcaaggacccgtaatcttttcagcagatgagccgcccaacggcccaatgttcactggaaaacattattacattaccggcctgaagtagcccaactttttggatatttcactcctctcgcattcgccgtgacgagacgagcgtacgtccgtcgtccagagtgcagacggcaatgcagacccccgcgcgcctctccgctccatcctcgccgctcgtctcctccgcgccaccgatacctgtacggccacaacgcgtcgctttcccctccctccgccgccgtgatctcctcctcctgccggcggcgctgaccctcccgacggcgcccgccccgttgcctgcctcggcgcgagggctgttccgcatgcccccgccgcggctggtgaaccgttactttctggtgcgcgcgggcgagtccgtgtacgaggggcagggcctcctccgcaccaacccggtcgccaagacctccgtcgacagcggcctctcccccgtggggctccgccagacggcgcgcgccgcgctcgagctccagcgcctcggcgcctgcgaggacgactgctggatatggccgtccatcactcagagagcttaccaggcggccgagatcattgccgcggccaacggcgtcaaccgcaggtgaggtgcccaagccgactctctgttttttttttcaggcgccagaaggctaggggtatacctttctctcagaaaaagttaggatccatgaggattctgaattatattgcctttgattgcagtcgcatcgtgccggagtacagcttcttggatgcacgcggattgggtgcatttgagtggaagagcttagacaccttacccgaggtacttattatttctgttcattataccatgaacagtctttcactacagttgcgtgtaaactaggatttatgggagtaccagagcagctagcttgaaagaaacaatgtttcttattacaagacagaagagatacagtatattttcatgttcagatgttgacttacttgcttcatcgtgaaccaaactattgtcagatcaatgccaatgccttgtttacactgctgaattaaatagcgataatggaatttcagcagatacataaagctgctgggctaactgggcatgaactaatagtcagtttttcacgaatgtatatcatcctaagataatggatttctacttttcaattacttcaattgagctgcatgctctaacattagattgtttttgcaacaaatttactcctattgtgcctgaactatgcttttcttggcatgatggctgcattaggtgtacgcgtcagataatatttctccagacttgaagcctcctcctatcagggatggtactccaaatgagagcgttgcagatgtatttgtgcgggtgacacagctcatgtcaatactagagacccagtactcaggggaaactgtcgtcattgtttcgccggattctgacaacttgtcaattcttcaagctggattgatcgggnttgaccttcggaggtactaaaacatagcaacctgattaactctagctagtgtattcggaactgcacttggtatgcaaggatttctctggcgaatagcatacattaacactacacattcctcatttggttctaaggaaacctttcttactcttaagcagaacttgtgtcagataattttgatctgtcgttataatgtttacacacatgaactgtcttcaggtactgttgctacctgaagtcttgaaggaaatcatgtcttaactgtttgatgccacttctgcaggcatagcagcttgttttttcagcctggtgaggtccggccggttgatccatcgagcatacctgaatacaagcaacctccttctactgtttttaagtgtgcaaatccaccgagttgtaaagagtagttcacttccttaccttacagttcatattttctgtccgtgtatgagtataatcatgacaaacgtcttggaccttggtgataattgtatatagctgaaagtattgtttatgtgccacatctaaattattgagcccccttgtgttggacgaactccagatattcacggttcgttcccagttcctttgcggttttgcctggtttcgaacaggtttttgttattggttttgtgtggcagggtgcggtctgtttctgaggtttttggttacggattttgggggagtttgcttggttttagttcatggatcaacttctgtcgagctcgggagattggatgaaattgacgccaagtggaatttaacgcagcaatgtcagaagggtggtggagga

SEQ ID NO: 1411 - DNA, 2458 bp, Zea mays
atgcatacttctgtactcatgtgtctgcctgctaagtgcttttgtggatttgtggcattgttatgcaaccttggtgcctttgtggatttattttgtttaattatttaattgtgcatttgagcagacttggtgaagcatacatgcatgctgcctgcgctcgatatgtaattgcaataattcgggcagagaccgaaatccgactgtacatttcgataaaattttaagagacaataattatataaaaataaacaatatatatattatcatttacctgattacctcaatatctcacaacttatttgcaaacaactaatacaaaactaaattcaacttgggagcgcctcctcctactctccctcggctattcagccacatattaccggcgccgacgcctcctagtcctccccttggttgttcttgcctgggtgcctctagaggcgcatggtggtagagtgtcacggcagcggtttgaggtgtttgtcgatggatgaaggtaaaggtggtgccacggatggagcgtgacgatggcggctagtgagtcggaggccggcaggtgctgaggagtaagcgctcatagtggttgtattgttggttacgcatgcaggcaatagatgagatttatttcatgcgagaagcgagagatgggaatagatttatatgcttcgtgtgtgacgtaggatgacagtcgaaactggtgctagagaggaagcgcttgtaatggttgtatcagtgatactgaggagtaaacgctcttggtggttgtatggttggttacacatgcaagccagagataagatttatcttatctggtttgttaggcgagacgtgagggaggggaatagacttatacgtttcgtgcgtgatacaggacgatggtcgaaaccggttataccctccgtgcgtgacgttggacgagagtcgaaactggtgctggaaaggaaacagtcgtagtggttgtatgggtggtcttggggagtaagcgacgattgaaattggtgctttataggtgtagaatgatggttgtatgagtggtggtaaggagtaattaagcagtcgtgatgattatatgattgacatgcgttgttagactaaaaacgaagggaaaaagacttatgcgctccgtggaggatgacggtcgctttatatgtgtaagagatttctgcaccactagtgcatgtgtgaattgatttgggtttgcgtttatgaagcacgaaaaaaatgttcgtgatcatcttcccgccacgtggcggtggcgctgccgtcttcttccttcgctctcctctgttcggttgggctggagcattttcctcctaaatactgtcaaaagggtcccaactctcaactcgcgctcaatgcatccgctatcgtctctcctcctgttccgttccgccgcgccgcccagcgcgctccccttgcggcggcggcggcggagtcacacgccagtgcgagcatcatggcaggagctggcgggcgtgctggtgttttccgccatccccttcactgcagtcaaggccctcgccaacagtcccctgggtgcccgcctccgccgccgcctcgaggacaggaaggccgccgcagctgccgaggctgacgctctccgcgctgcctcgcgcggcgcccgtaacaacagcttttggtacggtggagatcggccacggtggcttggtcccgtgccttacgactaccctgagtatttgacaggagagtaccctggagattatgggttcgatattgcaggtctgggaagggatcctgttgctttcgcaaactacttcaacttcgaaatcttacattgtcggtgggccatgcttgctgccctcggtgttgttgttcctgagctattagatctatttgggttagtgcattttgtggagcctgtctggtggaaagttggttatgcaaaacttcagggtgataaccttgattaccttgggattcctggattccgaattgctggtggtcaaggcgtcgttgtaattgcaatctgccaagccctcttgatggttggaccagaatatgcaaggtattgtgggatcgaggcactagaaccattgggaatatatcttcctggtgacataaactacccaggaggacccctttttgatcccttgggcctgtccaaggatcccgtggcatttgaagatctcaaggtgaaagaaatcaagaacggtcgccttgcgatggtagcatggtttggattttacatccaggcggctgtcacaggcaagggccctgtacagaacctggttgaacacttgtccgacccactaaataacaatatattgtcctccttccactaaatgaaaatatgcaagagtggcacgaaccatagcaacgggtgtatattgtattagcgtttacagttttacactaatgggttctgaaaattggctattatatttatttagatagacatttaacggtgattagtgatctatttgcagtttggtagtgcgtc

SEQ ID NO: 1412 - DNA, 2426 bp, Zea mays
cccgaagaaaatgctttccccttctcagctaaagtgaccgtggcacattagcccgggtgatactgcggtgggcccgcgttttggttcctccgccattcgacgccaccggtgtgccgtctggtccgtctaccaagctggaatcggtagaccgtttcgtgccggccgggattttgtccccacacgcgactaaaatttacatcacctcgaacggcggcggcggcggcggcggcggtttctcatctgcggcgcctcttcgatgctgtttgctttgccaaggctttgatcccagatggggatctcgtcgggtgcagacttccaccagcagcccaccccacaggccgtgctgccgccacgcccccatggccgtgcgccgacgctgcagacgtctctctccctggctggttccgcctcgccggagcaggtcgggtcgcctccggacacacaggagccgctgtcgaactccgacacggggcatgactccgccacagagagcgccagctcacgggagacttggcctggggagccccgcaagagtggtggcggcgacgctcctcccgtggcatcagcaccgataactgcactgaggatagctgataataaggagaaggaggtggttggtaatggcgtcgccgagctgcaggcctttcggagtaggatcccgagtgcaggccggatgactctcagggaggttgcttgggacagggtggacctcgttgctgagaagatgaagggtatgagcgatgagctgctggacgaaaccaaagccgagctgcagtcgattctggaagggactggcggtcagcaccagattcaggagttcatgtacctgcagaagcttcttcagggcagggttgatctcaccctgcccatccttttgatggctcaccatgtgcagctggagatcctggttgccatcaagactgggatacaggcgttcttgcacccgagcgtcgacataccccagatccgcctcgctgagattttcctgtacaagaggtgccgcaacattgcttgccagagtgctgtgcctgctgaggagtgcaagtgtaacatatgcagtaacaggaacgggttttgtaatctctgcatgtgcgtgatctgcaataagtttgattttgaggtcaatacgtgccgctgggttgggtgtgatatctgctcgcactggactcacacagactgtgcaattcgtgatggaaagattgggactgggctgacgattaagaacggcgttggccatgcagagatgcttttccggtgccaggcctgccagaggacatctgaactgtttggatgggttagggatgtctttcagcaatgtgcacccaattgggacagggatgccttgctgcgtgagcttgactacccacgcgtccgattccgtctaagtgaggactcaaaggggaggaaattgttcagaaaatgtgctgagctagttgaaagattgaggggtggttctgctgaatcaatgactcctagaattctgctacaagcgctgcaagagctggacattgattcctccaagaactttgagcaccaagagccagggcggctgatcactccccaggaggcctgcaaccggatcgctgaggtcgtccaggaagcagtgaggaagatggagatggtggccgaagagaaattgcggacgtacaaacgcgcccgcctcgctgtggaggcgtgcgacagggagctggaggagaaggcccgggaggcccaggagctgaaggtggagcggctgcggaagctgcagcaggcggaggagctggagagcatcatccggctgaagcaggcggagtcggagatgttccagctgaaggcgagcgaggcccaggaggaggccgagcggctgcggagcgtcgcgctggcgaagcggaagtcggaggcggcggggcaggactacgcgagcatgtacctcaagcggcgcctcgaggaggccgaggccgagaagcagtacatcttcgagaagatcaagctgcaggagaaccagcatgccacgagcagcagcggcgggggtgcccgcctcggcggcggagctccctccgccggggaaccctcgcaggcgatgatgctgtccaagatccaggacctgctgaagaacgtgcgcagcgtgccgtccggcaagccagatgggcagcgctccaagtagcagtagcgtcgtggggtgggctcggctgggcgggaactgccactccatcggcctgctggttgttactacttgttattagacgtagtagttgttaactagcagtgtagtaagtttacatgatatatatactgcatttttttggggggaacaaaatgttgattacctgcgcagcattgtcctaggtgtgtttagtagcgacttgttttcactgattatgtgatatgtatgaattgtatgtgcaggggggtcctgtgtagccgaccgccggcgccgctgtccggat

SEQ ID NO: 1413 - DNA, 1455 bp, Zea mays
taccctcgcgggcctgccgggaggaaccaaaatcccccaaccgccccagcgcacggcccggccgtctcaggcgtccgcggagatgacgcagcaggacgtggagatggcggcgcgccacgggaccggcgccgacggagcgggattctaccctcagccgcggaacggcgccggcggcgagacgctcgacgacgacggcaagaagaagcgcacgggaacggtatggacggcaagcgcgcacatcatcacagccgtcatcggctccggcgtgctctccctcgcctggtcgactgcacagctgggctgggtcgtggggccgctcaccctgatgatctttgccttgatcacgtactacacctctagccttcttgctgactgctaccgcagcggcgatcagctcaccggcaagaggaactacacctacatggacgctgtcgccgcgtacctgggtcgatggcaagtcctgtcctgtggtgttttccagtatgttaacttggttggaactgccgttgggtatacaattacagcgtccatcagtgcagcggccgtgcacaaggcaaactgcttccacaacaagggccacgcggccgactgcagcacctacgacaccatgtacatggtcgtatttgggatcgttcagatcttcttctctcagctccctaacttcagcgacctttcgtggctgtccatcgtcgccgccatcatgtctttctcttactccagcatcgccgtcggcctctcgttggcgcggaccatttcaggccgtagtggtacgaccactctgaccggcactgagatcggagtcgacgttgattcagcccagaaggtctggctcgcgcttcaagctcttggcaacatcgcgttcgcttactcctactccatgattctcatcgaaatccaagacacggtgaagtctcctccagccgagaacaagacgatgaagaaggcgacgctgatgggcgtgacgaccaccacggcgttctacatgcttgctggctgcctcgggtactcggcgttcgggaacgcggcgccagggaacatcctgaccgggttcggcttctacgagccctactggctgatcgacttcgccaacgtctgcatcgtggtgcacctggtgggcgcgtaccaggtcttctcccagcccatcttcgcggccttggagacggcggccgccgaccgctggcccgtcgccccgggcgtcacccgcgcgccccccctcgtggccggcaggttccacgtcaacctgctcaggctgacgtggaggacggcgttcgtggtggtgagcacggtgctcgccatcgtgttgcccttcttcaacgatatcctgggcttcctcggcgccatcggcttctggccgctcaccgtgtactacccagtggagatgtacatccggcagcggcgtatacagaagtacaccagcaggtgggtggcgctgcagctgctcagcttcctgtgctt

SEQ ID NO: 1414 - DNA, 1612 bp, Zea mays
caatttgaatcgatggataaagtttgagttttactaggaccctgcttttgtaccaaatcaggtgagtattatacttcaaaatccgaagttccaatcctttgcatctgttttgtgtaagacagaagccttttgtctaaaaggcagtggactcggatatgtgcacatatccgtcgaccgcatcagcatgaacttcgtatgccaaaatgcggcaatgcatttctggaatggagctagttccatcttcccggtggcatcgccgcatcgggacgacttgagaaccatgggtccctttcggtcacgctttccatgaggcgaatgaataatggtcgcctcatacctaagtaaaaaagctttagaactttgtaaaatccccattgcaaaatgagaaatggaaacggaaaaaaagcaagggtttaaaccttcgtcggaactgccaatcactgtagaccgggttatcgctgaagtagtccgccatgatcctcgcgtgtccagcggcgtggtcccggttaatggcgatatgaaattgctaggttgaacggttggagaagtgaaagtttggggggtggggggaggaaggtaataaaaagagtataaagtacgtatagggagagatggatggttggagaagccttatcacaaaaaacaaccaccaagcgacggcgcctgcacaagatgaaccagctctctctcctccaccacctacatcggctgtctcccggacgcggccatggcctcaccgccgtcgtccgagctgggctctcctcctgtgaaccaccaaccccgcagcagcacgcaaaacgcctccttgccatagcgcctcacgaaagcatcgcagcagctagggaggaggagagccacttgcgtcaagagctcgctgcagcgggcaataataacgaggccggcggcggcggcaggacgtgcgctctgccgacgtgggcgctcctcggcggcatcacggtgggcgtgaccgtggcgctggccctgtccgcggggccaggccccgccctggcgctggggccagagggccccctggtggaggagttctgggacaacatgcggcggtacgcgctgtacgttgtgacggtgagcacaggggtggcgtacacggtgctgcagcccatagtggagctgctcaagaaccccgtcacggcgctgctcatcgtggccgtcatcgccggcagcggcttcctcgtctcgcaggtgctcaatgccatggtcggcaactccgacttcatctacaggtatgagtaggtggatggcgagcgtgtggtggcgctgaggtctctgcgtgaccgagaatggagaggtgaacgtgtgctttagtgtgtcaacgaaccaggagctagaacaggaatgtctgaaattgaagtttgctgtctggatgtattttactctgtctgatatttactttgaccaacaggctatgctatgcatgagtgaaagaacgtggacgtcttctagtacctataccacagctcagttttacttttacatctctccagtacttattggtgagacattttttcatagacaaaactaagtagtgctactgaactaaaaaaaaaaaaaaaaggatccaatcggttgaatggtgaaaaacttacgatgttcg

SEQ ID NO: 1415 - DNA, 1159 bp, Zea mays
cccacaatcagaggtctatcagagcttggtacaactacaggctttatcacgaagaaacaggcaccaaacaacaatctcaatccgacaccacaggctgcacaagatgaaccagctctctcttctccaccgcgccttccacctgcatctcctctctcccgaacgcggtcatggcctcacagccgccgtcatccgagttcgactgtcctcctctcaacacaccccacgacagcacgcaaagcgcctcctcgcagtagcacctcacgaaagcatcgcggcagccacggaggagagcagccgtccgcgtcaagagctcgcggcggcgggcaataagaacgacggcggcggcggcggcggcaggacctgcgcgctgccgacgtgggcgctcatcggcggcatcacggcgggggtggccgtggcgctggccctgtccgcgggggccggccccgccctggcgctggggccggagggccccctggtggaggagttctgggacaacatgcggcgttacgcgctgtacgtggtgacggtgagcacaggggtggcgtatacggtgctgcagcccatagtggagctgctcaagaaccccatcacggcgctgctcatcgtggccgtcctcgccggcagcggcttcctcgtctcgcaggtgctcaatgccatggtcggcaactcccgacttcatctacaggtatgagtaggtggatggcgagcgtgtggtggcgctgaggtctctgcgtgaccgagaatggagagaggtgaacgtgtgctttagtgtgtcaatgaaccaggagctagaacaggaatgtctgaaattgaagtttgctgtctggatgtattttactctgtctgatatttactttgaccaacaggctatgctatgcatgagtgaaagaacgtggacgtcttctagtacctataccacagctcagttttacttttacatctctccagtacttattggtgagacattttttcatagacaaaactaagtagtgctactgaactaaagacatttaaaagtggatccaatcggttgaatggtgaaaaacttacgatgttcgtaaaggtattcaaaagtaaaaaaaaaaattcccgcgacagcattactaagactagccgttgtattggatcgaccggggaaaacaaactaaaaaaaaggagt

SEQ ID NO: 1416 - DNA, 898 bp, Zea mays
cctcgaggccggccgggccgagagatggccgcgtggccggcctcgatcagaggaaacaccaccaagcgacggcgcttgcacaagatgaaccagctctctctcctccaccacctacatcggctgtctcccggacgcggccatggcctcaccgccgcctcccccaccgtcgtccgagctgggctctcctcctgtgaaccaccaaccccgcagcagcacgcaaaacgcctccttgccatagcgcctcacgaaagcatcgcagcagctagggaggaggagagccacttgcgtcaagagctcgctgcagcgggcaataataacgaggccggcggcggcaggacgaggacgtgcgcgctgccgacgtgggcgctcatcggcggcatcacggtgggcgtgaccgtggcgctggccctgtccgcggggccaggccccgccctggcgctggggccagagggccccctggtggaggagttctgggacaacatgcggcggtacgcgctatacgttgtgacggtgagcacaggggtggcgtacacggtgctgcagcccatagtggagctgctcaagaaccccgtcacggcgctgctcatcgtggccgtcatcgccggcagcggcttcctcgtctcgcaggtgctcaatgccatggtcggcaactccgacttcatctacaggtacgagtaggtggatggcgagcgtgtggtggcgctgaggtctctgcgtgaccgagaatggagagaggtgaacgtgtgctttagtgtgtcaacgaaccaggagctagaacaggaatgtctgaaattgaagtttgctgtctggatgtattttactctggctgatatttactttgaccaacaggctatgctatgcatgagtgaaaggacgtggacgtcttctagtaccccta

SEQ ID NO: 1417 - DNA, 3390 bp, Zea mays
  misc_feature (8)..(8): n is a, c, g, or t
cccgcggnggcggccgctctttaactagtggatcccccgggctgcaggaattcgcacgagaccattacctagaacatcctcgtggatctcatccatcggaggtgctctcctcttcggcttccttcggcttcggttgcaagaaagaaaaaggtcacctcttaacaccaggccgccgccattgctgctccctttgttcgtttctcggcaccctcgatcccgagcgtggttaatccacgcatcgaccggcgaacgccaccgtatcccatctcgaatacctccgcgctcagcgtcatggacggcttctccaaaacgatcggcggtggtggccctaacgttccggcgggatcccaccccgcgggcgggagccaggcggcggcagggggaggcgcgacgcagcggacgcagtatccgtatgtgactggtacttcagtcattgccttgaaatacaaggatggtgtgatcatggcatgtgacactggagcctcctacggatcaactttgagatacaagagtgtggaacgcattaaggctgttggcaagcatagcatcattggagcaagcggagagttcagcgatttccaggagatcctgcgctatctggatgaactaactctttctgatcatatgtgggatgatggaaattctctgggccccaaagagatccacagttatttgacaagagtgatgtacaacagacgcaacaagtttgatcctctctggaactcactcgtacttggtggagtgaaaaagggtccaaagggtgatgagaagtatcttggcatggttaatatgattggtacccacttcgaggaaaaccatgtcgcaactggatttgcaaatcatctggcgatcccgatactccgtgctgaatggcgcgaggatatgacttttgaagaagctgttaagctggttgagaagtgcttgctggtcttgctgtaccgtgacaggtcatctatcaacaaattccaggtatgaacctattgatcttcgttacagattgctctaaccagtaaacattcaaacaaagctgttcagctggttgagaagtgcttgctggtcttgctgtaccgtgacaggtcatctatcaacaaattccagattgccaagatcacaactgaaggatcaaccatctacccaccatattccttgaagacctactggggcttctctcactttgaaaacccagcccagggcgctgtgggatcatggtagatttatgcgccgcgcacgccgcatatcatgccatgaacttaggcgaaaccaatctgtgctgctgaaatcgaacacttatgaacgtttgttctgaacatcactggaactctgcatttgcttgtatgacatgcttatggttcagcgagtttaattccaacgtttgatcacatgttgtgaatgtggaaaatggattgtgcgattgcgacctcagatgccgttgttgattgtactatgttgaaaacttgaaatgctaaattagtataggtaggtgacctttgccttgtggtcgttgcgtgaactctgatttctacggtttcttgcgtttgctttatgattcatgctagtgttaatgccctctgcgagtgatgggatcttggtagtctgtagtagatgcacaaactgtgttggcaaaactttccatgtacggatctaggagggaggttctccgtcagttaaagattccaatttttgacggaaagcgataccatccccggccaaaactactgctacgatgagaaagcgcaatgagaaatcaacaaagggtacaaggcatgaagacagaatcctgaggtacaacaaatgttgaggaatgtacatgacaaatctacgaagggtgcacttgctgtatcattcatggtaaaactgtgtcactgacacgagagcattaggcagatttgttacaaggcatggaacggcccaagattaaccactactattctttcgttacaaagaggctgtacaacaaaaaaaaagaagaagaatccggagttaaaaattgttgctgctctcaacgaatgtcgacaaatacctaactactaactgcctacgatcctcgttgctttctttacttgacaactctattgctcagcctctcgagctgcggcacgccgtagcttgcagtgagttccatgaatcgttgctttaggacttctagctgtcctagcaagtcgccagtagccacggtagtggcaatttgaccgttctcagactccgtgggttcagggcttctttcgttgtaccatttgactgcttctaattattgtaatttagatacaaactaattaagttaatatattagtataggtgatatatttatattttatcctaaatcatattgaggagatagttatacactacaatccggttaggaataatttcaggctacgtttccgtatgaaccgaacagacccatagtatagtgcctgtcaagtcacaagtttctacttactccctccagccatagtgcataaaccttatggaaagctttcaggtaaatgctgtctccagcaacgttctctaaattttatttttaaaggaatattatatgttctttacaacacactttaaaagattccgtcatctatattttcacatctccaacaacttaccctaaatttcatctcagtcttatcctctatatttttcctaaccatattaacgaaaattcattgatttttcgtatcggctcaaataaataaacttttagcattttacaaattattattttgagcgaacgaaaaaaacaatactgaaaataacaatacaatcaggagggggcatgggctgatttcttggatgagaaattgaaattcacgtggaagacagaatccttccttgtctttgttgggagtcctatcatcattgttacagtattatgcacagactgagcgagtggagagggagccgccacattagcggacgctggcgactggcgtcgtcccctgcttgagccttgaggctgtccgcagcggcgcctgtaaacatcaactgtaaatttttacagctcttatccatgctgcagcggtgaactgcaacaggaaccgtaaaaaaattacagctctcgggaacttcacagctaggcagctagcgcaccttctactgtcagttaggtgcggcgaggaaagaggtgaaaataaataataaaatatgtggtagttggtatagggtaaatatttagagtgaatatgaccgtggagtattatgagagtagataatcttgctgactaaaatgaaatatttcttttaaagtagaaatgtagggttctatgagtgcggatagcatccttactggagcatttaacgcgtgttgatggaggaacaaaagaggcaagtgcacactaaatatagcaaagagatgcatgtaacgaacctcgttgggaagagcaggaacgccttgta

SEQ ID NO: 1418 - DNA, 3833 bp, Zea mays
ttggggttgtaaacgttttagaaatatacctcctttcattcgtcgaaagccgggaaggggttgagcggcggcaacattctttgtgaaaactttctcaaagatagaatctgtcattgtgccagatacatttacctgtagctgcatttgtaagaaaggcaatggaaagataaaaccaagaagacattggtcaaaactgttaaggattcattgacaccttccacacagagatgaccgtgaaattttagctaacctttatcagaccatcctcttgagcacacactgaaacagagaagtcactgaaagatactggcgactgcataaggttttctgtacctgacaattcaaattattgactgatgtcaaatacacaaggattttaagaacatacacagtttcaaggaattgataagaagaaaagtcgtacattgcacctgaagcaaaccacaatctttatggttggttctgcaagagaaattatataagcaattccaaaggattaactcattaccattatgcactggacatcaactccatgatacgttgtagcataatagaaatagattaggcaacaatcactattttcgtcattacaaatcatccctaactatagttttgaggtaaaaagaactgtgtataccaatagaaaaagtagaaggcaccaaaaacaacctaccgttgtgaaggttgtgtgtttaacaacattgaacaagctacagatggtagcctatgaggaaattggcattcaagtggcatacccctggcacacatttgattggttatctgcaggacaaactgcattttcagaccgaatttctcaagggaagagctaaataaggaaaagtaatactacgagacgaaaagttagatgatgcaaggctaaattcagtaatcttctcaaacaaagtgccatacataatgaatttgcaacaacatttgactttctgaagtcggaacatgttttagactcatataagcctttcactagagctcaataaaatgatatcagtaccgctctccgaatttgattgtacataccaaaatctctgaaactcagaactcagttaaagtcctccttgagtcattgtacacacgatcccacgagcaaaatgatcactgaaaagtgaagactgaaccctaattttcttcccaaatccgagaagaaacaggcagcaaagtgcccacccaaaactagactttagctgtggaccagaccaagatatggccaaaatatcttagcctaatctgaactattctagcataactgcccagaaagtgttactgcaaccgagattatccttgcaagttgcaaccacgcagagaagtgaagcgtccgattaagggagttgcttaccttgaagctggggctaacgagggccatggtcgcagttctagcaagggagctcccgacgggagtggataactccattgagctccgcctcggaggtcgcaggctcgcagcagcagcggtagccgcaaactcccagctcccctggtccccactcctagctctgaggggatcggacggttgacctgatgttgtctcgcttcttaatccatcctagccgttggttttcatatactagcccacgagacccagcccagccggcttggatctcaacccataggtggcgctctcctcttcggcttcggttgcaagaaagaaaaaggtcacctcttaacaccaggccgccgccattgctgctccctttgttcgtttctcggcaccctcgatcccgagcgcggttaacccacgcatcgaccggcgaacgccaccgtctcccatcgagatctctcccatctagaatacctccgtgctcagcgtcatggacggcttctccaaaacgatcggcggcagtggccctaacgttccggcgggatcccaccccgcgggcgggagccaggcggcggcagggggaggcgcgacgcagcggacgcagtaagtctgtcgtcttatgttgtggttcagatcgcgacttctcctttgggtgaagatttcggtgcttccggtcgcggttcagatcgcggttctgcgttactttgccccactttcttcgggctaagatttgagcaaattttgcggtggactgttagttgtttagggtgatttaacacggatagtaaaattctcatcttccatcgggtagggtttttttgccccccgcgatgaaacctttttgcgaaaaaaaataggtttttgttcattgggtccgcgtgggctgttagggattaaggttaatggttcaattgtactgtccctaacgtgggctgctagggattaaggttaataattcaattgtcagccgggatgcttcgatgttgtttagcttgtggggattacacgttattgtgcatatggttgagtagtggcatttaacactagttacgaaataggtcggaataaaattggaagacccatggggtttttaagtgggtgtgaccattagtttccccccattttcctgtctccaggtattgatccagtgtatgaattggcaaacaagagctactgttatgacaataacatcatttaaattagaattgaacttaatttacttggtctgtatgcttttacggaaagtgtacaaccagatttttaccgtatgctatgtccgaagtgtacaaccggagtgtagtctttgtctacctttgtgttggcctctctgctaaagcaacatggaattgtttgcttgattttttttttcaggatggtttccaagcttcttgtagtgtggcacttctattcaactcatctatagttctattattttgatgctttcacttttgataagtttatcggttcacatgatttcctcctgtcattgtctcacatcaacaggtatccgtatgtgactggtacttcagtcattgccttgaaatacaaggatggtgtgatcatggcatgtgacactggaggttggtcccagttcctctgcacagatagtatgccaaatactacgatggtgtgatcctggcatgtgacactggagcctcttatggatcaactttgagatacaagagtgtggaacgcattaaggcagttggcaagcatagcatcattggagcaagcggagagttcagtgacttccaggagattttgcgctatttggatgaactaactctgtctgatcatatgtgggatgatggaaactcgctgggccccaaagagatccacagctatttgacaagagtgatgtacaaccggcgcaacaagtttgatcctctctggaactcacttgtacttggtggggtgaaaaagggtccaaagggtgatgagaagtatcttgggatggttaacatgattggtacccacttcgaggaaaaccatgtcgctactggatttggaaatcatatggcaatcccgatactccgtgctgaatggcgcgatgatatgacttttgaagaagctgttaagctggttgagaagtgcttggtggtcttgctgtaccgagacagatcatctatcaacaaattccagattgccaagatcacaagtgaaggatcaaccatctacccaccatattccttgaagacctactggggcttcactcacttcgaaaacccagcccagggcgctgtgggatcatggtagatttatgctctgcatgccgcgtatcatgccatgaacttaggggagagcaatctgtgctgctgaaatcaaaacccttgtgaacgtttgttctgaacataactggaactctgcatttgcttgtatgacatgcgtatggttcaggaagtttaattccaatatttggtcactaaaaaaaaattgtgcggttgtgttctcagaaaaaaaaaaaaaaaaaaaaaaaaaaaaaaaaaaaaaaaaaaaaagg

(The sequence listing continues in the following parts.)

We claim:

1. A polynucleotide molecule comprising a sequence selected from the group consisting of:
    (a) nucleotides 1553 through 2280 of SEQ ID NO: 17666;
    (b) a nucleic acid fragment that comprises at least 95 contiguous nucleotides of nucleotides 1553 through 2280 of SEQ ID NO:17666 having promoter activity; and
    (c) a nucleic acid sequence comprising at least 95% identity to nucleotides 1553 through 2280 of SEQ ID NO:17666 having promoter activity,
    wherein said polynucleotide molecule is operably linked to a heterologous transcribable polynucleotide molecule.

2. The polynucleotide molecule of claim 1, wherein said molecule comprises a nucleic acid fragment that comprises at least 95 contiguous nucleotides of nucleotides 1553 through 2280 of SEQ ID NO:17666.

3. The polynucleotide molecule of claim 1, wherein said molecule comprises a nucleic acid fragment that comprises at least 150 contiguous nucleotides of nucleotides 1553 through 2280 of SEQ ID NO:17666.

4. The polynucleotide molecule of claim 1, wherein said molecule comprises a nucleic acid sequence comprising at least 98% identity to of nucleotides 1553 through 2280 of SEQ ID NO:17666.

5. The polynucleotide molecule of claim 1, further comprising a leader sequence comprising group nucleotides 2281 through 2325 of SEQ ID NO:17666.

6. The polynucleotide molecule of claim 1, wherein said heterologous transcribable polynucleotide molecule is a gene of agronomic interest.

7. The polynucleotide molecule of claim 6, wherein said gene of agronomic interest is selected from the group consisting of: an herbicide tolerance gene, a gene conferring tolerance to a stress condition, a gene conferring resistance to a pest, a gene conferring resistance to a disease, a gene impacting crop yield, a gene involved in plant growth or development.

8. A transgenic plant cell stably transformed with the polynucleotide molecule of claim 1.

9. A transgenic plant stably transformed with the polynucleotide molecule of claim 1.

10. A seed of said transgenic plant of claim 9, wherein the seed comprises said polynucleotide molecule.

11. The transgenic plant cell of claim 8, wherein said plant cell is from a monocotyledonous plant.

12. The transgenic plant of claim 9, wherein said plant is a monocotyledonous plant.

13. The seed of the transgenic plant of claim 12, wherein the seed comprises said polynucleotide molecule.

14. The transgenic plant cell of claim 8, wherein said plant cell is from a dicotyledonous plant.

15. The transgenic plant of claim 9, wherein said plant is a dicotyledonous plant.

16. The seed of the transgenic plant of claim 15, wherein the seed comprises said polynucleotide molecule.

17. A progeny of the transgenic plant of claim 9, wherein said progeny has inherited said polynucleotide molecule.

18. A method of inhibiting weed growth in a field of transgenic herbicide tolerant crop plants comprising:
   (a) planting transgenic plants transformed with an expression cassette comprising a polynucleotide molecule of claim 1, wherein said heterologous transcribable polynucleotide encodes a herbicide tolerance gene; and
   (b) applying herbicide to the field at an application rate that inhibits the growth of weeds, wherein the growth and yield of the transgenic crop plants is not substantially affected by the herbicide application,
   wherein said herbicide is selected from the group consisting of: glyphosate, glufosinate, sulfonylureas, imidazolinones, bromoxynil, delapon, dicamba, cyclohezanedione, protoporphyrionogen oxidase inhibitors, and isoxasfiutole herbicides.

19. A method of providing pest control in a field of transgenic crop plants comprising planting transgenic plants transformed with an expression cassette comprising the polynucleotide molecule of claim 1, wherein the heterologous transcribable polynucleotide encodes a gene conferring pest resistance.

20. A method of providing disease control in a field of transgenic crop plants comprising planting transgenic plants transformed with an expression cassette comprising the polynucleotide molecule of claim 1, wherein the heterologous transcribable polynucleotide encodes a gene conferring disease resistance.

21. A method of providing stress tolerance to plants in a field of transgenic crop plants comprising planting transgenic plants transformed with an expression cassette comprising the polynucleotide molecule of claim 1, wherein the heterologous transcribable polynucleotide encodes to a gene conferring stress tolerance.

22. A method of providing yield enhancement to plants in a field of transgenic crop plants comprising planting transgenic plants transformed with an expression cassette comprising the polynucleotide molecule of claim 1, wherein the heterologous transcribable polynucleotide encodes a gene conferring yield enhancement.

23. A method of transforming a host cell comprising:
   (a) providing a polynucleotide molecule of claim 1; and
   (b) transforming a cell with the nucleic acid molecule.

* * * * *

UNITED STATES PATENT AND TRADEMARK OFFICE
CERTIFICATE OF CORRECTION

Page 1 of 1

PATENT NO.       : 7,750,207 B2
APPLICATION NO.  : 11/514704
DATED            : July 6, 2010
INVENTOR(S)      : Wu et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 758 days.

Signed and Sealed this
Tenth Day of May, 2011

David J. Kappos
*Director of the United States Patent and Trademark Office*